United States Patent 8,541,208 (PROCESS FOR THE PRODUCTION OF FINE CHEMICALS) - sequence listing, part 16

SEQ ID NO: 86982 - DNA, 711 bp, Rickettsia akari str. Hartford; identical to SEQ ID NO: 58872
  CDS (1)..(711)

SEQ ID NO: 86983 - protein, 236 aa, Rickettsia akari str. Hartford; identical to SEQ ID NO: 58873

SEQ ID NO: 86984 - DNA, 690 bp, Polaromonas sp. JS666; identical to SEQ ID NO: 58874
  CDS (1)..(690)

SEQ ID NO: 86985 - protein, 229 aa, Polaromonas sp. JS666; identical to SEQ ID NO: 58875

SEQ ID NO: 86986 - DNA, 702 bp, Campylobacter lari RM2100; identical to SEQ ID NO: 58876
  CDS (1)..(702): transl_table=11

SEQ ID NO: 86987 - protein, 233 aa, Campylobacter lari RM2100; identical to SEQ ID NO: 58877

SEQ ID NO: 86988 - DNA, 633 bp, Cowpox virus; identical to SEQ ID NO: 58878
  CDS (1)..(633)

SEQ ID NO: 86989 - protein, 210 aa, Cowpox virus; identical to SEQ ID NO: 58879

SEQ ID NO: 86990 - DNA, 711 bp, Brachydanio rerio; identical to SEQ ID NO: 58880
  CDS (1)..(711)

SEQ ID NO: 86991 - protein, 236 aa, Brachydanio rerio; identical to SEQ ID NO: 58881

SEQ ID NO: 86992 - DNA, 1008 bp, Xenopus laevis; identical to SEQ ID NO: 58882
  CDS (1)..(1008)

SEQ ID NO: 86993 - protein, 335 aa, Xenopus laevis; identical to SEQ ID NO: 58883

SEQ ID NO: 86994 - DNA, 795 bp, Oryza sativa; identical to SEQ ID NO: 58884
  CDS (1)..(795)

SEQ ID NO: 86995 - protein, 264 aa, Oryza sativa; identical to SEQ ID NO: 58885

SEQ ID NO: 86996 - DNA, 714 bp, Xenopus laevis; identical to SEQ ID NO: 58886
  CDS (1)..(714)

SEQ ID NO: 86997 - protein, 237 aa, Xenopus laevis; identical to SEQ ID NO: 58887

SEQ ID NO: 86998 - DNA, 726 bp, Oryza sativa; identical to SEQ ID NO: 58888
  CDS (1)..(726)

SEQ ID NO: 86999 - protein, 241 aa, Oryza sativa; identical to SEQ ID NO: 58889

SEQ ID NO: 87000 - DNA, 747 bp, Chlamydomonas reinhardtii; identical to SEQ ID NO: 58890
  CDS (1)..(747)

SEQ ID NO: 87001 - protein, 248 aa, Chlamydomonas reinhardtii; identical to SEQ ID NO: 58891

SEQ ID NO: 87002 - DNA, 747 bp, Lycopersicon esculentum; identical to SEQ ID NO: 58892
  CDS (1)..(747)

SEQ ID NO: 87003 - protein, 248 aa, Lycopersicon esculentum; identical to SEQ ID NO: 58893

SEQ ID NO: 87004 - DNA, 744 bp, Brassica oleracea; identical to SEQ ID NO: 58894
  CDS (1)..(744)

SEQ ID NO: 87005 - protein, 247 aa, Brassica oleracea; identical to SEQ ID NO: 58895

SEQ ID NO: 87006 - DNA, 741 bp, Cryptosporidium parvum; identical to SEQ ID NO: 58896
  CDS (1)..(741)

SEQ ID NO: 87007 - protein, 246 aa, Cryptosporidium parvum; identical to SEQ ID NO: 58897

SEQ ID NO: 87008 - DNA, 714 bp, Xenopus laevis; identical to SEQ ID NO: 58898
  CDS (1)..(714)

SEQ ID NO: 87009 - protein, 237 aa, Xenopus laevis; identical to SEQ ID NO: 58899

SEQ ID NO: 87010 - DNA, 660 bp, Schistosoma japonicum; identical to SEQ ID NO: 58900
  CDS (1)..(660)

SEQ ID NO: 87011 - protein, 219 aa, Schistosoma japonicum; identical to SEQ ID NO: 58901

SEQ ID NO: 87012 - DNA, 744 bp, Arabidopsis thaliana; identical to SEQ ID NO: 58902
  CDS (1)..(744)

SEQ ID NO: 87013 - protein, 247 aa, Arabidopsis thaliana; identical to SEQ ID NO: 58903

SEQ ID NO: 87014 - DNA, 714 bp, Camelpox virus; identical to SEQ ID NO: 58904
  CDS (1)..(714)

SEQ ID NO: 87015 - protein, 237 aa, Camelpox virus; identical to SEQ ID NO: 58905

SEQ ID NO: 87016 - DNA, 741 bp, Brassica oleracea; identical to SEQ ID NO: 58906
  CDS (1)..(741)

SEQ ID NO: 87017 - protein, 246 aa, Brassica oleracea; identical to SEQ ID NO: 58907

SEQ ID NO: 87018 - DNA, 750 bp, Nicotiana tabacum; identical to SEQ ID NO: 58908
  CDS (1)..(750)

SEQ ID NO: 87019 - protein, 249 aa, Nicotiana tabacum; identical to SEQ ID NO: 58909

SEQ ID NO: 87020 - DNA, 744 bp, Hordeum vulgare; identical to SEQ ID NO: 58910
  CDS (1)..(744)

SEQ ID NO: 87021 - protein, 247 aa, Hordeum vulgare; identical to SEQ ID NO: 58911

SEQ ID NO: 87022 - DNA, 744 bp, Arabidopsis thaliana; identical to SEQ ID NO: 58912
  CDS (1)..(744)

SEQ ID NO: 87023 - protein, 247 aa, Arabidopsis thaliana; identical to SEQ ID NO: 58913

SEQ ID NO: 87024 - DNA, 750 bp, Oryza sativa; identical to SEQ ID NO: 58914
  CDS (1)..(750)

SEQ ID NO: 87025 - protein, 249 aa, Oryza sativa; identical to SEQ ID NO: 58915

SEQ ID NO: 87026 - DNA, 714 bp, Paralichthys olivaceus; identical to SEQ ID NO: 58916
  CDS (1)..(714): n means a or g or c or t/u

SEQ ID NO: 87027 - protein, 237 aa, Paralichthys olivaceus; identical to SEQ ID NO: 58917
  misc_feature (187)..(187): Xaa can be Cys or Phe or Ser or Tyr

SEQ ID NO: 87028 - DNA, 663 bp, Haemophilus influenzae; identical to SEQ ID NO: 58918
  CDS (1)..(663): transl_table=11

SEQ ID NO: 87029 - protein, 220 aa, Haemophilus influenzae; identical to SEQ ID NO: 58919

SEQ ID NO: 87030 - DNA, 672 bp, Vibrio cholerae; identical to SEQ ID NO: 58920
  CDS (1)..(672): transl_table=11

SEQ ID NO: 87031 - protein, 223 aa, Vibrio cholerae; identical to SEQ ID NO: 58921

SEQ ID NO: 87032 - DNA, 711 bp, Rickettsia prowazekii; identical to SEQ ID NO: 58922
  CDS (1)..(711): transl_table=11

SEQ ID NO: 87033 - protein, 236 aa, Rickettsia prowazekii; identical to SEQ ID NO: 58923

SEQ ID NO: 87034 - DNA, 696 bp, Campylobacter jejuni; identical to SEQ ID NO: 58924
  CDS (1)..(696): transl_table=11

SEQ ID NO: 87035 - protein, 231 aa, Campylobacter jejuni; identical to SEQ ID NO: 58925

SEQ ID NO: 87036 - DNA, 669 bp, Pseudomonas aeruginosa; identical to SEQ ID NO: 58926
  CDS (1)..(669): transl_table=11

SEQ ID NO: 87037 - protein, 222 aa, Pseudomonas aeruginosa; identical to SEQ ID NO: 58927

SEQ ID NO: 87038 - DNA, 663 bp, Pasteurella multocida; identical to SEQ ID NO: 58928
  CDS (1)..(663): transl_table=11

SEQ ID NO: 87039 - protein, 220 aa, Pasteurella multocida; identical to SEQ ID NO: 58929

SEQ ID NO: 87040 - DNA, 699 bp, Borrelia burgdorferi; identical to SEQ ID NO: 58930
  CDS (1)..(699): transl_table=11

SEQ ID NO: 87041 - protein, 232 aa, Borrelia burgdorferi; identical to SEQ ID NO: 58931

SEQ ID NO: 87042 - DNA, 696 bp, Deinococcus radiodurans; identical to SEQ ID NO: 58932
  CDS (1)..(696): transl_table=11

SEQ ID NO: 87043 - protein, 231 aa, Deinococcus radiodurans; identical to SEQ ID NO: 58933

SEQ ID NO: 87044 - DNA, 693 bp, Helicobacter pylori J99; identical to SEQ ID NO: 58934
  CDS (1)..(693): transl_table=11

SEQ ID NO: 87045 - protein, 230 aa, Helicobacter pylori J99; identical to SEQ ID NO: 58935

SEQ ID NO: 87046 - DNA, 705 bp, Escherichia coli; identical to SEQ ID NO: 58936
  CDS (1)..(705): transl_table=11

SEQ ID NO: 87047 - protein, 234 aa, Escherichia coli; identical to SEQ ID NO: 58937

SEQ ID NO: 87048 - DNA, 705 bp, Lactococcus lactis; identical to SEQ ID NO: 58938
  CDS (1)..(705)

SEQ ID NO: 87049 - protein, 234 aa, Lactococcus lactis; identical to SEQ ID NO: 58939

SEQ ID NO: 87050 - DNA, 809 bp, Mus musculus; identical to SEQ ID NO: 58940
  CDS (22)..(738)

SEQ ID NO: 87051 - protein, 238 aa, Mus musculus; identical to SEQ ID NO: 58941

SEQ ID NO: 87052 - DNA, 25 bp, Primer
atggatcgtattgttagttcttcac

SEQ ID NO: 87053 - DNA, 22 bp, Primer
ttaatcgcggctagcgaagccc

SEQ ID NO: 87054 - protein, 228 aa, consensus; identical to SEQ ID NO: 58944
  MISC_FEATURE (1)..(228): consensus for the disclosure of xaa see table XV

SEQ ID NO: 87055 - DNA, 1614 bp, Escherichia coli; identical to SEQ ID NO: 38469
  CDS (130)..(1503)

SEQ ID NO: 87056 - protein, 457 aa, Escherichia coli; identical to SEQ ID NO: 38470

SEQ ID NO: 87057 - DNA, 1221 bp, Thermococcus kodakaraensis; identical to SEQ ID NO: 38471
  CDS (1)..(1221)

SEQ ID NO: 87058 - protein, 406 aa, Thermococcus kodakaraensis; identical to SEQ ID NO: 38472

SEQ ID NO: 87059 - DNA, 1530 bp, Staphylococcus epidermidis RP62A; identical to SEQ ID NO: 38473
  CDS (1)..(1530)

SEQ ID NO: 87060 - protein, 509 aa, Staphylococcus epidermidis RP62A; identical to SEQ ID NO: 38474

SEQ ID NO: 87061 - DNA, 1452 bp, Homo sapiens; identical to SEQ ID NO: 38475
  CDS (1)..(1452)

SEQ ID NO: 87062 - protein, 483 aa, Homo sapiens; identical to SEQ ID NO: 38476

SEQ ID NO: 87063 - DNA, 1107 bp, Archaeoglobus fulgidus DSM 4304; identical to SEQ ID NO: 38477
  CDS (1)..(1107): transl_table=11

SEQ ID NO: 87064 - protein, 368 aa, Archaeoglobus fulgidus DSM 4304; identical to SEQ ID NO: 38478

SEQ ID NO: 87065 - DNA, 1131 bp, Thermoplasma volcanium GSS1; identical to SEQ ID NO: 38479
  CDS (1)..(1131): transl_table=11

SEQ ID NO: 87066 - protein, 376 aa, Thermoplasma volcanium GSS1; identical to SEQ ID NO: 38480

SEQ ID NO: 87067 - DNA, 1506 bp, Arabidopsis thaliana; identical to SEQ ID NO: 38481
  CDS (1)..(1506)

SEQ ID NO: 87068 - protein, 501 aa, Arabidopsis thaliana; identical to SEQ ID NO: 38482

SEQ ID NO: 87069 - DNA, 1833 bp, Arabidopsis thaliana; identical to SEQ ID NO: 38483
  CDS (1)..(1833)

SEQ ID NO: 87070 - protein, 610 aa, Arabidopsis thaliana; identical to SEQ ID NO: 38484

SEQ ID NO: 87071 - DNA, 1851 bp, Arabidopsis thaliana; identical to SEQ ID NO: 38485
  CDS (1)..(1851)

SEQ ID NO: 87072 - protein, 616 aa, Arabidopsis thaliana [sequence omitted]

SEQ ID NO: 87073 - DNA, 1497 bp, Arabidopsis thaliana; identical to SEQ ID NO: 38487
  CDS (1)..(1497)

SEQ ID NO: 87074 - protein, 498 aa, Arabidopsis thaliana; identical to SEQ ID NO: 38488

SEQ ID NO: 87075 - DNA, 2370 bp, Arabidopsis thaliana; identical to SEQ ID NO: 38489
  CDS (1)..(2370)

SEQ ID NO: 87076 - protein, 789 aa, Arabidopsis thaliana; identical to SEQ ID NO: 38490

SEQ ID NO: 87077 - DNA, 2142 bp, Arabidopsis thaliana; identical to SEQ ID NO: 38491
  CDS (1)..(2142)

SEQ ID NO: 87078 - protein, 713 aa, Arabidopsis thaliana; identical to SEQ ID NO: 38492

SEQ ID NO: 87079 - DNA, 1479 bp, Helicobacter pylori 26695; identical to SEQ ID NO: 38493
  CDS (1)..(1479): transl_table=11

SEQ ID NO: 87080 - protein, 492 aa, Helicobacter pylori 26695; identical to SEQ ID NO: 38494

SEQ ID NO: 87081 - DNA, 1950 bp, Treponema pallidum subsp. pallidum str. Nichols; identical to SEQ ID NO: 38495
  CDS (1)..(1950): transl_table=11

SEQ ID NO: 87082 - protein, 649 aa, Treponema pallidum subsp. pallidum str. Nichols; identical to SEQ ID NO: 38496

SEQ ID NO: 87083 - DNA, 1476 bp, Helicobacter pylori J99; identical to SEQ ID NO: 38497
  CDS (1)..(1476): transl_table=11

SEQ ID NO: 87084 - protein, 491 aa, Helicobacter pylori J99; identical to SEQ ID NO: 38498

SEQ ID NO: 87085 - DNA, 1833 bp, Pasteurella multocida subsp. multocida str. Pm70; identical to SEQ ID NO: 38499
  CDS (1)..(1833): transl_table=11

SEQ ID NO: 87086 - protein, 610 aa, Pasteurella multocida subsp. multocida str. Pm70; identical to SEQ ID NO: 38500

SEQ ID NO: 87087 - DNA, 1389 bp, Neisseria meningitidis MC58; identical to SEQ ID NO: 38501
  CDS (1)..(1389): transl_table=11

SEQ ID NO: 87088 - protein, 462 aa, Neisseria meningitidis MC58; identical to SEQ ID NO: 38502

SEQ ID NO: 87089 - DNA, 1278 bp, Methanothermobacter thermautotrophicus str. Delta H; identical to SEQ ID NO: 38503
  CDS (1)..(1278): transl_table=11

SEQ ID NO: 87090 - protein, 425 aa, Methanothermobacter thermautotrophicus str. Delta H; identical to SEQ ID NO: 38504

SEQ ID NO: 87091 - DNA, 1446 bp, Clostridium acetobutylicum ATCC 824; identical to SEQ ID NO: 38505
  CDS (1)..(1446): transl_table=11

SEQ ID NO: 87092 - protein, 481 aa, Clostridium acetobutylicum ATCC 824; identical to SEQ ID NO: 38506

SEQ ID NO: 87093 - DNA, 1167 bp, Thermoplasma acidophilum DSM 1728; identical to SEQ ID NO: 38507
  CDS (1)..(1167): transl_table=11

SEQ ID NO: 87094 - protein, 388 aa, Thermoplasma acidophilum DSM 1728; identical to SEQ ID NO: 38508

SEQ ID NO: 87095 - DNA, 1941 bp, Escherichia coli K12; identical to SEQ ID NO: 38509
  CDS (1)..(1941): transl_table=11

SEQ ID NO: 87096 - protein, 646 aa, Escherichia coli K12; identical to SEQ ID NO: 38510

SEQ ID NO: 87097 - DNA, 1554 bp, Caulobacter crescentus CB15; identical to SEQ ID NO: 38511
  CDS (1)..(1554): transl_table=11

SEQ ID NO: 87098 - protein, 517 aa, Caulobacter crescentus CB15; identical to SEQ ID NO: 38512

SEQ ID NO: 87099 - DNA, 1512 bp, Sinorhizobium meliloti 1021; identical to SEQ ID NO: 38513
  CDS (1)..(1512): transl_table=11

SEQ ID NO: 87100 - protein, 503 aa, Sinorhizobium meliloti 1021; identical to SEQ ID NO: 38514

SEQ ID NO: 87101 - DNA, 1479 bp, Synechocystis sp. PCC 6803; identical to SEQ ID NO: 38515
  CDS (1)..(1479): transl_table=11

SEQ ID NO: 87102 - protein, 492 aa, Synechocystis sp. PCC 6803; identical to SEQ ID NO: 38516

SEQ ID NO: 87103 - DNA, 1374 bp, Salmonella typhimurium LT2; identical to SEQ ID NO: 38517
  CDS (1)..(1374): transl_table=11

SEQ ID NO: 87104 - protein, 457 aa, Salmonella typhimurium LT2; identical to SEQ ID NO: 38518

SEQ ID NO: 87105 - DNA, 1890 bp, Salmonella typhimurium LT2; identical to SEQ ID NO: 38519
  CDS (1)..(1890): transl_table=11

SEQ ID NO: 87106 - protein, 629 aa, Salmonella typhimurium LT2; identical to SEQ ID NO: 38520

SEQ ID NO: 87107 - DNA, 1563 bp, Listeria monocytogenes EGD-e; identical to SEQ ID NO: 38521
  CDS (1)..(1563): transl_table=11

SEQ ID NO: 87108 - protein, 520 aa, Listeria monocytogenes EGD-e; identical to SEQ ID NO: 38522

SEQ ID NO: 87109 - DNA, 1542 bp, Nostoc sp. PCC 7120; identical to SEQ ID NO: 38523
  CDS (1)..(1542): transl_table=11

SEQ ID NO: 87110 - protein, 513 aa, Nostoc sp. PCC 7120; identical to SEQ ID NO: 38524

SEQ ID NO: 87111 - DNA, 1281 bp, Nostoc sp. PCC 7120; identical to SEQ ID NO: 38525
  CDS (1)..(1281): transl_table=11

SEQ ID NO: 87112 - protein, 426 aa, Nostoc sp. PCC 7120; identical to SEQ ID NO: 38526

SEQ ID NO: 87113 - DNA, 1200 bp, Caenorhabditis elegans; identical to SEQ ID NO: 38527
  CDS (1)..(1200)

SEQ ID NO: 87114 - protein, 399 aa, Caenorhabditis elegans; identical to SEQ ID NO: 38528

SEQ ID NO: 87115 - DNA, 1398 bp, Ralstonia solanacearum GMI1000; identical to SEQ ID NO: 38529
  CDS (1)..(1398): transl_table=11

SEQ ID NO: 87116 - protein, 465 aa, Ralstonia solanacearum GMI1000; identical to SEQ ID NO: 38530

SEQ ID NO: 87117 - DNA, 1509 bp, Agrobacterium tumefaciens str. C58; identical to SEQ ID NO: 38531
  CDS (1)..(1509): transl_table=11

SEQ ID NO: 87118 - protein, 502 aa, Agrobacterium tumefaciens str. C58; identical to SEQ ID NO: 38532

SEQ ID NO: 87119 - DNA, 1608 bp, Brucella melitensis 16M; identical to SEQ ID NO: 38533
  CDS (1)..(1608): transl_table=11

SEQ ID NO: 87120 - protein, 535 aa, Brucella melitensis 16M; identical to SEQ ID NO: 38534

SEQ ID NO: 87121 - DNA, 1437 bp, Clostridium perfringens str. 13; identical to SEQ ID NO: 38535
  CDS (1)..(1437): transl_table=11

SEQ ID NO: 87122 - protein, 478 aa, Clostridium perfringens str. 13; identical to SEQ ID NO: 38536

SEQ ID NO: 87123 - DNA, 1587 bp, Clostridium perfringens str. 13; identical to SEQ ID NO: 38537
  CDS (1)..(1587): transl_table=11

SEQ ID NO: 87124 - protein, 528 aa, Clostridium perfringens str. 13; identical to SEQ ID NO: 38538

SEQ ID NO: 87125 - DNA, 1989 bp, Schizosaccharomyces pombe; identical to SEQ ID NO: 38539
  CDS (1)..(1989)

SEQ ID NO: 87126 - protein, 662 aa, Schizosaccharomyces pombe; identical to SEQ ID NO: 38540

SEQ ID NO: 87127 - DNA, 1398 bp, Schizosaccharomyces pombe; identical to SEQ ID NO: 38541
  CDS (1)..(1398)

SEQ ID NO: 87128 - protein, 465 aa, Schizosaccharomyces pombe; identical to SEQ ID NO: 38542

SEQ ID NO: 87129 - DNA, 1362 bp, Schizosaccharomyces pombe; identical to SEQ ID NO: 38543
  CDS (1)..(1362)

SEQ ID NO: 87130 - protein, 453 aa, Schizosaccharomyces pombe; identical to SEQ ID NO: 38544

SEQ ID NO: 87131 - DNA, 1275 bp, Corynebacterium glutamicum ATCC 13032; identical to SEQ ID NO: 38545
  CDS (1)..(1275): transl_table=11

SEQ ID NO: 87132 - protein, 424 aa, Corynebacterium glutamicum ATCC 13032; identical to SEQ ID NO: 38546

SEQ ID NO: 87133 - DNA, 2199 bp, Corynebacterium glutamicum ATCC 13032; identical to SEQ ID NO: 38547
  CDS (1)..(2199): transl_table=11

SEQ ID NO: 87134 - protein, 732 aa, Corynebacterium glutamicum ATCC 13032; identical to SEQ ID NO: 38548

SEQ ID NO: 87135 - DNA, 1668 bp, Methanosarcina acetivorans C2A; identical to SEQ ID NO: 38549
  CDS (1)..(1668): transl_table=11

SEQ ID NO: 87136 - protein, 555 aa, Methanosarcina acetivorans C2A; identical to SEQ ID NO: 38550

SEQ ID NO: 87137 - DNA, 1764 bp, Methanosarcina mazei Go1; identical to SEQ ID NO: 38551
  CDS (1)..(1764): transl_table=11

SEQ ID NO: 87138 - protein, 587 aa, Methanosarcina mazei Go1; identical to SEQ ID NO: 38552

SEQ ID NO: 87139 - DNA, 1290 bp, Methanosarcina mazei Go1; identical to SEQ ID NO: 38553
  CDS (1)..(1290): transl_table=11

SEQ ID NO: 87140 - protein, 429 aa, Methanosarcina mazei Go1; identical to SEQ ID NO: 38554

SEQ ID NO: 87141 - DNA, 1293 bp, Xanthomonas campestris pv. campestris str. ATCC 33913; identical to SEQ ID NO: 38555
  CDS (1)..(1293): transl_table=11

SEQ ID NO: 87142 - protein, 430 aa, Xanthomonas campestris pv. campestris str. ATCC 33913; identical to SEQ ID NO: 38556

SEQ ID NO: 87143 - DNA, 1377 bp, Xanthomonas campestris pv. campestris str. ATCC 33913; identical to SEQ ID NO: 38557
  CDS (1)..(1377): transl_table=11

SEQ ID NO: 87144 - protein, 458 aa, Xanthomonas campestris pv. campestris str. ATCC 33913; identical to SEQ ID NO: 38558

SEQ ID NO: 87145 - DNA, 1293 bp, Xanthomonas axonopodis pv. citri str. 306; identical to SEQ ID NO: 38559
  CDS (1)..(1293): transl_table=11

SEQ ID NO: 87146 - protein, 430 aa, Xanthomonas axonopodis pv. citri str. 306; identical to SEQ ID NO: 38560

SEQ ID NO: 87147 - DNA, 1974 bp, Chlorobium tepidum TLS; identical to SEQ ID NO: 38561
  CDS (1)..(1974): transl_table=11

SEQ ID NO: 87148 - protein, 657 aa, Chlorobium tepidum TLS; identical to SEQ ID NO: 38562

SEQ ID NO: 87149 - DNA, 1245 bp, Chlorobium tepidum TLS; identical to SEQ ID NO: 38563
  CDS (1)..(1245): transl_table=11

SEQ ID NO: 87150 - protein, 414 aa, Chlorobium tepidum TLS; identical to SEQ ID NO: 38564

SEQ ID NO: 87151 - DNA, 1488 bp, Oceanobacillus iheyensis HTE831; identical to SEQ ID NO: 38565
  CDS (1)..(1488): transl_table=11

SEQ ID NO: 87152 - protein, 495 aa, Oceanobacillus iheyensis HTE831; identical to SEQ ID NO: 38566

SEQ ID NO: 87153 - DNA, 1566 bp, Leptospira interrogans serovar Lai str. 56601; identical to SEQ ID NO: 38567
  CDS (1)..(1566): transl_table=11

SEQ ID NO: 87154 - protein, 521 aa, Leptospira interrogans serovar Lai str. 56601; identical to SEQ ID NO: 38568

SEQ ID NO: 87155 - DNA, 1377 bp, Shewanella oneidensis MR-1; identical to SEQ ID NO: 38569
  CDS (1)..(1377): transl_table=11

SEQ ID NO: 87156 - protein, 458 aa, Shewanella oneidensis MR-1; identical to SEQ ID NO: 38570

SEQ ID NO: 87157 - DNA, 1302 bp, Shewanella oneidensis MR-1; identical to SEQ ID NO: 38571
  CDS (1)..(1302): transl_table=11

SEQ ID NO: 87158 - protein, 433 aa, Shewanella oneidensis MR-1; identical to SEQ ID NO: 38572

SEQ ID NO: 87159 - DNA, 1284 bp, Shewanella oneidensis MR-1; identical to SEQ ID NO: 38573
  CDS (1)..(1284): transl_table=11

SEQ ID NO: 87160 - protein, 427 aa, Shewanella oneidensis MR-1; identical to SEQ ID NO: 38574

SEQ ID NO: 87161 - DNA, 1230 bp, Shewanella oneidensis MR-1; identical to SEQ ID NO: 38575
  CDS (1)..(1230): transl_table=11

SEQ ID NO: 87162 - protein, 409 aa, Shewanella oneidensis MR-1; identical to SEQ ID NO: 38576

SEQ ID NO: 87163 - DNA, 1608 bp, Shewanella oneidensis MR-1; identical to SEQ ID NO: 38577
  CDS (1)..(1608): transl_table=11

SEQ ID NO: 87164 - protein, 535 aa, Shewanella oneidensis MR-1; identical to SEQ ID NO: 38578

SEQ ID NO: 87165 - DNA, 1872 bp, Shewanella oneidensis MR-1; identical to SEQ ID NO: 38579
  CDS (1)..(1872): transl_table=11

SEQ ID NO: 87166 - protein, 623 aa, Shewanella oneidensis MR-1; identical to SEQ ID NO: 38580

SEQ ID NO: 87167 - DNA, 1554 bp, Streptococcus mutans UA159; identical to SEQ ID NO: 38581
  CDS (1)..(1554): transl_table=11

SEQ ID NO: 87168 - protein, 517 aa, Streptococcus mutans UA159; identical to SEQ ID NO: 38582

SEQ ID NO: 87169 - DNA, 1446 bp, Clostridium tetani E88; identical to SEQ ID NO: 38583
  CDS (1)..(1446): transl_table=11

SEQ ID NO: 87170 - protein, 481 aa, Clostridium tetani E88; identical to SEQ ID NO: 38584

SEQ ID NO: 87171 - DNA, 1575 bp, Clostridium tetani E88; identical to SEQ ID NO: 38585
  CDS (1)..(1575): transl_table=11

SEQ ID NO: 87172 - protein, 524 aa, Clostridium tetani E88; identical to SEQ ID NO: 38586

SEQ ID NO: 87173 - DNA, 1113 bp, Clostridium tetani E88; identical to SEQ ID NO: 38587
  CDS (1)..(1113): transl_table=11

SEQ ID NO: 87174 - protein, 370 aa, Clostridium tetani E88; identical to SEQ ID NO: 38588

SEQ ID NO: 87175 - DNA, 1587 bp, Lactobacillus plantarum WCFS1; identical to SEQ ID NO: 38589
  CDS (1)..(1587): transl_table=11

SEQ ID NO: 87176 - protein, 528 aa, Lactobacillus plantarum WCFS1; identical to SEQ ID NO: 38590

SEQ ID NO: 87177 - DNA, 1380 bp, Vibrio parahaemolyticus RIMD 2210633; identical to SEQ ID NO: 38591
  CDS (1)..(1380): transl_table=11

SEQ ID NO: 87178 - protein, 459 aa, Vibrio parahaemolyticus RIMD 2210633; identical to SEQ ID NO: 38592

SEQ ID NO: 87179 - DNA, 1932 bp, Vibrio parahaemolyticus RIMD 2210633; identical to SEQ ID NO: 38593
  CDS (1)..(1932): transl_table=11

SEQ ID NO: 87180 - protein, 643 aa, Vibrio parahaemolyticus RIMD 2210633; identical to SEQ ID NO: 38594

SEQ ID NO: 87181 - DNA, 1125 bp, Bacteroides thetaiotaomicron VPI-5482; identical to SEQ ID NO: 38595
  CDS (1)..(1125): transl_table=11

SEQ ID NO: 87182 - protein, 374 aa, Bacteroides thetaiotaomicron VPI-5482; identical to SEQ ID NO: 38596

SEQ ID NO: 87183 - DNA, 1944 bp, Bacteroides thetaiotaomicron VPI-5482; identical to SEQ ID NO: 38597
  CDS (1)..(1944): transl_table=11

SEQ ID NO: 87184 - protein, 647 aa, Bacteroides thetaiotaomicron VPI-5482; identical to SEQ ID NO: 38598

SEQ ID NO: 87185 - DNA, 1611 bp, Enterococcus faecalis V583; identical to SEQ ID NO: 38599
  CDS (1)..(1611): transl_table=11

SEQ ID NO: 87186 - protein, 536 aa, Enterococcus faecalis V583; identical to SEQ ID NO: 38600

SEQ ID NO: 87187 - DNA, 1236 bp, Coxiella burnetii RSA 493; identical to SEQ ID NO: 38601
  CDS (1)..(1236): transl_table=11

SEQ ID NO: 87188 - protein, 411 aa, Coxiella burnetii RSA 493; identical to SEQ ID NO: 38602

SEQ ID NO: 87189 - DNA, 1545 bp, Bacillus cereus ATCC 14579; identical to SEQ ID NO: 38603
  CDS (1)..(1545): transl_table=11

SEQ ID NO: 87190 - protein, 514 aa, Bacillus cereus ATCC 14579; identical to SEQ ID NO: 38604

SEQ ID NO: 87191 - DNA, 1377 bp, Bacillus cereus ATCC 14579; identical to SEQ ID NO: 38605
  CDS (1)..(1377): transl_table=11

SEQ ID NO: 87192 - protein, 458 aa, Bacillus cereus ATCC 14579; identical to SEQ ID NO: 38606

SEQ ID NO: 87193 - DNA, 1446 bp, Bacillus cereus ATCC 14579; identical to SEQ ID NO: 38607
  CDS (1)..(1446): transl_table=11

SEQ ID NO: 87194 - protein, 481 aa, Bacillus cereus ATCC 14579; identical to SEQ ID NO: 38608

SEQ ID NO: 87195 - DNA, 1374 bp, Nitrosomonas europaea ATCC 19718; identical to SEQ ID NO: 38609
  CDS (1)..(1374): transl_table=11

SEQ ID NO: 87196 - protein, 457 aa, Nitrosomonas europaea ATCC 19718; identical to SEQ ID NO: 38610

SEQ ID NO: 87197 - DNA, 1860 bp, Arabidopsis thaliana; identical to SEQ ID NO: 38611
  CDS (1)..(1860)

SEQ ID NO: 87198 - protein, 619 aa, Arabidopsis thaliana; identical to SEQ ID NO: 38612

SEQ ID NO: 87199 - DNA, 1593 bp, Helicobacter hepaticus ATCC 51449; identical to SEQ ID NO: 38613
  CDS (1)..(1593): transl_table=11

SEQ ID NO: 87200 - protein, 530 aa, Helicobacter hepaticus ATCC 51449; identical to SEQ ID NO: 38614

SEQ ID NO: 87201 - DNA, 1359 bp, Rhodopirellula baltica SH 1; identical to SEQ ID NO: 38615
  CDS (1)..(1359): transl_table=11

SEQ ID NO: 87202 - protein, 452 aa, Rhodopirellula baltica SH 1; identical to SEQ ID NO: 38616

SEQ ID NO: 87203 - DNA, 2796 bp, Rhodopirellula baltica SH 1; identical to SEQ ID NO: 38617
  CDS (1)..(2796): transl_table=11

SEQ ID NO: 87204 - protein, 931 aa, Rhodopirellula baltica SH 1; identical to SEQ ID NO: 38618

SEQ ID NO: 87205 - DNA, 1752 bp, Wigglesworthia glossinidia endosymbiont of Glossina brevipalpis; identical to SEQ ID NO: 38619
  CDS (1)..(1752): transl_table=11

SEQ ID NO: 87206 - protein, 583 aa, Wigglesworthia glossinidia endosymbiont of Glossina brevipalpis; identical to SEQ ID NO: 38620

SEQ ID NO: 87207 - DNA, 1821 bp, Haemophilus ducreyi 35000HP; identical to SEQ ID NO: 38621
  CDS (1)..(1821): transl_table=11

SEQ ID NO: 87208 - protein, 606 aa, Haemophilus ducreyi 35000HP; identical to SEQ ID NO: 38622

SEQ ID NO: 87209 - DNA, 1812 bp, Prochlorococcus marinus subsp. marinus str. CCMP1375; identical to SEQ ID NO: 38623
  CDS (1)..(1812): transl_table=11

SEQ ID NO: 87210 - protein, 603 aa, Prochlorococcus marinus subsp. marinus str. CCMP1375; identical to SEQ ID NO: 38624

SEQ ID NO: 87211 - DNA, 1464 bp, Candidatus Blochmannia floridanus; identical to SEQ ID NO: 38625
  CDS (1)..(1464): transl_table=11

SEQ ID NO: 87212 - protein, 487 aa, Candidatus Blochmannia floridanus; identical to SEQ ID NO: 38626

SEQ ID NO: 87213 - DNA, 1725 bp, Bordetella pertussis Tohama I; identical to SEQ ID NO: 38627
  CDS (1)..(1725): transl_table=11

SEQ ID NO: 87214 - protein, 574 aa, Bordetella pertussis Tohama I; identical to SEQ ID NO: 38628

SEQ ID NO: 87215 - DNA, 1389 bp, Bordetella bronchiseptica RB50; identical to SEQ ID NO: 38629
  CDS (1)..(1389): transl_table=11

SEQ ID NO: 87216 - protein, 462 aa, Bordetella bronchiseptica RB50; identical to SEQ ID NO: 38630

SEQ ID NO: 87217 - DNA, 1779 bp, Prochlorococcus marinus subsp. pastoris str. CCMP1986; identical to SEQ ID NO: 38631
  CDS (1)..(1779): transl_table=11

SEQ ID NO: 87218 - protein, 592 aa, Prochlorococcus marinus subsp. pastoris str. CCMP1986; identical to SEQ ID NO: 38632

SEQ ID NO: 87219 - DNA, 1797 bp, Synechococcus sp. WH 8102; identical to SEQ ID NO: 38633
  CDS (1)..(1797): transl_table=11

SEQ ID NO: 87220 - protein, 598 aa, Synechococcus sp. WH 8102; identical to SEQ ID NO: 38634

SEQ ID NO: 87221 - DNA, 1419 bp, Chromobacterium violaceum ATCC 12472; identical to SEQ ID NO: 38635
  CDS (1)..(1419): transl_table=11

SEQ ID NO: 87222 - protein, 472 aa, Chromobacterium violaceum ATCC 12472; identical to SEQ ID NO: 38636

SEQ ID NO: 87223 - DNA, 1326 bp, Chromobacterium violaceum ATCC 12472; identical to SEQ ID NO: 38637
  CDS (1)..(1326): transl_table=11

SEQ ID NO: 87224 - protein, 441 aa, Chromobacterium violaceum ATCC 12472; identical to SEQ ID NO: 38638

SEQ ID NO: 87225 - DNA, 1263 bp, Chromobacterium violaceum ATCC 12472; identical to SEQ ID NO: 38639
  CDS (1)..(1263): transl_table=11

SEQ ID NO: 87226 - protein, 420 aa, Chromobacterium violaceum ATCC 12472; identical to SEQ ID NO: 38640

SEQ ID NO: 87227 - DNA, 1383 bp, Chromobacterium violaceum ATCC 12472; identical to SEQ ID NO: 38641
  CDS (1)..(1383): transl_table=11

SEQ ID NO: 87228 - protein, 460 aa, Chromobacterium violaceum ATCC 12472; identical to SEQ ID NO: 38642

SEQ ID NO: 87229 - DNA, 1320 bp, Chromobacterium violaceum ATCC 12472; identical to SEQ ID NO: 38643
  CDS (1)..(1320): transl_table=11

SEQ ID NO: 87230 - protein, 439 aa, Chromobacterium violaceum ATCC 12472; identical to SEQ ID NO: 38644

SEQ ID NO: 87231 - DNA, 1815 bp, Porphyromonas gingivalis W83; identical to SEQ ID NO: 38645
  CDS (1)..(1815): transl_table=11

SEQ ID NO: 87232 - protein, 604 aa, Porphyromonas gingivalis W83; identical to SEQ ID NO: 38646

SEQ ID NO: 87233 - DNA, 1284 bp, Porphyromonas gingivalis W83; identical to SEQ ID NO: 38647
  CDS (1)..(1284): transl_table=11

SEQ ID NO: 87234 - protein, 427 aa, Porphyromonas gingivalis W83; identical to SEQ ID NO: 38648

SEQ ID NO: 87235 - DNA, 1518 bp, Wolinella succinogenes DSM 1740; identical to SEQ ID NO: 38649
  CDS (1)..(1518): transl_table=11

SEQ ID NO: 87236 - protein, 505 aa, Wolinella succinogenes DSM 1740; identical to SEQ ID NO: 38650

SEQ ID NO: 87237 - DNA, 1215 bp, Oryza sativa (japonica cultivar-group); identical to SEQ ID NO: 38651
  CDS (1)..(1215)

SEQ ID NO: 87238 - protein, 404 aa, Oryza sativa (japonica cultivar-group); identical to SEQ ID NO: 38652

SEQ ID NO: 87239 - DNA, 2277 bp, Oryza sativa (japonica cultivar-group); identical to SEQ ID NO: 38653
  CDS (1)..(2277)

SEQ ID NO: 87240 - protein, 758 aa, Oryza sativa (japonica cultivar-group); identical to SEQ ID NO: 38654

SEQ ID NO: 87241 - DNA, 1485 bp, Oryza sativa (japonica cultivar-group); identical to SEQ ID NO: 38655
  CDS (1)..(1485)

SEQ ID NO: 87242 - protein, 494 aa, Oryza sativa (japonica cultivar-group); identical to SEQ ID NO: 38656

SEQ ID NO: 87243 - DNA, 2676 bp, Oryza sativa (japonica cultivar-group); identical to SEQ ID NO: 38657
  CDS (1)..(2676)

SEQ ID NO: 87244 - protein, 891 aa, Oryza sativa (japonica cultivar-group); identical to SEQ ID NO: 38658

SEQ ID NO: 87245 - DNA, 1155 bp, Gloeobacter violaceus PCC 7421; identical to SEQ ID NO: 38659
  CDS (1)..(1155): transl_table=11

SEQ ID NO: 87246 - protein, 384 aa, Gloeobacter violaceus PCC 7421; identical to SEQ ID NO: 38660

SEQ ID NO: 87247 - DNA, 1314 bp, Gloeobacter violaceus PCC 7421; identical to SEQ ID NO: 38661
  CDS (1)..(1314): transl_table=11

SEQ ID NO: 87248 - protein, 437 aa, Gloeobacter violaceus PCC 7421; identical to SEQ ID NO: 38662

SEQ ID NO: 87249 - DNA, 1305 bp, Photorhabdus luminescens subsp. laumondii TTO1; identical to SEQ ID NO: 38663
  CDS (1)..(1305): transl_table=11

SEQ ID NO: 87250 - protein, 434 aa, Photorhabdus luminescens subsp. laumondii TTO1; identical to SEQ ID NO: 38664

SEQ ID NO: 87251 - DNA, 1935 bp, Photorhabdus luminescens subsp. laumondii TTO1; identical to SEQ ID NO: 38665
  CDS (1)..(1935): transl_table=11

SEQ ID NO: 87252 - protein, 644 aa, Photorhabdus luminescens subsp. laumondii TTO1; identical to SEQ ID NO: 38666

SEQ ID NO: 87253 - DNA, 1380 bp, Vibrio vulnificus YJ016; identical to SEQ ID NO: 38667
  CDS (1)..(1380): transl_table=11

SEQ ID NO: 87254 - protein, 459 aa, Vibrio vulnificus YJ016; identical to SEQ ID NO: 38668

SEQ ID NO: 87255 - DNA, 1407 bp, Danio rerio; identical to SEQ ID NO: 38669
  CDS (1)..(1407)

SEQ ID NO: 87256 - protein, 468 aa, Danio rerio; identical to SEQ ID NO: 38670

SEQ ID NO: 87257 - DNA, 1425 bp, Rhodopseudomonas palustris CGA009; identical to SEQ ID NO: 38671
  CDS (1)..(1425): transl_table=11

SEQ ID NO: 87258 - protein, 474 aa, Rhodopseudomonas palustris CGA009; identical to SEQ ID NO: 38672

SEQ ID NO: 87259 - DNA, 2085 bp, Rhodopseudomonas palustris CGA009; identical to SEQ ID NO: 38673
  CDS (1)..(2085): transl_table=11

SEQ ID NO: 87260 - protein, 694 aa, Rhodopseudomonas palustris CGA009; identical to SEQ ID NO: 38674

SEQ ID NO: 87261 - DNA, 1659 bp, Onion yellows phytoplasma OY-M; identical to SEQ ID NO: 38675
  CDS (1)..(1659): transl_table=11

SEQ ID NO: 87262 - protein, 552 aa, Onion yellows phytoplasma OY-M; identical to SEQ ID NO: 38676

SEQ ID NO: 87263 - DNA, 1383 bp, Geobacter sulfurreducens PCA; identical to SEQ ID NO: 38677
  CDS (1)..(1383): transl_table=11

SEQ ID NO: 87264 - protein, 460 aa, Geobacter sulfurreducens PCA; identical to SEQ ID NO: 38678

SEQ ID NO: 87265 - DNA, 1353 bp, Geobacter sulfurreducens PCA; identical to SEQ ID NO: 38679
  CDS (1)..(1353): transl_table=11

SEQ ID NO: 87266 - protein, 450 aa, Geobacter sulfurreducens PCA; identical to SEQ ID NO: 38680

SEQ ID NO: 87267 - DNA, 1455 bp, Lactobacillus johnsonii NCC 533; identical to SEQ ID NO: 38681
  CDS (1)..(1455): transl_table=11

SEQ ID NO: 87268 - protein, 484 aa, Lactobacillus johnsonii NCC 533; identical to SEQ ID NO: 38682

SEQ ID NO: 87269 - DNA, 1227 bp, Wolbachia endosymbiont of Drosophila melanogaster; identical to SEQ ID NO: 38683
  CDS (1)..(1227): transl_table=11

SEQ ID NO: 87270 - protein, 408 aa, Wolbachia endosymbiont of Drosophila melanogaster; identical to SEQ ID NO: 38684

SEQ ID NO: 87271 - DNA, 1518 bp, Bdellovibrio bacteriovorus HD100; identical to SEQ ID NO: 38685
  CDS (1)..(1518): transl_table=11

SEQ ID NO: 87272 - protein, 505 aa, Bdellovibrio bacteriovorus HD100; identical to SEQ ID NO: 38686

SEQ ID NO: 87273 - DNA, 1518 bp, Bdellovibrio bacteriovorus HD100; identical to SEQ ID NO: 38687
  CDS (1)..(1518): transl_table=11

SEQ ID NO: 87274 - protein, 505 aa, Bdellovibrio bacteriovorus HD100; identical to SEQ ID NO: 38688

SEQ ID NO: 87275 - DNA, 1971 bp, Bdellovibrio bacteriovorus HD100; identical to SEQ ID NO: 38689
  CDS (1)..(1971): transl_table=11

SEQ ID NO: 87276 - protein, 656 aa, Bdellovibrio bacteriovorus HD100; identical to SEQ ID NO: 38690

SEQ ID NO: 87277 - DNA, 1650 bp, Bdellovibrio bacteriovorus HD100; identical to SEQ ID NO: 38691
  CDS (1)..(1650): transl_table=11

SEQ ID NO: 87278 - protein, 549 aa, Bdellovibrio bacteriovorus HD100; identical to SEQ ID NO: 38692

SEQ ID NO: 87279 - DNA, 1776 bp, Arabidopsis thaliana; identical to SEQ ID NO: 38693
  CDS (1)..(1776)

SEQ ID NO: 87280 - protein, 591 aa, Arabidopsis thaliana; identical to SEQ ID NO: 38694

SEQ ID NO: 87281 - DNA, 1446 bp, Bacillus cereus ATCC 10987; identical to SEQ ID NO: 38695
  CDS (1)..(1446): transl_table=11

SEQ ID NO: 87282 - protein, 481 aa, Bacillus cereus ATCC 10987; identical to SEQ ID NO: 38696

SEQ ID NO: 87283 - DNA, 2205 bp, Eremothecium gossypii; identical to SEQ ID NO: 38697
  CDS (1)..(2205)

SEQ ID NO: 87284 - protein, 734 aa, Eremothecium gossypii; identical to SEQ ID NO: 38698

SEQ ID NO: 87285 - DNA, 1197 bp, Eremothecium gossypii; identical to SEQ ID NO: 38699
  CDS (1)..(1197)

SEQ ID NO: 87286 - protein, 398 aa, Eremothecium gossypii; identical to SEQ ID NO: 38700

SEQ ID NO: 87287 - DNA, 1617 bp, Methanococcus maripaludis S2; identical to SEQ ID NO: 38701
  CDS (1)..(1617): transl_table=11

SEQ ID NO: 87288 - protein, 538 aa, Methanococcus maripaludis S2; identical to SEQ ID NO: 38702

SEQ ID NO: 87289 - DNA, 2100 bp, Xenopus tropicalis; identical to SEQ ID NO: 38703
  CDS (1)..(2100)

SEQ ID NO: 87290 - protein, 699 aa, Xenopus tropicalis; identical to SEQ ID NO: 38704

SEQ ID NO: 87291 - DNA, 1440 bp, Xenopus tropicalis; identical to SEQ ID NO: 38705
  CDS (1)..(1440)

SEQ ID NO: 87292 - protein, 479 aa, Xenopus tropicalis; identical to SEQ ID NO: 38706

SEQ ID NO: 87293 - DNA, 1809 bp, Anopheles gambiae str. PEST; identical to SEQ ID NO: 38707
  CDS (1)..(1809)

SEQ ID NO: 87294 - protein, 602 aa, Anopheles gambiae str. PEST; identical to SEQ ID NO: 38708

SEQ ID NO: 87295 - DNA, 1548 bp, Neurospora crassa; identical to SEQ ID NO: 38709
  CDS (1)..(1548)

SEQ ID NO: 87296 - protein, 515 aa, Neurospora crassa; identical to SEQ ID NO: 38710

SEQ ID NO: 87297 - DNA, 1203 bp, Neurospora crassa; identical to SEQ ID NO: 38711
  CDS (1)..(1203)

SEQ ID NO: 87298 - protein, 400 aa, Neurospora crassa; identical to SEQ ID NO: 38712

SEQ ID NO: 87299 - DNA, 1278 bp, Neurospora crassa; identical to SEQ ID NO: 38713
  CDS (1)..(1278)

SEQ ID NO: 87300 - protein, 425 aa, Neurospora crassa; identical to SEQ ID NO: 38714

SEQ ID NO: 87301 - DNA, 1278 bp, Magnaporthe grisea 70-15; identical to SEQ ID NO: 38715
  CDS (1)..(1278)

SEQ ID NO: 87302 - protein, 425 aa, Magnaporthe grisea 70-15; identical to SEQ ID NO: 38716

SEQ ID NO: 87303 - DNA, 2025 bp, Magnaporthe grisea 70-15; identical to SEQ ID NO: 38717
  CDS (1)..(2025)

SEQ ID NO: 87304 - protein, 674 aa, Magnaporthe grisea 70-15; identical to SEQ ID NO: 38718

SEQ ID NO: 87305 - DNA, 1746 bp, Gibberella zeae PH-1; identical to SEQ ID NO: 38719
  CDS (1)..(1746)

SEQ ID NO: 87306 - protein, 581 aa, Gibberella zeae PH-1; identical to SEQ ID NO: 38720

SEQ ID NO: 87307 - DNA, 1461 bp, Gibberella zeae PH-1; identical to SEQ ID NO: 38721
  CDS (1)..(1461)

SEQ ID NO: 87308 - protein, 486 aa, Gibberella zeae PH-1; identical to SEQ ID NO: 38722

SEQ ID NO: 87309 - DNA, 1206 bp, Gibberella zeae PH-1; identical to SEQ ID NO: 38723
  CDS (1)..(1206)

SEQ ID NO: 87310 - protein, 401 aa, Gibberella zeae PH-1; identical to SEQ ID NO: 38724

SEQ ID NO: 87311 - DNA, 1875 bp, Apis mellifera; identical to SEQ ID NO: 38725
  CDS (1)..(1875)

SEQ ID NO: 87312 - protein, 624 aa, Apis mellifera; identical to SEQ ID NO: 38726

SEQ ID NO: 87313 - DNA, 1656 bp, Ustilago maydis 521; identical to SEQ ID NO: 38727
  CDS (1)..(1656)

SEQ ID NO: 87314 - protein, 551 aa, Ustilago maydis 521; identical to SEQ ID NO: 38728

SEQ ID NO: 87315 - DNA, 1194 bp, Ustilago maydis 521; identical to SEQ ID NO: 38729
  CDS (1)..(1194)

SEQ ID NO: 87316 - protein, 397 aa, Ustilago maydis 521; identical to SEQ ID NO: 38730

SEQ ID NO: 87317 - DNA, 1266 bp, Aspergillus nidulans FGSC A4; identical to SEQ ID NO: 38731
  CDS (1)..(1266)

SEQ ID NO: 87318 - protein, 421 aa, Aspergillus nidulans FGSC A4; identical to SEQ ID NO: 38732

SEQ ID NO: 87319 - DNA, 1398 bp, Aspergillus nidulans FGSC A4; identical to SEQ ID NO: 38733
  CDS (1)..(1398)

SEQ ID NO: 87320 - protein, 465 aa, Aspergillus nidulans FGSC A4; identical to SEQ ID NO: 38734

SEQ ID NO: 87321 - DNA, 1497 bp, Aspergillus nidulans FGSC A4; identical to SEQ ID NO: 38735
  CDS (1)..(1497)

SEQ ID NO: 87322 - protein, 498 aa, Aspergillus nidulans FGSC A4; identical to SEQ ID NO: 38736

SEQ ID NO: 87323 - DNA, 1200 bp, Aspergillus nidulans FGSC A4; identical to SEQ ID NO: 38737
  CDS (1)..(1200)

SEQ ID NO: 87324 - protein, 399 aa, Aspergillus nidulans FGSC A4; identical to SEQ ID NO: 38738

SEQ ID NO: 87325 - DNA, 2178 bp, Candida glabrata CBS138; identical to SEQ ID NO: 38739
  CDS (1)..(2178)

SEQ ID NO: 87326 - protein, 725 aa, Candida glabrata CBS138; identical to SEQ ID NO: 38740

SEQ ID NO: 87327 - DNA, 1482 bp, Candida glabrata CBS138; identical to SEQ ID NO: 38741
  CDS (1)..(1482)

SEQ ID NO: 87328 - protein, 493 aa, Candida glabrata CBS138; identical to SEQ ID NO: 38742

SEQ ID NO: 87329 - DNA, 1635 bp, Candida glabrata CBS138; identical to SEQ ID NO: 38743
  CDS (1)..(1635)

SEQ ID NO: 87330 - protein, 544 aa, Candida glabrata CBS138; identical to SEQ ID NO: 38744

SEQ ID NO: 87331 - DNA, 1197 bp, Kluyveromyces lactis NRRL Y-1140; identical to SEQ ID NO: 38745
  CDS (1)..(1197)

SEQ ID NO: 87332 - protein, 398 aa, Kluyveromyces lactis NRRL Y-1140; identical to SEQ ID NO: 38746

SEQ ID NO: 87333 - DNA, 1464 bp, Kluyveromyces lactis NRRL Y-1140; identical to SEQ ID NO: 38747
  CDS (1)..(1464)

SEQ ID NO: 87334 - protein, 487 aa, Kluyveromyces lactis NRRL Y-1140; identical to SEQ ID NO: 38748

SEQ ID NO: 87335 - DNA, 2247 bp, Kluyveromyces lactis NRRL Y-1140; identical to SEQ ID NO: 38749
  CDS (1)..(2247)

SEQ ID NO: 87336 - protein, 748 aa, Kluyveromyces lactis NRRL Y-1140; identical to SEQ ID NO: 38750

SEQ ID NO: 87337 - DNA, 1665 bp, Kluyveromyces lactis NRRL Y-1140; identical to SEQ ID NO: 38751
  CDS (1)..(1665)

SEQ ID NO: 87338 - protein, 554 aa, Kluyveromyces lactis NRRL Y-1140; identical to SEQ ID NO: 38752

SEQ ID NO: 87339 - DNA, 1611 bp, Debaryomyces hansenii CBS767; identical to SEQ ID NO: 38753
  CDS (1)..(1611)

SEQ ID NO: 87340 - protein, 536 aa, Debaryomyces hansenii CBS767; identical to SEQ ID NO: 38754

SEQ ID NO: 87341 - DNA, 1917 bp, Oryza sativa (japonica cultivar-group); identical to SEQ ID NO: 38755
  CDS (1)..(1917)

SEQ ID NO: 87342 - protein, 638 aa, Oryza sativa (japonica cultivar-group); identical to SEQ ID NO: 38756

SEQ ID NO: 87343 - DNA, 1443 bp, Yarrowia lipolytica CLIB99; identical to SEQ ID NO: 38757
  CDS (1)..(1443)

SEQ ID NO: 87344 - protein, 480 aa, Yarrowia lipolytica CLIB99; identical to SEQ ID NO: 38758

SEQ ID NO: 87345 - DNA, 1188 bp, Yarrowia lipolytica CLIB99; identical to SEQ ID NO: 38759
  CDS (1)..(1188)

SEQ ID NO: 87346 - protein, 395 aa, Yarrowia lipolytica CLIB99; identical to SEQ ID NO: 38760

SEQ ID NO: 87347 - DNA, 1659 bp, Yarrowia lipolytica CLIB99; identical to SEQ ID NO: 38761
  CDS (1)..(1659)

SEQ ID NO: 87348 - protein, 552 aa, Yarrowia lipolytica CLIB99; identical to SEQ ID NO: 38762

SEQ ID NO: 87349 - DNA, 1194 bp, Yarrowia lipolytica CLIB99; identical to SEQ ID NO: 38763
  CDS (1)..(1194)

SEQ ID NO: 87350 - protein, 397 aa, Yarrowia lipolytica CLIB99; identical to SEQ ID NO: 38764

SEQ ID NO: 87351 - DNA, 2256 bp, Pan troglodytes; identical to SEQ ID NO: 38765
  CDS (1)..(2256)

SEQ ID NO: 87352 - protein, 751 aa, Pan troglodytes; identical to SEQ ID NO: 38766

SEQ ID NO: 87353 - DNA, 2127 bp, Oryza sativa (japonica cultivar-group); identical to SEQ ID NO: 38767
  CDS (1)..(2127)

SEQ ID NO: 87354 - protein, 708 aa, Oryza sativa (japonica cultivar-group); identical to SEQ ID NO: 38768

SEQ ID NO: 87355 - DNA, 2280 bp, Oryza sativa (japonica cultivar-group); identical to SEQ ID NO: 38769
  CDS (1)..(2280)

SEQ ID NO: 87356 - protein, 759 aa, Oryza sativa (japonica cultivar-group); identical to SEQ ID NO: 38770

SEQ ID NO: 87357 - DNA, 1554 bp, Thermus thermophilus HB27; identical to SEQ ID NO: 38771
  CDS (1)..(1554): transl_table=11

SEQ ID NO: 87358 - protein, 517 aa, Thermus thermophilus HB27; identical to SEQ ID NO: 38772

SEQ ID NO: 87359 - DNA, 1548 bp, Parachlamydia sp. UWE25; identical to SEQ ID NO: 38773
  CDS (1)..(1548): transl_table=11

SEQ ID NO: 87360 - protein, 515 aa, Parachlamydia sp. UWE25; identical to SEQ ID NO: 38774

SEQ ID NO: 87361 - DNA, 1734 bp, Desulfovibrio vulgaris subsp. vulgaris str. Hildenborough; identical to SEQ ID NO: 38775
  CDS (1)..(1734): transl_table=11

SEQ ID NO: 87362 - protein, 577 aa, Desulfovibrio vulgaris subsp. vulgaris str. Hildenborough; identical to SEQ ID NO: 38776

SEQ ID NO: 87363 - DNA, 1599 bp, Desulfovibrio vulgaris subsp. vulgaris str. Hildenborough; identical to SEQ ID NO: 38777
  CDS (1)..(1599): transl_table=11

SEQ ID NO: 87364 - protein, 532 aa, Desulfovibrio vulgaris subsp. vulgaris str. Hildenborough; identical to SEQ ID NO: 38778

SEQ ID NO: 87365 - DNA, 1404 bp, Bartonella quintana str. Toulouse; identical to SEQ ID NO: 38779
  CDS (1)..(1404): transl_table=11

SEQ ID NO: 87366 - protein, 467 aa, Bartonella quintana str. Toulouse; identical to SEQ ID NO: 38780

SEQ ID NO: 87367 - DNA, 1521 bp, Staphylococcus aureus subsp. aureus MRSA252; identical to SEQ ID NO: 38781
  CDS (1)..(1521): transl_table=11

SEQ ID NO: 87368 - protein, 506 aa, Staphylococcus aureus subsp. aureus MRSA252; identical to SEQ ID NO: 38782

SEQ ID NO: 87369 - DNA, 1152 bp, Acinetobacter sp. ADP1; identical to SEQ ID NO: 38783
  CDS (1)..(1152): transl_table=11

SEQ ID NO: 87370 - protein, 383 aa, Acinetobacter sp. ADP1; identical to SEQ ID NO: 38784

SEQ ID NO: 87371 - DNA, 1923 bp, Acinetobacter sp. ADP1; identical to SEQ ID NO: 38785
  CDS (1)..(1923): transl_table=11

SEQ ID NO: 87372 - protein, 640 aa, Acinetobacter sp. ADP1; identical to SEQ ID NO: 38786

SEQ ID NO: 87373 - DNA, 1914 bp, Erwinia carotovora subsp. atroseptica SCRI1043; identical to SEQ ID NO: 38787
  CDS (1)..(1914)

SEQ ID NO: 87374 - protein, 637 aa, Erwinia carotovora subsp. atroseptica SCRI1043; identical to SEQ ID NO: 38788

SEQ ID NO: 87375 - DNA, 1383 bp, Erwinia carotovora subsp. atroseptica SCRI1043; identical to SEQ ID NO: 38789
  CDS (1)..(1383)

SEQ ID NO: 87376 - protein, 460 aa, Erwinia carotovora subsp. atroseptica SCRI1043; identical to SEQ ID NO: 38790

SEQ ID NO: 87377 - DNA, 2001 bp, Mesoplasma florum L1; identical to SEQ ID NO: 38791
  CDS (1)..(2001): transl_table=4

SEQ ID NO: 87378 - protein, 666 aa, Mesoplasma florum L1; identical to SEQ ID NO: 38792

SEQ ID NO: 87379 - DNA, 1686 bp, Propionibacterium acnes KPA171202; identical to SEQ ID NO: 38793
  CDS (1)..(1686): transl_table=11

SEQ ID NO: 87380 - protein, 561 aa, Propionibacterium acnes KPA171202; identical to SEQ ID NO: 38794

SEQ ID NO: 87381 - DNA, 1476 bp, Leifsonia xyli subsp. xyli str. CTCB07; identical to SEQ ID NO: 38795
  CDS (1)..(1476): transl_table=11

SEQ ID NO: 87382 - protein, 491 aa, Leifsonia xyli subsp. xyli str. CTCB07; identical to SEQ ID NO: 38796

SEQ ID NO: 87383 - DNA, 1770 bp, Leifsonia xyli subsp. xyli str. CTCB07; identical to SEQ ID NO: 38797
  CDS (1)..(1770): transl_table=11

SEQ ID NO: 87384 - protein, 589 aa, Leifsonia xyli subsp. xyli str. CTCB07; identical to SEQ ID NO: 38798

SEQ ID NO: 87385 - DNA, 1275 bp, Desulfotalea psychrophila LSv54; identical to SEQ ID NO: 38799
  CDS (1)..(1275): transl_table=11

SEQ ID NO: 87386 - protein, 424 aa, Desulfotalea psychrophila LSv54; identical to SEQ ID NO: 38800

SEQ ID NO: 87387 - DNA, 1410 bp, Desulfotalea psychrophila LSv54; identical to SEQ ID NO: 38801
  CDS (1)..(1410): transl_table=11

SEQ ID NO: 87388 - protein, 469 aa, Desulfotalea psychrophila LSv54; identical to SEQ ID NO: 38802

SEQ ID NO: 87389 - DNA, 1383 bp, Yersinia pseudotuberculosis IP 32953; identical to SEQ ID NO: 38803
  CDS (1)..(1383): transl_table=11

SEQ ID NO: 87390 - protein, 460 aa, Yersinia pseudotuberculosis IP 32953; identical to SEQ ID NO: 38804

SEQ ID NO: 87391 - DNA, 1581 bp, Symbiobacterium thermophilum IAM 14863; identical to SEQ ID NO: 38805
  CDS (1)..(1581): transl_table=11

SEQ ID NO: 87392 - protein, 526 aa, Symbiobacterium thermophilum IAM 14863; identical to SEQ ID NO: 38806

SEQ ID NO: 87393 - DNA, 1587 bp, Bacillus cereus ZK; identical to SEQ ID NO: 38807
  CDS (1)..(1587): transl_table=11

SEQ ID NO: 87394 - protein, 528 aa, Bacillus cereus ZK; identical to SEQ ID NO: 38808

SEQ ID NO: 87395 - DNA, 1842 bp, Mannheimia succiniciproducens MBEL55E; identical to SEQ ID NO: 38809
  CDS (1)..(1842): transl_table=11

SEQ ID NO: 87396 - protein, 613 aa, Mannheimia succiniciproducens MBEL55E; identical to SEQ ID NO: 38810

SEQ ID NO: 87397 - DNA, 1254 bp, Mannheimia succiniciproducens MBEL55E; identical to SEQ ID NO: 38811
  CDS (1)..(1254): transl_table=11

SEQ ID NO: 87398 - protein, 417 aa, Mannheimia succiniciproducens MBEL55E; identical to SEQ ID NO: 38812

SEQ ID NO: 87399 - DNA, 1446 bp, Bacillus licheniformis ATCC 14580; identical to SEQ ID NO: 38813
  CDS (1)..(1446): transl_table=11

SEQ ID NO: 87400 - protein, 481 aa, Bacillus licheniformis ATCC 14580; identical to SEQ ID NO: 38814

SEQ ID NO: 87401 - DNA, 1911 bp, Bacteroides fragilis YCH46; identical to SEQ ID NO: 38815
  CDS (1)..(1911): transl_table=11

SEQ ID NO: 87402 - protein, 636 aa, Bacteroides fragilis YCH46; identical to SEQ ID NO: 38816

SEQ ID NO: 87403 - DNA, 1284 bp, Bacteroides fragilis YCH46; identical to SEQ ID NO: 38817
  CDS (1)..(1284): transl_table=11

SEQ ID NO: 87404 - protein, 427 aa, Bacteroides fragilis YCH46; identical to SEQ ID NO: 38818

SEQ ID NO: 87405 - DNA, 1362 bp, Methylococcus capsulatus str. Bath; identical to SEQ ID NO: 38819
  CDS (1)..(1362): transl_table=11

SEQ ID NO: 87406 - protein, 453 aa, Methylococcus capsulatus str. Bath; identical to SEQ ID NO: 38820

SEQ ID NO: 87407 - DNA, 1809 bp, Nocardia farcinica IFM 10152; identical to SEQ ID NO: 38821
  CDS (1)..(1809): transl_table=11

SEQ ID NO: 87408 - protein, 602 aa, Nocardia farcinica IFM 10152; identical to SEQ ID NO: 38822

SEQ ID NO: 87409 - DNA, 1770 bp, Legionella pneumophila str. Paris; identical to SEQ ID NO: 38823
  CDS (1)..(1770): transl_table=11

SEQ ID NO: 87410 - protein, 589 aa, Legionella pneumophila str. Paris; identical to SEQ ID NO: 38824

SEQ ID NO: 87411 - DNA, 1407 bp, Legionella pneumophila str. Lens; identical to SEQ ID NO: 38825
  CDS (1)..(1407): transl_table=11

SEQ ID NO: 87412 - protein, 468 aa, Legionella pneumophila str. Lens; identical to SEQ ID NO: 38826

SEQ ID NO: 87413 - DNA, 1368 bp, Photobacterium profundum SS9; identical to SEQ ID NO: 38827
  CDS (1)..(1368): transl_table=11

SEQ ID NO: 87414 - protein, 455 aa, Photobacterium profundum SS9; identical to SEQ ID NO: 38828

SEQ ID NO: 87415 - DNA, 1389 bp, Photobacterium profundum SS9; identical to SEQ ID NO: 38829
  CDS (1)..(1389): transl_table=11

SEQ ID NO: 87416 - protein, 462 aa, Photobacterium profundum SS9; identical to SEQ ID NO: 38830

SEQ ID NO: 87417 - DNA, 1872 bp, Photobacterium profundum SS9; identical to SEQ ID NO: 38831
  CDS (1)..(1872): transl_table=11

SEQ ID NO: 87418 - protein, 623 aa, Photobacterium profundum SS9; identical to SEQ ID NO: 38832

SEQ ID NO: 87419 - DNA, 1587 bp, Streptococcus thermophilus LMG 18311; identical to SEQ ID NO: 38833
  CDS (1)..(1587): transl_table=11

SEQ ID NO: 87420 - protein, 528 aa, Streptococcus thermophilus LMG 18311; identical to SEQ ID NO: 38834

SEQ ID NO: 87421 - DNA, 1554 bp, Thermus thermophilus HB8; identical to SEQ ID NO: 38835
  CDS (1)..(1554): transl_table=11

SEQ ID NO: 87422 - protein, 517 aa, Thermus thermophilus HB8; identical to SEQ ID NO: 38836

SEQ ID NO: 87423 - DNA, 1404 bp, Geobacillus kaustophilus HTA426; identical to SEQ ID NO: 38837
  CDS (1)..(1404): transl_table=11

SEQ ID NO: 87424 - protein, 467 aa, Geobacillus kaustophilus HTA426; identical to SEQ ID NO: 38838

SEQ ID NO: 87425 - DNA, 1425 bp, Idiomarina loihiensis L2TR; identical to SEQ ID NO: 38839
  CDS (1)..(1425): transl_table=11

SEQ ID NO: 87426 - protein, 474 aa, Idiomarina loihiensis L2TR; identical to SEQ ID NO: 38840

SEQ ID NO: 87427 - DNA, 1251 bp, Idiomarina loihiensis L2TR; identical to SEQ ID NO: 38841
  CDS (1)..(1251): transl_table=11

SEQ ID NO: 87428 - protein, 416 aa, Idiomarina loihiensis L2TR; identical to SEQ ID NO: 38842

SEQ ID NO: 87429 - DNA, 1785 bp, Idiomarina loihiensis L2TR; identical to SEQ ID NO: 38843
  CDS (1)..(1785): transl_table=11

SEQ ID NO: 87430 - protein, 594 aa, Idiomarina loihiensis L2TR; identical to SEQ ID NO: 38844

SEQ ID NO: 87431 - DNA, 1392 bp, Azoarcus sp. EbN1; identical to SEQ ID NO: 38845
  CDS (1)..(1392): transl_table=11

SEQ ID NO: 87432 - protein, 463 aa, Azoarcus sp. EbN1; identical to SEQ ID NO: 38846

SEQ ID NO: 87433 - DNA, 1527 bp, Azoarcus sp. EbN1; identical to SEQ ID NO: 38847
  CDS (1)..(1527): transl_table=11

SEQ ID NO: 87434 - protein, 508 aa, Azoarcus sp. EbN1; identical to SEQ ID NO: 38848

SEQ ID NO: 87435 - DNA, 1977 bp, Azoarcus sp. EbN1; identical to SEQ ID NO: 38849
  CDS (1)..(1977): transl_table=11

SEQ ID NO: 87436 - protein, 658 aa, Azoarcus sp. EbN1; identical to SEQ ID NO: 38850

SEQ ID NO: 87437 - DNA, 1479 bp, Zymomonas mobilis subsp. mobilis ZM4; identical to SEQ ID NO: 38851
  CDS (1)..(1479): transl_table=11

SEQ ID NO: 87438 - protein, 492 aa, Zymomonas mobilis subsp. mobilis ZM4; identical to SEQ ID NO: 38852

SEQ ID NO: 87439 - DNA, 1416 bp, Silicibacter pomeroyi DSS-3; identical to SEQ ID NO: 38853
  CDS (1)..(1416): transl_table=11

SEQ ID NO: 87440 - protein, 471 aa, Silicibacter pomeroyi DSS-3; identical to SEQ ID NO: 38854

SEQ ID NO: 87441 - DNA, 1326 bp, Francisella tularensis subsp. tularensis Schu 4; identical to SEQ ID NO: 38855
  CDS (1)..(1326): transl_table=11

SEQ ID NO: 87442 - protein, 441 aa, Francisella tularensis subsp. tularensis Schu 4; identical to SEQ ID NO: 38856

SEQ ID NO: 87443 - DNA, 1710 bp, Francisella tularensis subsp. tularensis Schu 4; identical to SEQ ID NO: 38857
  CDS (1)..(1710): transl_table=11

SEQ ID NO: 87444 - protein, 569 aa, Francisella tularensis subsp. tularensis Schu 4; identical to SEQ ID NO: 38858

SEQ ID NO: 87445 - DNA, 1614 bp, Bacillus clausii KSM-K16; identical to SEQ ID NO: 38859
  CDS (1)..(1614): transl_table=11

SEQ ID NO: 87446 - protein, 537 aa, Bacillus clausii KSM-K16; identical to SEQ ID NO: 38860

SEQ ID NO: 87447 - DNA, 1683 bp, Dehalococcoides ethenogenes 195; identical to SEQ ID NO: 38861
  CDS (1)..(1683): transl_table=11

SEQ ID NO: 87448 - protein, 560 aa, Dehalococcoides ethenogenes 195; identical to SEQ ID NO: 38862

SEQ ID NO: 87449 - DNA, 1362 bp, Rhodobacter sphaeroides 2.4.1; identical to SEQ ID NO: 38863
  CDS (1)..(1362)

SEQ ID NO: 87450 - protein, 453 aa, Rhodobacter sphaeroides 2.4.1; identical to SEQ ID NO: 38864

SEQ ID NO: 87451 - DNA, 1830 bp, Xylella fastidiosa Dixon; identical to SEQ ID NO: 38865
  CDS (1)..(1830)

SEQ ID NO: 87452 - protein, 609 aa, Xylella fastidiosa Dixon; identical to SEQ ID NO: 38866

SEQ ID NO: 87453 - DNA, 1656 bp, Magnetospirillum magnetotacticum MS-1; identical to SEQ ID NO: 38867
  CDS (1)..(1656)

SEQ ID NO: 87454 - protein, 551 aa, Magnetospirillum magnetotacticum MS-1; identical to SEQ ID NO: 38868

SEQ ID NO: 87455 - DNA, 1623 bp, Leuconostoc mesenteroides subsp. mesenteroides ATCC 8293; identical to SEQ ID NO: 38869
  CDS (1)..(1623)

SEQ ID NO: 87456 - protein, 540 aa, Leuconostoc mesenteroides subsp. mesenteroides ATCC 8293; identical to SEQ ID NO: 38870

SEQ ID NO: 87457 - DNA, 1260 bp, Azotobacter vinelandii; identical to SEQ ID NO: 38871
  CDS (1)..(1260)

SEQ ID NO: 87458 - protein, 419 aa, Azotobacter vinelandii; identical to SEQ ID NO: 38872

SEQ ID NO: 87459 - DNA, 1452 bp, Azotobacter vinelandii; identical to SEQ ID NO: 38873
  CDS (1)..(1452)

SEQ ID NO: 87460 - protein, 483 aa, Azotobacter vinelandii; identical to SEQ ID NO: 38874

SEQ ID NO: 87461 - DNA, 1677 bp, Azotobacter vinelandii; identical to SEQ ID NO: 38875
  CDS (1)..(1677)

SEQ ID NO: 87462 - protein, 558 aa, Azotobacter vinelandii; identical to SEQ ID NO: 38876

SEQ ID NO: 87463 - DNA, 1470 bp, Desulfitobacterium hafniense DCB-2; identical to SEQ ID NO: 38877
  CDS (1)..(1470)

SEQ ID NO: 87464 - protein, 489 aa, Desulfitobacterium hafniense DCB-2; identical to SEQ ID NO: 38878

SEQ ID NO: 87465 - DNA, 1530 bp, Nostoc punctiforme PCC 73102; identical to SEQ ID NO: 38879
  CDS (1)..(1530)

SEQ ID NO: 87466 - protein, 509 aa, Nostoc punctiforme PCC 73102; identical to SEQ ID NO: 38880

SEQ ID NO: 87467 - DNA, 1674 bp, Pseudomonas syringae pv. syringae B728a; identical to SEQ ID NO: 38881
  CDS (1)..(1674)

SEQ ID NO: 87468 - protein, 557 aa, Pseudomonas syringae pv. syringae B728a; identical to SEQ ID NO: 38882

SEQ ID NO: 87469 - DNA, 1860 bp, Actinobacillus pleuropneumoniae serovar 1 str. 4074; identical to SEQ ID NO: 38883
  CDS (1)..(1860)

SEQ ID NO: 87470 - protein, 619 aa, Actinobacillus pleuropneumoniae serovar 1 str. 4074; identical to SEQ ID NO: 38884

SEQ ID NO: 87471 - DNA, 1671 bp, Pseudomonas aeruginosa UCBPP-PA14; identical to SEQ ID NO: 38885
  CDS (1)..(1671)

SEQ ID NO: 87472 - protein, 556 aa, Pseudomonas aeruginosa UCBPP-PA14; identical to SEQ ID NO: 38886

SEQ ID NO: 87473 - DNA, 1377 bp, Pseudomonas aeruginosa UCBPP-PA14; identical to SEQ ID NO: 38887
  CDS (1)..(1377)

SEQ ID NO: 87474 - protein, 458 aa, Pseudomonas aeruginosa UCBPP-PA14; identical to SEQ ID NO: 38888

SEQ ID NO: 87475 - DNA, 1587 bp, Fusobacterium nucleatum subsp. vincentii ATCC 49256; identical to SEQ ID NO: 38889
  CDS (1)..(1587): transl_table=11

SEQ ID NO: 87476 - protein, 528 aa, Fusobacterium nucleatum subsp. vincentii ATCC 49256; identical to SEQ ID NO: 38890

SEQ ID NO: 87477 - DNA, 1704 bp, Psychrobacter sp. 273-4; identical to SEQ ID NO: 38891
  CDS (1)..(1704)

SEQ ID NO: 87478 - protein, 567 aa, Psychrobacter sp. 273-4; identical to SEQ ID NO: 38892

SEQ ID NO: 87479 - DNA, 1569 bp, Methanococcoides burtonii DSM 6242; identical to SEQ ID NO: 38893
  CDS (1)..(1569)

SEQ ID NO: 87480 - protein, 522 aa, Methanococcoides burtonii DSM 6242; identical to SEQ ID NO: 38894

SEQ ID NO: 87481 - DNA, 1821 bp, Dechloromonas aromatica RCB; identical to SEQ ID NO: 38895
  CDS (1)..(1821)

SEQ ID NO: 87482 - protein, 606 aa, Dechloromonas aromatica RCB; identical to SEQ ID NO: 38896

SEQ ID NO: 87483 - DNA, 1524 bp, Dechloromonas aromatica RCB; identical to SEQ ID NO: 38897
  CDS (1)..(1524)

SEQ ID NO: 87484 - protein, 507 aa, Dechloromonas aromatica RCB; identical to SEQ ID NO: 38898

SEQ ID NO: 87485 - DNA, 1401 bp, Dechloromonas aromatica RCB; identical to SEQ ID NO: 38899
  CDS (1)..(1401)

SEQ ID NO: 87486 - protein, 466 aa, Dechloromonas aromatica RCB; identical to SEQ ID NO: 38900

SEQ ID NO: 87487 - DNA, 1233 bp, Rickettsia rickettsii; identical to SEQ ID NO: 38901
  CDS (1)..(1233)

SEQ ID NO: 87488 - protein, 410 aa, Rickettsia rickettsii; identical to SEQ ID NO: 38902

SEQ ID NO: 87489 - DNA, 1842 bp, Haemophilus influenzae R2846; identical to SEQ ID NO: 38903
  CDS (1)..(1842)

SEQ ID NO: 87490 - protein, 613 aa, Haemophilus influenzae R2846; identical to SEQ ID NO: 38904

SEQ ID NO: 87491 - DNA, 1842 bp, Haemophilus influenzae R2866; identical to SEQ ID NO: 38905
  CDS (1)..(1842)

SEQ ID NO: 87492 - protein, 613 aa, Haemophilus influenzae R2866; identical to SEQ ID NO: 38906

SEQ ID NO: 87493 - DNA, 1248 bp, Haemophilus influenzae R2866; identical to SEQ ID NO: 38907
  CDS (1)..(1248)

SEQ ID NO: 87494 - protein, 415 aa, Haemophilus influenzae R2866; identical to SEQ ID NO: 38908

SEQ ID NO: 87495 - DNA, 1281 bp, Anabaena variabilis ATCC 29413; identical to SEQ ID NO: 38909
  CDS (1)..(1281)

SEQ ID NO: 87496 - protein, 426 aa, Anabaena variabilis ATCC 29413; identical to SEQ ID NO: 38910

SEQ ID NO: 87497 - DNA, 1542 bp, Anabaena variabilis ATCC 29413; identical to SEQ ID NO: 38911
  CDS (1)..(1542)

SEQ ID NO: 87498 - protein, 513 aa, Anabaena variabilis ATCC 29413; identical to SEQ ID NO: 38912

SEQ ID NO: 87499 - DNA, 1425 bp, Ralstonia eutropha JMP134; identical to SEQ ID NO: 38913
  CDS (1)..(1425)

SEQ ID NO: 87500 - protein, 474 aa, Ralstonia eutropha JMP134; identical to SEQ ID NO: 38914

SEQ ID NO: 87501 - DNA, 1521 bp, Ralstonia eutropha JMP134; identical to SEQ ID NO: 38915
  CDS (1)..(1521)

SEQ ID NO: 87502 - protein, 506 aa, Ralstonia eutropha JMP134; identical to SEQ ID NO: 38916

SEQ ID NO: 87503 - DNA, 1356 bp, Methylobacillus flagellatus KT; identical to SEQ ID NO: 38917
  CDS (1)..(1356)

SEQ ID NO: 87504 - protein, 451 aa, Methylobacillus flagellatus KT; identical to SEQ ID NO: 38918

SEQ ID NO: 87505 - DNA, 1383 bp, Methylobacillus flagellatus KT; identical to SEQ ID NO: 38919
  CDS (1)..(1383)

SEQ ID NO: 87506 - protein, 460 aa, Methylobacillus flagellatus KT; identical to SEQ ID NO: 38920

SEQ ID NO: 87507 - DNA, 1548 bp, Methylobacillus flagellatus KT; identical to SEQ ID NO: 38921
  CDS (1)..(1548)

SEQ ID NO: 87508 - protein, 515 aa, Methylobacillus flagellatus KT; identical to SEQ ID NO: 38922

SEQ ID NO: 87509 - DNA, 1443 bp, Crocosphaera watsonii WH 8501; identical to SEQ ID NO: 38923
  CDS (1)..(1443)

SEQ ID NO: 87510 - protein, 480 aa, Crocosphaera watsonii WH 8501; identical to SEQ ID NO: 38924

SEQ ID NO: 87511 - DNA, 1233 bp, Exiguobacterium sp. 255-15; identical to SEQ ID NO: 38925
  CDS (1)..(1233)

SEQ ID NO: 87512 - protein, 410 aa, Exiguobacterium sp. 255-15; identical to SEQ ID NO: 38926

SEQ ID NO: 87513 - DNA, 1536 bp, Exiguobacterium sp. 255-15; identical to SEQ ID NO: 38927
  CDS (1)..(1536)

SEQ ID NO: 87514 - protein, 511 aa, Exiguobacterium sp. 255-15; identical to SEQ ID NO: 38928

SEQ ID NO: 87515 - DNA, 1446 bp, Exiguobacterium sp. 255-15; identical to SEQ ID NO: 38929
  CDS (1)..(1446)

SEQ ID NO: 87516 - protein, 481 aa, Exiguobacterium sp. 255-15; identical to SEQ ID NO: 38930

SEQ ID NO: 87517 - DNA, 1398 bp, Burkholderia cepacia R1808; identical to SEQ ID NO: 38931
  CDS (1)..(1398)

SEQ ID NO: 87518 - protein, 465 aa, Burkholderia cepacia R1808; identical to SEQ ID NO: 38932

SEQ ID NO: 87519 - DNA, 1413 bp, Listeria monocytogenes str. 1/2a F6854; identical to SEQ ID NO: 38933
  CDS (1)..(1413): transl_table=11

SEQ ID NO: 87520 - protein, 470 aa, Listeria monocytogenes str. 1/2a F6854; identical to SEQ ID NO: 38934

SEQ ID NO: 87521 - DNA, 1467 bp, Rubrivivax gelatinosus PM1; identical to SEQ ID NO: 38935
  CDS (1)..(1467)

SEQ ID NO: 87522 - protein, 488 aa, Rubrivivax gelatinosus PM1; identical to SEQ ID NO: 38936

SEQ ID NO: 87523 - DNA, 1422 bp, Rubrivivax gelatinosus PM1; identical to SEQ ID NO: 38937
  CDS (1)..(1422)

SEQ ID NO: 87524 - protein, 473 aa, Rubrivivax gelatinosus PM1; identical to SEQ ID NO: 38938

SEQ ID NO: 87525 - DNA, 1182 bp, Rhodospirillum rubrum; identical to SEQ ID NO: 38939
  CDS (1)..(1182)

SEQ ID NO: 87526 - protein, 393 aa, Rhodospirillum rubrum; identical to SEQ ID NO: 38940

SEQ ID NO: 87527 - DNA, 2034 bp, Rhodospirillum rubrum; identical to SEQ ID NO: 38941
  CDS (1)..(2034)

SEQ ID NO: 87528 - protein, 677 aa, Rhodospirillum rubrum; identical to SEQ ID NO: 38942

SEQ ID NO: 87529 - DNA, 1905 bp, Ralstonia metallidurans CH34; identical to SEQ ID NO: 38943
  CDS (1)..(1905)

SEQ ID NO: 87530 - protein, 634 aa, Ralstonia metallidurans CH34; identical to SEQ ID NO: 38944

SEQ ID NO: 87531 - DNA, 1476 bp, Burkholderia fungorum LB400; identical to SEQ ID NO: 38945
  CDS (1)..(1476)

SEQ ID NO: 87532 - protein, 491 aa, Burkholderia fungorum LB400; identical to SEQ ID NO: 38946

SEQ ID NO: 87533 - DNA, 1512 bp, Thermobifida fusca; identical to SEQ ID NO: 38947
  CDS (1)..(1512)

SEQ ID NO: 87534 - protein, 503 aa, Thermobifida fusca; identical to SEQ ID NO: 38948

SEQ ID NO: 87535 - DNA, 1713 bp, Thermobifida fusca; identical to SEQ ID NO: 38949
  CDS (1)..(1713)

SEQ ID NO: 87536 - protein, 570 aa, Thermobifida fusca; identical to SEQ ID NO: 38950

SEQ ID NO: 87537 - DNA, 1740 bp, Methanosarcina barkeri str. fusaro; identical to SEQ ID NO: 38951
  CDS (1)..(1740)

SEQ ID NO: 87538 - protein, 579 aa, Methanosarcina barkeri str. fusaro; identical to SEQ ID NO: 38952

SEQ ID NO: 87539 - DNA, 1359 bp, Geobacter metallireducens GS-15; identical to SEQ ID NO: 38953
  CDS (1)..(1359)

SEQ ID NO: 87540 - protein, 452 aa, Geobacter metallireducens GS-15; identical to SEQ ID NO: 38954

SEQ ID NO: 87541 - DNA, 1395 bp, Novosphingobium aromaticivorans DSM 12444; identical to SEQ ID NO: 38955
  CDS (1)..(1395)

SEQ ID NO: 87542 - protein, 464 aa, Novosphingobium aromaticivorans DSM 12444; identical to SEQ ID NO: 38956

SEQ ID NO: 87543 - DNA, 1497 bp, Novosphingobium aromaticivorans DSM 12444; identical to SEQ ID NO: 38957
  CDS (1)..(1497)

SEQ ID NO: 87544 - protein, 498 aa, Novosphingobium aromaticivorans DSM 12444; identical to SEQ ID NO: 38958

SEQ ID NO: 87545 - DNA, 1260 bp, Cytophaga hutchinsonii; identical to SEQ ID NO: 38959
  CDS (1)..(1260)

SEQ ID NO: 87546 - protein, 419 aa, Cytophaga hutchinsonii; identical to SEQ ID NO: 38960

SEQ ID NO: 87547 - DNA, 1743 bp, Cytophaga hutchinsonii; identical to SEQ ID NO: 38961
  CDS (1)..(1743)

SEQ ID NO: 87548 - protein, 580 aa, Cytophaga hutchinsonii; identical to SEQ ID NO: 38962

SEQ ID NO: 87549 - DNA, 1395 bp, Microbulbifer degradans 2-40; identical to SEQ ID NO: 38963
  CDS (1)..(1395)

SEQ ID NO: 87550 - protein, 464 aa, Microbulbifer degradans 2-40; identical to SEQ ID NO: 38964

SEQ ID NO: 87551 - DNA, 1179 bp, Microbulbifer degradans 2-40; identical to SEQ ID NO: 38965
  CDS (1)..(1179)

SEQ ID NO: 87552 - protein, 392 aa, Microbulbifer degradans 2-40; identical to SEQ ID NO: 38966

SEQ ID NO: 87553 - DNA, 1788 bp, Microbulbifer degradans 2-40; identical to SEQ ID NO: 38967
  CDS (1)..(1788)

SEQ ID NO: 87554 - protein, 595 aa, Microbulbifer degradans 2-40; identical to SEQ ID NO: 38968

SEQ ID NO: 87555 - DNA, 1311 bp, Microbulbifer degradans 2-40; identical to SEQ ID NO: 38969
  CDS (1)..(1311)

SEQ ID NO: 87556 - protein, 436 aa, Microbulbifer degradans 2-40; identical to SEQ ID NO: 38970

SEQ ID NO: 87557 - DNA, 1197 bp, Microbulbifer degradans 2-40; identical to SEQ ID NO: 38971
  CDS (1)..(1197)

SEQ ID NO: 87558 - protein, 398 aa, Microbulbifer degradans 2-40; identical to SEQ ID NO: 38972

SEQ ID NO: 87559 - DNA, 1566 bp, Oenococcus oeni PSU-1; identical to SEQ ID NO: 38973
  CDS (1)..(1566)

SEQ ID NO: 87560 - protein, 521 aa, Oenococcus oeni PSU-1; identical to SEQ ID NO: 38974

SEQ ID NO: 87561 - DNA, 1626 bp, Haemophilus influenzae 86-028NP; identical to SEQ ID NO: 38975
  CDS (1)..(1626)

SEQ ID NO: 87562 - protein, 541 aa, Haemophilus influenzae 86-028NP; identical to SEQ ID NO: 38976

SEQ ID NO: 87563 - DNA, 1581 bp, Pediococcus pentosaceus ATCC 25745; identical to SEQ ID NO: 38977
  CDS (1)..(1581)

SEQ ID NO: 87564 - protein, 526 aa, Pediococcus pentosaceus ATCC 25745; identical to SEQ ID NO: 38978

SEQ ID NO: 87565 - DNA, 1362 bp, Pediococcus pentosaceus ATCC 25745; identical to SEQ ID NO: 38979
  CDS (1)..(1362)

SEQ ID NO: 87566 - protein, 453 aa, Pediococcus pentosaceus ATCC 25745; identical to SEQ ID NO: 38980

SEQ ID NO: 87567 - DNA, 1365 bp, Trichodesmium erythraeum IMS101; identical to SEQ ID NO: 38981
  CDS (1)..(1365)

SEQ ID NO: 87568 - protein, 454 aa, Trichodesmium erythraeum IMS101; identical to SEQ ID NO: 38982

SEQ ID NO: 87569 - DNA, 1488 bp, Trichodesmium erythraeum IMS101; identical to SEQ ID NO: 38983
  CDS (1)..(1488)

SEQ ID NO: 87570 - protein, 495 aa, Trichodesmium erythraeum IMS101; identical to SEQ ID NO: 38984

SEQ ID NO: 87571 - DNA, 1602 bp, Thiobacillus denitrificans ATCC 25259; identical to SEQ ID NO: 38985
  CDS (1)..(1602)

SEQ ID NO: 87572 - protein, 533 aa, Thiobacillus denitrificans ATCC 25259; identical to SEQ ID NO: 38986

SEQ ID NO: 87573 - DNA, 1434 bp, Thiobacillus denitrificans ATCC 25259; identical to SEQ ID NO: 38987
  CDS (1)..(1434)

SEQ ID NO: 87574 - protein, 477 aa, Thiobacillus denitrificans ATCC 25259; identical to SEQ ID NO: 38988

SEQ ID NO: 87575 - DNA, 1383 bp, Thiobacillus denitrificans ATCC 25259; identical to SEQ ID NO: 38989
  CDS (1)..(1383)

SEQ ID NO: 87576 - protein, 460 aa, Thiobacillus denitrificans ATCC 25259; identical to SEQ ID NO: 38990

SEQ ID NO: 87577 - DNA, 1338 bp, Silicibacter sp. TM1040; identical to SEQ ID NO: 38991
  CDS (1)..(1338)

SEQ ID NO: 87578 - protein, 445 aa, Silicibacter sp. TM1040; identical to SEQ ID NO: 38992

SEQ ID NO: 87579 - DNA, 1587 bp, Desulfovibrio desulfuricans G20; identical to SEQ ID NO: 38993
  CDS (1)..(1587)

SEQ ID NO: 87580 - protein, 528 aa, Desulfovibrio desulfuricans G20; identical to SEQ ID NO: 38994

SEQ ID NO: 87581 - DNA, 1659 bp, Chloroflexus aurantiacus; identical to SEQ ID NO: 38995
  CDS (1)..(1659)

SEQ ID NO: 87582 - protein, 552 aa, Chloroflexus aurantiacus; identical to SEQ ID NO: 38996

SEQ ID NO: 87583 - DNA, 1407 bp, Polaromonas sp. JS666; identical to SEQ ID NO: 38997
  CDS (1)..(1407)

SEQ ID NO: 87584 - protein, 468 aa, Polaromonas sp. JS666; identical to SEQ ID NO: 38998

SEQ ID NO: 87585 - DNA, 1269 bp, Polaromonas sp. JS666; identical to SEQ ID NO: 38999
  CDS (1)..(1269)

SEQ ID NO: 87586 - protein, 422 aa, Polaromonas sp. JS666; identical to SEQ ID NO: 39000

SEQ ID NO: 87587 - DNA, 1533 bp, Thermus thermophilus; identical to SEQ ID NO: 39001
  CDS (1)..(1533): transl_table=11

SEQ ID NO: 87588 - protein, 510 aa, Thermus thermophilus; identical to SEQ ID NO: 39002

SEQ ID NO: 87589 - DNA, 1407 bp, Brachydanio rerio; identical to SEQ ID NO: 39003
  CDS (1)..(1407)

SEQ ID NO: 87590 - protein, 468 aa, Brachydanio rerio; identical to SEQ ID NO: 39004

SEQ ID NO: 87591 - DNA, 2199 bp, Corynebacterium glutamicum; identical to SEQ ID NO: 39005
  CDS (1)..(2199): transl_table=11

SEQ ID NO: 87592 - protein, 732 aa, Corynebacterium glutamicum; identical to SEQ ID NO: 39006

SEQ ID NO: 87593 - DNA, 1908 bp, uncultured marine proteobacterium ANT8C10; identical to SEQ ID NO: 39007
  CDS (1)..(1908): transl_table=11

SEQ ID NO: 87594 - protein, 635 aa, uncultured marine proteobacterium ANT8C10; identical to SEQ ID NO: 39008

SEQ ID NO: 87595 - DNA, 1974 bp, Yersinia enterocolitica; identical to SEQ ID NO: 39009
  CDS (1)..(1974): transl_table=11

SEQ ID NO: 87596 - protein, 657 aa, Yersinia enterocolitica; identical to SEQ ID NO: 39010

SEQ ID NO: 87597 - DNA, 2247 bp, Arabidopsis thaliana; identical to SEQ ID NO: 39011
  CDS (1)..(2247)

SEQ ID NO: 87598 - protein, 748 aa, Arabidopsis thaliana; identical to SEQ ID NO: 39012

SEQ ID NO: 87599 - DNA, 1239 bp, Arabidopsis thaliana; identical to SEQ ID NO: 39013
  CDS (1)..(1239)

SEQ ID NO: 87600 - protein, 412 aa, Arabidopsis thaliana; identical to SEQ ID NO: 39014

SEQ ID NO: 87601 - DNA, 1860 bp, Arabidopsis thaliana; identical to SEQ ID NO: 39015
  CDS (1)..(1860)

SEQ ID NO: 87602 - protein, 619 aa, Arabidopsis thaliana; identical to SEQ ID NO: 39016

SEQ ID NO: 87603 - DNA, 1569 bp, Streptococcus sobrinus; identical to SEQ ID NO: 39017
  CDS (1)..(1569): transl_table=11

SEQ ID NO: 87604 - protein, 522 aa, Streptococcus sobrinus; identical to SEQ ID NO: 39018

SEQ ID NO: 87605 - DNA, 1464 bp, Synechococcus sp; identical to SEQ ID NO: 39019
  CDS (1)..(1464): transl_table=11

SEQ ID NO: 87606 - protein, 487 aa, Synechococcus sp; identical to SEQ ID NO: 39020

SEQ ID NO: 87607 - DNA, 1869 bp, Pisum sativum; identical to SEQ ID NO: 39021
  CDS (1)..(1869)

SEQ ID NO: 87608 - protein, 622 aa, Pisum sativum; identical to SEQ ID NO: 39022

SEQ ID NO: 87609 - DNA, 1494 bp, Lactobacillus reuteri; identical to SEQ ID NO: 39023
  CDS (1)..(1494): transl_table=11

SEQ ID NO: 87610 - protein, 497 aa, Lactobacillus reuteri; identical to SEQ ID NO: 39024

SEQ ID NO: 87611 - DNA, 1641 bp, Saccharomyces cerevisiae; identical to SEQ ID NO: 39025
  CDS (1)..(1641)

SEQ ID NO: 87612 - protein, 546 aa, Saccharomyces cerevisiae; identical to SEQ ID NO: 39026

SEQ ID NO: 87613 - DNA, 1440 bp, Bacillus subtilis; identical to SEQ ID NO: 39027
  CDS (1)..(1440): transl_table=11

SEQ ID NO: 87614 - protein, 479 aa, Bacillus subtilis; identical to SEQ ID NO: 39028

SEQ ID NO: 87615 - DNA, 1446 bp, Xenopus laevis; identical to SEQ ID NO: 39029
  CDS (1)..(1446)

SEQ ID NO: 87616 - protein, 481 aa, Xenopus laevis; identical to SEQ ID NO: 39030

SEQ ID NO: 87617 - DNA, 2336 bp, Klebsiella pneumoniae; identical to SEQ ID NO: 39031
  CDS (266)..(2197)

SEQ ID NO: 87618 - protein, 643 aa, Klebsiella pneumoniae; identical to SEQ ID NO: 39032

SEQ ID NO: 87619 - DNA, 2259 bp, Saccharomyces cerevisiae; identical to SEQ ID NO: 39033
  CDS (1)..(2259)

SEQ ID NO: 87620 - protein, 752 aa, Saccharomyces cerevisiae; identical to SEQ ID NO: 39034

SEQ ID NO: 87621 - DNA, 1575 bp, Streptococcus pneumoniae; identical to SEQ ID NO: 39035
  CDS (1)..(1575): transl_table=11

SEQ ID NO: 87622 - protein, 524 aa, Streptococcus pneumoniae; identical to SEQ ID NO: 39036

SEQ ID NO: 87623 - DNA, 1104 bp, Methanococcus jannaschii; identical to SEQ ID NO: 39037
  CDS (1)..(1104): transl_table=11

SEQ ID NO: 87624 - protein, 367 aa, Methanococcus jannaschii; identical to SEQ ID NO: 39038

SEQ ID NO: 87625 - DNA, 1239 bp, Arabidopsis thaliana; identical to SEQ ID NO: 39039
  CDS (1)..(1239)

SEQ ID NO: 87626 - protein, 412 aa, Arabidopsis thaliana; identical to SEQ ID NO: 39040

SEQ ID NO: 87627 - DNA, 1242 bp, Nicotiana tabacum; identical to SEQ ID NO: 39041
  CDS (1)..(1242)

SEQ ID NO: 87628 - protein, 413 aa, Nicotiana tabacum; identical to SEQ ID NO: 39042

SEQ ID NO: 87629 - DNA, 1185 bp, Schizosaccharomyces pombe; identical to SEQ ID NO: 39043
  CDS (1)..(1185)

SEQ ID NO: 87630 - protein, 394 aa, Schizosaccharomyces pombe; identical to SEQ ID NO: 39044

SEQ ID NO: 87631 - DNA, 1242 bp, Nicotiana tabacum; identical to SEQ ID NO: 39045
  CDS (1)..(1242)

SEQ ID NO: 87632 - protein, 413 aa, Nicotiana tabacum; identical to SEQ ID NO: 39046

SEQ ID NO: 87633 - DNA, 1242 bp, Nicotiana tabacum; identical to SEQ ID NO: 39047
  CDS (1)..(1242)

SEQ ID NO: 87634 - protein, 413 aa, Nicotiana tabacum; identical to SEQ ID NO: 39048

SEQ ID NO: 87635 - DNA, 1632 bp, Xylella fastidiosa; identical to SEQ ID NO: 39049
  CDS (1)..(1632): transl_table=11

SEQ ID NO: 87636 - protein, 543 aa, Xylella fastidiosa; identical to SEQ ID NO: 39050

SEQ ID NO: 87637 - DNA, 1365 bp, Escherichia coli; identical to SEQ ID NO: 39051
  CDS (1)..(1365): transl_table=11

SEQ ID NO: 87638 - protein, 454 aa, Escherichia coli; identical to SEQ ID NO: 39052

SEQ ID NO: 87639 - DNA, 2285 bp, Drosophila melanogaster; identical to SEQ ID NO: 39053
  CDS (152)..(2137)

SEQ ID NO: 87640 - protein, 661 aa, Drosophila melanogaster; identical to SEQ ID NO: 39054

SEQ ID NO: 87641 - DNA, 25 bp, Primer
atgaccgctttttctaccctgaatg

SEQ ID NO: 87642 - DNA, 24 bp, Primer
ttattttaataaccgcacccggca

SEQ ID NO: 87643 - protein, 414 aa, consensus; identical to SEQ ID NO: 39057
  MISC_FEATURE (1)..(414): consensus for the disclosure of xaa see table XV

SEQ ID NO: 87644 - protein, 94 aa, consensus; identical to SEQ ID NO: 39058
  MISC_FEATURE (1)..(94): consensus for the disclosure of xaa see table XV

SEQ ID NO: 87645 - protein, 116 aa, consensus; identical to SEQ ID NO: 39059
  MISC_FEATURE (1)..(116): consensus for the disclosure of xaa see table XV

SEQ ID NO: 87646 - protein, 99 aa, consensus; identical to SEQ ID NO: 39060
  MISC_FEATURE (1)..(99): consensus for the disclosure of xaa see table XV

SEQ ID NO: 87647 - DNA, 759 bp, Escherichia coli (strain K-12); identical to SEQ ID NO: 29326
  CDS (1)..(759)

SEQ ID NO: 87648 - protein, 252 aa, Escherichia coli (strain K-12); identical to SEQ ID NO: 29327

SEQ ID NO: 87649 - DNA, 678 bp, Streptococcus thermophilus LMG 18311; identical to SEQ ID NO: 29328
  CDS (1)..(678)

SEQ ID NO: 87650 - protein, 225 aa, Streptococcus thermophilus LMG 18311; identical to SEQ ID NO: 29329

SEQ ID NO: 87651 - DNA, 1812 bp, Arabidopsis thaliana; identical to SEQ ID NO: 29330
  CDS (1)..(1812)

SEQ ID NO: 87652 - protein, 603 aa, Arabidopsis thaliana; identical to SEQ ID NO: 29331

SEQ ID NO: 87653 - DNA, 798 bp, Neisseria meningitidis Z2491; identical to SEQ ID NO: 29332
  CDS (1)..(798): transl_table=11

SEQ ID NO: 87654 - protein, 265 aa, Neisseria meningitidis Z2491; identical to SEQ ID NO: 29333

SEQ ID NO: 87655 - DNA, 678 bp, Streptococcus agalactiae 2603V/R; identical to SEQ ID NO: 29334
  CDS (1)..(678): transl_table=11

SEQ ID NO: 87656 - protein, 225 aa, Streptococcus agalactiae 2603V/R; identical to SEQ ID NO: 29335

SEQ ID NO: 87657 - DNA, 774 bp, Oceanobacillus iheyensis HTE831; identical to SEQ ID NO: 29336
  CDS (1)..(774): transl_table=11

SEQ ID NO: 87658 - protein, 257 aa, Oceanobacillus iheyensis HTE831; identical to SEQ ID NO: 29337

SEQ ID NO: 87659 - DNA, 759 bp, Oceanobacillus iheyensis HTE831; identical to SEQ ID NO: 29338
  CDS (1)..(759): transl_table=11

SEQ ID NO: 87660 - protein, 252 aa, Oceanobacillus iheyensis HTE831; identical to SEQ ID NO: 29339

SEQ ID NO: 87661 - DNA, 759 bp, Shigella flexneri 2a str. 301; identical to SEQ ID NO: 29340
  CDS (1)..(759): transl_table=11

SEQ ID NO: 87662 - protein, 252 aa, Shigella flexneri 2a str. 301; identical to SEQ ID NO: 29341

SEQ ID NO: 87663 - DNA, 678 bp, Streptococcus mutans UA159; identical to SEQ ID NO: 29342
  CDS (1)..(678): transl_table=11

SEQ ID NO: 87664 - protein, 225 aa, Streptococcus mutans UA159; identical to SEQ ID NO: 29343

SEQ ID NO: 87665 - DNA, 750 bp, Lactobacillus plantarum WCFS1; identical to SEQ ID NO: 29344
  CDS (1)..(750): transl_table=11

SEQ ID NO: 87666 - protein, 249 aa, Lactobacillus plantarum WCFS1; identical to SEQ ID NO: 29345

SEQ ID NO: 87667 - DNA, 702 bp, Coxiella burnetii RSA 493; identical to SEQ ID NO: 29346
  CDS (1)..(702): transl_table=11

SEQ ID NO: 87668 - protein, 233 aa, Coxiella burnetii RSA 493; identical to SEQ ID NO: 29347

SEQ ID NO: 87669 - DNA, 1491 bp, Rhodopirellula baltica SH 1; identical to SEQ ID NO: 29348
  CDS (1)..(1491): transl_table=11

SEQ ID NO: 87670 - protein, 496 aa, Rhodopirellula baltica SH 1; identical to SEQ ID NO: 29349

SEQ ID NO: 87671 - DNA, 1596 bp, Oryza sativa (japonica cultivar-group); identical to SEQ ID NO: 29350
  CDS (1)..(1596)

SEQ ID NO: 87672 - protein, 531 aa, Oryza sativa (japonica cultivar-group); identical to SEQ ID NO: 29351

SEQ ID NO: 87673 - DNA, 1503 bp, Oryza sativa (japonica cultivar-group); identical to SEQ ID NO: 29352
  CDS (1)..(1503)

SEQ ID NO: 87674 - protein, 500 aa, Oryza sativa (japonica cultivar-group); identical to SEQ ID NO: 29353

SEQ ID NO: 87675 - DNA, 657 bp, Methanococcus maripaludis S2; identical to SEQ ID NO: 29354
  CDS (1)..(657): transl_table=11

SEQ ID NO: 87676 - protein, 218 aa, Methanococcus maripaludis S2; identical to SEQ ID NO: 29355

SEQ ID NO: 87677 - DNA, 681 bp, Desulfotalea psychrophila LSv54; identical to SEQ ID NO: 29356
  CDS (1)..(681): transl_table=11

SEQ ID NO: 87678 - protein, 226 aa, Desulfotalea psychrophila LSv54; identical to SEQ ID NO: 29357

SEQ ID NO: 87679 - DNA, 765 bp, Bacillus licheniformis DSM 13; identical to SEQ ID NO: 29358
  CDS (1)..(765): transl_table=11

SEQ ID NO: 87680 - protein, 254 aa, Bacillus licheniformis DSM 13; identical to SEQ ID NO: 29359

SEQ ID NO: 87681 - DNA, 882 bp, Leuconostoc mesenteroides subsp. mesenteroides ATCC 8293; identical to SEQ ID NO: 29360
  CDS (1)..(882)

SEQ ID NO: 87682 - protein, 293 aa, Leuconostoc mesenteroides subsp. mesenteroides ATCC 8293; identical to SEQ ID NO: 29361

SEQ ID NO: 87683 - DNA, 702 bp, Methanococcoides burtonii DSM 6242; identical to SEQ ID NO: 29362
  CDS (1)..(702)

SEQ ID NO: 87684 - protein, 233 aa, Methanococcoides burtonii DSM 6242; identical to SEQ ID NO: 29363

SEQ ID NO: 87685 - DNA, 759 bp, Enterococcus faecium; identical to SEQ ID NO: 29364
  CDS (1)..(759)

SEQ ID NO: 87686 - protein, 252 aa, Enterococcus faecium; identical to SEQ ID NO: 29365

SEQ ID NO: 87687 - DNA, 801 bp, Methanosarcina barkeri str. fusaro; identical to SEQ ID NO: 29366
  CDS (1)..(801)

SEQ ID NO: 87688 - protein, 266 aa, Methanosarcina barkeri str. fusaro; identical to SEQ ID NO: 29367

SEQ ID NO: 87689 - DNA, 2195 bp, Lycopersicon esculentum; identical to SEQ ID NO: 29368
  CDS (80)..(1717)

SEQ ID NO: 87690 - protein, 545 aa, Lycopersicon esculentum; identical to SEQ ID NO: 29369

SEQ ID NO: 87691 - DNA, 690 bp, Haloarcula marismortui ATCC 43049; identical to SEQ ID NO: 29370
  CDS (1)..(690)

SEQ ID NO: 87692 - protein, 229 aa, Haloarcula marismortui ATCC 43049; identical to SEQ ID NO: 29371

SEQ ID NO: 87693 - DNA, 1710 bp, Nicotiana tabacum; identical to SEQ ID NO: 29372
  CDS (1)..(1710)

SEQ ID NO: 87694 - protein, 569 aa, Nicotiana tabacum; identical to SEQ ID NO: 29373

SEQ ID NO: 87695 - DNA, 819 bp, Acinetobacter sp; identical to SEQ ID NO: 29374
  CDS (1)..(819)

SEQ ID NO: 87696 - protein, 272 aa, Acinetobacter sp; identical to SEQ ID NO: 29375

SEQ ID NO: 87697 - DNA, 660 bp, Aquifex aeolicus; identical to SEQ ID NO: 29376
  CDS (1)..(660): transl_table=11

SEQ ID NO: 87698 - protein, 219 aa, Aquifex aeolicus; identical to SEQ ID NO: 29377

SEQ ID NO: 87699 - DNA, 768 bp, Bacillus subtilis; identical to SEQ ID NO: 29378
  CDS (1)..(768): transl_table=11

SEQ ID NO: 87700 - protein, 255 aa, Bacillus subtilis; identical to SEQ ID NO: 29379

SEQ ID NO: 87701 - DNA, 681 bp, Halobacterium sp; identical to SEQ ID NO: 29380
  CDS (1)..(681)

SEQ ID NO: 87702 - protein, 226 aa, Halobacterium sp; identical to SEQ ID NO: 29381

SEQ ID NO: 87703 - DNA, 681 bp, Lactococcus lactis; identical to SEQ ID NO: 29382
  CDS (1)..(681): transl_table=11

SEQ ID NO: 87704 - protein, 226 aa, Lactococcus lactis; identical to SEQ ID NO: 29383

SEQ ID NO: 87705 - DNA, 759 bp, Lactobacillus plantarum; identical to SEQ ID NO: 29384
  CDS (1)..(759): transl_table=11

SEQ ID NO: 87706 - protein, 252 aa, Lactobacillus plantarum; identical to SEQ ID NO: 29385

SEQ ID NO: 87707 - DNA, 759 bp, Listeria innocua; identical to SEQ ID NO: 29386
  CDS (1)..(759): transl_table=11

SEQ ID NO: 87708 - protein, 252 aa, Listeria innocua; identical to SEQ ID NO: 29387

SEQ ID NO: 87709 - DNA, 759 bp, Listeria monocytogenes; identical to SEQ ID NO: 29388
  CDS (1)..(759): transl_table=11

SEQ ID NO: 87710 - protein, 252 aa, Listeria monocytogenes; identical to SEQ ID NO: 29389

SEQ ID NO: 87711 - DNA, 729 bp, Methanosarcina acetivorans; identical to SEQ ID NO: 29390
  CDS (1)..(729): transl_table=11

SEQ ID NO: 87712 - protein, 242 aa, Methanosarcina acetivorans; identical to SEQ ID NO: 29391

SEQ ID NO: 87713 - DNA, 663 bp, Methanococcus jannaschii; identical to SEQ ID NO: 29392
  CDS (1)..(663): transl_table=11

SEQ ID NO: 87714 - protein, 220 aa, Methanococcus jannaschii; identical to SEQ ID NO: 29393

SEQ ID NO: 87715 - DNA, 648 bp, Methanopyrus kandleri; identical to SEQ ID NO: 29394
  CDS (1)..(648): transl_table=11

SEQ ID NO: 87716 - protein, 215 aa, Methanopyrus kandleri; identical to SEQ ID NO: 29395

SEQ ID NO: 87717 - DNA, 729 bp, Methanosarcina mazei; identical to SEQ ID NO: 29396
  CDS (1)..(729): transl_table=11

SEQ ID NO: 87718 - protein, 242 aa, Methanosarcina mazei; identical to SEQ ID NO: 29397

SEQ ID NO: 87719 - DNA, 666 bp, Methanobacterium thermoautotrophicum; identical to SEQ ID NO: 29398
  CDS (1)..(666): transl_table=11

SEQ ID NO: 87720 - protein, 221 aa, Methanobacterium thermoautotrophicum; identical to SEQ ID NO: 29399

SEQ ID NO: 87721 - DNA, 648 bp, Pyrococcus abyssi; identical to SEQ ID NO: 29400
  CDS (1)..(648): transl_table=11

SEQ ID NO: 87722 - protein, 215 aa, Pyrococcus abyssi; identical to SEQ ID NO: 29401

SEQ ID NO: 87723 - DNA, 906 bp, Pyrobaculum aerophilum; identical to SEQ ID NO: 29402
  CDS (1)..(906): transl_table=11

SEQ ID NO: 87724 - protein, 301 aa, Pyrobaculum aerophilum; identical to SEQ ID NO: 29403

SEQ ID NO: 87725 - DNA, 654 bp, Pyrococcus furiosus; identical to SEQ ID NO: 29404
  CDS (1)..(654): transl_table=11

SEQ ID NO: 87726 - protein, 217 aa, Pyrococcus furiosus; identical to SEQ ID NO: 29405

SEQ ID NO: 87727 - DNA, 759 bp, Salmonella enteritidis; identical to SEQ ID NO: 29406
  CDS (1)..(759): transl_table=11

SEQ ID NO: 87728 - protein, 252 aa, Salmonella enteritidis; identical to SEQ ID NO: 29407

SEQ ID NO: 87729 - DNA, 759 bp, Salmonella typhi; identical to SEQ ID NO: 29408
  CDS (1)..(759): transl_table=11

SEQ ID NO: 87730 - protein, 252 aa, Salmonella typhi; identical to SEQ ID NO: 29409

SEQ ID NO: 87731 - DNA, 759 bp, Shigella dysenteriae; identical to SEQ ID NO: 29410
  CDS (1)..(759): transl_table=11

SEQ ID NO: 87732 - protein, 252 aa, Shigella dysenteriae; identical to SEQ ID NO: 29411

SEQ ID NO: 87733 - DNA, 717 bp, Staphylococcus aureus; identical to SEQ ID NO: 29412
  CDS (1)..(717): transl_table=11

SEQ ID NO: 87734 - protein, 238 aa, Staphylococcus aureus; identical to SEQ ID NO: 29413

SEQ ID NO: 87735 - DNA, 717 bp, Staphylococcus aureus; identical to SEQ ID NO: 29414
  CDS (1)..(717): transl_table=11

SEQ ID NO: 87736 - protein, 238 aa, Staphylococcus aureus; identical to SEQ ID NO: 29415

SEQ ID NO: 87737 - DNA, 717 bp, Staphylococcus epidermidis; identical to SEQ ID NO: 29416
  CDS (1)..(717): transl_table=11

SEQ ID NO: 87738 - protein, 238 aa, Staphylococcus epidermidis; identical to SEQ ID NO: 29417

SEQ ID NO: 87739 - DNA, 687 bp, Streptococcus pyogenes; identical to SEQ ID NO: 29418
  CDS (1)..(687): transl_table=11

SEQ ID NO: 87740 - protein, 228 aa, Streptococcus pyogenes; identical to SEQ ID NO: 29419

SEQ ID NO: 87741 - DNA, 678 bp, Streptococcus pneumoniae; identical to SEQ ID NO: 29420
  CDS (1)..(678): transl_table=11

SEQ ID NO: 87742 - protein, 225 aa, Streptococcus pneumoniae; identical to SEQ ID NO: 29421

SEQ ID NO: 87743 - DNA, 762 bp, Enterococcus faecalis; identical to SEQ ID NO: 29422
  CDS (1)..(762): transl_table=11

SEQ ID NO: 87744 - protein, 253 aa, Enterococcus faecalis; identical to SEQ ID NO: 29423

SEQ ID NO: 87745 - DNA, 26 bp, Primer
atgaaaaccgtaactgtaaaagatct

SEQ ID NO: 87746 - DNA, 27 bp, Primer
ttatgcctggtgtaaaatagttaatac

SEQ ID NO: 87747 - protein, 163 aa, consensus; identical to SEQ ID NO: 29426
  MISC_FEATURE (1)..(163): consensus for the disclosure of xaa see table XV

SEQ ID NO: 87748 - protein, 8 aa, consensus
  MISC_FEATURE (1)..(8): consensus for the disclosure of xaa see table XV
XXXEXRXD

SEQ ID NO: 87749 - protein, 37 aa, consensus; identical to SEQ ID NO: 29428
  MISC_FEATURE (1)..(37): consensus for the disclosure of xaa see table XV

SEQ ID NO: 87750 - protein, 47 aa, consensus; identical to SEQ ID NO: 29429
  MISC_FEATURE (1)..(47): consensus for the disclosure of xaa see table XV

SEQ ID NO: 87751 - protein, 42 aa, consensus; identical to SEQ ID NO: 29430
  MISC_FEATURE (1)..(42): consensus for the disclosure of xaa see table XV

SEQ ID NO: 87752 - DNA, 321 bp, Escherichia coli; identical to SEQ ID NO: 40582
  CDS (1)..(321)

SEQ ID NO: 87753 - protein, 106 aa, Escherichia coli; identical to SEQ ID NO: 40583

SEQ ID NO: 87754 - DNA, 336 bp, Lactobacillus acidophilus NCFM; identical to SEQ ID NO: 40584
  CDS (1)..(336)

SEQ ID NO: 87755 - protein, 111 aa, Lactobacillus acidophilus NCFM; identical to SEQ ID NO: 40585

SEQ ID NO: 87756 - DNA, 318 bp, Borrelia burgdorferi B31; identical to SEQ ID NO: 40586
  CDS (1)..(318): transl_table=11

SEQ ID NO: 87757 - protein, 105 aa, Borrelia burgdorferi B31; identical to SEQ ID NO: 40587

SEQ ID NO: 87758 - DNA, 306 bp, Vibrio cholerae O1 biovar eltor str. N16961; identical to SEQ ID NO: 40588
  CDS (1)..(306): transl_table=11

SEQ ID NO: 87759 - protein, 101 aa, Vibrio cholerae O1 biovar eltor str. N16961; identical to SEQ ID NO: 40589

SEQ ID NO: 87760 - DNA, 312 bp, Bacillus halodurans C-125; identical to SEQ ID NO: 40590
  CDS (1)..(312): transl_table=11

SEQ ID NO: 87761 - protein, 103 aa, Bacillus halodurans C-125; identical to SEQ ID NO: 40591

SEQ ID NO: 87762 - DNA, 327 bp, Lactococcus lactis subsp. lactis Il1403; identical to SEQ ID NO: 40592
  CDS (1)..(327): transl_table=11

SEQ ID NO: 87763 - protein, 108 aa, Lactococcus lactis subsp. lactis Il1403; identical to SEQ ID NO: 40593

SEQ ID NO: 87764 - DNA, 309 bp, Streptococcus pneumoniae TIGR4; identical to SEQ ID NO: 40594
  CDS (1)..(309): transl_table=11

SEQ ID NO: 87765 - protein, 102 aa, Streptococcus pneumoniae TIGR4; identical to SEQ ID NO: 40595

SEQ ID NO: 87766 - DNA, 309 bp, Clostridium acetobutylicum ATCC 824; identical to SEQ ID NO: 40596
  CDS (1)..(309): transl_table=11

SEQ ID NO: 87767 - protein, 102 aa, Clostridium acetobutylicum ATCC 824; identical to SEQ ID NO: 40597

SEQ ID NO: 87768 - DNA, 309 bp, Streptococcus pneumoniae R6; identical to SEQ ID NO: 40598
  CDS (1)..(309): transl_table=11

SEQ ID NO: 87769 - protein, 102 aa, Streptococcus pneumoniae R6; identical to SEQ ID NO: 40599

SEQ ID NO: 87770 - DNA, 309 bp, Streptococcus pneumoniae R6; identical to SEQ ID NO: 40600
  CDS (1)..(309): transl_table=11

SEQ ID NO: 87771 - protein, 102 aa, Streptococcus pneumoniae R6; identical to SEQ ID NO: 40601

SEQ ID NO: 87772 - DNA, 312 bp, Bacillus subtilis subsp. subtilis str. 168; identical to SEQ ID NO: 40602
  CDS (1)..(312): transl_table=11

SEQ ID NO: 87773 - protein, 103 aa, Bacillus subtilis subsp. subtilis str. 168; identical to SEQ ID NO: 40603

SEQ ID NO: 87774 - DNA, 321 bp, Salmonella typhimurium LT2; identical to SEQ ID NO: 40604
  CDS (1)..(321): transl_table=11

SEQ ID NO: 87775 - protein, 106 aa, Salmonella typhimurium LT2; identical to SEQ ID NO: 40605

SEQ ID NO: 87776 - DNA, 336 bp, Listeria innocua Clip11262; identical to SEQ ID NO: 40606
  CDS (1)..(336): transl_table=11

SEQ ID NO: 87777 - protein, 111 aa, Listeria innocua Clip11262; identical to SEQ ID NO: 40607

SEQ ID NO: 87778 - DNA, 306 bp, Listeria innocua Clip11262; identical to SEQ ID NO: 40608
  CDS (1)..(306): transl_table=11

SEQ ID NO: 87779 - protein, 101 aa, Listeria innocua Clip11262; identical to SEQ ID NO: 40609

SEQ ID NO: 87780 - DNA, 357 bp, Listeria innocua Clip11262; identical to SEQ ID NO: 40610
  CDS (1)..(357): transl_table=11

SEQ ID NO: 87781 - protein, 118 aa, Listeria innocua Clip11262; identical to SEQ ID NO: 40611

SEQ ID NO: 87782 - DNA, 330 bp, Clostridium perfringens str. 13; identical to SEQ ID NO: 40612
  CDS (1)..(330): transl_table=11

SEQ ID NO: 87783 - protein, 109 aa, Clostridium perfringens str. 13; identical to SEQ ID NO: 40613

SEQ ID NO: 87784 - DNA, 312 bp, Thermoanaerobacter tengcongensis MB4; identical to SEQ ID NO: 40614
  CDS (1)..(312): transl_table=11

SEQ ID NO: 87785 - protein, 103 aa, Thermoanaerobacter tengcongensis MB4; identical to SEQ ID NO: 40615

SEQ ID NO: 87786 - DNA, 327 bp, Thermoanaerobacter tengcongensis MB4; identical to SEQ ID NO: 40616
  CDS (1)..(327): transl_table=11

SEQ ID NO: 87787 - protein, 108 aa, Thermoanaerobacter tengcongensis MB4; identical to SEQ ID NO: 40617

SEQ ID NO: 87788 - DNA, 321 bp, Streptococcus agalactiae 2603V/R; identical to SEQ ID NO: 40618
  CDS (1)..(321): transl_table=11

SEQ ID NO: 87789 - protein, 106 aa, Streptococcus agalactiae 2603V/R; identical to SEQ ID NO: 40619

SEQ ID NO: 87790 - DNA, 306 bp, Oceanobacillus iheyensis HTE831; identical to SEQ ID NO: 40620
  CDS (1)..(306): transl_table=11

SEQ ID NO: 87791 - protein, 101 aa, Oceanobacillus iheyensis HTE831; identical to SEQ ID NO: 40621

SEQ ID NO: 87792 - DNA, 306 bp, Oceanobacillus iheyensis HTE831; identical to SEQ ID NO: 40622
  CDS (1)..(306): transl_table=11

SEQ ID NO: 87793 - protein, 101 aa, Oceanobacillus iheyensis HTE831; identical to SEQ ID NO: 40623

SEQ ID NO: 87794 - DNA, 300 bp, Lactobacillus plantarum WCFS1; identical to SEQ ID NO: 40624
  CDS (1)..(300): transl_table=11

SEQ ID NO: 87795 - protein, 99 aa, Lactobacillus plantarum WCFS1; identical to SEQ ID NO: 40625

SEQ ID NO: 87796 - DNA, 318 bp, Lactobacillus plantarum WCFS1; identical to SEQ ID NO: 40626
  CDS (1)..(318): transl_table=11

SEQ ID NO: 87797 - protein, 105 aa, Lactobacillus plantarum WCFS1; identical to SEQ ID NO: 40627

SEQ ID NO: 87798 - DNA, 327 bp, Lactobacillus plantarum WCFS1; identical to SEQ ID NO: 40628
  CDS (1)..(327): transl_table=11

SEQ ID NO: 87799 - protein, 108 aa, Lactobacillus plantarum WCFS1; identical to SEQ ID NO: 40629

SEQ ID NO: 87800 - DNA, 306 bp, Vibrio parahaemolyticus RIMD 2210633; identical to SEQ ID NO: 40630
  CDS (1)..(306): transl_table=11

SEQ ID NO: 87801 - protein, 101 aa, Vibrio parahaemolyticus RIMD 2210633; identical to SEQ ID NO: 40631

SEQ ID NO: 87802 - DNA, 330 bp, Enterococcus faecalis V583; identical to SEQ ID NO: 40632
  CDS (1)..(330): transl_table=11

SEQ ID NO: 87803 - protein, 109 aa, Enterococcus faecalis V583; identical to SEQ ID NO: 40633

SEQ ID NO: 87804 - DNA, 336 bp, Enterococcus faecalis V583; identical to SEQ ID NO: 40634
  CDS (1)..(336): transl_table=11

SEQ ID NO: 87805 - protein, 111 aa, Enterococcus faecalis V583; identical to SEQ ID NO: 40635

SEQ ID NO: 87806 - DNA, 303 bp, Bacillus cereus ATCC 14579; identical to SEQ ID NO: 40636
  CDS (1)..(303): transl_table=11

SEQ ID NO: 87807 - protein, 100 aa, Bacillus cereus ATCC 14579; identical to SEQ ID NO: 40637

SEQ ID NO: 87808 - DNA, 306 bp, Photorhabdus luminescens subsp. laumondii TTO1; identical to SEQ ID NO: 40638
  CDS (1)..(306): transl_table=11

SEQ ID NO: 87809 - protein, 101 aa, Photorhabdus luminescens subsp. laumondii TTO1; identical to SEQ ID NO: 40639

SEQ ID NO: 87810 - DNA, 324 bp, Lactobacillus johnsonii NCC 533; identical to SEQ ID NO: 40640
  CDS (1)..(324): transl_table=11

SEQ ID NO: 87811 - protein, 107 aa, Lactobacillus johnsonii NCC 533; identical to SEQ ID NO: 40641

SEQ ID NO: 87812 - DNA, 306 bp, Bacillus cereus ATCC 10987; identical to SEQ ID NO: 40642
  CDS (1)..(306): transl_table=11

SEQ ID NO: 87813 - protein, 101 aa, Bacillus cereus ATCC 10987; identical to SEQ ID NO: 40643

SEQ ID NO: 87814 - DNA, 306 bp, Listeria monocytogenes str. 4b F2365; identical to SEQ ID NO: 40644
  CDS (1)..(306): transl_table=11

SEQ ID NO: 87815 - protein, 101 aa, Listeria monocytogenes str. 4b F2365; identical to SEQ ID NO: 40645

SEQ ID NO: 87816 - DNA, 303 bp, Bacillus thuringiensis serovar konkukian str. 97-27; identical to SEQ ID NO: 40646
  CDS (1)..(303): transl_table=11

SEQ ID NO: 87817 - protein, 100 aa, Bacillus thuringiensis serovar konkukian str. 97-27; identical to SEQ ID NO: 40647

SEQ ID NO: 87818 - DNA, 318 bp, Erwinia carotovora subsp. atroseptica SCRI1043; identical to SEQ ID NO: 40648
  CDS (1)..(318)

SEQ ID NO: 87819 - protein, 105 aa, Erwinia carotovora subsp. atroseptica SCRI1043; identical to SEQ ID NO: 40649

SEQ ID NO: 87820 - DNA, 312 bp, Erwinia carotovora subsp. atroseptica SCRI1043; identical to SEQ ID NO: 40650
  CDS (1)..(312)

SEQ ID NO: 87821 - protein, 103 aa, Erwinia carotovora subsp. atroseptica SCRI1043; identical to SEQ ID NO: 40651

SEQ ID NO: 87822 - DNA, 306 bp, Erwinia carotovora subsp. atroseptica SCRI1043; identical to SEQ ID NO: 40652
  CDS (1)..(306)

SEQ ID NO: 87823 - protein, 101 aa, Erwinia carotovora subsp. atroseptica SCRI1043; identical to SEQ ID NO: 40653

SEQ ID NO: 87824 - DNA, 318 bp, Borrelia garinii PBi; identical to SEQ ID NO: 40654
  CDS (1)..(318): transl_table=11

SEQ ID NO: 87825 - protein, 105 aa, Borrelia garinii PBi; identical to SEQ ID NO: 40655

SEQ ID NO: 87826 - DNA, 318 bp, Yersinia pseudotuberculosis IP 32953; identical to SEQ ID NO: 40656
  CDS (1)..(318): transl_table=11

SEQ ID NO: 87827 - protein, 105 aa, Yersinia pseudotuberculosis IP 32953; identical to SEQ ID NO: 40657

SEQ ID NO: 87828 - DNA, 303 bp, Bacillus cereus ZK; identical to SEQ ID NO: 40658
  CDS (1)..(303): transl_table=11

SEQ ID NO: 87829 - protein, 100 aa, Bacillus cereus ZK; identical to SEQ ID NO: 40659

SEQ ID NO: 87830 - DNA, 300 bp, Bacillus licheniformis ATCC 14580; identical to SEQ ID NO: 40660
  CDS (1)..(300): transl_table=11

SEQ ID NO: 87831 - protein, 99 aa, Bacillus licheniformis ATCC 14580; identical to SEQ ID NO: 40661

SEQ ID NO: 87832 - DNA, 309 bp, Bacillus licheniformis ATCC 14580; identical to SEQ ID NO: 40662
  CDS (1)..(309): transl_table=11

SEQ ID NO: 87833 - protein, 102 aa, Bacillus licheniformis ATCC 14580; identical to SEQ ID NO: 40663

SEQ ID NO: 87834 - DNA, 336 bp, Photobacterium profundum SS9; identical to SEQ ID NO: 40664
  CDS (1)..(336): transl_table=11

SEQ ID NO: 87835 - protein, 111 aa, Photobacterium profundum SS9; identical to SEQ ID NO: 40665

SEQ ID NO: 87836 - DNA, 318 bp, Photobacterium profundum SS9; identical to SEQ ID NO: 40666
  CDS (1)..(318): transl_table=11

SEQ ID NO: 87837 - protein, 105 aa, Photobacterium profundum SS9; identical to SEQ ID NO: 40667

SEQ ID NO: 87838 - DNA, 312 bp, Geobacillus kaustophilus HTA426; identical to SEQ ID NO: 40668
  CDS (1)..(312): transl_table=11

SEQ ID NO: 87839 - protein, 103 aa, Geobacillus kaustophilus HTA426; identical to SEQ ID NO: 40669

SEQ ID NO: 87840 - DNA, 297 bp, Bacillus clausii KSM-K16; identical to SEQ ID NO: 40670
  CDS (1)..(297): transl_table=11

SEQ ID NO: 87841 - protein, 98 aa, Bacillus clausii KSM-K16; identical to SEQ ID NO: 40671

SEQ ID NO: 87842 - DNA, 324 bp, Lactobacillus gasseri; identical to SEQ ID NO: 40672
  CDS (1)..(324)

SEQ ID NO: 87843 - protein, 107 aa, Lactobacillus gasseri; identical to SEQ ID NO: 40673

SEQ ID NO: 87844 - DNA, 312 bp, Haemophilus somnus 2336; identical to SEQ ID NO: 40674
  CDS (1)..(312)

SEQ ID NO: 87845 - protein, 103 aa, Haemophilus somnus 2336; identical to SEQ ID NO: 40675

SEQ ID NO: 87846 - DNA, 303 bp, Listeria monocytogenes str. 1/2a F6854; identical to SEQ ID NO: 40676
  CDS (1)..(303): transl_table=11

SEQ ID NO: 87847 - protein, 100 aa, Listeria monocytogenes str. 1/2a F6854; identical to SEQ ID NO: 40677

SEQ ID NO: 87848 - DNA, 324 bp, Listeria monocytogenes str. 1/2a F6854; identical to SEQ ID NO: 40678
  CDS (1)..(324): transl_table=11

SEQ ID NO: 87849 - protein, 107 aa, Listeria monocytogenes str. 1/2a F6854; identical to SEQ ID NO: 40679

SEQ ID NO: 87850 - DNA, 321 bp, Enterococcus faecium; identical to SEQ ID NO: 40680
  CDS (1)..(321)

SEQ ID NO: 87851 - protein, 106 aa, Enterococcus faecium; identical to SEQ ID NO: 40681

SEQ ID NO: 87852 - DNA, 318 bp, Enterococcus faecium; identical to SEQ ID NO: 40682
  CDS (1)..(318)

SEQ ID NO: 87853 - protein, 105 aa, Enterococcus faecium; identical to SEQ ID NO: 40683

SEQ ID NO: 87854 - DNA, 309 bp, Oenococcus oeni PSU-1; identical to SEQ ID NO: 40684
  CDS (1)..(309)

SEQ ID NO: 87855 - protein, 102 aa, Oenococcus oeni PSU-1; identical to SEQ ID NO: 40685

SEQ ID NO: 87856 - DNA, 324 bp, Oenococcus oeni PSU-1; identical to SEQ ID NO: 40686
  CDS (1)..(324)

SEQ ID NO: 87857 - protein, 107 aa, Oenococcus oeni PSU-1; identical to SEQ ID NO: 40687

SEQ ID NO: 87858 - DNA, 312 bp, Pediococcus pentosaceus ATCC 25745; identical to SEQ ID NO: 40688
  CDS (1)..(312)

SEQ ID NO: 87859 - protein, 103 aa, Pediococcus pentosaceus ATCC 25745; identical to SEQ ID NO: 40689

SEQ ID NO: 87860 - DNA, 312 bp, Streptococcus suis 89/1591; identical to SEQ ID NO: 40690
  CDS (1)..(312)

SEQ ID NO: 87861 - protein, 103 aa, Streptococcus suis 89/1591; identical to SEQ ID NO: 40691

SEQ ID NO: 87862 - DNA, 306 bp, Streptococcus suis 89/1591; identical to SEQ ID NO: 40692
  CDS (1)..(306)

SEQ ID NO: 87863 - protein, 101 aa, Streptococcus suis 89/1591; identical to SEQ ID NO: 40693

SEQ ID NO: 87864 - DNA, 306 bp, Pectobacterium carotovorum; identical to SEQ ID NO: 40694
  CDS (1)..(306): transl_table=11

SEQ ID NO: 87865 - protein, 101 aa, Pectobacterium carotovorum; identical to SEQ ID NO: 40695

SEQ ID NO: 87866 - DNA, 312 bp, Bacillus pumilus; identical to SEQ ID NO: 40696
  CDS (1)..(312): transl_table=11

SEQ ID NO: 87867 - protein, 103 aa, Bacillus pumilus; identical to SEQ ID NO: 40697

SEQ ID NO: 87868 - DNA, 318 bp, Serratia marcescens; identical to SEQ ID NO: 40698
  CDS (1)..(318): transl_table=11

SEQ ID NO: 87869 - protein, 105 aa, Serratia marcescens; identical to SEQ ID NO: 40699

SEQ ID NO: 87870 - DNA, 309 bp, Bacillus subtilis; identical to SEQ ID NO: 40700
  CDS (1)..(309): transl_table=11

SEQ ID NO: 87871 - protein, 102 aa, Bacillus subtilis; identical to SEQ ID NO: 40701

SEQ ID NO: 87872 - DNA, 27 bp, Primer
atggaaaagaaacacatttatctgttt

SEQ ID NO: 87873 - DNA, 26 bp, Primer
ttaatttgctgcggcttttttaatcg

SEQ ID NO: 87874 - protein, 107 aa, consensus; identical to SEQ ID NO: 40704
  MISC_FEATURE (1)..(107): consensus for the disclosure of xaa see table XV

SEQ ID NO: 87875 - protein, 18 aa, consensus
  MISC_FEATURE (1)..(18): consensus for the disclosure of xaa see table XV
XXXXCXXGXXXXXXXXXX

SEQ ID NO: 87876 - protein, 11 aa, consensus
  MISC_FEATURE (1)..(11): consensus for the disclosure of xaa see table XV
DXXXXXPXXXX

SEQ ID NO: 87877 - protein, 21 aa, consensus
  MISC_FEATURE (1)..(21): consensus for the disclosure of xaa see table XV
XXXIXXXXYXXXXGXXXXXXX

SEQ ID NO: 87878 - DNA, 1419 bp, Escherichia coli
  CDS (1)..(1419)
atgcaggaaaatatatcagtaaccgattcatacagcaccgggaatgccgcacaggcaatgctggagaaactgctgcaaatttatgatgttaaaacgttggtggcgcagcttaatggtgtaggtgagaatcactggagcgcggcaattttaaaacgtgcgctggcgaatgactcggcatggcaccgtttaagtgagaaagagttcgcccatctgcaaacgttattacccaaaccaccggcacatcatccgcattatgcgtttcgctttatcgatctattcgccggaattggcggcatccgtcgcggttttgaatcgattggcggacagtgcgtgtttaccagcgaatggaacaaacatgcggtacgcacttataaagccaaccattattgcgatccggcgacgcatcattttaatgaagatatccgcgacatcaccctcagccataaagaaggcgtgagtgatgaggcggcggcggaacatattcgtcaacacattcctgaacacgatgttttactggccggtttcccttgtcagccattttcgctggctggcgtatcgaaaaagaactcgctcgggcgggcgcacggttttgcctgcgatacccagggcacgctgttttttgatgtggtacgcattatcgacgcgcgtcgtccggcgatgtttgtgctcgaaaacgtcaaaaacctgaaaagtcacgaccagggtaaaacgttccgcatcatcatgcagacgctggacgaactgggctatgacgtggctgatgcagaagataatgggccagacgatccgaaaatcatcgacggcaaacattttctgccgcagcaccgtgaacgcatcgtgctggtgggttttcgtcgcgatctgaatctgaaagccgattttaccctgcgtgatatcagcgaatgtttccctgcgcagcgagtgacgctggcgcagctgttggacccgatggtcgaggcgaaatatatcctgacgccggtgctgtggaagtacctctatcgatatgcgaaaaaacatcaggcgcgcggtaacggcttcggttatggaatggtttatccgaacaatccgcaaagcgtcacgcgtacgctgtctgcgcgttattacaaagatggcgcggaaattttaatcgatcgcggctgggatatggccacgggtgagaaagactttgacgatccgctgaatcagcaacatcgtccacgtcggttaacgcctcgggaatgcgcgcgcttaatgggttttgaagcgccgggagaagcgaaattccgtattccggtttcggacactcaggcctatcgccagttcggtaactcggtggtcgtgccggtctttgccgcggtggcaaaactgcttgagccaaaaatcaaacaggcggtggcgttgcgtcagcaagaggcacaacatggccgacgttcacgataa

SEQ ID NO: 87879 - protein, 472 aa, Escherichia coli
MQENISVTDSYSTGNAAQAMLEKLLQIYDVKTLVAQLNGVGENHWSAAILKRALANDSAWHRLSEKEFAHLQTLLPKPPAHHPHYAFRFIDLFAGIGGIRRGFESIGGQCVFTSEWNKHAVRTYKANHYCDPATHHFNEDIRDITLSHKEGVSDEAAAEHIRQHIPEHDVLLAGFPCQPFSLAGVSKKNSLGRAHGFACDTQGTLFFDVVRIIDARRPAMFVLENVKNLKSHDQGKTFRIIMQTLDELGYDVADAEDNGPDDPKIIDGKHFLPQHRERIVLVGFRRDLNLKADFTLRDISECFPAQRVTLAQLLDPMVEAKYILTPVLWKYLYRYAKKHQARGNGFGYGMVYPNNPQSVTRTLSARYYKDGAEILIDRGWDMATGEKDFDDPLNQQHRPRRLTPRECARLMGFEAPGEAKFRIPVSDTQAYRQFGNSVVVPVFAAVAKLLEPKIKQAVALRQQEAQHGRRSR

SEQ ID NO: 87880 - DNA, 1428 bp, Salmonella typhi
  CDS (1)..(1428): transl_table=11
atgtatagcgcgagaaatgagcctgcaataactgcattgctaaatgatgagacacattcctctatccataaattattggttcaggttgcaagtatctatgacgtaaaagatttggctgcgcaacttaatgctgcaaccggcagcgactggtcgagggcatcacttattcgccagatcaaaggttcagttaatgaatgtcgaataacccaggaagaatatcattatcttcgatcgttgctcccctcacgcccagcagactatgaccagaaatttttccgttttattgacttgtttgctgggatcggtggcctccggagtggttttgacgccattggcgggaaatgcgtgtttacaagcgaatggaatcagttctcccgccggacatacagtgcaaactggtactgcgaagataccgagcaccatttcaactcagatatccgggacattacactcagcaatcttcccgatgtgtcggaagaccaggcgtatgcttctatcgctgcatccattcctgaccatgatgttttgctcgccggtttcccgtgccagccgttcagtattgccggtgtcagcaaaaagaactctttgggccgaaaacacggctttgaatgcgacacccaggggacccttttttttgatgtcgcccggatcatccgagccaaacagcctgccattttcgttcttgagaacgtaaaaaatctgaagagccacgataagggaaatacgttccgcatcatcatgaaagcgcttgatgaacttggctacgatgttgccgactgcgatgctcacggatcaaaggaccccaaaataattgacggtaagaacttcaggcctcagcaccgggaacgtatcgtgttggttggattcaggcgcgatctgaagctccatgatggcttttcgttaagtggtgtatcggctctttatccttcacgacggccaacccttggggagctgctggacgctgaggtcgatagccgttacatcctttctccaaagctctgggagtacctttataactacgctaaaaagcaccaggcaaaaggtaatggatttggcttcggactggtaaatccacttgataaatcagttgtttgcagaacactcagcgcacggtactatcgtgatggctctgaaattttgctagaccgtggatgggatcacagcataggcgaaaaggactttaatgatcctgtaaatatggcaaggcgcccgcgccgtttaaccccgcgagaatgtgcccgccttatgggattcgagcaaccgggaaaagttacttttcgcattccagtctctgatacccaggcctatcgccagttcggcaattcggtcatcgtcgacgtatttgcggccgtggccagtttgcttcgaagccgtattgagatcgccgttgcggctcgtctcaagggagagtttgaagcggcatcatag

SEQ ID NO: 87881 - protein, 475 aa, Salmonella typhi
MYSARNEPAITALLNDETHSSIHKLLVQVASIYDVKDLAAQLNAATGSDWSRASLIRQIKGSVNECRITQEEYHYLRSLLPSRPADYDQKFFRFIDLFAGIGGLRSGFDAIGGKCVFTSEWNQFSRRTYSANWYCEDTEHHFNSDIRDITLSNLPDVSEDQAYASIAASIPDHDVLLAGFPCQPFSIAGVSKKNSLGRKHGFECDTQGTLFFDVARIIRAKQPAIFVLENVKNLKSHDKGNTFRIIMKALDELGYDVADCDAHGSKDPKIIDGKNFRPQHRERIVLVGFRRDLKLHDGFSLSGVSALYPSRRPTLGELLDAEVDSRYILSPKLWEYLYNYAKKHQAKGNGFGFGLVNPLDKSVVCRTLSARYYRDGSEILLDRGWDHSIGEKDFNDPVNMARRPRRLTPRECARLMGFEQPGKVTFRIPVSDTQAYRQFGNSVIVDVFAAVASLLRSRIEIAVAARLKGEFEAAS

SEQ ID NO: 87882 - DNA, 1158 bp, Streptococcus pneumoniae bacteriophage MM1
  CDS (1)..(1158): transl_table=11
atgaaattcttagacttatttgctggcattggaggttttaggatcggcatggaatcagccgggcatgaatgtataggattttgtgaaatagacaaattcgctagagctagttataaagctatacacgatacgaaaggagaaattgaattacatgacatcacaacagtatcagatgacactattcgaggaatcggacatgttgatgttatctgtggaggatttccgtgccaggctttcagcattgcaggaaacagacgaggatttgaagatacaagaggaactctcttctttgaaatcgcaaggttcgcatctattctcaaacccagatatctattccttgaaaacgtcaagggactcctcaaccacgacagaggaaatacctttgaggtcatcctctcagcgttggatgaactggggtatgatgtggaatggcaagtgcttaacagcaaaaattttggagtcccccaaaatcgggaacgtgtgttcattatcggacatcttagaggaggaagtggacgaaaggtatttcctctcagcggagatggtgcagcgattacttgtgaacaaccaaaaataaacaaggttggaaatactagaaaaaaagggaaatcgcaaagtggtgatgtcgtctcaattgactcattagctcccaccctgtgtagtactacgacacaaaaagatccgttaaaagttttaattgaaaatgaaataaagcagtttggtgttctgcaaccaaactacaatcaaagcggcgttgtttatgagattgatggtatttcaccaacaatcagagcgtatcaaggaggaaatcttgaacctaaaatcagagtaaaagaagcaaccaagcaaggctaccaagaggctgaaattggagatagtgtaaacctatcgcatccaaactctaaaacacgcagagggcgagtaggtaagcagatagcaaatactctcttaactggagagagtcaaggtgtggttgagcctgattttaggattaggaagctaacacctagagaatgctggaggttacaaggttttcctgattgggcttttgataaggcgcaggaggtcaactctaacagtcaattatacaagcaagcaggcaatagcgtaacagtaaacgttatttctgcaatagcacaggggttaggaggaaattaa

SEQ ID NO: 87883 - protein, 385 aa, Streptococcus pneumoniae bacteriophage MM1
MKFLDLFAGIGGFRIGMESAGHECIGFCEIDKFARASYKAIHDTKGEIELHDITTVSDDTIRGIGHVDVICGGFPCQAFSIAGNRRGFEDTRGTLFFEIARFASILKPRYLFLENVKGLLNHDRGNTFEVILSALDELGYDVEWQVLNSKNFGVPQNRERVFIIGHLRGGSGRKVFPLSGDGAAITCEQPKINKVGNTRKKGKSQSGDVVSIDSLAPTLCSTTTQKDPLKVLIENEIKQFGVLQPNYNQSGVVYEIDGISPTIRAYQGGNLEPKIRVKEATKQGYQEAEIGDSVNLSHPNSKTRRGRVGKQIANTLLTGESQGVVEPDFRIRKLTPRECWRLQGFPDWAFDKAQEVNSNSQLYKQAGNSVTVNVISAIAQGLGGN

SEQ ID NO: 87884 - DNA, 1068 bp, Helicobacter pylori 26695
  CDS (1)..(1068): transl_table=11
atgaattataaaattttagatttattttgtggggctgggggttttagcgctgggttagagtgtttagaagagtttgacgctttaatagggctagattgcgataaacaagccctaatcacttttgaaaacaaccataaaaacgccataggcgtttgtggggacatcactcaaaccgaaattaaagaaaaagtcatcaaactagctaaaaaattagaaatcaacatgatcattggcgggcctccatgtcaaggcttttctaataaagggaaaaatttagggctaaaagaccctaggaattttttattcttagaatatatagaaatagtcaaagccataaagccagaaatttttatcattgaaaacgtgaaaaacctcatctcttgcgctaaaggctattttttagaagaaattaaagaaaggttgaacgctttagggtatcaattgagctatcaaatcctaaacgctaaagattatggcgtgcctcaaaacagagagagagcctttattgtaggggctagtcgtttcagttttgatttcaatcttttagagccttctcaaagcgtgaatgttcaagatgccataagcgatttagcctatctttgttctaatgagggggcgtttgagagcgattatttaaaccctatccaatcaagctatcaagctttaatgcgaaaagatagccctaaattatacaaccatcaagccaccaaccactcgcaagccgctttagagaaattaaaactcattaacaaagaacaaggcaaagaatgcttgcctaaaaacttgcatggcaaacagcaattcaaaagcacatgggggcgcctgaattggaataaaatcagccccaccatagacacacgatttgacactcccagcaatggcaccaactcccaccccgaattgcaccgctctatcacgcctagagaagccgctaggatacaaagttttagcgataattatatcttttatggcaataaaacgagcgtttgtaagcaaatcggtaacgctgtgcctcctcttctagccctagccttaggcaaagcgatcttaaaaagcttaagaaaatga

SEQ ID NO: 87885 - protein, 355 aa, Helicobacter pylori 26695
MNYKILDLFCGAGGFSAGLECLEEFDALIGLDCDKQALITFENNHKNAIGVCGDITQTEIKEKVIKLAKKLEINMIIGGPPCQGFSNKGKNLGLKDPRNFLFLEYIEIVKAIKPEIFIIENVKNLISCAKGYFLEEIKERLNALGYQLSYQILNAKDYGVPQNRERAFIVGASRFSFDFNLLEPSQSVNVQDAISDLAYLCSNEGAFESDYLNPIQSSYQALMRKDSPKLYNHQATNHSQAALEKLKLINKEQGKECLPKNLHGKQQFKSTWGRLNWNKISPTIDTRFDTPSNGTNSHPELHRSITPREAARIQSFSDNYIFYGNKTSVCKQIGNAVPPLLALALGKAILKSLRK

SEQ ID NO: 87886 - DNA, 981 bp, Bacillus halodurans C-125
  CDS (1)..(981): transl_table=11
atggttaaaacaaattttacagccgtttccctgtttagtggtgcaggtgggcttgatatggggtttgaacgcataggttttaaaattatttgggcaaatgatatagatgaagatgcttgtgcaactcatcgactttggagcgatgcagaagtagtacaaggtgatatttcaaagatagatgtctctacaataccaagtgctgatattttgttgggtggctggccttgtcaaggatttagtttagcgggtcctagacaactggatgatagccggaataccctctataagtactatgtaaaatacttggaagaaaagaaaccccttgcttttgttggcgagaacgttaaaggtatgctgactttgggaaatggtgaaattttcaaggcgatcataagtgatatggacaaaaaaggatatacgctattttataaattgttgaacgcaaaagattatagcgttccacaaaatcgtgagcgagtaataattgtaggttttcgaaatgatttaggtatcacagaatttacttttccagagaaacacgacaaaattgtaacccttagagaggcactagccgatttaccagaaccatcacctgaggatatttgtgatgcaccatatagttctcgatttatgagtcgaaatagaaaaaggaattgggatgaagtgtcttatactattccagccatggcaaaacaagttcctctgcatccaagttcccctgatatggtgaaacttggaaaggatttgtggaagtttggtgagaatggggtaacaagacgtttttcatggcaagaagctgctgccatccaaacatttccacgtgacatgcattttgttggtgaattaactagcaaatataaacaaatcggtaatgcagtcccagtaaaattggctgaagccgtagcagaaaaagtgtatgaaaaactaaatgagtgtttacgaaataatcagcaagaatataaagaaaaggtggtggtgtaa

SEQ ID NO: 87887 - protein, 326 aa, Bacillus halodurans C-125
MVKTNFTAVSLFSGAGGLDMGFERIGFKIIWANDIDEDACATHRLWSDAEVVQGDISKIDVSTIPSADILLGGWPCQGFSLAGPRQLDDSRNTLYKYYVKYLEEKKPLAFVGENVKGMLTLGNGEIFKAIISDMDKKGYTLFYKLLNAKDYSVPQNRERVIIVGFRNDLGITEFTFPEKHDKIVTLREALADLPEPSPEDICDAPYSSRFMSRNRKRNWDEVSYTIPAMAKQVPLHPSSPDMVKLGKDLWKFGENGVTRRFSWQEAAAIQTFPRDMHFVGELTSKYKQIGNAVPVKLAEAVAEKVYEKLNECLRNNQQEYKEKVVV

SEQ ID NO: 87888 - DNA, 1014 bp, Neisseria meningitidis MC58
  CDS (1)..(1014): transl_table=11
atgaaaaataaaatacaaaatcaattagataatatagttaccttaaataatgagaaatttacttttattgatttatttgcgggaataggtggttttcgcattgcaatggagaatgttggtgggcgatgtgtattttctagtgaatgggatgataaagcccgtcaaacctaccaagtaaattttaatgatattccttatggagatattacattaaaggaaaccaaagcagctattccaagtaagtttgatgtattaacagcaggattcccgtgtcagccattctctatagctggtgtttcaaagaaaaaaagcctaggacgagaaacaggcttcttagataaggcgcagggaactctattttttgatgttgctgaaattattggaaaacatcgacctaaaatttttcttttagagaatgtgaaaaaccttgtttcgcatgacaaaggaaatacatttaaagtaattaaagggactttagaagagcttgactatcagatattttatcaagttatgaatgcaaaatattatgttcctcaaaatagggagcgtatttttattgtaggttttgatagacaatattttaataaggaaataaatttcaattttccttccccaccagaatcacaaccaaaattaaagcaaattttggaagatgatgtagataattcttttactctttctgataacttatggctttaccttcaaaattacgctaaaaaacataaggcaaagggtaatggatttggttttggattagttgatttagatggaatatcacgaactctatctgcacgatattacaaagatggttccgaaatactcatccctcagaaaggaaaaaatcctaggaagctgacacctagggagtgctcgcgtttaatgggatttcctaaagattttgttattgatgcagtatccaagacagctgcatacaagcagtttggcaattcaattgctgtaccgttggttcaagctattgctaaacaaattataaatgagttaaaaaatgaatga

SEQ ID NO: 87889 - protein, 337 aa, Neisseria meningitidis MC58
MKNKIQNQLDNIVTLNNEKFTFIDLFAGIGGFRIAMENVGGRCVFSSEWDDKARQTYQVNFNDIPYGDITLKETKAAIPSKFDVLTAGFPCQPFSIAGVSKKKSLGRETGFLDKAQGTLFFDVAEIIGKHRPKIFLLENVKNLVSHDKGNTFKVIKGTLEELDYQIFYQVMNAKYYVPQNRERIFIVGFDRQYFNKEINFNFPSPPESQPKLKQILEDDVDNSFTLSDNLWLYLQNYAKKHKAKGNGFGFGLVDLDGISRTLSARYYKDGSEILIPQKGKNPRKLTPRECSRLMGFPKDFVIDAVSKTAAYKQFGNSIAVPLVQAIAKQIINELKNE

SEQ ID NO: 87890 - DNA, 1236 bp, Neisseria meningitidis Z2491
  CDS (1)..(1236): transl_table=11
atgactatttcgacaatggcacagacacacgatactcgattacaaaaaactttgctctttcccagtcaacaaggttggaaatctaaaacttttcttaaacctgattcacatattagattagcaaccgtattcagcgggattggtgcggttgaacaggcattccaccgattaaatttaaaccataccattgtttttgcaggagatattgatccatacgttaaaaaaagttatcttggaaactataaattaaatgaagatttttggcataacgacattactcaatttgatgcgagcaagtttagaaatcaagttgatattttagttggaggcagtccttgccaagcattttccatggttggcaaacgtgcaggattagaagatacacgaggaacattattctatgaatttgctcgcgttgtggatgaagtccaaccaaagatatttatttatgaaaatgtaaagggcttgctcaatcatgataatggaaaaacttggaaagttgtaaaaagtgttttttattcacttggttatgacttatatttccaaataatgaatagtaaggattatgggattcctcaacatcgtgagcgtatttttgttgttggctttcatacccctcctataaatggttttcagtttcctgaaaagattgaattagaacatactatgcaagattttttggaggactatactgatagcaaatattttttacgtgaaaagggtgcgaaatttgttaccagttctaaaaatagacaaaaacgttatacacagattaatggagaaattgccttatgccaaaaagcaaatcaacaatttaattggcatggtgattttatttttcaggcagcccgcgaatctgaatttgatgactttatttttgatgtaaataacgttgaggaaaaatattatctttctgaaaaaatcaaaaattatgttttggcaggaggaacaaaaaattttaaaaccagtacggaaactgatttgcctgtagctcgcccattattgcaaactatgcataaaatgcatcgtgccggggttgataattatgttactcataatcgtggacgtattcgtaaattaacacctagggaatgtttgcggctaatgggttttagagatgattttaaaattttagttagtgatactcaaatgtatcgccaagcgggaaacagtattgttgttgatgtattaatcgctatattaaaacaaatggatattacgctttatggagagtaa

SEQ ID NO: 87891 - protein, 411 aa, Neisseria meningitidis Z2491
MTISTMAQTHDTRLQKTLLFPSQQGWKSKTFLKPDSHIRLATVFSGIGAVEQAFHRLNLNHTIVFAGDIDPYVKKSYLGNYKLNEDFWHNDITQFDASKFRNQVDILVGGSPCQAFSMVGKRAGLEDTRGTLFYEFARVVDEVQPKIFIYENVKGLLNHDNGKTWKVVKSVFYSLGYDLYFQIMNSKDYGIPQHRERIFVVGFHTPPINGFQFPEKIELEHTMQDFLEDYTDSKYFLREKGAKFVTSSKNRQKRYTQINGEIALCQKANQQFNWHGDFIFQAARESEFDDFIFDVNNVEEKYYLSEKIKNYVLAGGTKNFKTSTETDLPVARPLLQTMHKMHRAGVDNYVTHNRGRIRKLTPRECLRLMGFRDDFKILVSDTQMYRQAGNSIVVDVLIAILKQMDITLYGE

SEQ ID NO: 87892 - DNA, 978 bp, Sulfolobus solfataricus P2
  CDS (1)..(978): transl_table=11
ttggagctaataaaaatcattgatctattttctggagctggaggattttcattaggttttaaaaaactaggaatagaacctaaattagcaatagacataaatcatgcagcaactagaacatattcattaaattttccaaatacaatagtaatagaagatgatataagagaaataagtggaggagaaatcttaaaaaacgtggggaatgatatagacgtagtaattggaggccctccatgtgagggatatactgcagctaaccccttacgtatgcaagatcctttagacagactatatttagatcaaagagggaatttaacactggaattcataaggattgtggacgaagtgaaaccgaaaatttttgttatggaaaatgttccagcaattatagaaactcaatcattaagagatgctctgatcaatgaatttaagaaagctggatatggcaatatattcttcaatatactacatgctgaagattatggtaatccatctaaacgaagtagagtgttcatctcaaacgttagaatatcacctattaaaaatcaaaaaagaatcacagtttacgacgcgattcatgatttagataacaagctggatgttcctaataacgaagtaagtgagcctaatgagaaaaaacttctgaaaatttctaaaattggatatggtaagtatttaacaatgtatagggcgagtaaaggaagaagtataccattatatatcagactttctccatttgatctagcacctacgattttgggcaattccagatttatacacccattccatgatagattcttaactgtaagagaacaagctagactaatgagttatcctgacgatcatgtatttttaggaagtaaagatgagcaatataatcaagtaggtgaatctgttccagtagccttatctactgctatagctaaagagattttgggtatcttaaatgaaagaactatatttcggcctacataa

SEQ ID NO: 87893 - protein, 325 aa, Sulfolobus solfataricus P2
MELIKIIDLFSGAGGFSLGFKKLGIEPKLAIDINHAATRTYSLNFPNTIVIEDDIREISGGEILKNVGNDIDVVIGGPPCEGYTAANPLRMQDPLDRLYLDQRGNLTLEFIRIVDEVKPKIFVMENVPAIIETQSLRDALINEFKKAGYGNIFFNILHAEDYGNPSKRSRVFISNVRISPIKNQKRITVYDAIHDLDNKLDVPNNEVSEPNEKKLLKISKIGYGKYLTMYRASKGRSIPLYIRLSPFDLAPTILGNSRFIHPFHDRFLTVREQARLMSYPDDHVFLGSKDEQYNQVGESVPVALSTAIAKEILGILNERTIFRPT

SEQ ID NO: 87894 - DNA, 1224 bp, Streptococcus pneumoniae TIGR4
  CDS (1)..(1224): transl_table=11
atgatttgggttttagatttatttgctgggataggaggctttaggatgggaatggaagctcaagggcatgagtgcttgggattttgtgagattgataaatttgctaggaaatcttataagtccatttttcaaacggaaggagaaatagaatttcatgacatacgagatgtttcagatgacgaatttaaaaaacttagagggaaagtcgatgtcatctgtgggggattcccttgtcaagcattttcaatcgcaggaagacgattgggatttgaagatactagaggaactttgttctttgaaattgctcgggcggccaaacaaatccaaccacgttttctttttcttgaaaatgttaaaggcctactcaatcacgataagggacggacgttcaccacaatacttaccacacttgatgagttggggtttgatgttgagtggcaggtgcttaacagtaaggattttggcgttcccaaaaacagagagagggtgtttattatcggacattctagaaagaaaggtaccagactcttatttcctttcagacgagaaggtcaagcaactaactctgagactttgaaagcactaggaaatttgaatccatcaagaagtggaatgagcggtaaagtctattattcagaaggtcttgcgccaaccttagttcgtggtaaaggagaaggatttaaagttgcgattccttgtatgacaccagatagattagacaagagacaaaatgggagacgctttaaggaaaatcaagagccgatgtttactttaaatactcaggatcgttatggcattgtcgttgttggagatttaccgactagctttaaggagacaggtcgtgtctatggaagtgagggcttatctccaacactgactacgatgcaaggaggagataaaatccccaaaatactaattccagaaccaatccaatttctaaaagtacgggaagcaacgaaaaaaggatatgctcaagcagagattggggattcaatcaatttagaaagaccaagttctcagtatcgtcgtggtagagttggaaaaggtatagctaatacgttaacaactagtggtcaaatgggagtagtagtggctagctatgaaggagaagataaacaagtttaccaagtagctggtgttttaatagatggacaattttaccgtttgagaatacgacgaatcactcctaaagagtgttttcgattgcatggctttcctgattag

SEQ ID NO: 87895 - protein, 407 aa, Streptococcus pneumoniae TIGR4
MIWVLDLFAGIGGFRMGMEAQGHECLGFCEIDKFARKSYKSIFQTEGEIEFHDIRDVSDDEFKKLRGKVDVICGGFPCQAFSIAGRRLGFEDTRGTLFFEIARAAKQIQPRFLFLENVKGLLNHDKGRTFTTILTTLDELGFDVEWQVLNSKDFGVPKNRERVFIIGHSRKKGTRLLFPFRREGQATNSETLKALGNLNPSRSGMSGKVYYSEGLAPTLVRGKGEGFKVAIPCMTPDRLDKRQNGRRFKENQEPMFTLNTQDRYGIVVVGDLPTSFKETGRVYGSEGLSPTLTTMQGGDKIPKILIPEPIQFLKVREATKKGYAQAEIGDSINLERPSSQYRRGRVGKGIANTLTTSGQMGVVVASYEGEDKQVYQVAGVLIDGQFYRLRIRRITPKECFRLHGFPD

SEQ ID NO: 87896 - DNA, 945 bp, Clostridium acetobutylicum ATCC 824
  CDS (1)..(945): transl_table=11
ttggaggaaaatattataataaaaacgttagagctattcggaggaataggcgcaccaagaaaagcatttaaaaatattggaatagacataaaggctattgattacgtagagatagatccaaagccagtaaaaacttataatgaaatgtttaaaaaggatttaatgtataaaacgcaaaatgtcattggatataatctcaaaccagatgttttgatacatggaagtccttgccaagatttttcaatagcagggtatcaaaagggagcagagcaaggtagtgagacaaggtcaagtcttatgtgggagactatcagcataattaaacaaatgggtatttggaaacctcgagttgtagtatgggaaaatgtaaaaaatgtgctatcaaagcacatgaaacataactttgataagtatttagaagaaatgaaaaaaatgggatataccaataactatgaaatactaaatgctatggattttggactgcctcagcgtagggaaagagtttttacgattagctgtttagatggtaaaaaatttgattttgataaattggagcataggaaactaagacctttatcatcttttttacaaactaatgttgatgagtactatactgttacccaacctagtattctgagagccataggtaaaaaaggtgtcagtagagccacaataataaaagattattgctatacaataacaactcgacaagataggtgtcctgctcaagttatcagtctaggaaatggaaaatatcgttttctaaccgaaaaggagtgttggttattacaaggcttttcagaagaagattttgaagcagccgcaaaagtgaatagtcgaagagatttatataagcaggcaggaaatagtattccagtaacgatactagaaagtattttcaaacaggttttagaggaatggaataataaacaaatagctgtgtaa

SEQ ID NO: 87897 - protein, 314 aa, Clostridium acetobutylicum ATCC 824
MEENIIIKTLELFGGIGAPRKAFKNIGIDIKAIDYVEIDPKPVKTYNEMFKKDLMYKTQNVIGYNLKPDVLIHGSPCQDFSIAGYQKGAEQGSETRSSLMWETISIIKQMGIWKPRVVVWENVKNVLSKHMKHNFDKYLEEMKKMGYTNNYEILNAMDFGLPQRRERVFTISCLDGKKFDFDKLEHRKLRPLSSFLQTNVDEYYTVTQPSILRAIGKKGVSRATIIKDYCYTITTRQDRCPAQVISLGNGKYRFLTEKECWLLQGFSEEDFEAAAKVNSRRDLYKQAGNSIPVTILESIFKQVLEEWNNKQIAV

SEQ ID NO: 87898 - DNA, 1248 bp, Clostridium acetobutylicum ATCC 824
  CDS (1)..(1248): transl_table=11
atgcacactcataaatttactgtaggaagtctgtttgcaggggttggaggaatctgtttgggattcaaaacagcagagtatagaggactgggatataatcttatatgggcaaatgaaatagatgaatatgcaggagaaacatataggcataattttgaccataatttaatagctggtgatattgaaaagatagtagacttgaatataattcaaagtgagcaaaatagatatataaatatcatgaatgaagttgctactgatgaagaaaggataaagtataaggttctgatagaaaaatgtgaggaagagaagcaaatatacagagaaaagcaaaaacaaattttaagttcgaaaatagatgtattaaatggtggatttccgtgccaggcgtttagtatagcaggagagcaaaagggatttgatgaccatagaggaaacttgtttataagcattataaaattaattagattacttgattcggttcatggaaaaccaagagtattatttttagaaaatgttaaaaatttgatgtcacatgatggtggaagaacatataaagttataaaatcaaaacttgaaaaagaaggatatataataaaagaaaaggtattaaatacaatggatttttctcatttaccccagaatagagagagaatatatatagttggatttttaaataaaaaagatgctgaaaagttcactatgtttgataatataggggagttttatatcaataaaacagttgatgaaagagtgagagatattaagaaagttatcgattatacgttaactaaaaatactggagataagtattattatacaaaagaaaaatatcctaaatattttattacagaagaagagtatgataaaattccagaaagttatagaaaagatgtaagaataaatttggatgaatcaataacagaagaatatcaattttatcaacttagaagaggaatgtatgttagaaaaaatatgagtaatgtatgtccaacgttaacggctaacatgggaactggtggacacaatgtaccattaattaaagtaaaggatggaattagaaaacttacgcctaaagaaacttttaaacttcaaggctttcctgttggtaatgggtatgaacttccaactaaatatattaatagaccttatcctgaaagtagattgtataaacaggcaggaaatgcagtatcagtaccaattataagattaatagcagaacagattttgagggtattagaagaatag

SEQ ID NO: 87899 - protein, 415 aa, Clostridium acetobutylicum ATCC 824
MHTHKFTVGSLFAGVGGICLGFKTAEYRGLGYNLIWANEIDEYAGETYRHNFDHNLIAGDIEKIVDLNIIQSEQNRYINIMNEVATDEERIKYKVLIEKCEEEKQIYREKQKQILSSKIDVLNGGFPCQAFSIAGEQKGFDDHRGNLFISIIKLIRLLDSVHGKPRVLFLENVKNLMSHDGGRTYKVIKSKLEKEGYIIKEKVLNTMDFSHLPQNRERIYIVGFLNKKDAEKFTMFDNIGEFYINKTVDERVRDIKKVIDYTLTKNTGDKYYYTKEKYPKYFITEEEYDKIPESYRKDVRINLDESITEEYQFYQLRRGMYVRKNMSNVCPTLTANMGTGGHNVPLIKVKDGIRKLTPKETFKLQGFPVGNGYELPTKYINRPYPESRLYKQAGNAVSVPIIRLIAEQILRVLEE

SEQ ID NO: 87900 - DNA, 1125 bp, Caulobacter crescentus CB15
  CDS (1)..(1125): transl_table=11
atgaatcggaacggtcaacggcgttttctggagttcttcgccggcggcggcatggcccgcctcggcctgggcgccgattgggcgtgcgccttcgccaacgacttcgatccggtcaaggcggcgacctatcgcgccaacttcgcggacgcgggtaagcacttccaggaaggcgatgttttcgcgctcagcgccgagcgcttgcccgacgccgatttggcctgggcgtccagcccttgccaggacttcagcttggcgggcgcgcgcgcgggtctggcgggcgggcgttcttcggccttcttcggcttctggagcctgatgcggtccctctcggcggagggtcgcgcgccgtccgtgatcgtgatcgagaacgtggtcggccttctgacctcgcatggcggcgccgacttcaccgcgctgtgccaggccctgcatgaggaaggctatcgcttcggtgcgctggagatcgacgccggcgccttcgtgcctcagtcccggccccgcgtgttcgtggtcgccacgcgaaacccgcccggcgaccttgtcggctccagcgccttccacacgcgggccgttcgcgaggcggccgcgcgtctgcccgccgatctgcaggcgagctgggtctggtggggcgcgccgtcgccgcccgcgcgcaatacagacctcgcttcgatgctggagcccgacgacagggctgtctggaacccgccggaacgcaccgcagccctgctggcgctcatggcgccatcgcatcgcgccgccgtcgaggcgcgccgggccgggcgcgagcgggccgtgggcgcggtcttccggcgcatgcgcggcggcgagcagcgcgccgaggtccggttcgatggtctggccggatgcctgcggacgccgcgcggcggctcctcgcgccagaccttgctggtgatcgacgggggcgaagttcgctcgcgcctgatctcaccccgcgaagccgcgcgcctgatgggcctgcccgacagctaccagctgcccaagtcgcagaccgcaggcttgcaggtgatgggcgacggcgtcgccgtccccgtcgtgcgctggctggcggaaaccctgctggtcccgctcgttgatagcaaaactgcaagcctcgccgccgaatga

SEQ ID NO: 87901 - protein, 374 aa, Caulobacter crescentus CB15
MNRNGQRRFLEFFAGGGMARLGLGADWACAFANDFDPVKAATYRANFADAGKHFQEGDVFALSAERLPDADLAWASSPCQDFSLAGARAGLAGGRSSAFFGFWSLMRSLSAEGRAPSVIVIENVVGLLTSHGGADFTALCQALHEEGYRFGALEIDAGAFVPQSRPRVFVVATRNPPGDLVGSSAFHTRAVREAAARLPADLQASWVWWGAPSPPARNTDLASMLEPDDRAVWNPPERTAALLALMAPSHRAAVEARRAGRERAVGAVFRRMRGGEQRAEVRFDGLAGCLRTPRGGSSRQTLLVIDGGEVRSRLISPREAARLMGLPDSYQLPKSQTAGLQVMGDGVAVPVVRWLAETLLVPLVDSKTASLAAE

SEQ ID NO: 87902 - DNA, 945 bp, Pyrobaculum aerophilum str. IM2
  CDS (1)..(945): transl_table=11
gtgtacagcgcagtggatttattcgcaggcgggggcgggtttgggctgggctttagaatggcggggtttaaaattgctgttgctgtagatattgacagagatgccgtgaggacttacagcgccaatcacagatacacaatcattatacaagaagacatcagatatatagactatggggatttgttaaaatatgcgggtgatgtcgatgtaattatcggtagcccgccctgcgagccgttcaccgcggcaaatcccaatagaatggaggacccggcagataggctttacacagaccccgcgggccaattaactttagagttcataaggctagtgggcgaaatagggcccaaggtctttgtaatggagaacgtggccgccctcgccgaagagcctctcaggacttacattaaaagggagtttaagagagttggatacgaggtttattttaatatactacacgccgaggactacggagtgcctagtagaagaaggagggtatttgtatcaaatatagaaattagacctgttaagtctaggcgggttacagtaagagaggcgttgcgcgacttacctcctcctgacagcggcatagttcccaaccacgagactacgactttaagcccgaagaaacaagaaagaatttccaagctgaagcccggcgaggccttaatgagatatagaggggcaggcggcttttatgaaaattatatacgcctcatgtgggacgacatagcgcccacggtaatgggctctaggcggtttatacaccccgaggagcacagggtattaacagtgcgggagcaggccaggctaatgggctatcccgacggatatatattcctcggctcaaaggagtctcagtataaccaggttggcgagagcgtcccgccgccgctatcatacgccatagccctagaggttaaaaaatatttagagggtcgttga

SEQ ID NO: 87903 - protein, 314 aa, Pyrobaculum aerophilum str. IM2
MYSAVDLFAGGGGFGLGFRMAGFKIAVAVDIDRDAVRTYSANHRYTIIIQEDIRYIDYGDLLKYAGDVDVIIGSPPCEPFTAANPNRMEDPADRLYTDPAGQLTLEFIRLVGEIGPKVFVMENVAALAEEPLRTYIKREFKRVGYEVYFNILHAEDYGVPSRRRRVFVSNIEIRPVKSRRVTVREALRDLPPPDSGIVPNHETTTLSPKKQERISKLKPGEALMRYRGAGGFYENYIRLMWDDIAPTVMGSRRFIHPEEHRVLTVREQARLMGYPDGYIFLGSKESQYNQVGESVPPPLSYAIALEVKKYLEGR

SEQ ID NO: 87904 - DNA, 1272 bp, Methanosarcina mazei Go1
  CDS (1)..(1272): transl_table=11
atggaatcaaaatatacagttcttgatatgttttctggcgcaggagggcttacagaagggttctttcagcagggattcaaatttgtttctcatatagagaaaaattgtcatgctaggaattctctggaaaccagagcgatttatcattctctgaaagattccagcaacgaaaggatttatagagactatatttcaggaaatctcaacagagatgaatttattcataaattcaaagagcttgaactcactccagctggattattacagggggaagtaactgaatcaaacgaaactactatgataaaagagattaaagagcatttaaaagtcattgacagcgattcggttgatgtcgttataggagggccaccatgtcaggcttattctgttgccgggagaggcagaaagccaaaagaaatgaaagacgatccccgtaactatctatataggcattacatctctttcttaaaaagctttgaaccaaaaattttcgtattcgaaaacgttccgggaattaaaagtgcaataaatgggattatcttctcaaatttacatgaagaactggaaaaactgggatacaaaacagaagctcatatgctgaatgcaaaagattttagtgtacttcaggaaagaaaccggataatatttattggctggaaaaatgagcacgatctttcatatcctgactttttaaaaactcctcttggcaggtttcatgtttcttcccttttgaatgacctcccccccttgcaagctggcgaaggtactgaaggtcctgcaaaatatacaaagccgttttcatggtcatctgaataccttcaaagatttaagattcgagaaaagaaagatatacttattcaacacaacgcaagaatacataatcctagagatcgtaccatatatagacttgcaattgaaaaatgggataaagaaagaaaacggctcaaatataatgaactatcaccggaactccagacacacaaaaataaaacgtcttttctggatagatttaaggtggtcaatcagtatggttactcccatgctatacttgctcatatatcaaaggatggtcattatttcattcatccagatattcatcaggcaagatctctgacggttagagaagtggcaagaatacagtcatttcctgataattataaattcgaaggccctcgaatcgcgcagtatgcacagattggtaatgccgtgcctcctcttatggctaaagggatagcagttgaaatcgaaaagatgcttgaagagatttcatga

SEQ ID NO: 87905 - protein, 423 aa, Methanosarcina mazei Go1
MESKYTVLDMFSGAGGLTEGFFQQGFKFVSHIEKNCHARNSLETRAIYHSLKDSSNERIYRDYISGNLNRDEFIHKFKELELTPAGLLQGEVTESNETTMIKEIKEHLKVIDSDSVDVVIGGPPCQAYSVAGRGRKPKEMKDDPRNYLYRHYISFLKSFEPKIFVFENVPGIKSAINGIIFSNLHEELEKLGYKTEAHMLNAKDFSVLQERNRIIFIGWKNEHDLSYPDFLKTPLGRFHVSSLLNDLPPLQAGEGTEGPAKYTKPFSWSSEYLQRFKIREKKDILIQHNARIHNPRDRTIYRLAIEKWDKERKRLKYNELSPELQTHKNKTSFLDRFKVVNQYGYSHAILAHISKDGHYFIHPDIHQARSLTVREVARIQSFPDNYKFEGPRIAQYAQIGNAVPPLMAKGIAVEIEKMLEEIS

SEQ ID NO: 87906 - DNA, 1113 bp, Oceanobacillus iheyensis HTE831
  CDS (1)..(1113): transl_table=11
atgacgtattcagttgcaagcttgtttgctggtattggcggaattgatataggatttgaacaagctggtgcaagagttatctgggctaatgaaatggataagcacgcttgtgaaacgtatcgccaaaatttcgagagtaaactaattgaagatgatgtaagaaatataaaagaaagtgacatgcctgatgctgatataataactgctggatggccttgtgttgcatttagcattgcaggtaacagacatggtatgaaatataaatgtaacaattgtgagcatgaacacagtgtaacttacgatgagtatatacatggagttacatgtccaaaatgtgctgggcatacagaagcaatagatccaagagggacacttttttttgatgttatccgctttattcgcgctaagaatcctgaagcaatttttttggaaaatgtaaaaaatttaagaggtcatgacaaagggaatacttttaaagtaattactgaaatgcttcaagaaagtggttattatatagatagcaaaataatgaatacaatggattatggaaacatacctcagaacagagagcgaatatttattgtaggatttaaagatgaagagaaatataataaatttcaatggccccaaaaaattggacttacaaaatcaattgataatgtaatagatcgcagcaagaagcaggatgatgcttattattatacggaagaaagtcaatactattcaatgatcgttgagtctatgaaaaatagaaatactgtatatcagcttagaagagtctatatgagagaaaatcaaagcaatgtttgtcctacactaactgcaaatatgggtactggaggacataatgtacctcttataatggatgactggggatatagaaaaatcacacctaaagaggcactgaagtttcaaggtttccttgtcggtgaaaattataaaattcctgaagatatggcaaaaagtcatttatataaacaggcaggaaatgctgtaagtgttccagtaatcagaagaattgcaactaatttattggaagcattaggatttggagaaacagaatataaaacgattgagaaaaatgaaaaacatgagcagctttcatttaactaa

SEQ ID NO: 87907 - protein, 370 aa, Oceanobacillus iheyensis HTE831
MTYSVASLFAGIGGIDIGFEQAGARVIWANEMDKHACETYRQNFESKLIEDDVRNIKESDMPDADIITAGWPCVAFSIAGNRHGMKYKCNNCEHEHSVTYDEYIHGVTCPKCAGHTEAIDPRGTLFFDVIRFIRAKNPEAIFLENVKNLRGHDKGNTFKVITEMLQESGYYIDSKIMNTMDYGNIPQNRERIFIVGFKDEEKYNKFQWPQKIGLTKSIDNVIDRSKKQDDAYYYTEESQYYSMIVESMKNRNTVYQLRRVYMRENQSNVCPTLTANMGTGGHNVPLIMDDWGYRKITPKEALKFQGFLVGENYKIPEDMAKSHLYKQAGNAVSVPVIRRIATNLLEALGFGETEYKTIEKNEKHEQLSFN

SEQ ID NO: 87908 - DNA, 1353 bp, Streptococcus agalactiae NEM316
  CDS (1)..(1353): transl_table=11
atgaagtttttagatttatttgctggaattggcggctttcgattagggctagaaagtcagggacatgagtgccttggtttttgtgagattgataagtttgctcggaaatcttacaaagccatatttgagactgaaggagaggtagaatttcatgatattagacaagtcacagaccaagactttagaaaatttagaggacaagtggacattatctgtgtgggattcccttgtcaggcattttcactcgcaggcagacgattgggatttgaggatactcgaggaactctcttctttgaacttgctcgagcggcccaacagatccaaccacgttttctatttttggaaaacgtcaagggcttactcagtcacgacaagggagcgacatttcgaacaatcctcactacattggatgagctggggtatgatgtcgagtggcaggtgcttaacagtaaggatttccaagtcccccaaaacagagagagggtatttcttatcggacattctagaagataccgtccccgattcctatttcctctcagacgagaaggtagcccaactgatattgaaagactaggaaatatcaatccctcaaaacatgggatgagtgggcaggtctatttgacaagtggccttgcgcctaccttaacccgaggcaagggagaggggactaagattgccgtccctgttttaacgcctgaccgtttggaaaaacgtcaaaacggtcggcgttttaaagacaatcaagacaccatgtttacactaacagctcaagataagcatggcgttgtggtggcaggcaatctcccaacagcttttgttcagactggtcgtgtttatgacatttcagggatttctcccacaataaccactatgcagggcggtgataaggtgccgaagattttactgcgagaaactttaccgcatctcaagattaaggaagccacaaaaactggatttgccaaggcgacccttggagattctgtgaatttggcttatcccaaatccaatagccatagagggagagttggtcaagggatttcaaatacgctcactacttcaggcaatatgggagtagttgtagccgctcttgaataccgtaaggacaaatggtacgaggtaacaggaatcgtcctagatggaaaactctatcgcttaagaattcggcgtttaactcccagagaatgctttaggcttcaaggatttcctgattgggcttatgagcgagcagaggctgtatcaagcaaaagccaattatacaaacaagcaggcaatagcgtgacggtcaatgtgattgcggcgattgctgaaaaatttagaaagattgaggaagaagaacatgaaactcttacataa

SEQ ID NO: 87909 - protein, 450 aa, Streptococcus agalactiae NEM316
MKFLDLFAGIGGFRLGLESQGHECLGFCEIDKFARKSYKAIFETEGEVEFHDIRQVTDQDFRKFRGQVDIICVGFPCQAFSLAGRRLGFEDTRGTLFFELARAAQQIQPRFLFLENVKGLLSHDKGATFRTILTTLDELGYDVEWQVLNSKDFQVPQNRERVFLIGHSRRYRPRFLFPLRREGSPTDIERLGNINPSKHGMSGQVYLTSGLAPTLTRGKGEGTKIAVPVLTPDRLEKRQNGRRFKDNQDTMFTLTAQDKHGVVVAGNLPTAFVQTGRVYDISGISPTITTMQGGDKVPKILLRETLPHLKIKEATKTGFAKATLGDSVNLAYPKSNSHRGRVGQGISNTLTTSGNMGVVVAALEYRKDKWYEVTGIVLDGKLYRLRIRRLTPRECFRLQGFPDWAYERAEAVSSKSQLYKQAGNSVTVNVIAAIAEKFRKIEEEEHETLT

SEQ ID NO: 87910 - DNA, 1431 bp, Salmonella enterica subsp. enterica serovar Typhi Ty2
  CDS (1)..(1431): transl_table=11
atgcaggaaaatatttcagtaacacacgcccggaacctcatcgccgacgacgccggaagcgagatccaggcgatgctgagtcaattgctggaaatctacgatgttaaaacgctggtggcgcaccttaacggcctgggcgaacagcactggagcccggccatcttcaagcgcgtaatgatgaacgcggcatggcatcgtttgagcgacaatgaactcagctgtcttaaaacagagttgccgacgccgccagcgcatcatccacattacgcctttcgttttatcgatctcttcgcgggcatcggcggcattcgccgcggatttgaagcgataggcggacagtgcgtgtttaccagcgaatggaataagcacgcggtacggacatataaagcgaactatttttgcgatccgctgcaacatcgctttaatgaagatatccgcgatatcacattgagccaccgggaaggggtcagcgatgatgaggcggcggaacacattcgccagcatattccgcaacatgatgtcctgctggcgggctttccctgtcagccattttctctggcgggcgtttccaagaaaaatgcgctgggccgcgcccacggctttgcctgcgagactcaggggacgttattttttgatgtcgtaagaattatcgacgcccgccgccccgcgctgtttgtgctggaaaacgtgaaaaaccttaaaagtcacgaccagggcaacaccttccgcattattatgcaaacgctcgatgaactgggatatgacgtggcggatgccgctgacaatggcccggacgatccgaaaattatcgacgggcagcactttcttcctcagcatcgggaacgtattgtgttggtgggattccgtcgcgatttaaacctgaaaaccgattttacgttacgcaatatcgcccgttgttatccaccgcgccgtccgacgctggcagaactgctggagcccgtcgtcgaagccaaatatatcctgacgccggtgctgtggaaatatttatatcgctacgcgaaaaagcaccaggcgcggggaaacggttttggctatggcatggtttatcctgacaatccggaaagtgtggcgcgcacgttatctgctcgctactacaaagatggcgccgaaattctgatcgatcgtggttgggatatggcgaaaggcgaagtgaatttcgacgatgctggcaaccaacaacatcgtccccgccgactcacgccgagagagtgcgcgcgtttaatgggatttgaggcgccgcaaacgtaccagttcaggatacctgtctcggatacgcaggcctatcgccagtttggcaactccgtggtggtgccggtatttgccgcggtagcaaagctgctggaacccaaaattcaccaggcggtgacgctgcgtcagagagagacggcagatggcggacgttcacgataa

SEQ ID NO: 87911 - protein, 476 aa, Salmonella enterica subsp. enterica serovar Typhi Ty2
MQENISVTHARNLIADDAGSEIQAMLSQLLEIYDVKTLVAHLNGLGEQHWSPAIFKRVMMNAAWHRLSDNELSCLKTELPTPPAHHPHYAFRFIDLFAGIGGIRRGFEAIGGQCVFTSEWNKHAVRTYKANYFCDPLQHRFNEDIRDITLSHREGVSDDEAAEHIRQHIPQHDVLLAGFPCQPFSLAGVSKKNALGRAHGFACETQGTLFFDVVRIIDARRPALFVLENVKNLKSHDQGNTFRIIMQTLDELGYDVADAADNGPDDPKIIDGQHFLPQHRERIVLVGFRRDLNLKTDFTLRNIARCYPPRRPTLAELLEPVVEAKYILTPVLWKYLYRYAKKHQARGNGFGYGMVYPDNPESVARTLSARYYKDGAEILIDRGWDMAKGEVNFDDAGNQQHRPRRLTPRECARLMGFEAPQTYQFRIPVSDTQAYRQFGNSVVVPVFAAVAKLLEPKIHQAVTLRQRETADGGRSR

SEQ ID NO: 87912 - DNA, 1437 bp, Photorhabdus luminescens subsp. laumondii TTO1
  CDS (1)..(1437): transl_table=11
atgaaagaatttttttcgtatgcccaggatctccatgaaaaatcgaagttattgcagcagcaaaagttggcatcagataaaaagctgatgggacaactttttgagtcttatgatcaaaaaactattgcagaacttttgcgcagagtaaattataacgactggacccgtgaaactttaaatcgctggtttcacggaaaatcagtccagaagttgttaacagaagttgaagttgctatgctccaaaaaatgctacctgaaccacccaaaaatcatcctcaatacggtttccgtttcattgatctttttgcagggattggaggaattcgaaaaggttttgaagaaattggcggtcagtgtgtttttaccagcgaatggaacaaagatgctgttcgtacctacaaagcaaactggtattgtgatccggaatcccataaatttaattctgatattcgtgaaataacattaagtgaaaactcaaaaatagatgaaaaagaagcttataaaaatattgataaagaaattccagatcatgatgttcttttggcaggctttccatgtcagccattttcattagcaggtgtttcgaaaaagaactcccttggtcgtgctcatgggtttgagtgtgatacacagggaactcttttttttgatgtggccagaattattacagctaaaaaacctgctatttttcttctggaaaacgttaagaacttaaaaagtcatgataaagggaaaacattccgtattatcatgaatacattgaatgagctgggatacgctgttgctgatgctgatatcatggggccgaatgatcctaaaattattgatggaaaatattttttgcctcagcatagggaacgaattgtgttagttggttttcggaaagatctgaatattcatcaaggatttacacttagggatattagtcgatatttcccgaaagaacggccaacacttgcggatttacttgaaccagaagttgacagtaaatatattcttacccctaatctctggaaatatttatataattatgccagaaaacatcaggctaaaggaaatggctttggatttggccttatagatcccaacaataaggatagtgttactcgcacactttctgcgcgttaccataaagatggctcagaaatccttattgaccggggatggaataaaaagcttggggaacaggattttgataatccagataaccaggaaaatcgcccgcgtcgtttaacaccgaaagaatgcgcacggctaatggggtttgagtctcctcagggagaagcatttcatattccagtttcagatacacaagcttatcgacagtttggaaactcagttgttgtgcctgtatttacagctgttgctaaattattagctccttatatagcgaaagcagtgaaacaacagcagataaacaaagatcaggcggcatag

SEQ ID NO: 87913 - protein, 478 aa, Photorhabdus luminescens subsp. laumondii TTO1
MKEFFSYAQDLHEKSKLLQQQKLASDKKLMGQLFESYDQKTIAELLRRVNYNDWTRETLNRWFHGKSVQKLLTEVEVAMLQKMLPEPPKNHPQYGFRFIDLFAGIGGIRKGFEEIGGQCVFTSEWNKDAVRTYKANWYCDPESHKFNSDIREITLSENSKIDEKEAYKNIDKEIPDHDVLLAGFPCQPFSLAGVSKKNSLGRAHGFECDTQGTLFFDVARIITAKKPAIFLLENVKNLKSHDKGKTFRIIMNTLNELGYAVADADIMGPNDPKIIDGKYFLPQHRERIVLVGFRKDLNIHQGFTLRDISRYFPKERPTLADLLEPEVDSKYILTPNLWKYLYNYARKHQAKGNGFGFGLIDPNNKDSVTRTLSARYHKDGSEILIDRGWNKKLGEQDFDNPDNQENRPRRLTPKECARLMGFESPQGEAFHIPVSDTQAYRQFGNSVVVPVFTAVAKLLAPYIAKAVKQQQINKDQAA

SEQ ID NO: 87914 - DNA, 1428 bp, Serratia marcescens
  CDS (1)..(1428): transl_table=11
atgaaacgttacactcatgatcttgagacagacctgaatgatgtggataaaacaccatctctgatccacaaaactttgttaacagcttcgactatttatgacctgaaatatctggctcaggtattaaatgatgaaaatggcagtaattggtcccgtgcatcccttaaacgtcaggttacatgcatacctgagcattgtgatctgagtatcgcagatggacgctatctacagactttaataccttcacgacctgctgattatgaggacaggcactttagctttatcgatctgtttgcagggataggtggactgcgaagcggatttgatgccatcggtggtaaatgtcttttcacgagcgaatggaatacttattccagccgtacttaccgggcgaactggtattgcgatgagaacgagcaccgcttcaattcagacatccgtgacatcactcttagcaaccggcccgaggttactgatgacgaggcatacaaatttatcgatgcctctatcccggatcatgatgttcttcttgcgggatttccatgccagccattcagcatcgccggtgtcagtaaaaagaactctatgggtcgcaaacacggtttcgagtgcgacactcagggtacgctcttctttgatgtggccaggatcatccgggcaaaacaacctgcaatttttgttctggaaaacgtaaaaaatctgaagagtcacgataagggtaatacctttaacatcatcatgaaaacgctcgatgagcttggctacgacgtcgcaaacagcgaaagcacgggcgcggatgatcctaaagtcatcgatggccgtcatttccgaccccagcaccgtgaacgtatcgtccttattggttttcgccgcgacctacgtctgaaagacggttttactctgagagacattaaagacttttatccggacaagcgcccttctctctcagatttactggatccgagcgtagatagtaaatacatcctctcccctaaactctgggagtacttatacaactatgcaaagaaacatgcggcaaaaggcaatggttttggttttggactagtagatccttccaatgttaatagtgtcaccagaaccctctcaagccgctatatgaaagacggatctgaaattcttattgatcggggctggtctcatgagctgggagaaactgatttccataacacatacaacatggaccgtcggccacgcatgctaacgccacgtgaatgcagcaggctaatgggcttcgataaacccggggaaagtgttttccgtatccctgtgtccaatacacaggcttacagacagtttgggaactccgtggtcgttgatgtctttgcggccgtcgccaaactgctgaagtctcgaattgaatttgcagcctcccagcgcttgcggcagttttacgacgaagtcagctga

SEQ ID NO: 87915 - protein, 475 aa, Serratia marcescens
MKRYTHDLETDLNDVDKTPSLIHKTLLTASTIYDLKYLAQVLNDENGSNWSRASLKRQVTCIPEHCDLSIADGRYLQTLIPSRPADYEDRHFSFIDLFAGIGGLRSGFDAIGGKCLFTSEWNTYSSRTYRANWYCDENEHRFNSDIRDITLSNRPEVTDDEAYKFIDASIPDHDVLLAGFPCQPFSIAGVSKKNSMGRKHGFECDTQGTLFFDVARIIRAKQPAIFVLENVKNLKSHDKGNTFNIIMKTLDELGYDVANSESTGADDPKVIDGRHFRPQHRERIVLIGFRRDLRLKDGFTLRDIKDFYPDKRPSLSDLLDPSVDSKYILSPKLWEYLYNYAKKHAAKGNGFGFGLVDPSNVNSVTRTLSSRYMKDGSEILIDRGWSHELGETDFHNTYNMDRRPRMLTPRECSRLMGFDKPGESVFRIPVSNTQAYRQFGNSVVVDVFAAVAKLLKSRIEFAASQRLRQFYDEVS

SEQ ID NO: 87916 - DNA, 1077 bp, Desulfovibrio vulgaris subsp. vulgaris str. Hildenborough
  CDS (1)..(1077): transl_table=11
atgacttcccaactgtctttttccttcatcgacctgtttgctggcattggcggcataaggctaggcttcgaagctgcagggggccgttgtgtcatgtcggccgaatacgacaagtatgcccagaaaacctatcgggccttctttggtgaatcgcccgatttctcagaaatcatgtctgtttcgcctcctggcgatatcactaagctacctccgcaccttgtaccagatcacgacgtgcttaccggcggctttccctgtcagccgttctctctggcaggcgtatcaaagaagcagtcactaggccgacctcacggcttcgacgaccccacgcagggaaccctcttcttcaacgtgaaggagatcatcaagagcaagcggcccaaggccttcatgcttgagaacgtcaagaatctgtgtagccacgattccgggcgaacgttccgtgtcatccgggagtctcttgagggactcggctacaggatgcactaccgtgtcattgatgcccgtgactggattccccagcatcgggaacgtatcttcatggtcggctttcgcctgccggaggcttgccctgctggcgcgcagaaatgggatgtgaaggatttcgactttgggaaggtctccaggcgggggtcccagaaagaccttgaaagcgtgatcgagccggacgtgcctgaaaaatacacactgggaccgggaacgtggaataccctggtgaggcacaaagctaatcacgcggccaagggccagggctttggctacggcatgatcaccccccccttcgcaggacagacgactcgcactctctctgcccgttaccataaggacggggcagagattcttgttgcccagccggacaggccgcggcctagacgcctgacccccctggagtgttgtagactgatgggttttccgaaggagtgccagcgctggtttgacagaagggatgaggcgcatccgcagccagtctctgactgtcaggcctacagacagttcgggaattcggtcgccgttccagttgtgaaggccattgcccgggcaatggcagaagccttgaagcgcaacggtgccatctga

SEQ ID NO: 87917 - protein, 358 aa, Desulfovibrio vulgaris subsp. vulgaris str. Hildenborough
MTSQLSFSFIDLFAGIGGIRLGFEAAGGRCVMSAEYDKYAQKTYRAFFGESPDFSEIMSVSPPGDITKLPPHLVPDHDVLTGGFPCQPFSLAGVSKKQSLGRPHGFDDPTQGTLFFNVKEIIKSKRPKAFMLENVKNLCSHDSGRTFRVIRESLEGLGYRMHYRVIDARDWIPQHRERIFMVGFRLPEACPAGAQKWDVKDFDFGKVSRRGSQKDLESVIEPDVPEKYTLGPGTWNTLVRHKANHAAKGQGFGYGMITPPFAGQTTRTLSARYHKDGAEILVAQPDRPRPRRLTPLECCRLMGFPKECQRWFDRRDEAHPQPVSDCQAYRQFGNSVAVPVVKAIARAMAEALKRNGAI

SEQ ID NO: 87918 - DNA, 1122 bp, Bacillus thuringiensis serovar konkukian str. 97-27
  CDS (1)..(1122): transl_table=11
atgaaatataaaacattagacctttttgctggtattggtggtatcagaaggggttttgaactaacagggagatttgaaaacgtattgtcagctgaaattgatcagtatgcttgtcaaacatatgaacacctttattcagaaaatcctaaaaatgatgtgacaagtgctgaatttaaagaaaaagtagagaaattaacatatgatgtattattaggggggtttccttgtcaggcgtttagtacagctggaaaaaaagaaggttttcgcgataaaacaagaggcactctgttttttgatgtagcggatataattgaaaggacacgcccaaaagcttttctacttgaaaatgtggaaggattaattcgacataaaaaaggcgaaacttttaaaactattcttgaaacattggtaatagaattagactacaaagttattggtgttgaaaaaggagagaatggggaattaatatatgaccctcgaagttttttacttaattctagaaattttggggttccccaaaatagaccacgtatatatatagtaggttttaatcaaaggctttacagagacaaaattgaatctatgcctttatttacacttccgaaaagtagatcaagaaaaaaaatctatgacagtgtaagagatgtattagaagataatgtcggagaaaaatactatttgtcagaaggatatttagaaacattaaaaaagcataaagaagctcaaggtaaaaagggaaatggatttggatattctatagttaatttaccagaaattgaaaatccagtttctaatgcactcttagctacggggggatctgggaaggaacggaatctaatttatgattataacccagatatagtagggaaattagttaagtctaaaaaatcacctcttaattctgaaggggttcgaattatgacaccaaatgagtgggggaaactgcaaggctttgttggttacgcatttaaaagtgcttcaggtgaagacacttttagttttcccgaaaaaatgagtgatgctcaaagatataagcagtttggaaattcagttacaattcctgtaatcgaggagattgcatataaaatagttgaagcattagatattttagagagatcttga

SEQ ID NO: 87919 - protein, 373 aa, Bacillus thuringiensis serovar konkukian str. 97-27
MKYKTLDLFAGIGGIRRGFELTGRFENVLSAEIDQYACQTYEHLYSENPKNDVTSAEFKEKVEKLTYDVLLGGFPCQAFSTAGKKEGFRDKTRGTLFFDVADIIERTRPKAFLLENVEGLIRHKKGETFKTILETLVIELDYKVIGVEKGENGELIYDPRSFLLNSRNFGVPQNRPRIYIVGFNQRLYRDKIESMPLFTLPKSRSRKKIYDSVRDVLEDNVGEKYYLSEGYLETLKKHKEAQGKKGNGFGYSIVNLPEIENPVSNALLATGGSGKERNLIYDYNPDIVGKLVKSKKSPLNSEGVRIMTPNEWGKLQGFVGYAFKSASGEDTFSFPEKMSDAQRYKQFGNSVTIPVIEEIAYKIVEALDILERS

SEQ ID NO: 87920 - DNA, 1227 bp, Streptococcus pyogenes MGAS10394
  CDS (1)..(1227): transl_table=11
ttgacctttgatagacacattttagaaagtaatagaaaattgactactaccaatattttatcaaaaaaaactacaattgcagaaaatctttcgggaaatgatataaaatatctacgaaaaaaatataatctcactcaaaaagaattagcagatgcactcggtcttcaaaaatttggagatagaaccattagacgttgggaagcagaagaaacgcatccttcaaaacttgaacagtccagtattcagtctttttttaattctctaaagaatccgccttttattattagtgaaaatcttccgttcaaaatgatcgatctttttgctggaataggtggaactagattaggtttccaattaacaaatgaagtagaaactgtatttacaagtgaatgggataaatttgctcaaaaaacatacattactaattttggagacactccagaaggtgacatcactcagattgatgaaaatactataccagatcatgatatactcgttgctggttttccttgtcaagctttctcccaagcaggtaaacgtctaggatttgaagatactcgtggaactttattttttgacgttgctagaataataaaagctaaacgtccaaaagcttttttacttgaaaatgtcaaaaacctaaagacacatgataaaggtaagacatacaagataatcatttcaactcttgagaatttaggatatagtacatcaactgtactttttaaggccagagattttggtgtaccacaaaatagagaaaggatttatatagttggatttgataagacttgtgtaaataattttagtgaattccgtttccctgaaccgtttcatttagaaactaaactaggaaatattctacaaactgatgttgatgaaaagtatactatctccgataaactctgggaaggacaccaaagaaggaaagctgaacataaaacaaaaggaaatggattcggctactcactatttaatgctgatagtccatatacaaatacactttctgctcgatactacaaagatggaagtgaaatattaatagaacaaaaaggtaaaaacccacgtaaaattactccacgagaagctgctagactccaaggtttccctgaagagtttataattccggtttctgatacacaagcctacaaacaatttggaaattctgtctgtgtaccaacaattcatgaaattgctaaacaaatactagccgtcctaaaaaaatag

SEQ ID NO: 87921 - protein, 408 aa, Streptococcus pyogenes MGAS10394
MTFDRHILESNRKLTTTNILSKKTTIAENLSGNDIKYLRKKYNLTQKELADALGLQKFGDRTIRRWEAEETHPSKLEQSSIQSFFNSLKNPPFIISENLPFKMIDLFAGIGGTRLGFQLTNEVETVFTSEWDKFAQKTYITNFGDTPEGDITQIDENTIPDHDILVAGFPCQAFSQAGKRLGFEDTRGTLFFDVARIIKAKRPKAFLLENVKNLKTHDKGKTYKIIISTLENLGYSTSTVLFKARDFGVPQNRERIYIVGFDKTCVNNFSEFRFPEPFHLETKLGNILQTDVDEKYTISDKLWEGHQRRKAEHKTKGNGFGYSLFNADSPYTNTLSARYYKDGSEILIEQKGKNPRKITPREAARLQGFPEEFIIPVSDTQAYKQFGNSVCVPTIHEIAKQILAVLKK

SEQ ID NO: 87922 - DNA, 1251 bp, Legionella pneumophila subsp. pneumophila str. Philadelphia 1
  CDS (1)..(1251): transl_table=11
atgagctacgatcttattgaagatgctccttttgtttcaatcagtgaagcagcaactgcactggatgcttctatcgacaccataaggcgttgggaaaagaaaggattaataaaggcacacaggagtgatacagggcatcggctgtttcaaataactgaactccaaaggttaaaagccaaattgtttggtgctggtgatgatcattgttataagatattaacagcccctagcaggacacaattcaaggtagttgaactatttgctggtgctggtggtttggcgcttggtttccataatgctggtttagattgttcaatgttggttgaaattgataagaacccagtcgaaacgttaaggcataattgcccatcatggaatgttattcatgatgatattgcaaatgttgacttccaaggaattactgctgatgtagttgcaggaggatttccctgccaggcattcagctatgctgggaaaaaacttggttttgaagacaccagaggaaccttattttttgaatacgctagagcgattaaagaaataaaccctaaagtaattgtcggtgaaaatgttcgtggattggaaaaacatgacagtggccggacattaaatactatgctgcaaattttagatcaattaggttatgacgttgaatacaaaatcctccgtgcccagtacttagatgtgcctcaaaaacgcgaacgccttgttatgctgggcatcaggaaagatcttaaaggcactatcgcatttcccaaagaacaggattatacaattagcctaagagaggctttaaaagatgtacctgatgctcctggccaaaaatatactgagaaaaaatctaaggtaatgtcgctagttccagagggtggctattggagagatttaccagatgacaaacaaaaggaatacatgggagccagttattttttgggtggaggaaaaacaggaatggccaggcgtttggcatgggatgaaccatccttaaccctaacgtgcaaccctgcccaaaaacagactgaacgttgccatcctaaagaaactaggccattaaatgttagggaatatgcaaggatccaaacctttcctgattcatggatgttctctggcacagtatcatcgcagtataaacaaatcggtaatgctgtgcctgtaaacttgggctaccatattggcaggtgtgttattgctatgcttacccagaggtttgataggaaagatctaattatttgctcccgaaagcctgattaa

SEQ ID NO: 87923 - protein, 416 aa, Legionella pneumophila subsp. pneumophila str. Philadelphia 1
MSYDLIEDAPFVSISEAATALDASIDTIRRWEKKGLIKAHRSDTGHRLFQITELQRLKAKLFGAGDDHCYKILTAPSRTQFKVVELFAGAGGLALGFHNAGLDCSMLVEIDKNPVETLRHNCPSWNVIHDDIANVDFQGITADVVAGGFPCQAFSYAGKKLGFEDTRGTLFFEYARAIKEINPKVIVGENVRGLEKHDSGRTLNTMLQILDQLGYDVEYKILRAQYLDVPQKRERLVMLGIRKDLKGTIAFPKEQDYTISLREALKDVPDAPGQKYTEKKSKVMSLVPEGGYWRDLPDDKQKEYMGASYFLGGGKTGMARRLAWDEPSLTLTCNPAQKQTERCHPKETRPLNVREYARIQTFPDSWMFSGTVSSQYKQIGNAVPVNLGYHIGRCVIAMLTQRFDRKDLIICSRKPD

SEQ ID NO: 87924 - DNA, 1296 bp, Bacteroides fragilis YCH46
  CDS (1)..(1296): transl_table=11
atgatagcaaaaaaaacagtcatacaagatattaagctcgccgacttccccgaggaaattgacgagcaaaacaacattaaagtgtacggagagaccagtcgggaaaatcaattggctgtactcagccattatctgcataacaacgattgcatcaaaggtgaagaaagtaagtgggaagtgatatacgccatccgtgagtttttagagcagaaaaaagagagcaaggaagaagaaataacggatgaatatgtgaccaaagtcgcagaagatcctgccgcatacggtctattctcggatttcttcaacgtgccgtttctcgaccctaaagaaccaaaattcactttcatcgacctatttgccggaatgggaggtttccgtttggccatgcaggcgcaaggtggcaagtgtgtattttcgtcagaatggaacaagtatgctcaaaagacttacttggcaaactttggggaaatgcctttcggcgacattacaaaagaaatgaccaaaagctatatccctcgaaattttgatgtgctatgtgccggttttccgtgtcaaccattttctattgccggagtttcgaagaaaaaaagtctcggacgggaaacgggattcaaggataaaacgcaaggtacgttgttttttgacgtggcagacattatcagtcgtcaccgccccaaagcgttctttttggagaatgtgaaaaatctgatgtcgcatgacaaaggtaacacattcaaggtaatcaaaggcacattagaggagttgcgttattcgctccactatcttgtcatggacggacaaacttatgtgccacaacatcgggaacgcatcatgatagtaggttttaaccaagatgtctttcatggaaaagagcaattcgcctttcccgagcagaaacaatcaacccggagcatcaaagaaatacttgaccctgatattgacggaaaatacacgttaagtgacaaactttggagctatctgcaaaactatgcagaaaagcaccgcgccaaaggaaatgggtttggtttcggaatggtagatttgaatggtatttcccgtacgttaagtgctcgttactataaggatggttccgaaatccttatcccacaaacaggaggaaagaatcctcgtagattgtctcctcgtgaatgtgcccgactaatgggatatcccgataaatatcgccttaaccaagtctctgatgtacaagcttacaggcaatgcgggaattcagtcgtggtgcctcttatcacagctgtttctgaacaattagtaaaagccatgttaaatgattga

SEQ ID NO: 87925 - protein, 431 aa, Bacteroides fragilis YCH46
MIAKKTVIQDIKLADFPEEIDEQNNIKVYGETSRENQLAVLSHYLHNNDCIKGEESKWEVIYAIREFLEQKKESKEEEITDEYVTKVAEDPAAYGLFSDFFNVPFLDPKEPKFTFIDLFAGMGGFRLAMQAQGGKCVFSSEWNKYAQKTYLANFGEMPFGDITKEMTKSYIPRNFDVLCAGFPCQPFSIAGVSKKKSLGRETGFKDKTQGTLFFDVADIISRHRPKAFFLENVKNLMSHDKGNTFKVIKGTLEELRYSLHYLVMDGQTYVPQHRERIMIVGFNQDVFHGKEQFAFPEQKQSTRSIKEILDPDIDGKYTLSDKLWSYLQNYAEKHRAKGNGFGFGMVDLNGISRTLSARYYKDGSEILIPQTGGKNPRRLSPRECARLMGYPDKYRLNQVSDVQAYRQCGNSVVVPLITAVSEQLVKAMLND

SEQ ID NO: 87926 - DNA, 1251 bp, Mycoplasma hyopneumoniae 232
  CDS (1)..(1251): transl_table=4
atgaaatactataaaatttccgaaattgcaaaccttgaagctgttagtcaaaaattcattagaagagaaattgcaagaaaaactttaatctcaataaagaaaaataataagtatctaatttcggaatttgattatcaaaaatgaaaatcatcctatagaaaacaagaaaaactaaggaaaaatttaggaaaaactaaagaaaaagtccactttattgagatctcagaagaaatgaagaaacttgatggttggagctcaagttatcacaatggttataattttatcgatcttttctcgggtgctggcggcctttcttgtggtcttgttatggctggatttttgcccttggcaagtttagaaataatgaaacaagcctttgaaacctatgcctataattttaaaaaaaggtccaaaaataaagaactttttaaactaggcgatattagagattctaaaataaaatccgaattttatgatcattttaaggatcaagaactggatttaattgctggaggttttccttgtcagggcttttctatggcaggtaatcgagtctttgatgatccccgaaataatttataccttgaaatgttagatattgttgcaaatttaaagccaaaattcgtgttaatggagaatgttcaagggcttagaaccatgctttctggtcaaattgaggccaaaatcataaaagattttgaaaaaatcggctataagattaatgtagcaacattaaatagtgccgattttggagtcgctcaaataagaaaacgggtaatttttattgcaaaccggattggtttgacaaattttttccctgcagctattcttagcccagaaaattataaaactttaggtcagtgtattgaaaaatatatgaattgagaagaaaatattgaaattaatcatatttttacaaaacattcagccaaaatgagggaaaaaattttaaaaacatccgaaggacaaagcgtttataaaaattactctgatggttggaagaaatcaccttgaaatcagcctagttgtacagttaaagaaaatcatggcggggtgaatctccatcctaaactcccaagggttttaactccgcgtgagttggcggctttacagtcatttcctgatagttttatttttaaagggtcaaaaaaatgacaacttgtgcaaatcggaaatgcggtgcccccacttttagcaaaggctatcggcctggctattaaaaaatctttggataagaaagatgtattataa

SEQ ID NO: 87927 - protein, 416 aa, Mycoplasma hyopneumoniae 232
MKYYKISEIANLEAVSQKFIRREIARKTLISIKKNNKYLISEFDYQKWKSSYRKQEKLRKNLGKTKEKVHFIEISEEMKKLDGWSSSYHNGYNFIDLFSGAGGLSCGLVMAGFLPLASLEIMKQAFETYAYNFKKRSKNKELFKLGDIRDSKIKSEFYDHFKDQELDLIAGGFPCQGFSMAGNRVFDDPRNNLYLEMLDIVANLKPKFVLMENVQGLRTMLSGQIEAKIIKDFEKIGYKINVATLNSADFGVAQIRKRVIFIANRIGLTNFFPAAILSPENYKTLGQCIEKYMNWEENIEINHIFTKHSAKMREKILKTSEGQSVYKNYSDGWKKSPWNQPSCTVKENHGGVNLHPKLPRVLTPRELAALQSFPDSFIFKGSKKWQLVQIGNAVPPLLAKAIGLAIKKSLDKKDVL

SEQ ID NO: 87928 - DNA, 963 bp, Legionella pneumophila str. Paris
  CDS (1)..(963): transl_table=11
gtgcgtaggaaagcatttaaattcatagacttatttgctggaattggtggtattcgaattccatttgataaattaaatggcgaatgtgttttctcttccgaaatagatccatattgtcaaaagacatatgaagctaattttggtgagaaaccttttggagatataacaaagatatcgccgcaagatgtacctgatcacgatattttacttggtggttttccctgccaagcattttccataattggtagacaaaaaggtttttctgatacaagaggaactcttttctttaatattgaacaaatcttgaaagtaaaacgccctagagcttttttgctggaaaatgtgaagcaactgtctacacatgatggaggtcgtacttttcaaataattattgaaacacttagaaacttgggatatacagtctatagtaccattttaaattccttggattttggagttccccaaaaaagagagcgaacatatattgttggatttattgataatgttccgttcgaatttcctaaaggcggggttccatttaatttggaatccatacttgaaaaagagcagcaaataccgaataaatattatgcttcagattatattagacagaaaagaattgcggcattgaaaggtgtcccccctataccaagtatttggcatgaaaataaatcgggaaatatttcaacacttccttattcatgtgctttaagagcgacagcatcatatagttatttgttagttaatggggaaagaagattaactgaaagagaaatgcttcgattacaaggatttcctgatacttttaaaatagtttgtaattatactcaaactaggaagcaagctggcaatgctgtaacagttaatgtaatagatgcaattgctaaaaaattgattgattcgttagaaatggcaaatgatatgaataaaattaagtttcataaaacatttgctacagcttga

SEQ ID NO: 87929 - protein, 320 aa, Legionella pneumophila str. Paris
MRRKAFKFIDLFAGIGGIRIPFDKLNGECVFSSEIDPYCQKTYEANFGEKPFGDITKISPQDVPDHDILLGGFPCQAFSIIGRQKGFSDTRGTLFFNIEQILKVKRPRAFLLENVKQLSTHDGGRTFQIIIETLRNLGYTVYSTILNSLDFGVPQKRERTYIVGFIDNVPFEFPKGGVPFNLESILEKEQQIPNKYYASDYIRQKRIAALKGVPPIPSIWHENKSGNISTLPYSCALRATASYSYLLVNGERRLTEREMLRLQGFPDTFKIVCNYTQTRKQAGNAVTVNVIDAIAKKLIDSLEMANDMNKIKFHKTFATA

SEQ ID NO: 87930 - DNA, 1254 bp, Legionella pneumophila str. Lens
  CDS (1)..(1254): transl_table=11
atgaacacaataacaaagttaaaaaccctaaatgtattacttggagaggagcaactttctaattttttggagctttcccccaaaacattaaaaatctggataaaggatggcagcattccaaaacaatccattgtagacgcaaagtttgatcaaataatcgaaaatattaagaatcctaaaagaaacccagtaaagagctttagttttattgatttgtttgccggcatcggtggtatccgtctcgggtttgaaagtattggtggagaatgtatttttacttctgaatgggataagtattcacaaatcacctatcgtaaaaactttagaaatgaccaccatccaattataggagacattactaaagtagatgttaatttcattccagaacacgatgtattgctcgctggctttccttgccagccattttcgctcgccggagtttctaaaaagaactctcttggacgggcacatggatttgaatgcaacacccagggcactttattctttgatgtagagcgcataatagcagcaaaacaaccaaaagcctttctacttgaaaatgttaaaaatctcagaagccatgataacggaaaaactttttccattattatggatactctacaacaaaagttaggatacaaagtacatactcttgtaatagacgctaatggatttgttcctcaacatagagaaagaatttttattgttggttttagggaagatcttccattctcatggaacgatctcagattgcctccaaaaaacagtgtattactcgagtctatactacatcctgaaaatggcactgagatagaagaaaagccctatacatttggagaaaaagccgaagtatcctcttgctttactttatctgataaattgtggaattatttgcaggattataagaaaaagcattctgaaaaaggaaatggttttggttttggacttgtttctgaaaaaaatatagcccgtactttgtcagcccggtatcataaagatggttcagaaatattaatttattgtggaaaagaaaaaaatccaagaagactgactcccagagaatgtgcaagacttatggggtatcccgatagttttaaaatacctgtatcaaatactcaagcatacagacaatttggtaactcagtggtagttcctgttataaaagctattgcacaaattatgaagcctcatattgaaattcttatgaagaagtctgtatctgctgttaaaaaagatgttgctttagaaatatga

SEQ ID NO: 87931 - protein, 417 aa, Legionella pneumophila str. Lens
MNTITKLKTLNVLLGEEQLSNFLELSPKTLKIWIKDGSIPKQSIVDAKFDQIIENIKNPKRNPVKSFSFIDLFAGIGGIRLGFESIGGECIFTSEWDKYSQITYRKNFRNDHHPIIGDITKVDVNFIPEHDVLLAGFPCQPFSLAGVSKKNSLGRAHGFECNTQGTLFFDVERIIAAKQPKAFLLENVKNLRSHDNGKTFSIIMDTLQQKLGYKVHTLVIDANGFVPQHRERIFIVGFREDLPFSWNDLRLPPKNSVLLESILHPENGTEIEEKPYTFGEKAEVSSCFTLSDKLWNYLQDYKKKHSEKGNGFGFGLVSEKNIARTLSARYHKDGSEILIYCGKEKNPRRLTPRECARLMGYPDSFKIPVSNTQAYRQFGNSVVVPVIKAIAQIMKPHIEILMKKSVSAVKKDVALEI

SEQ ID NO: 87932 - DNA, 1260 bp, Idiomarina loihiensis L2TR
  CDS (1)..(1260): transl_table=11
atgtcaaatatagaacttaaacagcttcgcgaacgactttgtctgactcagtcgcaagcagcgtcgttggttcactccagcgttcgtgcttggcaacaatgggagtcaggcgagagacaaatgcacccagcgattcgggaactgttcactatcaaaaccaaaacatatcagcgagagagtcgaactatgtcatttgccaagccaagtgttacttttagggatttgaaaaaaaattatcaagaactagccgagtcgactcatagatctgaacaggcgaatgcaaaagactccagtataaagtttatcgatttgtttgccggtgtgggcgggatcaggttggcttttgaaaaagctggcgcagcttgtgtgttttcatcggaaatagatacgcatgcacagcttacttattttactaatcatggaacggttccttatggtgatattaccaagattgacgctgactcaattccttcacatgatatcctgtgtgctggctttccatgccaaccttttagccatatcggcagaagggagggatttaagcaccctactcaaggaactatgttccatgaaattgttaggattgctgagaaaaagcggccaagagttttatttctagaaaacgtgccgggaattgtgaatcatgacaatgggaatactctaaaagtaatcctcgacacgctcacagagcttgggtatgaatgcaaccacaccattctgaatgccagtgattttggagtacctcagaatcgtaaacgattttaccttgtggcatttgacggtaaggactgcggcttttccttcccccaaccaccaatgataaaggcagatatcggaacacttttggaaaaaggagctgaaggctattcaatttctgaacacctgcagaaaacttacttattcaaaaaggatgatggccgtccgattttgattgacagaaatacgaaaggccctatgaggacattggtatctagttaccataaaattcagcgcctaacgggtacattcgttaaagatggtgaaacaggtattcgtctactcacagcgtacgaatgtaaaaaagccatgggctttcctgatgacttcaagttccctgtctcgcgtactcaaatgtacagacagatgggcaactccgtagttattacagtgattgatgctattgctgaaaagatacttgagaccctttctcataaaaagagccctacggagaaaaaatctgaacgcgacatgcccgaatctaatcttgaggtagcgatatag

SEQ ID NO: 87933 - protein, 419 aa, Idiomarina loihiensis L2TR
MSNIELKQLRERLCLTQSQAASLVHSSVRAWQQWESGERQMHPAIRELFTIKTKTYQRESRTMSFAKPSVTFRDLKKNYQELAESTHRSEQANAKDSSIKFIDLFAGVGGIRLAFEKAGAACVFSSEIDTHAQLTYFTNHGTVPYGDITKIDADSIPSHDILCAGFPCQPFSHIGRREGFKHPTQGTMFHEIVRIAEKKRPRVLFLENVPGIVNHDNGNTLKVILDTLTELGYECNHTILNASDFGVPQNRKRFYLVAFDGKDCGFSFPQPPMIKADIGTLLEKGAEGYSISEHLQKTYLFKKDDGRPILIDRNTKGPMRTLVSSYHKIQRLTGTFVKDGETGIRLLTAYECKKAMGFPDDFKFPVSRTQMYRQMGNSVVITVIDAIAEKILETLSHKKSPTEKKSERDMPESNLEVAI

SEQ ID NO: 87934 - DNA, 1275 bp, Synechococcus elongatus PCC 6301
  CDS (1)..(1275): transl_table=11
atgaacctaaacctcagcactccgagtgacgttattgtggctgaggctctcaagcgcttctctaaacgagaactagctaagcacctcgggaaagatccccgtatcatcactgcttttcagagagacggagtggatgagacttacaaaatggctctgctttaccttctgcagagcaacactcctcgtcctaatcaaggtaaaaagcatgactttactttcatagatctgtttgctggtattggcggaactcggatgggtttcgaacgtgccggtggaaaatgtgtattcacgtcagagtgggatacctctgcccaaaaaacctatcgagctaatttctcagttgatgagcatcccatcatcggtgatattcacgagattacagtcgaaggaaaatgggatctcttaccagagcatgacgttcttgtagctggattcccttgtcagccgttttctatcgccggtgtcagcaagaaaaactcgcttggaagggctcatggctttgcatgtgatgctcaaggcacactcttttttgatatcgcaaccattattgaaagaagacgacccaaggcctttttgttagaaaatgtcaaaaacctaatgagtcatgacaagggaaacacttttcgtgttatcaagaatgttcttgaggatgagcttggctataagatttacccaaaaataattgatgcaaaagggtttgtccctcaacatagagaacgtatctatattgttggcttccgagaagaggttggcttcaactgggattctttctcgcagccgcctactgatacaaaatgcatggccgacatccttcatcctaatgatggcagcgaggaagttgaggaaccttatacagttgggatagaggctaaagttaatgacaaatataccctaagcgataagctctggaattacttgcaaaactatgcgaataaacatcgagcggctggcaacggctttggttttggtcttgtcaacaaggacagtattgcccggactctttctgctaggtactacaaggatggatctgagatcttggttgatcaaggcaaggataagaatccgcgacgcctaacccctcgagaatgcgcccgtttaatgggctttgatagttctgagcataagttcaacatcgttgttgctgacacaccagcctacaaacaatttggaaactcagttgtagtaccggtcattactgaaattgctcacaccatgaagccgagcataatacaactaaaggagagatatattcggcaaatttcattagccatctaa

SEQ ID NO: 87935 - protein, 424 aa, Synechococcus elongatus PCC 6301
MNLNLSTPSDVIVAEALKRFSKRELAKHLGKDPRIITAFQRDGVDETYKMALLYLLQSNTPRPNQGKKHDFTFIDLFAGIGGTRMGFERAGGKCVFTSEWDTSAQKTYRANFSVDEHPIIGDIHEITVEGKWDLLPEHDVLVAGFPCQPFSIAGVSKKNSLGRAHGFACDAQGTLFFDIATIIERRRPKAFLLENVKNLMSHDKGNTFRVIKNVLEDELGYKIYPKIIDAKGFVPQHRERIYIVGFREEVGFNWDSFSQPPTDTKCMADILHPNDGSEEVEEPYTVGIEAKVNDKYTLSDKLWNYLQNYANKHRAAGNGFGFGLVNKDSIARTLSARYYKDGSEILVDQGKDKNPRRLTPRECARLMGFDSSEHKFNIVVADTPAYKQFGNSVVVPVITEIAHTMKPSIIQLKERYIRQISLAI

SEQ ID NO: 87936 - DNA, 1125 bp, Neisseria gonorrhoeae FA 1090
  CDS (1)..(1125): transl_table=11
atgctatctaaacaaatctcaaatcttaattcttctagtaacaaaccaaaaatcctatctctattttcaggatgtggcggtttggatttgggctttcatcaagctggttgtgaaactgtttgggcgaacgatttctcccattgggcttgcgaaagtttccgtaaaaatatcggcgatgtcatcgtagaaggtgatattgaacaaattaatccgaatgatccaactattcccgattgcgacatcattttaggcggattcccttgtcaagatttttccatgatttggaaacagccgggcttagagggtgagcgcggcaatctttataaaagctttttacgttttgtaaatgcaaaaaaaccgaaagtttttgttgctgagaatgtgaaaggtttattgactgccaacaagaaaaaagccatccagcaaattattaccgactttgaaaattgcggttattacgttcaggcgaagctgtataactttgcagaatttggcgtacctcaatttcgtgaacgtgtgctgattgtcggagtacgtttggatacaggatttgattttcgccatccggaaccgacgcacaatgaaactggcgaaaacggcttaaaaccatatgtaacagcaggtcaggccatatccaatattccacaaaatgccagtaataatgaattactgaaaatcagcgataaaacacgccgtatgttggaattaattcctgaaggtggaaattttaccgatattcctaaagatcatcctttatatgtgaaaggtatgattagccacgtttatcgtcgtatgcatcggaacgagccatcaaaaacaattattgcagcaggtggcggtggtacttggggctatcacttccctgaaccgcgtgcttttactaatagagaacgagcaaggcttcaaagttttcctgatgattttgagtttgtcggatcaacaactgaagtacgtcgccagattggtaatgctgttcctcctcagggcgtggttgaactggcaaaaagcattttaccgattttttcagacaactatgagaaagtagatttgcatgagaaattagtcgaagaaaaagaaattttattccatgaccgactaagcaaaattcgagggggaaaacaatga

SEQ ID NO: 87937 - protein, 374 aa, Neisseria gonorrhoeae FA 1090
MLSKQISNLNSSSNKPKILSLFSGCGGLDLGFHQAGCETVWANDFSHWACESFRKNIGDVIVEGDIEQINPNDPTIPDCDIILGGFPCQDFSMIWKQPGLEGERGNLYKSFLRFVNAKKPKVFVAENVKGLLTANKKKAIQQIITDFENCGYYVQAKLYNFAEFGVPQFRERVLIVGVRLDTGFDFRHPEPTHNETGENGLKPYVTAGQAISNIPQNASNNELLKISDKTRRMLELIPEGGNFTDIPKDHPLYVKGMISHVYRRMHRNEPSKTIIAAGGGGTWGYHFPEPRAFTNRERARLQSFPDDFEFVGSTTEVRRQIGNAVPPQGVVELAKSILPIFSDNYEKVDLHEKLVEEKEILFHDRLSKIRGGKQ

SEQ ID NO: 87938 - DNA, 1026 bp, Neisseria gonorrhoeae FA 1090
  CDS (1)..(1026): transl_table=11
atgcaaaactcatcacctaccacttataatcctatgaaaatcattagtttgtttagcggttgcggcggtttggatttgggtttcgaaaaagcgggatttgaaatccccgccgccaacgaatacgataaaaccatttgggcaaccttcaaggcaaaccatccaaagacccatttgatagaaggcgatatacgcaagattaaagaagaagatttccctgaagaaatcgacgggattatcggcggcccaccctgccagtcttggtctgaagcgggagctttgcgcggcatcgacgatgcgcgcggacagttgtttttcgactacatccgtattttgaaaagcaaacagccaaaattctttttagcggaaaacgtcagcggaatgctggcaaaccgccacaacggagccgtacaaaacctgctgaaaatgtttgacggatgcggatacgacgtaaccttgactatggccaacgccaaagactacggtgtagcacaggaacgcaaaagggtcttctacatcggtttccgtaaagacttggaaataaaattttcttttccaaaaggttcgacggtcgaagacaaagacaagattacattgaaagacgttatttgggatttgcaggacacagccgtaccttccgccccgcaaaacaagaccaaccccgacgcagtcaacaacaacgaatattttaccggcagtttttcccctatttttatgagccggaaccgagttaaagcgtgggatgaacagggttttaccgtccaagcttcaggcaggcagtgccaactgcacccgcaagccccaaagatggaaaagcacggggcaaacgactaccgttttgctgccggcaaagaaacactatatcggaggatgacggtacgcgaagttgcaagaatccaaggctttcccgacaacttcaaattcatctatcaaaatgtcaacgacgcatacaaaatgattggcaacgccgtccccgtcaaccttgcctacgaaattgcagcggcaattaaaaaaaccctagaaaggtga

SEQ ID NO: 87939 - protein, 341 aa, Neisseria gonorrhoeae FA 1090
MQNSSPTTYNPMKIISLFSGCGGLDLGFEKAGFEIPAANEYDKTIWATFKANHPKTHLIEGDIRKIKEEDFPEEIDGIIGGPPCQSWSEAGALRGIDDARGQLFFDYIRILKSKQPKFFLAENVSGMLANRHNGAVQNLLKMFDGCGYDVTLTMANAKDYGVAQERKRVFYIGFRKDLEIKFSFPKGSTVEDKDKITLKDVIWDLQDTAVPSAPQNKTNPDAVNNNEYFTGSFSPIFMSRNRVKAWDEQGFTVQASGRQCQLHPQAPKMEKHGANDYRFAAGKETLYRRMTVREVARIQGFPDNFKFIYQNVNDAYKMIGNAVPVNLAYEIAAAIKKTLER

SEQ ID NO: 87940 - DNA, 948 bp, Neisseria gonorrhoeae FA 1090
  CDS (1)..(948): transl_table=11
atgtacaaaacaatagatttattttcaggcattggcggaatacgcctaggctttgaaaaatacgggtgcaccaatgtattctcatcggaatgggacaaatatgcccgacaagtgtatgaagcaaactttggagaaaaaccttttggcgacattaacggcatcgatccttcagatattcccgatcatgatattctgcttgcgggatttccgtgccaacctttcagtatcgcaggtaagggattgggatttgaagatacgcgcggaacattgtttttcaatattgccgaaatcctgaaaaccaaacagccgaaggcttttcttctggaaaacgttaagcggctgactacgcacgattcgggcaggactttccgtattattttagaaacccttaaacagcttggttatacggtttattttaaggttttaaatactttggatttcggattgccgcaaaaacgcgagagaatttatattgtgggtttttcagacaacatccctttttactttcccgaacccataaaccaatatcggccattgggcgaactgctggaaaacgatcgagatgtcgaaccaagctattttttatcagataccttgaaacaaaaacgtttggcagccttaaaaaaagctccgcccaccccatcaatttggcatgaaaatattggcgggaatgtttccgcacttccatattcctgtgccttaagggccgggggaagttacaattatttggtggtaaacggagtaagaaggctaacaggaagggaaatgttaagattacaaggttttcccgatgattttgaaatcaatatcccctactcgcaagtcaggaaagtcgccggaaattctgtatccgtccctgtaatagaagccatcgcggaaaatatgctcgcttctctttccggcaaggtcgaacaaaaagggcaattggatttattggaggcaggatga

SEQ ID NO: 87941 - protein, 315 aa, Neisseria gonorrhoeae FA 1090
MYKTIDLFSGIGGIRLGFEKYGCTNVFSSEWDKYARQVYEANFGEKPFGDINGIDPSDIPDHDILLAGFPCQPFSIAGKGLGFEDTRGTLFFNIAEILKTKQPKAFLLENVKRLTTHDSGRTFRIILETLKQLGYTVYFKVLNTLDFGLPQKRERIYIVGFSDNIPFYFPEPINQYRPLGELLENDRDVEPSYFLSDTLKQKRLAALKKAPPTPSIWHENIGGNVSALPYSCALRAGGSYNYLVVNGVRRLTGREMLRLQGFPDDFEINIPYSQVRKVAGNSVSVPVIEAIAENMLASLSGKVEQKGQLDLLEAG

SEQ ID NO: 87942 - DNA, 996 bp, Nostoc punctiforme PCC 73102
  CDS (1)..(996)
atgaaagaaaaatataaagattataccaaaaactcttcacttagagttgtagaccttttcgctggttgtggagggttatctttagggtttcaaaatgctggttttaatattgtagcagcatttgataattggaaaccagctatagatgtttatcaaaaaaactttagccatgaaatttttgattatgatcttaataatttaaggaaaaactatcaaatttttagagaaatatgtcctgaaattattattggcggaccaccgtgccaagacttctctagcgcaggcaaacgcgatgaaaatttaggaagaggagatttaagtattgtattttccgagatagttacaagtgttcttcctcagtggtttttgatagagaacgtagacttatttcgtaaaagtaataaatataaagaggttaaacaaatattcaaaaatactggatatggtttaagtgaaataattttggatgcgagtttgtgcggtgtccctcaaaagcgaaaaagatttttttgctttggagagttacaaggaaaagacgaaggtctggaaccttacctgaaaaaaaggttggcagacaagccaatgaccattagagattatctgggaaataaattagaaattcaatattactacagacatccaagaagttaccaaagaagaggaatttttagtattgatgaacctagcccaacagtaagaggagttaatcgtcctattcctaaaacctataaaaagcaccctaaagatccagtaaacgttacagaaaatttgcgcccattgactacaattgaaagaagctatttgcagacttttcctgaaacatttatttttgaagggacaaaaacagaccttgagcagatgatagggaatgctgtaccagttaagcttgcagagcatgttgctcaaagtatccttgaatatattaaagataatttaaatcattctataagagttacagaaaaaacttatatttcagaattcagttcaaataaataa

SEQ ID NO: 87943 - protein, 331 aa, Nostoc punctiforme PCC 73102
MKEKYKDYTKNSSLRVVDLFAGCGGLSLGFQNAGFNIVAAFDNWKPAIDVYQKNFSHEIFDYDLNNLRKNYQIFREICPEIIIGGPPCQDFSSAGKRDENLGRGDLSIVFSEIVTSVLPQWFLIENVDLFRKSNKYKEVKQIFKNTGYGLSEIILDASLCGVPQKRKRFFCFGELQGKDEGLEPYLKKRLADKPMTIRDYLGNKLEIQYYYRHPRSYQRRGIFSIDEPSPTVRGVNRPIPKTYKKHPKDPVNVTENLRPLTTIERSYLQTFPETFIFEGTKTDLEQMIGNAVPVKLAEHVAQSILEYIKDNLNHSIRVTEKTYISEFSSNK

SEQ ID NO: 87944 - DNA, 948 bp, Bifidobacterium longum DJO10A
  CDS (1)..(948)
ttgttcgccggcatcggcggcatccgcatgggaatggtgcaggcgctgggcgatgccgcgcacgtggtgtattcgtccgagtggaacaagtacagcgtgcagacctatgaggcgaactggcacgacgagaatcccgtggccggcgacatcaccaaggtcgacgagcatgacgttcccgacatcgacctgctgctcgcgggattcccgtgccagccgttctccatcgccggcgtctccaagaaacagagcatgggccgtcccaccggcttcgaggacaagacccaaggcacactgttcttcgacgtggcgagaatcatcaaggcgaagcagccgaaggcgttcctcctggagaacgtgaagaacctgctctcgcacgaccgtgggcgcacgttcaagacgatatattccgtgctgaccgaagaccttggataccacgtcacctacaagctgatcgacgcggcgggcttcgtcccccagcacagggaacgcacgtacatcgtgggctttcgcgaggagaacgggttcacgttcgatgacgtgaagcccatcgcgcacggcaacgtcggcagcatcctcctgcccgcctcccaggttcccgacaagtatgttctgagcgacaagctgtggacgtacctccagaactacaagaagaagcacgaggccgcaggcaacggtttcggatatggcatggtcgatgccgccaccgaccacacgcgcacgttgagcgcgcggtacggaaaggacggcagcgagatactggtctcacgcggcgagggaaagaaccctcgaaggctaaccccgcgcgaatgcgcgcgactgatgggctacccggattcgttcagtatcccggtatcagacacgcaggcataccggcagttcggcaactcggtcgcagtgccggtcatccgagccataggcgaggcgatgagaccctacctgtccgactga

SEQ ID NO: 87945 - protein, 315 aa, Bifidobacterium longum DJO10A
MFAGIGGIRMGMVQALGDAAHVVYSSEWNKYSVQTYEANWHDENPVAGDITKVDEHDVPDIDLLLAGFPCQPFSIAGVSKKQSMGRPTGFEDKTQGTLFFDVARIIKAKQPKAFLLENVKNLLSHDRGRTFKTIYSVLTEDLGYHVTYKLIDAAGFVPQHRERTYIVGFREENGFTFDDVKPIAHGNVGSILLPASQVPDKYVLSDKLWTYLQNYKKKHEAAGNGFGYGMVDAATDHTRTLSARYGKDGSEILVSRGEGKNPRRLTPRECARLMGYPDSFSIPVSDTQAYRQFGNSVAVPVIRAIGEAMRPYLSD

SEQ ID NO: 87946 - DNA, 1227 bp, Haemophilus somnus 2336
  CDS (1)..(1227)
atgacaaatctcgtggataaaacaaacctaaattttgaattacccttatttgatgagtgtgattggcgttttaaaacatttaaaaatcctaatgcaaaaatacgcttagccacgacgtttagtggtattggtgcaatagaacaagctttcaaacgtttagaactaaatcactgtattgtttttgctggcgatattgatccccacgttaaaaaaagttatttagccaattacgatttatctgaagaacattggcattctgatattaccacttttgatgcgataccttaccgtgatcaagtagatattttagtgggtggaagcccttgtcaggctttctctatggtgggaaaacgacatggattggaagatactcgaggtacgcttttttatgattttgcgagagtggtaaatgagactcaaccaaaagtctttatttatgaaaacgtaaaagggttattaaatcacgatggtggaaatacttggcaagtagtaaaagatgtttttcatagcttaggctacgatttatattttcaagtaatgaacagcaaaaattatggtattccgcaacatcgtgaacgtatttttgttgtaggatttaaaacctcgccaaaaggcggattccaatttccaactaagattcctttagagcgtacgatgcaagattttctagaggattacactgatagcaaatattttcttaaagaaaaaggcattaaatttgtaaccagttctaaaaatcggcaaaaacgctatacgcaaattaatggcgatataatgttatgtcaaaaagccaaccaacaatttaattggcatggtgattttgtttttgtgcccaaaataaataaaagcagttttgatgagtttatttttaacattaatgatgtcgaagaaaaatattatttatccagcaaaattcgtgattatgttttagcaggtggaacaaagaatttcaaaacgagtacacaaactgatttatcagtagctcgtcctttattacaaacaatgcacaaaatgcaccgtgccggcgtcgataattatgttactcataatcaaggaagaataagaaagctcacgccaagagagtgtttacgtttaatgggatttagagatgatttccaaattgtcgtcagcgacactcaaacatacagacaagcaggaaatagtattgtcgttgatgtgttaatcgcattgctaaaacaaatggatattacacaatacggagaatag

SEQ ID NO: 87947 - protein, 408 aa, Haemophilus somnus 2336
MTNLVDKTNLNFELPLFDECDWRFKTFKNPNAKIRLATTFSGIGAIEQAFKRLELNHCIVFAGDIDPHVKKSYLANYDLSEEHWHSDITTFDAIPYRDQVDILVGGSPCQAFSMVGKRHGLEDTRGTLFYDFARVVNETQPKVFIYENVKGLLNHDGGNTWQVVKDVFHSLGYDLYFQVMNSKNYGIPQHRERIFVVGFKTSPKGGFQFPTKIPLERTMQDFLEDYTDSKYFLKEKGIKFVTSSKNRQKRYTQINGDIMLCQKANQQFNWHGDFVFVPKINKSSFDEFIFNINDVEEKYYLSSKIRDYVLAGGTKNFKTSTQTDLSVARPLLQTMHKMHRAGVDNYVTHNQGRIRKLTPRECLRLMGFRDDFQIVVSDTQTYRQAGNSIVVDVLIALLKQMDITQYGE

SEQ ID NO: 87948 - DNA, 1188 bp, Haemophilus influenzae R2846
  CDS (1)..(1188)
atggatatcggatttgaaggtagtttctcttgtctaaaaaaatctattaatgaggagctccaccctgaatggatcagctccacagaaaatgaatgggttaccgtttcgcccacttcttttgagacaatttttgctaatgatattaaacctgatgctaaagcagcatgggtttcttatttcttagaccaaaaagcgaatgcaaacgaaatctaccacttagaaagcattgttgatcttgtaaaaaaagaacgggaaactcacaatattttcccaaaagacattgatatattaacaggtggatttccttgtcaagatttttctgtagctggaaaacgattaggatttgattctcacaaaaatcatcatggaaaaatatcaaatatagatgaaccctcaattgaaaatagaggacaattatacatgtggatgagagaagtaatatctataactcaacccaaattattcatagctgaaaatgtaaaaggattaacgaaccttaaagatgtaaaagaaattattgaacatgattttggtcaagctagtgacgaaggatacttagttgtaccagctcaagtattaaatgctcagttttatggagttcctcaatcacgtgagcgtgtcattttttttggttttaaaaaaaatgcgctaaataaaaaagctttagaagaattacaaaaagaaaatattgctgaggattacaatccatatcctcccccaactcatggaaaagaaaatttgaaagctgttgttacatgcaccgatgcatttataaatctacaagaacccaattttagcaaagacccctctcaacaaaaatattcaaaagccaaatatatgggaaaccattgtcaagggcaggttgaaattaaacttaattctgttggcccaacaatccgatctgaacatcatggtaatattgaatatcgtagactaagcatagagcatggagggaaatatattaacgaattatctaaaggcatgctcgaacgtcgtcttactataagagaatgtgctagattacaaacgtttcctgatagataccaatttattttacctaaaacagcagaaaacgtttctgtttcagctagtaatgcctataaaattattggcaatgcggtaccatgtgtattagcttataatattgctaaaaatatagaaaaaaaatggaatctttattttaaatag

SEQ ID NO: 87949 - protein, 395 aa, Haemophilus influenzae R2846
MDIGFEGSFSCLKKSINEELHPEWISSTENEWVTVSPTSFETIFANDIKPDAKAAWVSYFLDQKANANEIYHLESIVDLVKKERETHNIFPKDIDILTGGFPCQDFSVAGKRLGFDSHKNHHGKISNIDEPSIENRGQLYMWMREVISITQPKLFIAENVKGLTNLKDVKEIIEHDFGQASDEGYLVVPAQVLNAQFYGVPQSRERVIFFGFKKNALNKKALEELQKENIAEDYNPYPPPTHGKENLKAVVTCTDAFINLQEPNFSKDPSQQKYSKAKYMGNHCQGQVEIKLNSVGPTIRSEHHGNIEYRRLSIEHGGKYINELSKGMLERRLTIRECARLQTFPDRYQFILPKTAENVSVSASNAYKIIGNAVPCVLAYNIAKNIEKKWNLYFK

SEQ ID NO: 87950 - DNA, 1308 bp, Crocosphaera watsonii WH 8501
  CDS (1)..(1308)
atgaacaacaaacgtcccatcgctgttgatttattcgccggggttgggggaatgacattagggtttgaacaagctggtttcgatgttttagcctcggtggaaattgatcccattcactgcagtattcaccgttataattttcccttctggacaactatttgtgcttcagtaacctcaataaaagctagtgagattagagagttatcaactattaaaaataaacccattgacgttgtatttgggggtcctccttgtcagggtttttctttaatgggtaaacgaagtttagaggatgatcgtaatactttggttaaacattttattcgcttagttttggagttacaaccgaactatttcgtcatagaaaatgtaccaggtatggtgattggcaaacagcaaatgtttttagaagaaatatttgctgaatttgctcaaaataactatcaagtaaaaccagactataaaattttaaactctgctaattatggggttcctcaactaagagaaagactatttttactgggaagtaaaaaaggattaaatttacctaattaccctagttttattactgattacacccacataaatgactcaaatttaccttcaactccaacggtaaaagaagcaattcaagacttaccagaagttaatcaatatccagaattaaaccgacgagactgggtaattactgattatggaaaaccgagtaattatattaaaaatcttagaattgtgtctaatgcaattgatgattattcatacccaagacactataataaaaaacttttaacctctagtttaagaaccaaacatcaacaaaaatctatagagagatttaaggaaactcatcaaggaaaaattgaacccattagtcgctttttcaggttgcatcctgatggtttttgtaataccttaagagcagggacaccgattaatcgtggggcccatacttcccctcgtcccattcatccttttacccctagatgtatcactgtcagagaagcagcaagactacattcataccctgattggtttcgatttcatgtcacaaaatggcatggttttcgacaaattggtaattcagttcctcccttattagcaaaagcggttgctcaagaaattcttaaagttattgagatttcacccgttaaaccaatgactatatatcaattagaaagggaagaattattaagctttaatatgactcaagcagctaaatattataatgtaagccccgatgttattgggaagagaattagaaaagaagatactagaaaaaataaggaaacaatcggcagttttatttag

SEQ ID NO: 87951 - protein, 435 aa, Crocosphaera watsonii WH 8501
MNNKRPIAVDLFAGVGGMTLGFEQAGFDVLASVEIDPIHCSIHRYNFPFWTTICASVTSIKASEIRELSTIKNKPIDVVFGGPPCQGFSLMGKRSLEDDRNTLVKHFIRLVLELQPNYFVIENVPGMVIGKQQMFLEEIFAEFAQNNYQVKPDYKILNSANYGVPQLRERLFLLGSKKGLNLPNYPSFITDYTHINDSNLPSTPTVKEAIQDLPEVNQYPELNRRDWVITDYGKPSNYIKNLRIVSNAIDDYSYPRHYNKKLLTSSLRTKHQQKSIERFKETHQGKIEPISRFFRLHPDGFCNTLRAGTPINRGAHTSPRPIHPFTPRCITVREAARLHSYPDWFRFHVTKWHGFRQIGNSVPPLLAKAVAQEILKVIEISPVKPMTIYQLEREELLSFNMTQAAKYYNVSPDVIGKRIRKEDTRKNKETIGSFI

SEQ ID NO: 87952 - DNA, 1263 bp, Crocosphaera watsonii WH 8501
  CDS (1)..(1263)
atgattaattttattgatctttttgctggtattggaggaatgcgtttagggttagaattagcctgtaaaaaactaaatatagaaacccgttgtattttaagttctgaaattgattataaagcttgtgaaacttatgcactaaattttgatgaaataccacaaggagacattaaaaatatagataaaatttcatctttcaactttattttagcaggatctccttgtcaacctttttcttatgcaggaaaacatcaagggtttggagatactagaggtactctgttttttgaagttgaaagaattttggataaatataaacccgatggatttttattagaaaatgttcgaggtttagtcactcatgataaaggaagaaccttaaaaactattataaataaattaaacgacctagattatagtgtcgaatatttcttattaaacagtagtaattttaatgttcctcaaaatagagtaagaatctatattgtaggaaaaaaaggaagtcaacctaatttgactattaaatcagataaaggagcgattgattcccattcttttaaaaagaatattattcaaggtgatctgtttgctcctataaattatccgactaaaccgctaacagttaaagatattttaaaagatatagtagaagaaaaatacttttgctctcaagaatttactaatttactcaatcgtgctgtaagaggaaactttaataaattacatggaacaagactaattgattttagaggaggaaactctttacattcttgggatttaggaatcaagggagaatgtagtagtgccgaaagaaatttgatgaatttattaattgctaatcggagaaaaaaagttttcggaactcatcaagatggaaaaagtttgaccttggaacaaataaaaatattctacttaaatgatgatttagaacaactgattacaagtttattagctaaaggttatcttaaagaagaatgtgataaatatggtccagtatgtggtaatttatcctttgaagtgtttaagtttttagatcctgatagtatctctattaccttaaccagtgccgatgctcatagattagggattgttattaataatagacctcgaagactgacccctagagaatgtgcaagattacagggttttcctgatagttttaaattacatcctgatgatagggctacttataaacaattaggaaattccgtcagtgttcctgtggttgaagcagtgataatggattattttcaaaataattag

SEQ ID NO: 87953 - protein, 420 aa, Crocosphaera watsonii WH 8501
MINFIDLFAGIGGMRLGLELACKKLNIETRCILSSEIDYKACETYALNFDEIPQGDIKNIDKISSFNFILAGSPCQPFSYAGKHQGFGDTRGTLFFEVERILDKYKPDGFLLENVRGLVTHDKGRTLKTIINKLNDLDYSVEYFLLNSSNFNVPQNRVRIYIVGKKGSQPNLTIKSDKGAIDSHSFKKNIIQGDLFAPINYPTKPLTVKDILKDIVEEKYFCSQEFTNLLNRAVRGNFNKLHGTRLIDFRGGNSLHSWDLGIKGECSSAERNLMNLLIANRRKKVFGTHQDGKSLTLEQIKIFYLNDDLEQLITSLLAKGYLKEECDKYGPVCGNLSFEVFKFLDPDSISITLTSADAHRLGIVINNRPRRLTPRECARLQGFPDSFKLHPDDRATYKQLGNSVSVPVVEAVIMDYFQNN

SEQ ID NO: 87954 - DNA, 1020 bp, Crocosphaera watsonii WH 8501
  CDS (1)..(1020)
atgttaactaattatatcaatcaaattaataacattttgaaaccacaacagctaaaatctcatttagtgttagatttgtttgcagggtgtggtggtttatctttgggatttgaagcgcaaggatttgagacttacggatttgagaaagagcaagattgttgtcatagttatgaaaagaatttacggggtaaatgtgagcaaatagaattaacagttaatagtaaattatcgggtgcatctgtcatcattggtggaccaccttgccaaccatttagtgttgggggaaaacaaaaaggtctaagagattcacgagatggttttcctatttttatcaatgccattaaacaggttaagcctgatatttggttatttgaaaatgtgagagggttactatacaaaaataaatggtattttgataagataacacaatcattacaagatttaggctacattattgaatggaaactattaaattctgttgatttcggagttcctcaaaatagagaaagattaatggtagttggacatcgaggaaaattccagtttcctcaaatttcagctaagagaattacagcaggagaagcattaggagaattagcatttcaagtgttacctgactctaaatttttaactcctagcatggataaatatattgctaaatatgagaaagcatcttgttgtaaacggcctcgtgatttacatttagataaacaagcaaggactttaacttgtcgtaatttagcaggtgcaacaggagatatgcacagaattaaacttcccgatggtagaagaagacgtttatcaattcgagaagcagcgcggttacaaagttttccagactggtttgaattttatggaagtgaaacaagttcttataatcagattggtaatgctgtgtctccactattagctttttatttagcaaaaagtgtccgtaattatttagaatctagttatcgcttatcagccagagaacttaaaaaatatacgcttcctcaacaattatctttacctttatga

SEQ ID NO: 87955 - protein, 339 aa, Crocosphaera watsonii WH 8501
MLTNYINQINNILKPQQLKSHLVLDLFAGCGGLSLGFEAQGFETYGFEKEQDCCHSYEKNLRGKCEQIELTVNSKLSGASVIIGGPPCQPFSVGGKQKGLRDSRDGFPIFINAIKQVKPDIWLFENVRGLLYKNKWYFDKITQSLQDLGYIIEWKLLNSVDFGVPQNRERLMVVGHRGKFQFPQISAKRITAGEALGELAFQVLPDSKFLTPSMDKYIAKYEKASCCKRPRDLHLDKQARTLTCRNLAGATGDMHRIKLPDGRRRRLSIREAARLQSFPDWFEFYGSETSSYNQIGNAVSPLLAFYLAKSVRNYLESSYRLSARELKKYTLPQQLSLPL

SEQ ID NO: 87956 - DNA, 1119 bp, Haemophilus somnus 2336
  CDS (1)..(1119)
atgcagtctaatcaactctctttatttggtacgcaaccaaaaccaaaaatcctttctcttttttcaggctgtggaggtttggatcttggctttcaccaagctggttacgaaacagtttgggcgaacgacttttctcattgggcatgcgaaagtttccgtaaaaatatcggtgatgtaattgtagaaggtgatattgaacagattaacccaaatgatcctacgattcccgactgcgatattattcttggtggttttccgtgccaagacttttcgatgatttggaaacagcctggcctagatggcgagcgaggcaatctttacaagagctttttacgctttgtgaatgccaaaaaaccgaaagtgtttgtagcagaaaatgtgaaaggtttgctgacagcaaataagaaaaaagccattcaacaaattattactgattttgaaagctgcggttattacgttcaagctaagttgtataactttgccgaatttggcgtaccacaatttcgtgaacgtgtgctgattgtcggcgtacgtttagatactggctttaattttcaacacccaatgccaactcataatgcaagaggtgaaaatgggctaaaaccttacgttaccgcaggtcaagctgtttctaatattccaaacgatgcgatgaacaatgagctgatgaaaattagcgataaaactcgtcaaatgctgtcacttattcccgaggggggtaattttaccgatattccgaaagatcatcctttgtatgtgaaaggaatgattagccacgtttaccgccgtatgcatagagatgaaccatcaaaaaccattattgcagctggcggtggtggcacttggggctatcattttcctgagcctcgagcctttactaatcgtgaacgtgccagattgcaaagtttccctgatgattttgaatttattggctcagctactgaagttcgccgtcaaattggcaatgctgttccaccgcaaggcgtagtagagcttgcaaaagcaattttgcctattttctcggataattatgaaaaagtagatttacacgaaaaattggaaatagaaaaaacagaagtcttccaaaaccgtttaaataaaattcgtggaggaaaataa

SEQ ID NO: 87957 - protein, 372 aa, Haemophilus somnus 2336
MQSNQLSLFGTQPKPKILSLFSGCGGLDLGFHQAGYETVWANDFSHWACESFRKNIGDVIVEGDIEQINPNDPTIPDCDIILGGFPCQDFSMIWKQPGLDGERGNLYKSFLRFVNAKKPKVFVAENVKGLLTANKKKAIQQIITDFESCGYYVQAKLYNFAEFGVPQFRERVLIVGVRLDTGFNFQHPMPTHNARGENGLKPYVTAGQAVSNIPNDAMNNELMKISDKTRQMLSLIPEGGNFTDIPKDHPLYVKGMISHVYRRMHRDEPSKTIIAAGGGGTWGYHFPEPRAFTNRERARLQSFPDDFEFIGSATEVRRQIGNAVPPQGVVELAKAILPIFSDNYEKVDLHEKLEIEKTEVFQNRLNKIRGGK

SEQ ID NO: 87958 - DNA, 1155 bp, Burkholderia cepacia R1808
  CDS (1)..(1155)
atgcctcccgcctccgcgctctgcggcccgagcgatcgctcgcgcctgtcgtatctcgaatttttcgcaggcagcggcctggtggctgaagggctccgcggcctcttccgcccagtgtgggcgaatgatctctccgagaagaaagcggcgacctacaccgcgaatcacggcgcgcggcattttcacctcggatcgatcgagaacgtcgagggcgcggttttgcccgtggccgacatgacgtgggcctcgttcccttgccaagatttgtcgctcgcgggcaagcaagccggcattcacgccgcgcgtagcgggcttgtgtggcaatggcttcgcgcgctcgacgagatacctgagaggccgcctgtcctggtcgcagagaacgttgtgggcctcgtctccgcgcacggcggcgaaggctacctgcagctgcatgcggcgctgcgcgagcggggctacctcgtgggcgccatgaagctcgacgcggcccgatggctgccgcaatcgcggccaagaatctttgtcgtggcctatcgcgagagtctgcccctgccggccgagcttgtgaacgatggccccggctgggcgcatgacaccgccttgcgccgcgtccgcgaaagcctcgaaagcgcgtcgccggctggttcggatggctgggtctggtgggcgttgcccgagccgcccgctcgcgccgcgcgccttgcgagcgtgctcgaccagagcgccaaatggagcgccgttgacgctccgccgaaggccctcgccttgattgcgccagcgcacgagtcgcagctgcgcgatgaggcgcggcaggccacgagcggcgtcgccgtcgcgcccggctatcggagaacacgcccaggcggccaggtggtcgagttgcgctttgatggcctcgccggttgtttgcgcactccgaaaggcggcagcagccggcagcttctcgtgcaatcgaccgacggcggcgaagcgcccttgcaatgccgatggctgacgccgcgcgaagcggcgcggctcatgggcgcgccggagcgctacgcgctcgcaggcagcgccaccgacgcctacgccgcgatgggcgacgcggtcgccgcgccggtcgcaaggtggctcggccggcatcttctcgtcccgctcgcgcgcgcagcaaggtcttga

SEQ ID NO: 87959 - protein, 384 aa, Burkholderia cepacia R1808
MPPASALCGPSDRSRLSYLEFFAGSGLVAEGLRGLFRPVWANDLSEKKAATYTANHGARHFHLGSIENVEGAVLPVADMTWASFPCQDLSLAGKQAGIHAARSGLVWQWLRALDEIPERPPVLVAENVVGLVSAHGGEGYLQLHAALRERGYLVGAMKLDAARWLPQSRPRIFVVAYRESLPLPAELVNDGPGWAHDTALRRVRESLESASPAGSDGWVWWALPEPPARAARLASVLDQSAKWSAVDAPPKALALIAPAHESQLRDEARQATSGVAVAPGYRRTRPGGQVVELRFDGLAGCLRTPKGGSSRQLLVQSTDGGEAPLQCRWLTPREAARLMGAPERYALAGSATDAYAAMGDAVAAPVARWLGRHLLVPLARAARS

SEQ ID NO: 87960 - DNA, 1422 bp, Rubrivivax gelatinosus PM1
  CDS (1)..(1422)
atgacttcactgcatacctacgcagtacgcaagattggcagccaccgtggttcgccacggctctggctggagggcagggagccgaccaagggaggtttcctgccgggcacgcgcttcaacacgcgtgtcgacaccggccgggcactcctggtgctggaggcggtcgaagatggtgttcgcatcgtctctggcaagcagcgcggcgaccggcagatcccggtcatcgacatcaacagcaaggaactgctcgacatcttcacgggtatcgaggcggtccgcgtgatcgtccaggagggtgtcatcagcatcctgccgctggcctccgaactgcgcgcgcgcgagcgcgtcattcggctgaaggacggactggcgaacggaaccctttccaccggctcggtttcgagcggcatcggggtgcttgaccgtgcggcgcacgagggccttgaacaggccggcgtggagtgccgcctggccttcgcgaacgagatccgggaagactgcgtcgagcacatgtgcgatcacaacccgatcgtggaccagcacaccgtgaccctgacggcgccgatgcaggagctcgcgttcgacgagtgggcgatgagccgcttgccgaaggtggacgttctggtcggcggcatcccttgttccggcgcaagcagggcagggcgcgcgaagcggggcgcctcgcacgcggaagcgcaccccgaagtcggtcacctgatcgtggccttcctcgccatcatcgccaaggtgaacccgtcggccatcgtgctggagaacgtccccgtctggggaacctctgcttcgatgttcatcctgcgcaaccagctgcgggacctgggatacgacgtccacgagacgatcgtcaactcggccgaatggaacgtgctcgagcaccgggagcgcctgtgtgtcgtggcggtgaccaaggggatcgagttcagcttcgacggcctagagcggccggagcccgtgagtcgccgtctcggcgagatcatggacgaagtgccggtggacgcgccgtgctggagcgagatggcctacctgaaggacaagcgtgcccgcgacgaggccaaaggcaacaacttcaagatgacggtgctcacgcccgacagcgagaaggtgccttgcctgaacaagtccttgtggaagcgccagagttctggcagtttctggaagcatccggacgacagcaaccttctgaggctgcccacagtgcgtgaacacgcgcgctgcaagggtgtctgggaggatctggtcgaaggtgtcggcctgaccttcgggcacgaggctctcggacaatccgtcacggttccgccgttcatctcgatcttcaagctgctcggccaggcgctcaaacgctttgccagtgaggctgaggcttcgatccaacccttcgcgctccgcgagctcaaggcagcctga

SEQ ID NO: 87961 - protein, 473 aa, Rubrivivax gelatinosus PM1
MTSLHTYAVRKIGSHRGSPRLWLEGREPTKGGFLPGTRFNTRVDTGRALLVLEAVEDGVRIVSGKQRGDRQIPVIDINSKELLDIFTGIEAVRVIVQEGVISILPLASELRARERVIRLKDGLANGTLSTGSVSSGIGVLDRAAHEGLEQAGVECRLAFANEIREDCVEHMCDHNPIVDQHTVTLTAPMQELAFDEWAMSRLPKVDVLVGGIPCSGASRAGRAKRGASHAEAHPEVGHLIVAFLAIIAKVNPSAIVLENVPVWGTSASMFILRNQLRDLGYDVHETIVNSAEWNVLEHRERLCVVAVTKGIEFSFDGLERPEPVSRRLGEIMDEVPVDAPCWSEMAYLKDKRARDEAKGNNFKMTVLTPDSEKVPCLNKSLWKRQSSGSFWKHPDDSNLLRLPTVREHARCKGVWEDLVEGVGLTFGHEALGQSVTVPPFISIFKLLGQALKRFASEAEASIQPFALRELKAA

SEQ ID NO: 87962 - DNA, 1128 bp, Burkholderia fungorum LB400
  CDS (1)..(1128)
atgatcgcggaagccacgctgcgggaaatgctcgatatcaggactcgcaaggcgccggtcgagcgggcacccgaatttcgcctcgtcgacctctttgccggaatcggcggtattcgccgcggattcgaagcgcacggcggacggtgtgtcttcacgagcgaatggaacgacttctcgaagaagacctatcaggaaaattaccgtgattgcgacgacgcccatcagttcgtgggtgacatcgtttcgttcgacgtcgcttccgtgccatcacacgacgtgctgcttgccgggtttccgtgtcagcccttcagcatcgcgggcgtgagcaagaaaaattcgctcggccgtccgcacggcttcgaatgcacgacacaaggcacgctcttttacgacgttgcacgcatcatcgcggcgaagcgcccggctgccttcctgctggagaacgtcaagaatctgctgtcgcacgataaaggcaaaaccttccagaccatcatcgacgtgctgcgtgatgaactcaaatacgacgtccattacaaggttatcgacggtcaatacttcacgccgcaacatcgggaacgcatcgtgatcgtcggttttcgcgaggagaccgaatttacgttcgacgacctgaacgtgccggccgaaggaccacgccttgcttcgattctgcacaagaccgacggcagcgaaccggtgctggcgcatgacggcgaccgtttcttcgatcacgcgtctcgcgaggtgcaacccaggtacacgctcactgcgaacctgtgggcctatcttcaagcttacgcggccaagcatcgggcggcgggcaacggtttcgggttcgggctggtcacgcccgacagcgtgacgcgcacgctgtcggcccgatatttcaaggacggctcggagatcttatgctcgcaaggcaaaggcaagcgtccgcgccgtttgacgccgcgcgagtgcgcccggctaatgggttttcctgacgacttcgtgattccggtgagcgacacgcaagcctatcgccagttcggcaatagcgtggtggttccggtcatgcaggaagtcgcacgaatcatgattccgcacgtgaagggactgctggcgcaaaaagttgccggcgcaaccagttga

SEQ ID NO: 87963 - protein, 375 aa, Burkholderia fungorum LB400
MIAEATLREMLDIRTRKAPVERAPEFRLVDLFAGIGGIRRGFEAHGGRCVFTSEWNDFSKKTYQENYRDCDDAHQFVGDIVSFDVASVPSHDVLLAGFPCQPFSIAGVSKKNSLGRPHGFECTTQGTLFYDVARIIAAKRPAAFLLENVKNLLSHDKGKTFQTIIDVLRDELKYDVHYKVIDGQYFTPQHRERIVIVGFREETEFTFDDLNVPAEGPRLASILHKTDGSEPVLAHDGDRFFDHASREVQPRYTLTANLWAYLQAYAAKHRAAGNGFGFGLVTPDSVTRTLSARYFKDGSEILCSQGKGKRPRRLTPRECARLMGFPDDFVIPVSDTQAYRQFGNSVVVPVMQEVARIMIPHVKGLLAQKVAGATS

SEQ ID NO: 87964 - DNA, 1143 bp, Enterococcus faecium
  CDS (1)..(1143)
atgacatttttagatttattcgctgggattggtggcttttgcttaggtatggaacaagcgggtcaccagtgtatcggcttttgtgaaattgatgattttgctcgccagagttataaggcaatccatgatacaagtaaggaggtggaaatgcatgacatcacaagtgtatcagacgagtttattcaatctctcggaccagtggatatcctttgcggtggatttccgtgccaagctttttcaattgcgggaaagcggcaaggattttccgatactcgaggtactttattctttgaaatcgctcggttcgccgctattctccaacctaagtttttattccttgagaacgtccggggattactcaatcacgaaggaggggctacgttcgagacgatcctccgaacgctggatggattggggtatgatgtggaatggcaagtgcttaactcaaaggcctacgttccccaaaaccgtgagcggatcttccttatcggacattctcgagacgcatgtaccgaacaagtatttcctatcattggatcgtctccaacatctgatcaaaacatcagaaacttattaaatatcaacccttccaatcgaggaatggggggacaagtctatgggtcagatgacgtagcgcctaccttgaccggtgatgaaggaatcaaaatcgcattgccggtagatgatggaatttctgtagcgggtatgttactgggaaattttgaacaaggcaatcgggtttatgagataactggaacagcgcctactttgtcaacgaaacaaggcggaacgaagatcatgcttcggaaaaacgaaacagaatatcaagaggtgaagccagggaacagtgtgaacctggcttttcctaattccacaagtcgtcgaggccgtctgggaaaacaaagtgtgcataccttattaacaggagaccaacaagcagtcgtcacggatcagtatcaaattcgaaagttaacacctagggagtgctggcggcttcagggctttccggactgggcttttgatcgagcttctcaagtcaattcagatagtcagttgtataagcaggctggaaattctgtaacagttccggtcatttttgatattgctagaagattaaaggaggtaaaaacagatgatttatga

SEQ ID NO: 87965 - protein, 380 aa, Enterococcus faecium
MTFLDLFAGIGGFCLGMEQAGHQCIGFCEIDDFARQSYKAIHDTSKEVEMHDITSVSDEFIQSLGPVDILCGGFPCQAFSIAGKRQGFSDTRGTLFFEIARFAAILQPKFLFLENVRGLLNHEGGATFETILRTLDGLGYDVEWQVLNSKAYVPQNRERIFLIGHSRDACTEQVFPIIGSSPTSDQNIRNLLNINPSNRGMGGQVYGSDDVAPTLTGDEGIKIALPVDDGISVAGMLLGNFEQGNRVYEITGTAPTLSTKQGGTKIMLRKNETEYQEVKPGNSVNLAFPNSTSRRGRLGKQSVHTLLTGDQQAVVTDQYQIRKLTPRECWRLQGFPDWAFDRASQVNSDSQLYKQAGNSVTVPVIFDIARRLKEVKTDDL

SEQ ID NO: 87966 - DNA, 1161 bp, Ferroplasma acidarmanus
  CDS (1)..(1161)
atggataaatacgcttcagcaactctaagaacaagagctctgtaccatgcactccacgagaataataaagatgatatttattatgaatatgttggaaataaaacaacagtggatagtttatctgagagcgtaaaagacatcaatgttccagaaattataaataaagaaattacggaagaaaatcaggaaataatagcagatgaaattacagataagatgaaattaaagggaatacataaagtagatgttatgatagggggcccaccctgccagacctattctgttataaggcgttttgattctaaaatgcaaggaagaaactggaaagatgatccaagaaattacctctttaaaagatatgtttactttttacaaaaatttagccccgatatttttgtatttgaaaatgtgccgggtattaaatccgcaaatggtggagagttcctgcataattttgtcaccatggtaaataaagcaggatacaatattaccgaaaaaattcttaatgctaaggatttcatggttctccagcagagaaagagagaaataattataggctggaaaaaaggatataaactcgattatcctgaattcgaaactgttgaacataattataatgtaggtgaacttttaaacgatctgccaggacttgaaccggggcagggagattatcttcaggaatataaatcaggtgcttcagattatctggaaaaaaccggtattagaaaacataatgatattttgatacagcataaagcaagatatcacaatgaaagggacaggagaatatatagatatgttataaacgagtggaatacgaatcacaggcatattaaatacggggagcttccagcagagttgaggccctatgaaaatacaggaaccttttctgataaattcaaggttgtagcgtcagatcttaattattcccagacaataacggcgcatctttccagggacgggcattattacattcacccggatatagaacaggcacgttcaattacagtaagggaagcagctcggctgcagtcatttcctgataattttaaatttgaagggcccgttagtgcacagtacagacagataggaaatgctgtaccgccaataatggcgaaatccatagctttgaaaataaaaaaaatgcttgatgaaatatga

SEQ ID NO: 87967 - protein, 386 aa, Ferroplasma acidarmanus
MDKYASATLRTRALYHALHENNKDDIYYEYVGNKTTVDSLSESVKDINVPEIINKEITEENQEIIADEITDKMKLKGIHKVDVMIGGPPCQTYSVIRRFDSKMQGRNWKDDPRNYLFKRYVYFLQKFSPDIFVFENVPGIKSANGGEFLHNFVTMVNKAGYNITEKILNAKDFMVLQQRKREIIIGWKKGYKLDYPEFETVEHNYNVGELLNDLPGLEPGQGDYLQEYKSGASDYLEKTGIRKHNDILIQHKARYHNERDRRIYRYVINEWNTNHRHIKYGELPAELRPYENTGTFSDKFKVVASDLNYSQTITAHLSRDGHYYIHPDIEQARSITVREAARLQSFPDNFKFEGPVSAQYRQIGNAVPPIMAKSIALKIKKMLDEI

SEQ ID NO: 87968 - DNA, 1005 bp, Clostridium thermocellum ATCC 27405
  CDS (1)..(1005)
atgaaaataattgacttaaataaaataagaaacatcagaaaatacactgttgcgtcactatttgctggtgctggcggtctagacatgggattagaattagcaggtttcaaaaccgtttgggctaatgatattgataaagatgcttgtgctacataccgtctatggagtcaggcagatgttgtgcaaggagatattgcaaaaattgattactctgatgttccagatacagacgtgataacgggtggttttccatgtcaaggcttttcgttggcaggaccacgaaaaattaatgatgaaagaaataaattgtatcgttactttgttaaattagttgaattaaagcaaccttatgcttttattgcagaaaatgtaaaaggcatccttactcttggcgatggcgaaattattgaagccataatagaggattttgcgagcaaaggatatgatgtatatcctaatcttgttaatgccgctgactatggagttccgcaagacagatggcgtgttattctatacggatttagaaaagatttagaagtaaaagattttaaatttcctgagccgttcccatataaagttaccttgagagaggctatcggggatatgcctgaaccaaaacagagtgatatatgccatgcttcttattcaagtaggtatatgtcgagaaaccgaaaaagaggttgggacgaagtaagttatacaattccagcaatggcgaagcaagttccgttgcacccatcttctccagacatgattaagattgctgaagataagtggatatttggtgaagggaaaacaagaagatttagttggcaagaagcagcagttatacaaactttccctcgtgatatggaattcgtaggaaatctaacttctaagtatcgacagataggaaatgctgtcccggtaaaacttgcagaagtaataggtaagaaattatatgaaatacttgaagagaagttaaatgcaaatgttaaagaattagaacaaaaagttggtgaatga

SEQ ID NO: 87969 - protein, 334 aa, Clostridium thermocellum ATCC 27405
MKIIDLNKIRNIRKYTVASLFAGAGGLDMGLELAGFKTVWANDIDKDACATYRLWSQADVVQGDIAKIDYSDVPDTDVITGGFPCQGFSLAGPRKINDERNKLYRYFVKLVELKQPYAFIAENVKGILTLGDGEIIEAIIEDFASKGYDVYPNLVNAADYGVPQDRWRVILYGFRKDLEVKDFKFPEPFPYKVTLREAIGDMPEPKQSDICHASYSSRYMSRNRKRGWDEVSYTIPAMAKQVPLHPSSPDMIKIAEDKWIFGEGKTRRFSWQEAAVIQTFPRDMEFVGNLTSKYRQIGNAVPVKLAEVIGKKLYEILEEKLNANVKELEQKVGE

SEQ ID NO: 87970 - DNA, 1452 bp, Clostridium thermocellum ATCC 27405
  CDS (1)..(1452)
atgaccttccttgatttctttgcaggaataggcggctttcgattggggttagaacttgcaggacataaatgtataggattttgtgaaaaagataaatttgcagttaaaagctatagagcaatgtttgatacggaaggagagtggtatgcagatgacgttacaaaacttaaaagcgaagatatcccatatgcagacatctggtgttttggattcccatgtcaagacatctcagttgcaggaaaacagcgaggaatcagaggaaaaagaagcggcttatattttagaattattgaccttatcaaaggcaaagaagaaaaagataaaccctcataccttcttattgagaacgttaaaaacctgctgtcaattaataacggatgggactttgcagccgttctctctgagctggatgaagcagggtatgatgctttctggcaggtgcttaactctaaagatttcggagtaccccaaaacagagagcgtgtgttcattactgcaaatcttagaagcagaggcagacgagaaatactacctgtcagaggagaaaacacagcagctcttaagcagattataggcggctgtcaaggtgagcgagtttatgatgcagaaggagtagcttgcacacttacaggttgtggtggaggtggaggagcaaagactggtctttactgcgtaggaaatataaatccaagcggcaaaggtatgaatggaaatgtttattcatcagaaggaattgctccagcagttacaactaataagggcgaaggaagcaaaatttttatagaccagtcttacacaaagccaaagctcacagatacatcaagatgtattacatcacgttatacagcaggagtggttaatagaactgcaatgaatagcggagttttagagagtgttccaattgagtttaatagaaatgatggtattcttgatgaaataaaaatagcacatacaatcagtgccagtgattggcgaggactaaacagaaatcaaacacaaaatgctgttcttgaagcaagggctgttataactcctgaaagagaaaataaacgtcagaatggaaggagatttaaaaatgcagatgaaccaatgtttactttaacaagtcaggacagacatggagttgcagttaaagaagccacaaaaaaaggctatgctgaagctgagattggagacagcataaatatttcagtacctaattcaaaaacaagaagaggcagggttggaaaaggtatatcaaatactttagatacaggatgccaaatggctacattggacaaaaattaccgtattagaaggcttacaccaaaggaatgcttcagacttcaaggcttcccagatgaattatttgaaaaagcaagggctgtaaattcagatgctcagctatataagcaggcaggtaatgcagtaactgtaaatgtagcttttgcagtagcacaatctattaaataa

SEQ ID NO: 87971 - protein, 483 aa, Clostridium thermocellum ATCC 27405
MTFLDFFAGIGGFRLGLELAGHKCIGFCEKDKFAVKSYRAMFDTEGEWYADDVTKLKSEDIPYADIWCFGFPCQDISVAGKQRGIRGKRSGLYFRIIDLIKGKEEKDKPSYLLIENVKNLLSINNGWDFAAVLSELDEAGYDAFWQVLNSKDFGVPQNRERVFITANLRSRGRREILPVRGENTAALKQIIGGCQGERVYDAEGVACTLTGCGGGGGAKTGLYCVGNINPSGKGMNGNVYSSEGIAPAVTTNKGEGSKIFIDQSYTKPKLTDTSRCITSRYTAGVVNRTAMNSGVLESVPIEFNRNDGILDEIKIAHTISASDWRGLNRNQTQNAVLEARAVITPERENKRQNGRRFKNADEPMFTLTSQDRHGVAVKEATKKGYAEAEIGDSINISVPNSKTRRGRVGKGISNTLDTGCQMATLDKNYRIRRLTPKECFRLQGFPDELFEKARAVNSDAQLYKQAGNAVTVNVAFAVAQSIK

SEQ ID NO: 87972 - DNA, 1266 bp, Trichodesmium erythraeum IMS101
  CDS (1)..(1266)
atgcaacgaccaattggtattgatttatttgcaggcgcaggaggtatgactcttggatttgaacaagcaggatttgatatacctatttccgtagaattagaccctattcactgtgctattcataagtttaattttcccttttggtccatattatgtcgtaatgttgtcgaactcacagggaatgaaattagagagaaattaaatattccaaatagagaaattgatgtaatttttggaggtcctccatgtcaaggattttctcagattggaaaacgtgctttagacgatcctcgaaatgcgcttatatctcattttttacgaatagttttggaattaaaacccaaatattttgtcatagaaaatgttaaaggtttaactgtaggaaaacatcaaatttttcttgaggaagttattaataaattatctaaaaatagttatcaactacaactgccttaccaagttttaaatgctgctaattatggtgtaccacaacaccgagaaagattatttatactaggatgtaaaaaaggtttaaaattaccaaattatccacaaattcaaatacataaaaaatcagaagcctatataaatgtctgggatgcaataggagatttaccagaagtagaaaattatccagaattattagaaatagactgggtaaaagcagaaaatgactatgataaaccaagtgaatatgctaaaaaactccgtggaattgaatattttaacaatgattattcttatgaacgtgaatacgaccagacaatattaacctctagtttacgcacaaaacatacacaacaatcaatagcaagatttgatgctacagcacaaggaaaaactgagccagtaagtcgcttttataaactgaatcctcacggtatttgtaacacactcagagcagggactccaagtagtagaggttcatatacttctcctagaccaatacatccattgacacccagatgtatcacagttagagaagcagcaagactacattcatatcctgattggtttagatttcatgtgacaaaatggcatggttttagacaagtaggtaattcagttccaccactattagcaaaagcagttgctcaagaaattattcatgctttaaatattcaaccatttaaacctacaaagacagaatatgagttagaaaatctcaaaaatttagagcttaatatgtctagagccgccgatttatatggtattgatagatatactattgcacccagactaagaaagttaaaattaaataattaa

SEQ ID NO: 87973 - protein, 421 aa, Trichodesmium erythraeum IMS101
MQRPIGIDLFAGAGGMTLGFEQAGFDIPISVELDPIHCAIHKFNFPFWSILCRNVVELTGNEIREKLNIPNREIDVIFGGPPCQGFSQIGKRALDDPRNALISHFLRIVLELKPKYFVIENVKGLTVGKHQIFLEEVINKLSKNSYQLQLPYQVLNAANYGVPQHRERLFILGCKKGLKLPNYPQIQIHKKSEAYINVWDAIGDLPEVENYPELLEIDWVKAENDYDKPSEYAKKLRGIEYFNNDYSYEREYDQTILTSSLRTKHTQQSIARFDATAQGKTEPVSRFYKLNPHGICNTLRAGTPSSRGSYTSPRPIHPLTPRCITVREAARLHSYPDWFRFHVTKWHGFRQVGNSVPPLLAKAVAQEIIHALNIQPFKPTKTEYELENLKNLELNMSRAADLYGIDRYTIAPRLRKLKLNN

SEQ ID NO: 87974 - DNA, 1014 bp, Trichodesmium erythraeum IMS101
  CDS (1)..(1014)
atgaactacatatataaaataaatcatttccttaaaccatctattaatcaggctaatttagttatcgatatatttgctgggtgtggtggtttatctctaggttttgaagcacaaggttttacaactcatggttttgaaatgaatgctgattgttgtgcaacttataataaaaatttaaaaggtaattgcactcaaattgctctgacttcagaaacaaaattacctcctggaaaggtaataattggtggtcctccttgtcaaccttttagtgttggtggaaagcaaaaaggtttacaagattcccgagatggttttcctatttttattaatgccgtggcaaaattaaagcccgaaatttggttatttgaaaatgtacgagggttgctttatcggaataaatggtatttggatgaaattactcaagcacttcaatctttgggttatattattgaggttaaattgttaaatactgttgattttggtgtacctcaaaatcgtcaaagagtcatagttattgggcataaaggtgagtttacatttcctcaagttttagataaaaaagtaactgttggagaagcattagaagaaatggcatttcacgcccctccagagtcaaaatttctaactccaagtatggataaatatatagaaaaatatgaaaaagcttctagttgtaaacaacctcgtgacttatatttagataaacctgctagaactttaacttgtcgaaatatttcagctcctactggcgatatgcaccgaataaaattgccggatgggagaagaagacgtttattcttaagagaagctgcaagattacaaagttttcctgactggtttgaatttgtaggaaaagaagctagttgttttaagcagattggaaatgcagttcctcctttatttgcttttcatttggcgggcagtattaggagttatttagagtctgggaaaaaattatcaccagaggaaatttcacaaaaaattattcctgtacaattatctttacctttttaa

SEQ ID NO: 87975 - protein, 337 aa, Trichodesmium erythraeum IMS101
MNYIYKINHFLKPSINQANLVIDIFAGCGGLSLGFEAQGFTTHGFEMNADCCATYNKNLKGNCTQIALTSETKLPPGKVIIGGPPCQPFSVGGKQKGLQDSRDGFPIFINAVAKLKPEIWLFENVRGLLYRNKWYLDEITQALQSLGYIIEVKLLNTVDFGVPQNRQRVIVIGHKGEFTFPQVLDKKVTVGEALEEMAFHAPPESKFLTPSMDKYIEKYEKASSCKQPRDLYLDKPARTLTCRNISAPTGDMHRIKLPDGRRRRLFLREAARLQSFPDWFEFVGKEASCFKQIGNAVPPLFAFHLAGSIRSYLESGKKLSPEEISQKIIPVQLSLPF

SEQ ID NO: 87976 - DNA, 957 bp, Xylella fastidiosa Dixon
  CDS (1)..(957)
atgagccaattcaattctttggaaatgtgcgcaggggcaggagggcaggcgctcggcctagaaatggttggcttcaatcatgctgccctggtcgaactggaaccgaccgcgtgcgccacactgcgcctgaaccgccccgcctggaacgtcattgaggacgacttacgccgtttcgacggcctcccctatcagggcattgacctggtggctggcggcgtaccgtgcccgccgttctccaaggctggtaagcagctcggtgctaaggatgagcgcgacttgttccccgaagccatccgcctagtcgatgagtgccgcccgaaagccgtgatgctggaaaacgtgcgcggcctacttgatgccgtctttgacgactaccgaaacaaggttgaaaagcagctcaaaaaattgggctatgtccccggctggcggctgttcaacgcctctgattacggcgtgtcgcaactgcgtccgcgtgtggtgttcgtcggcatccgcaaagacctggccagcggctttgcctggccggaaccgctgcaaaacgcaccgccgaccgttggcgagctgctgcacgatctcatggccgcaaacggctggcgtggcgctgaccgctggcgcgaacaggcaaatgccatcgcacctacgctggtaggcggttccaagaaacacggcgggcctgaccttggcccgacccgcgcaaaaaaagcatgggccgccctgggcgtcgatggcatgggcctgtgggacgacgcccctctccgcgacttcgtgggcatgccacgcataacgccgcgcatggcggcccgcattcaaggcttccctgatgactggaaattctctggtcgcaagacggccacctatcgccagattggcaacgccttcccgccgccagtggctgctgccgtggcccggcaaatctccgcggcgctgtccgtccagtgtatctacaaggtagcgtga

SEQ ID NO: 87977 - protein, 318 aa, Xylella fastidiosa Dixon
MSQFNSLEMCAGAGGQALGLEMVGFNHAALVELEPTACATLRLNRPAWNVIEDDLRRFDGLPYQGIDLVAGGVPCPPFSKAGKQLGAKDERDLFPEAIRLVDECRPKAVMLENVRGLLDAVFDDYRNKVEKQLKKLGYVPGWRLFNASDYGVSQLRPRVVFVGIRKDLASGFAWPEPLQNAPPTVGELLHDLMAANGWRGADRWREQANAIAPTLVGGSKKHGGPDLGPTRAKKAWAALGVDGMGLWDDAPLRDFVGMPRITPRMAARIQGFPDDWKFSGRKTATYRQIGNAFPPPVAAAVARQISAALSVQCIYKVA

SEQ ID NO: 87978 - DNA, 981 bp, Campylobacter upsaliensis RM3195
  CDS (1)..(981): transl_table=11
atgacttttatagatttttgtagcggcataggtggtgggcgtttggggctagaatcttgtggctttaaatgcttgggctttagcgaaattgatagagcagccattaaaacctataaaactttttttgatacttcaaatgagctagaacttggtgatttaacacaaatcaatccgcaatctttgcccgattttgacttacttatctctggttttccttgtcaaagttttagcattgttggcagaagagagggactagaaaataaagaaaaagggcaaattattttttatttggctgaaattttaaaggcgaaaaaacctagcttttttattttagaaaatgttaaaggtttgctaaatcacaacaaaggacaaacactaaaagagattctaaaacttttagaatcttgtggctatcaagtttttcataagcttttaaatagtcttgattttgaattggcacaatcaagagagagggtttattttatagggattaaagaagacaaaaaatgctattttaattttagcaaaaatgcttcacacaaagacttaaaagattttttaaatcctgataaaaaaaacatttttcctaaaaattcacaaagttatcaaacatttttaagatttttagaaaataaatataataaaggcaaatttgatttaaaacaaattttaaaaaaagattttttagtgcttgacacaaggcagagtgatttaaggctttatgaaaataaaattccaacactaagacgagataggcaagggttgttttatgttttcaataaagagctttatcgcttaagtggtttggaggctttgagattgcaaggctttgaaaaaattaaaaaaatagaatcaaaaatcaatcacttatcgcaaaatgacattttacgacaatgcggaaatgcaatgagtgttaatgttatagaatctatcgccaaagatttattatgcaataaacagcaagggggcataaatggataa

SEQ ID NO: 87979 - protein, 326 aa, Campylobacter upsaliensis RM3195
MTFIDFCSGIGGGRLGLESCGFKCLGFSEIDRAAIKTYKTFFDTSNELELGDLTQINPQSLPDFDLLISGFPCQSFSIVGRREGLENKEKGQIIFYLAEILKAKKPSFFILENVKGLLNHNKGQTLKEILKLLESCGYQVFHKLLNSLDFELAQSRERVYFIGIKEDKKCYFNFSKNASHKDLKDFLNPDKKNIFPKNSQSYQTFLRFLENKYNKGKFDLKQILKKDFLVLDTRQSDLRLYENKIPTLRRDRQGLFYVFNKELYRLSGLEALRLQGFEKIKKIESKINHLSQNDILRQCGNAMSVNVIESIAKDLLCNKQQGGING

SEQ ID NO: 87980 - DNA, 948 bp, Campylobacter upsaliensis RM3195
  CDS (1)..(948): transl_table=11
atgaaaataggcagtttatttgcagggattggcggaattgagcttggctttaaaaaagcaggatttaaaaccgcttgggcggttgagcttgatagtaaagcttgtatcacttataaagcaaatcataagcacaaaattatcaataacgacctagcaaaagtggatttaaaaagcttaagcaaaattgacattttaacagcgggctttccgtgtcaagcctttagtgtggcggggtatagaaagggctttaaagatgagagggggaatgtcttttttgaaattttaaggtatttagagcattttaagcctagcattatctttttagaaaatgtcaaaaatctttttaaacacgataagggtagaacctttgaaatcattaaaaaagaattacaaaagcttggttattttttaaaatatgaaattttaaacactagcgaatatggcaatatccctcaaaatagagaaagaatttacattataggttttttagattttcacacttacgaaagctttcatttccccgctaaaattaaacttacacaaaaaattcagcatttattggaaaaaggcgttgataaaagcttttattacacttcacataaatattgtgcccagcttaaaaaagagatgcaaagtaaagaaaccttatatcaatggcggagacattatgtaagagaaaataaaaataatttatgtcccactttaacagcaaatatgggaacaggtgggcataatgtgcccttagtgctagatgatgatataagaaaacttacccctagagagtgtgcgagatttcaaggctttgatgatagctttattttaccctcacagctttcaaatgccacgctttataaacaaataggcaatagtgtttctgtgagcgtgatagcaaatatagcaaaagagctaaaaaaggctttaaaaaatgaccttagagcagtttgttaa

SEQ ID NO: 87981 - protein, 315 aa, Campylobacter upsaliensis RM3195
MKIGSLFAGIGGIELGFKKAGFKTAWAVELDSKACITYKANHKHKIINNDLAKVDLKSLSKIDILTAGFPCQAFSVAGYRKGFKDERGNVFFEILRYLEHFKPSIIFLENVKNLFKHDKGRTFEIIKKELQKLGYFLKYEILNTSEYGNIPQNRERIYIIGFLDFHTYESFHFPAKIKLTQKIQHLLEKGVDKSFYYTSHKYCAQLKKEMQSKETLYQWRRHYVRENKNNLCPTLTANMGTGGHNVPLVLDDDIRKLTPRECARFQGFDDSFILPSQLSNATLYKQIGNSVSVSVIANIAKELKKALKNDLRAVC

SEQ ID NO: 87982 - DNA, 1032 bp, Flavobacterium aquatile
  CDS (1)..(1032): transl_table=11
atggaacaaattattggaaatagcaaactaaaagttgcatcacttttttgtggttgtggcggtatggacgtaggtattcagggagattttaaatttcttaaaaagcactatgatacattgcctttcaaggtagtatatgctgttgataatgatgcttacgcaacaaaaatttacaacgacaatttcgctcataaatgtgaaacaaaagatgttcgagatatagtccctagcgaagttcctgaccacgatattttattgggtgggtttccttgccagtcattttctattagtgctcaaaatccgccaaggttgggttataaagacgatagaggcaagttattttttgaaatgattaaagtcttgaaagaaaaaaaaccacgtttttttattggagaaaatgtaaaaggcttgctttcagcaaataaaggtcaagcttttccaatgattattaaagaatttgaaaaagctggatatcacataaattacaaactattaaattcatctgaatttggtgttccacaaaaacgtgagcgagtatttattgtaggttttagagattttgacgactatcttaattttaaatttcctcagccaattacactagaaggttccaaaatagttttgaaggaagtaatagacaaaaaagcagatactgaagaaaagtggttctttagtcaaaaagccgttgatggaatgttacgtgttcgtgaaaagatgaataaaggtcgtgttcaagacctaaatcaaccttgtaatacgataagctcacacctcgcaaaagtaagtctaaatggaactgacccagttttaatggtaaatgaaagatatcgaaggttaactccaagagaggcggcaaatattcaatcatttccacaatcatttaaacttgatagtgtttcggaaaataggcaatataaagctattggaaatgcagttccaccagttttaatgtggaatgttgcaaacgcattaatagagagttgtgtagaaaatattgtgaaaagcaaatcagaagaatgttttcaagtttaa

SEQ ID NO: 87983 - protein, 343 aa, Flavobacterium aquatile
MEQIIGNSKLKVASLFCGCGGMDVGIQGDFKFLKKHYDTLPFKVVYAVDNDAYATKIYNDNFAHKCETKDVRDIVPSEVPDHDILLGGFPCQSFSISAQNPPRLGYKDDRGKLFFEMIKVLKEKKPRFFIGENVKGLLSANKGQAFPMIIKEFEKAGYHINYKLLNSSEFGVPQKRERVFIVGFRDFDDYLNFKFPQPITLEGSKIVLKEVIDKKADTEEKWFFSQKAVDGMLRVREKMNKGRVQDLNQPCNTISSHLAKVSLNGTDPVLMVNERYRRLTPREAANIQSFPQSFKLDSVSENRQYKAIGNAVPPVLMWNVANALIESCVENIVKSKSEECFQV

SEQ ID NO: 87984 - DNA, 1140 bp, Salmonella enteritidis
  CDS (1)..(1140): transl_table=11
atgactgataatatcgcagcaacaatcaaaggaaaaagagaaagacttcatatgactcaaaaagagtttgcagacgcccttggtctttcaaaatatggagacagaaccataagaagatgggagcgcggggaaacaaaacctactggggcggaactaaaagcagttatggactttccagacacaccaccttacccaaacaacgagaatggcagatatcgcatgatcgatttatttgctggaatcggtggaaccagacttggatttcatcaaactaacgctgtaaatgttgttttttccagcgaatgggataagtttgctcaaaagacatatcatgcaaattatggtgatttccctgatggggacataacaaaaatcgatgaaaaagatattcctgatcatgaaattcttgtcggtgggtttccttgcgtagcattctctcaagcagggctcaaaaaaggatttaatgatacaagaggaactttgttttttgatatagcaaggataataaaggaaaaaaaacctcatgcttttttacttgaaaatgtaaaaaacttgctaggacatgataaaggtagaactttttcaataataaaaaacacacttgaagaattgaattacactgtgtattacaatatcttcgctgcaaaagactttggtgttccacaaaatagagaacgcatatacattgtaggctttaataaagaaaaagtaagaaatcatgaacattttacttttccaaccccattaaaaacaaaaacaagagttggagatattcttgaaaagagcgtagacaataaatatacgctatcagatgcgctctggaatggacaccaacgcaggaaacttgtaaatgcagcagccggtaaaggctttgggtatggtttatttaatgaaaatagcccatatactaataccataagtgcgaggtactataaagatggtagcgaaatattaatagagcaaaaaggaagtaacccaagaaaaataactccgcgggaagcgtcaagacttcaagggtttcctagtgattttattatccctgtatcggatacacaggcttataagcaatttgggaattcagtcgcagtccctgttatcaatgcaatagcagaaaaaatcatatcgaccttagattcataa

SEQ ID NO: 87985 - protein, 379 aa, Salmonella enteritidis
MTDNIAATIKGKRERLHMTQKEFADALGLSKYGDRTIRRWERGETKPTGAELKAVMDFPDTPPYPNNENGRYRMIDLFAGIGGTRLGFHQTNAVNVVFSSEWDKFAQKTYHANYGDFPDGDITKIDEKDIPDHEILVGGFPCVAFSQAGLKKGFNDTRGTLFFDIARIIKEKKPHAFLLENVKNLLGHDKGRTFSIIKNTLEELNYTVYYNIFAAKDFGVPQNRERIYIVGFNKEKVRNHEHFTFPTPLKTKTRVGDILEKSVDNKYTLSDALWNGHQRRKLVNAAAGKGFGYGLFNENSPYTNTISARYYKDGSEILIEQKGSNPRKITPREASRLQGFPSDFIIPVSDTQAYKQFGNSVAVPVINAIAEKIISTLDS

SEQ ID NO: 87986 - DNA, 981 bp, Bacteriophage phi
  CDS (1)..(981): transl_table=11
atgaattttaatatgacgccaaagcaaccaacaaacggatttacggtactagaattattctgcggaggtggccttggggcaaccggcttcaagtcggctggctacgagatcgtaaaagcattggacatcgataagaatgccgtaaaagcataccgtcacaacttcggtgattacgtggaacaggcggatattaacgaaattgatatcgacagtttgccggacacagacgttattttcggaggtcctccgtgccaagacttctcggttgcgggaaaaggtgtgggcgctgatggagagcgtggtaagctcgtatggcgttatctcgaaattatcgaacgcaagcaaccgaaagctttcgtatttgaaaacgtaaaagggttgataacgaagcgtcaccgtcctacattcgacgcacttatcgagaagtttaatgaaataggttacgagattagttgggaagtagtaaacgcgtgggattacggagtagcgcagaaacgtgagcgagtgtttatagttggtgtgcggaatgacctcggttttaagttcgattttccgaatccgttagaaggcgattatcagacgcgagtattgcgggatgtgatcggagatctgccagaggtcggagaatacttctacgttaatcgggggggttggggtaagtgtttggtgaaaagtgttttcggactcgaagatgtatcgccgactataaaaagtcaaaacgcaaatcttcctcctggttatcccggacaccctaaagacgccgatcaaatctgcaaccgaccgattagccaaccaaaagcgccccgccgtttcaccgttcgcgaatgtctccgaatccaatctgcgccagacacttacgtcctgccagacgatatttccttaacggcgcagtatcggattgtcggtaacggaattgcttcgcgtgttgcgtggtatatcgggcgggccgttgcggatcaactttcatctaactgtaagtaa

SEQ ID NO: 87987 - protein, 326 aa, Bacteriophage phi
MNFNMTPKQPTNGFTVLELFCGGGLGATGFKSAGYEIVKALDIDKNAVKAYRHNFGDYVEQADINEIDIDSLPDTDVIFGGPPCQDFSVAGKGVGADGERGKLVWRYLEIIERKQPKAFVFENVKGLITKRHRPTFDALIEKFNEIGYEISWEVVNAWDYGVAQKRERVFIVGVRNDLGFKFDFPNPLEGDYQTRVLRDVIGDLPEVGEYFYVNRGGWGKCLVKSVFGLEDVSPTIKSQNANLPPGYPGHPKDADQICNRPISQPKAPRRFTVRECLRIQSAPDTYVLPDDISLTAQYRIVGNGIASRVAWYIGRAVADQLSSNCK

SEQ ID NO: 87988 - DNA, 1026 bp, Neisseria gonorrhoeae
  CDS (1)..(1026): transl_table=11
atgcaaaactcatcacctaccacttataatcctatgaaaatcattagtttgtttagcggttgcggcggtttggatttgggtttcgaaaaagcgggatttgaaatccccgccgccaacgaatacgataaaaccatttgggcaaccttcaaggcaaaccatccaaagacccatttgatagaaggcgatatacgcaagattaaagaagaagatttccctgaagaaatcgacgggattatcggcggcccaccctgccagtcttggtctgaagcgggagctttgcgcggcatcgacgatgcgcgcggacagttgtttttcgactacatccgtattttgaaaagcaaacagccaaaattctttttagcggaaaacgtcagcggaatgctggccaaccgccacaacggagccgtacaaaacctgctgaaaatgtttgacggatgcggatacgacgtaaccttgactatggccaacgccaaagactacggtgtagcacaggaacgcaaaagggtcttctacatcggtttccgtaaagacttggaaataaaattttcttttccaaaaggttcgacggtcgaagacaaagacaagattacattgaaagacgttatttgggatttgcaggacacagccgtaccttccgccccgcaaaacaagaccaaacccgacgcagtcaacaacaacgaatattttaccggcagtttttcccctatttttatgagccggaaccgagttaaagcgtgggatgaacagggttttaccgtccaagcttcaggcaggcagtgccaactgcacccgcaagccccaaagatggaaaagcacggggcaaacgactaccgttttgctgccggcaaagaaacactatatcggaggatgacggtacgcgaagttgcaagaatccaaggctttcccgacaacttcaaattcatctatcaaaatgtcaacgacgcatacaaaatgattggcaacgccgtccccgtcaaccttgcctacgaaattgcagcggcaattaaaaaaaccctagaaaggtga

SEQ ID NO: 87989 - protein, 341 aa, Neisseria gonorrhoeae
MQNSSPTTYNPMKIISLFSGCGGLDLGFEKAGFEIPAANEYDKTIWATFKANHPKTHLIEGDIRKIKEEDFPEEIDGIIGGPPCQSWSEAGALRGIDDARGQLFFDYIRILKSKQPKFFLAENVSGMLANRHNGAVQNLLKMFDGCGYDVTLTMANAKDYGVAQERKRVFYIGFRKDLEIKFSFPKGSTVEDKDKITLKDVIWDLQDTAVPSAPQNKTKPDAVNNNEYFTGSFSPIFMSRNRVKAWDEQGFTVQASGRQCQLHPQAPKMEKHGANDYRFAAGKETLYRRMTVREVARIQGFPDNFKFIYQNVNDAYKMIGNAVPVNLAYEIAAAIKKTLER

SEQ ID NO: 87990 - DNA, 1359 bp, Streptococcus pneumoniae
  CDS (1)..(1359): transl_table=11
atgagatttattgatttattttcaggtatcggtggctttcgactaggaatggaaagtgtcggacacgagtgtattggattttgtgagattgataaatttgctagagaatcttataagtccatttttcaaacggaaggagaaattgaatttcatgacatacgagatgtttcagatgacgaatttaaaaaacttagagggaaagtcgatgtcatctgtggaggattcccttgtcaagcattttcaatcgcaggaagacgattgggatttgaagatactagaggaactttattctttgaaattgctcgagcggccaaacaaatccaaccacgttttctttttcttgaaaatgttaaaggcctactcaatcacgataagggacggacgttcaccacaatccttaccacgcttgatgaattggggtttgatgttgagtggcagatgcttaacagtaaggattttggcgttccccaaaacagagagagggtgtttattatcggacattctagaaagagaggtaccagactcggatttcctttcagacgagaaggtcaagcaactaaccctgagactttaaaaatattagggaatttgaatccatcaaaaagtggaatgagtggtaaagtctattattcagaaggtcttgcgccaaccttagttcgtggaaaaggagaaggatttaaaattgcgattccttgtatgacaccagacagattagacaagagacaaaatggtagacgtttcaaggataatcaagagccaatgtttactttaaatactcaggatcgccatggtattgtcgttgttggagatttaccaactagctttaaggaaactggtagagtctatggaagtgagggcttatctccaacactgactacgatgcaaggaggagataaaatccccaaaatactgattccagaaccaatccaatttctaaaagtccgagaggcaacgaaaaaaggatatgctcaagcagagattggggattcaatcaatttagaaagaccaagttctcagcatcgtcgtggtagagttggaaaaggtatagctaatacgttaacaactagtgggcaaatgggagtagtagtggctagctatgaaggagaagataaacaagtttaccaagtagctggtgttttaatagatggacaattttaccgtttgagaatacgacgaatcactcctaaagagtgttttcgattgcagggctttcctgattgggcttttgaagctgctagaaaagtctctagtaatagtcagctctataaacaagctggtaatagtgtaaccgttcctgtgattgccgcaatcgcaaagaaattaaaagaagtagaggaaaaagatgaaagcattaaataa

SEQ ID NO: 87991 - protein, 452 aa, Streptococcus pneumoniae
MRFIDLFSGIGGFRLGMESVGHECIGFCEIDKFARESYKSIFQTEGEIEFHDIRDVSDDEFKKLRGKVDVICGGFPCQAFSIAGRRLGFEDTRGTLFFEIARAAKQIQPRFLFLENVKGLLNHDKGRTFTTILTTLDELGFDVEWQMLNSKDFGVPQNRERVFIIGHSRKRGTRLGFPFRREGQATNPETLKILGNLNPSKSGMSGKVYYSEGLAPTLVRGKGEGFKIAIPCMTPDRLDKRQNGRRFKDNQEPMFTLNTQDRHGIVVVGDLPTSFKETGRVYGSEGLSPTLTTMQGGDKIPKILIPEPIQFLKVREATKKGYAQAEIGDSINLERPSSQHRRGRVGKGIANTLTTSGQMGVVVASYEGEDKQVYQVAGVLIDGQFYRLRIRRITPKECFRLQGFPDWAFEAARKVSSNSQLYKQAGNSVTVPVIAAIAKKLKEVEEKDESIK

SEQ ID NO: 87992 - DNA, 969 bp, Haemophilus influenzae
  CDS (1)..(969): transl_table=11
atggaaaaactaaagtttattgatttttgtgcagggattggtggggggcgattaggcttagagcttaacggaatggaatgtattgctcatagcgaagtcgatcttaatcctgcaaaaacatatgaaatattttttaatgatagtcgtaatttaggtgatttaactcaacttgctccaaaatctttacctgattttgatttaatgattgcaggatttccttgccaaacattttctatcatcgggaaaagagatggttttctagatgatagagggcaaataatatattatttaagcaatattttgaaagtgaaaaaagtaccattttttattttagaaaatgttaagggattagtaaatcataaccaaggtgaaactttaaaatcaatcttagaaatattagaaggttgtaactatgatgtgtattataaagtattagatagtcaattttatggtacgccacaaatgagagaacggatctattttgttggaataagaaaagatatacatcattctgattatgtctttcctgagcctaaaagcaataatggaaatgagttgtcaaattatttaattggggatggtaaatataaatttttgataaataaaacttttgaaaattatattaataataaatacaataaggatagaataagtttagatcaaatatatgagaaaaattatcaggtaatagattggagacagtcagatttacggatctatgaaaataaaataccaacgcttagaacaggtaggcacgggattttatatgtcaaggataatcaattatataagttaagtggttacgaggctctattattacaaggatttccgaaagagattgctcaaaaagccattgattataaattacccgatagtaagattttatcccaagctggaaatgcgatgacggttaatgtaatacaggaaatcgcagaaaaattactaatctctataaataaaggtaaataa

SEQ ID NO: 87993 - protein, 322 aa, Haemophilus influenzae
MEKLKFIDFCAGIGGGRLGLELNGMECIAHSEVDLNPAKTYEIFFNDSRNLGDLTQLAPKSLPDFDLMIAGFPCQTFSIIGKRDGFLDDRGQIIYYLSNILKVKKVPFFILENVKGLVNHNQGETLKSILEILEGCNYDVYYKVLDSQFYGTPQMRERIYFVGIRKDIHHSDYVFPEPKSNNGNELSNYLIGDGKYKFLINKTFENYINNKYNKDRISLDQIYEKNYQVIDWRQSDLRIYENKIPTLRTGRHGILYVKDNQLYKLSGYEALLLQGFPKEIAQKAIDYKLPDSKILSQAGNAMTVNVIQEIAEKLLISINKGK

SEQ ID NO: 87994 - DNA, 1332 bp, Acidiphilium facilis
  CDS (1)..(1332): transl_table=11
gtgagacccattggaatcgacctgtttgccggcgccggcggcctctcattgggtttcgagcaagccgggttcgacgtggtggcggccgtggaggtcgatccggtgcattgcggtgtccataagttcaactttccccaaactgccgtcgtaccgcgctcagtggtcggtctcaccgccgctgaaatccgccttgccgccggtataggcaaccgcccggtcgactgcgtgttcggcggccccccttgccaaggcttttccatgatcggccatcgcgtgctcgacgacccccgcaacgagttggtcctcgagttcgtacgcctcgtcgccgagctggacgccaagacgttcgtcttcgaaaatgtgaaaggactgacggtcggcaagcaacgggcctttctggacgaattggttctggcgttcgaccgcgtcggctacgcggtgcggctggcttggcgggtgttggacgcctccaatttcggtaccccgcaaaagcgccagcgcttgatcttgttcggtgccaaaaaagggttggttttacccgactatccagcgccgaccaccaacgcggccgatgcgaagcggccaattcccgggcttgcggctggtccgactgtcaaggacgccatcggcgatcttcccgacgccgagcgttttcagaccctgcatgaaacggacttcgtaaagacaacgtcgttcaagaagccctctgcctatgccgccgagttgcgctgcctgaccaacgacgcctggcatttcggatacgtgcgcgattggcaatccgggttcctgacctccagcgcccgcaccgcgcattcggacatttcccggcgccgcttccaggagacggcgccgggcacggtcgagccgatcagccggttcttcaaactggcgccggcggggctctccaataccttgcgagccggaaccgacggcgctcgcggcgctttcaccagcccccgtccgatccattatgcgtatgaccgttgtgtcaccgtccgcgagatggctaggttgcatgggtttccggattggttccggctgcatgcgaccaagtggcacggcgcgcgccagatcggcaacgcggtgccggtgccgttggctcgggcgatcggcggcgccgtgatcgccgcgctcgggataaagccgaagcgacctaagcgtacgatcccgttgggcgacacggctctcctttatatggagatgtccgaggcggccggccatttcggcgtggcggcgccgaacggcaagcgcgaccgcaagagcggcgccaaaaagcgcaagcagcacgagatcgaagccgcgcgcgagcgtctgaaggtggcacatggctaa

SEQ ID NO: 87995 - protein, 443 aa, Acidiphilium facilis
MRPIGIDLFAGAGGLSLGFEQAGFDVVAAVEVDPVHCGVHKFNFPQTAVVPRSVVGLTAAEIRLAAGIGNRPVDCVFGGPPCQGFSMIGHRVLDDPRNELVLEFVRLVAELDAKTFVFENVKGLTVGKQRAFLDELVLAFDRVGYAVRLAWRVLDASNFGTPQKRQRLILFGAKKGLVLPDYPAPTTNAADAKRPIPGLAAGPTVKDAIGDLPDAERFQTLHETDFVKTTSFKKPSAYAAELRCLTNDAWHFGYVRDWQSGFLTSSARTAHSDISRRRFQETAPGTVEPISRFFKLAPAGLSNTLRAGTDGARGAFTSPRPIHYAYDRCVTVREMARLHGFPDWFRLHATKWHGARQIGNAVPVPLARAIGGAVIAALGIKPKRPKRTIPLGDTALLYMEMSEAAGHFGVAAPNGKRDRKSGAKKRKQHEIEAARERLKVAHG

SEQ ID NO: 87996 - DNA, 1092 bp, Escherichia coli
  CDS (1)..(1092): transl_table=11
gtgaacaaaatttcagcggtgagcttatttactggggcaggagggatggatgtcggtttctctaatgccgggttccgaacagtttgggccaatgatatagataaggatgcatgtgatacatttaagcttaatcatgaatcacctgttttttgtggtgatattgatgagatgctaagtgaattgtctgggctgaaaaatataggttgtgtttttggtgggcctccatgccaaggattttctgtggcagggaaaatggacgctcatgatccacgtagtaagctggttatgtcattcatgcgggcggtggatataattcaaccagaatgctttgttatggagaatgttaaggctttagcacagttgtccaaatttgaaccagttaggtgtgaactgtttaagatggctgaaaagtcaggctatcgttcagccttgctggtgctgaattctaaagattttggcgttcctcagaatagggaacgtatgttttttatagggtttcgttccgaaaatgatgtgaaacgagttgaggcggcgataaaaaaataccaatatctttcgccaacagttggtgagattattcggcctttagggcgagcgggtaatccaaataattcaagagtctgtaatgcaaggattacaaatgctgctaagccagtattacggaagtcaccttacgcgggaatgatgtttaacgggcagggaagaccaattaacccgaatgggtatgcttcaactatagctgcttctatgggggggaataggacaccaattattgatgaagaacacctttatgatggctcaacaagttatgttgagacttatcataatcatctaatgaatggtggtgagccaaaagatatgcacgatgtacctagtcgtttacgtcgactaacgatagatgaggctcttttgattcaaacattcccgagtaattatgtctttgtggggaaaaattcgtcaatttggcgtcagatagggaatgctgtgccttgtaaattggcgcaggctgttgctgcaggggttttggatgtccttactggtaaaactattaatgttcaaaagagtcaaacagagttgagtttgaattcgtaa

SEQ ID NO: 87997 - protein, 363 aa, Escherichia coli
MNKISAVSLFTGAGGMDVGFSNAGFRTVWANDIDKDACDTFKLNHESPVFCGDIDEMLSELSGLKNIGCVFGGPPCQGFSVAGKMDAHDPRSKLVMSFMRAVDIIQPECFVMENVKALAQLSKFEPVRCELFKMAEKSGYRSALLVLNSKDFGVPQNRERMFFIGFRSENDVKRVEAAIKKYQYLSPTVGEIIRPLGRAGNPNNSRVCNARITNAAKPVLRKSPYAGMMFNGQGRPINPNGYASTIAASMGGNRTPIIDEEHLYDGSTSYVETYHNHLMNGGEPKDMHDVPSRLRRLTIDEALLIQTFPSNYVFVGKNSSIWRQIGNAVPCKLAQAVAAGVLDVLTGKTINVQKSQTELSLNS

SEQ ID NO: 87998 - DNA, 933 bp, Escherichia coli
  CDS (1)..(933): transl_table=11
atgaaagttgtttcattgttctctggcgctggcggattggacctcgggttaaaacaatctggacttgatatcatttgggcaaatgatatctatgaagatgcggtagatacctataagagaaatataggcgaacatattgttttaggtgatattgccaatatcaattcatctgatatacctaattgtgatgtcgtggttggggggtttccatgccagggattctcagtagcaaatatgaacagaaaatcagaagaccctcgaaacaaattatatttagaaatggtccgcattattcgggataaacgaccagcatattttatagctgaaaatgtcaaaggtatattatccttggataaaggccttgtcatacaaaaaataacaagtgattttgaatcgttgggatataatgttaaatacagccttttaaattgtgctgattatggtgttccacaaacccgaatgagagtcattatcttaggtgtaaggaaagatttgcctgatatcgaaaactttccaccacctaaaactcatgaaaaagaagggataaatttgcctaaatggatctctgtaggccaagctttacaacggtttactgaaccaagagttgatagtcagttcaaaaaccatgagcattcattgtacaagcttacgtttaacgggcatctgggtcacaggtttatggacccggataaaccggcgcctacagtaacaggtcgtggagatgagaaaggtggtgtagttgtattgcaccatcccagcaatgagagaagaatgactgtcagagaaattgcggcagctcagtctttccctgatgacttctttttctgcggtagtaagacgtctggatatcgacaaatagccaatgctgttccacccaaactaggtatagccttaggtaaaatgttaattgagcatcataaaacgatagaatag

SEQ ID NO: 87999 - protein, 310 aa, Escherichia coli
MKVVSLFSGAGGLDLGLKQSGLDIIWANDIYEDAVDTYKRNIGEHIVLGDIANINSSDIPNCDVVVGGFPCQGFSVANMNRKSEDPRNKLYLEMVRIIRDKRPAYFIAENVKGILSLDKGLVIQKITSDFESLGYNVKYSLLNCADYGVPQTRMRVIILGVRKDLPDIENFPPPKTHEKEGINLPKWISVGQALQRFTEPRVDSQFKNHEHSLYKLTFNGHLGHRFMDPDKPAPTVTGRGDEKGGVVVLHHPSNERRMTVREIAAAQSFPDDFFFCGSKTSGYRQIANAVPPKLGIALGKMLIEHHKTIE

SEQ ID NO: 88000 - DNA, 945 bp, Escherichia coli
  CDS (1)..(945): transl_table=11
atgaaagtcgtttcattattttcaggagctggcggtcttgaccttggttttaaaaacgccggatttcaaatcgtttgggcaaatgatattgactctgacgcagtgctaacatacaagaaaaatattggtgatcatatcgtcttaagagatttatctcagattgatatggatgatataccggattgtgatgtggttattggtggatttccttgccaaggtttttctcaggcaaacctcttaaggaataaagacgatgaaagaaatcaattatacttagagtttctcagagttgtgaatgcgaaaaagccaaaattcttttttgctcaaaatgtaagggggattttaagcctagataatggtacggctattgaaaaaatagaaagtgatttcaagtcactaggatacaaagtcaaaaagcagttatttaatgtcgccgactatggcgttcctcaaatgcgataccgagtcatcattgtcggtgtaagagatgatataaaagtggaatatatttatccacaaccaacgcactcttcaccgaagaaaagtgataagacaggcctggcaccatggatcagcattggcgatgccctccatgatatcccagaaccagattctgagaatgacttattaaatcatgtgtattcaacttataaaataactaatagaaatttcacgggacacagagaaactgacccaaataagccatcacctacaattcttgcaagaggaaatggtaagggtggcgtttgcgcgattcaacatcccaaaaatcatcggaggatgtctgttagagaatcagcaattatacaaacttttcctttggattatgagtttataggaagtatgacatcttgttatcggcaggttggtaatgctgtccctgttttatttgctgagttattagctaagagtttaaaaaatacacttgcaggtgatgataaatga

SEQ ID NO: 88001 - protein, 314 aa, Escherichia coli
MKVVSLFSGAGGLDLGFKNAGFQIVWANDIDSDAVLTYKKNIGDHIVLRDLSQIDMDDIPDCDVVIGGFPCQGFSQANLLRNKDDERNQLYLEFLRVVNAKKPKFFFAQNVRGILSLDNGTAIEKIESDFKSLGYKVKKQLFNVADYGVPQMRYRVIIVGVRDDIKVEYIYPQPTHSSPKKSDKTGLAPWISIGDALHDIPEPDSENDLLNHVYSTYKITNRNFTGHRETDPNKPSPTILARGNGKGGVCAIQHPKNHRRMSVRESAIIQTFPLDYEFIGSMTSCYRQVGNAVPVLFAELLAKSLKNTLAGDDK

SEQ ID NO: 88002 - DNA, 1206 bp, Bacteroides sp
  CDS (1)..(1206): transl_table=11
atgaaagatgatgatatttatgaatatgttagaagtaaaaggaaaaaacttggtgtaactcaaaaacaattatcattattgttaggaatgaaagaggttggagaaagaacggtaagaagctgggaaataggtgagcataaacctagtaaagctagaataaaaagacttcaagaattgaatataaaccatccatttaaaacagataaaaaagaaataacatttaaattcatagacttatttgctggtattggaggtataagactaccatttcaattaaatgggggagaatgcgtgttttctagtgagatagattatcatgctcaaaaaacatactatagtaattatggtgattatccaagcggggatataactaaaataaaagcggaagatatacctgatcatgatattttattagcaggtttcccatgccaagcattttctcaagctgggttaggaaagggatttaatgacactagagggactatgttttttgaaatacaaagaatattagctgaaaagcagccaaaaatgtttttactggaaaatgtaaaaagattaattagccacgatgggaaaaaaacatttaaaaccatgattgatattctaagcgggtctcataatgaagaaatcccaaaagacttccctatatctgatgaagcaagaaaggctttatctaaaaaattaaattactggattgattttaaagttttaaatgcaaaagattttggttcaccacaaaatagagaaagaatatatattgtgggatttaacaaaaaccacttcacaaaaatagatgattttaatgaaatatttcaatttccagagccaagtaaagaaaaagtaagtgtcaaagatgttttagagaaaattcctgcaaatgatacaatatatacaatatctgaaagaatatggcagggtcatcaaaaaagaaaattaaaacatcaaaataaaggtaatgggtttggatttagcttgtttaatgaaaatagtgagtatacaaatacgataagtgctagatactacaaggatggttctgaagctttaatgcgaaagtcaaaagagaaatttactttttgtaaccgcatcacgcgagcaaaacgatacagcagatttaatcgtttacgactccacgtattaaagtcaccagcaaaaatgacgggaccatcgtgcagcgttaggtggtcaccaatagcttcgagctgttga

SEQ ID NO: 88003 - protein, 401 aa, Bacteroides sp
MKDDDIYEYVRSKRKKLGVTQKQLSLLLGMKEVGERTVRSWEIGEHKPSKARIKRLQELNINHPFKTDKKEITFKFIDLFAGIGGIRLPFQLNGGECVFSSEIDYHAQKTYYSNYGDYPSGDITKIKAEDIPDHDILLAGFPCQAFSQAGLGKGFNDTRGTMFFEIQRILAEKQPKMFLLENVKRLISHDGKKTFKTMIDILSGSHNEEIPKDFPISDEARKALSKKLNYWIDFKVLNAKDFGSPQNRERIYIVGFNKNHFTKIDDFNEIFQFPEPSKEKVSVKDVLEKIPANDTIYTISERIWQGHQKRKLKHQNKGNGFGFSLFNENSEYTNTISARYYKDGSEALMRKSKEKFTFCNRITRAKRYSRFNRLRLHVLKSPAKMTGPSCSVRWSPIASSC

SEQ ID NO: 88004 - DNA, 1086 bp, Helicobacter pylori
  CDS (1)..(1086): transl_table=11
atgaattataaaattttagatttattttgtggggctgggggttttagcgctgggttagagtgtttaaaagagtttgacgctttaatagggctagattgcgataaacaagccctaatcacttttgaaaacaaccataaaaacgctacgggtatttgtggggacatcactcaaattgaaattaaagaaaaagtcatcaaactagcccaaacattagaaatcaacatgatcattggcgggcctccctgtcaaggcttttctaataaagggaaaaatttagggctaaaagaccctaggaattttttattcttagaatatatagagatagtgaaagccataaaaccagaaatttttatcattgaaaatgtgaaaaacctcatctcttgcgctaaaggctattttttggaagaaattaaagaaagattgaacgctttagggtatcaattaagctatcagatcctaaacgctaaagattatggcgtgcctcaaaacagagagagggcttttattgtaggggctagtcgtttcagttttgatttcaatcttttagagccttctcaaagcgtgaatattcaagatgccataagcgatttggcctatctttgttctaatgagggggcgtttgagagcgattatttaaaccctatccaatcaagctatcaagccttgatgcgaaaagatagccctaaattatacaaccaccaagccaccaaccactcgcaagccgctttagagaaattaaagctcatcaataaagagcaaggcaaagaatgcttgcctaaaaacttgcatggcaaacaacaattcaaaagcacatgggggcgtttgaattggaataaaatcagccccaccatagacacacgctttgacactcccagcaatggcaccaactcccaccctgaattgcaccgctctatcacgcccagagaagccaccaggatacaaagttttagcgatgattatatcttttatggcaataaaacgagcgtttgtaagcaaatcggtaacgccgtgcctcctcttctagccctagccttaggcaaagcgatcttaaaaagcgcaagaaatgatacaaatttatcacgctga

SEQ ID NO: 88005 - protein, 361 aa, Helicobacter pylori
MNYKILDLFCGAGGFSAGLECLKEFDALIGLDCDKQALITFENNHKNATGICGDITQIEIKEKVIKLAQTLEINMIIGGPPCQGFSNKGKNLGLKDPRNFLFLEYIEIVKAIKPEIFIIENVKNLISCAKGYFLEEIKERLNALGYQLSYQILNAKDYGVPQNRERAFIVGASRFSFDFNLLEPSQSVNIQDAISDLAYLCSNEGAFESDYLNPIQSSYQALMRKDSPKLYNHQATNHSQAALEKLKLINKEQGKECLPKNLHGKQQFKSTWGRLNWNKISPTIDTRFDTPSNGTNSHPELHRSITPREATRIQSFSDDYIFYGNKTSVCKQIGNAVPPLLALALGKAILKSARNDTNLSR

SEQ ID NO: 88006 - DNA, 951 bp, Streptococcus thermophilus
  CDS (1)..(951): transl_table=11
atgcttacagtcgcttcttttttcgcaggcgtcggaggtattgacctcggttttgaaaaagcaggattcaaaacaatatacgccaacgagtttgataactacgctgctgatacctttgaacttaattttgatgtcacagttgaccgacgagatataaataccgtaccagccgaagatattccaaactttgatgttatgctggcaggtttcccttgccaagccttttctattgctggataccgtcaaggctttaatgacgagcaaggaagaggaaacctattttttgaactcgtccgaattttaaaagctaaaaaacctcgtatcgctttttttgagaacgtaaaaaatctagtttcacatgataatggaaatactttcagagttatttgctcagaactagataagctagggtacaaatacctttttcaagtcatgaacgctgctgactatggaaatatcccccaaaatcgtgaacgtatctacattgtagcgtttagagacaaagaggactacgctgattttgatttgcctaaatcaataccacttgaaacaagtatcaaagatgttatagactttgatagcaaagtcgatgacaaattttactataccgctgagaaaaataagttttttgatgaactaaaagaaaacatgacaaaaagcgataccacctatcagtggcgtagggtctacgttcgtgaaaataaaagtaatcttgtaccaactcttaccgccaatatgggaacaggtgggcacaatgtcccgctaattctaactaatagcaaggaaatccgtaaactaacacctcgtgagtgtttcaatgtccaaggttttcctaaagactacaaacttcctgagcaaagtaacagtcgtctctacaagcaagctggaaatagtgttactgtcccagtaattgaccggatagctaaaaatatagcaaaggcaatcaactaa

SEQ ID NO: 88007 - protein, 316 aa, Streptococcus thermophilus
MLTVASFFAGVGGIDLGFEKAGFKTIYANEFDNYAADTFELNFDVTVDRRDINTVPAEDIPNFDVMLAGFPCQAFSIAGYRQGFNDEQGRGNLFFELVRILKAKKPRIAFFENVKNLVSHDNGNTFRVICSELDKLGYKYLFQVMNAADYGNIPQNRERIYIVAFRDKEDYADFDLPKSIPLETSIKDVIDFDSKVDDKFYYTAEKNKFFDELKENMTKSDTTYQWRRVYVRENKSNLVPTLTANMGTGGHNVPLILTNSKEIRKLTPRECFNVQGFPKDYKLPEQSNSRLYKQAGNSVTVPVIDRIAKNIAKAIN

SEQ ID NO: 88008 - DNA, 1212 bp, Brevibacterium epidermidis
  CDS (1)..(1212): transl_table=11
ttgaaagttttatctttattttcaggttgtggtggtatggatcttggtttagaaggcggcttcttagcacatagatcgtctatcaatagtgatttatatgcttcttatatttcagaccatgatgaaaattatgtttatttaaaaaaaacaggatttgaaactgtttttgctaatgatattttgccttttgcaaaattggcttggtgtaattttttcaaaaatagagtaaatcaacctgaaaatatctttcatttagaaagtatcgttgatgttgtcaataatattgagaataagcaattttcctttcccaatgatattgatgtagtgactggtggatttccatgtcaagactttagctttgcaggtaaaagaaaagggtttgattctcataaagatcataatggcatcatttataatgaaccaactgaagctacgcgaggtcaactatatttatggctgaaaaaagtagttgaaatcacaaaacctaaagtattcattgcagaaaatgtaaaggggttagtaactttaggcgatgtaaaagacattattcaaaaagattttagaaatattgatgatgggtatgttgttcttgatgctcaggttcttaatgctaaaaattatggagttgctcaaaatagagaaagagttattttcattggtatatcaaaacgttatgctaacaaaaaaatcttagatgaactaatttctttgcaagaaaaatctgaagtctatccatatccaccatatactcatggtactgatccagagctaaaaccatatgcgactttaaatcaaattctagctcatcttccagagcctgagttggcaagcacagataagagccaacaatcttattctaaggctaaacttttcaaaaaaactcagggcaatattgaagttaacatgaatggccaagctccaactattagagcagaacatcatggaaatattgagtttagaagattatccaaagaaaatggcgggactaatctatctgaattacatctaccacaaagacgtctcacagtccgcgagtgcgctttaattcaaagttttccaccagattatgagtttgtatttaactacggaaaagccaattcagtatcagcatcggccgcatataaaattatcggtaatgccgttcctccattattaggatttgcaataggcaggcatcttagtcaaatatgggacaaattatttaaaacatga

SEQ ID NO: 88009 - protein, 403 aa, Brevibacterium epidermidis
MKVLSLFSGCGGMDLGLEGGFLAHRSSINSDLYASYISDHDENYVYLKKTGFETVFANDILPFAKLAWCNFFKNRVNQPENIFHLESIVDVVNNIENKQFSFPNDIDVVTGGFPCQDFSFAGKRKGFDSHKDHNGIIYNEPTEATRGQLYLWLKKVVEITKPKVFIAENVKGLVTLGDVKDIIQKDFRNIDDGYVVLDAQVLNAKNYGVAQNRERVIFIGISKRYANKKILDELISLQEKSEVYPYPPYTHGTDPELKPYATLNQILAHLPEPELASTDKSQQSYSKAKLFKKTQGNIEVNMNGQAPTIRAEHHGNIEFRRLSKENGGTNLSELHLPQRRLTVRECALIQSFPPDYEFVFNYGKANSVSASAAYKIIGNAVPPLLGFAIGRHLSQIWDKLFKT

SEQ ID NO: 88010 - DNA, 954 bp, Neisseria gonorrhoeae
  CDS (1)..(954): transl_table=11
atgtacaaaacaatagatttattttcaggcattggcggaatacgcctaggctttgaaaaatacgggtgcaccaatgtattctcatcggaatgggacaaatatgcccgacaagtgtatgaagcaaactttggagaaaaaccttttggcgacattaacggcatcgatccttcagatattcccgatcatgatattctgcttgcgggatttccgtgccaacctttcagtatcgcaggtaagggattgggatttgaagatacgcgcggaacattgtttttcaatattgccgaaatcctgaaaaccaaacagccgaaggcttttcttctggaaaacgttaagcggctgactacgcacgattcgggcaggactttccgtattgttttagaaacccttaaacagcttggttatacggtttattttaaggttttaaatactttggatttcggattgccgcaaaaacgcgagagaatttatattgtgggtttttcagacaacatccctttttactttcccgaacccataaaccaatatcggccattgggcgaactgctggaaaacgatcgagatgtcgaaccaagctattttttatcagataccttgaaacaaaaacgtttggcagccttaaaaaaagctccgcccaccccatcaatttggcatgaaaatattggcgggaatgtttccgcacttccatattcctgtgccttaagggccgggggaagttacaattatttggtggtaaacggagtaagaaggctaacaggaagggaaatgttaagattacaaggttttcccgatgattttgaaatcaatatcccctactcgcaagtcaggaaagtcgccggaaattctgtatccgtccctgtaatagaagccacgcggaaaatatgctcgcttctctttccggcaaggtcgaacaaaaagggcaattggatttattggaggcaggatgacgcttga

SEQ ID NO: 88011 - protein, 317 aa, Neisseria gonorrhoeae
MYKTIDLFSGIGGIRLGFEKYGCTNVFSSEWDKYARQVYEANFGEKPFGDINGIDPSDIPDHDILLAGFPCQPFSIAGKGLGFEDTRGTLFFNIAEILKTKQPKAFLLENVKRLTTHDSGRTFRIVLETLKQLGYTVYFKVLNTLDFGLPQKRERIYIVGFSDNIPFYFPEPINQYRPLGELLENDRDVEPSYFLSDTLKQKRLAALKKAPPTPSIWHENIGGNVSALPYSCALRAGGSYNYLVVNGVRRLTGREMLRLQGFPDDFEINIPYSQVRKVAGNSVSVPVIEATRKICSLLFPARSNKKGNWIYWRQDDA

SEQ ID NO: 88012 - DNA, 948 bp, Bacillus sp
  CDS (1)..(948): transl_table=11
atgttacaaatagcaagtttattcgcaggtgtaggtggaattgatttaggatttgaacaaactggatattttgaaacggtttgggcaaatgaatatgataaaaatgcagctattacctatcaatcaaattttaaaaacaaattaattatagatgatattcgaaatatcaaagtagaagatgttcctgattttgatgttttattatcaggatttccttgtacttcttttagcgtggctggatatagaaaaggctttgaagatgaaaaaagcggagatttattttttgaaactttacgcttgattgtagctaaaaaaccacaagttatatttttagaaaatgttaaaaatcttgtgggtcatgacaacggaaatacctttaaagtcatttatgaagcgttagaaagcaacggatatcatataaaataccaagttctaaacgcaaaagattttgggaatatacctcaaaatagagagcgtatctatattgtaggttttaggaatattgaacactataaaaattttaattttccgatgccacaaccacttacattaacaataaaagatatgataaatctttcagataaactagatgatagattttattatacagaggataaatgttctttttattcacctttacaagaacaaatgacttcagatgaaacaatatatcaatggcgtagaaaatatgtgagagaaaacaaaagtaatgtatgccctacgttaactgcgaacatgggaactggaggacataatgttccattagttaaaacaaaacatggaattagaaagttgactcctagagagtgtttcaattttcaaggttatcctgaagatttcattttacccgaattggctcctacgcatctttataagcaagctggaaattctgttgttgttcctgtcataagacgcatagcagaaaatatttataaatctatgttgtaa

SEQ ID NO: 88013 - protein, 315 aa, Bacillus sp
MLQIASLFAGVGGIDLGFEQTGYFETVWANEYDKNAAITYQSNFKNKLIIDDIRNIKVEDVPDFDVLLSGFPCTSFSVAGYRKGFEDEKSGDLFFETLRLIVAKKPQVIFLENVKNLVGHDNGNTFKVIYEALESNGYHIKYQVLNAKDFGNIPQNRERIYIVGFRNIEHYKNFNFPMPQPLTLTIKDMINLSDKLDDRFYYTEDKCSFYSPLQEQMTSDETIYQWRRKYVRENKSNVCPTLTANMGTGGHNVPLVKTKHGIRKLTPRECFNFQGYPEDFILPELAPTHLYKQAGNSVVVPVIRRIAENIYKSML

SEQ ID NO: 88014 - DNA, 1230 bp, Bacillus subtilis
  CDS (1)..(1230): transl_table=11
atgcgtggtggaaatcgactcggtgcaggaaggaaggttattcctgagtcagaaaaaaagaaaagaaaaagcgtgtatattacagataaactttacactagaattatggatactgacatcgaaaattgcaataatttcagtcaaaaatgtatggcattgattgaattagcaatggaaaatctaaataagaacaatcaagagcatagtgtgaaaaggaacaatatattgatggtgagagataccaaatctacatacaacaaaacgaataataattttgaaaaacaaaaccgtggaataaaattgacatttattgatttattcgctggtattggaggaattagattaggatttgaagacaaatatacgaaatgtgtatttagttctgaatgggataaatatgcagctcaaacgtatgaagctaattatggtgagaagcctcatggtgatattacaaaaatcaacgaaaatgatattccagatcaagatgttttattggctggatttccttgtcagccgtttagcaatataggcaagcgtgaaggttttgctcatgaaagaaggaacattatttttgatgttcttaggatcctaaagaaaaagcaacctaagatgtttttgttggaaaatgtaaaagggcttttaacaaatgataatgggaatacatttcgagtcattttagacaatcttaagagtctaggatattccgttttttatgaagttatggatgcacaaaattttgggcttccacaaagacgtgaacgtattgtaattgtgggatttcatcctgatttaggcattaatgatttttcatttcctaaaggtaatcctgacaataaggttccaattaatgctattttagagcataatcctacagggtattcaatttccaagcgtttgcaagaaagttacttatttaaaaaggatgatgggaagccacagattgttgattttagatgcacatatcaagttaacactttagtagctagttatcacaaaatacagcgtcttacaggaacatttgtaaaagacggagaaacagggcttcgattattcagcgaattagaactgaaacgtttgatgggtttccctgttgattttaaagttcctgtgtcaagaacacaaatgtataggcagtttggaaattctgttgctgttcccatgattaaagctgttgcaggagcaatgaaagagcgacttttgttggctgaaatgcaggtattgaaaaaataa

SEQ ID NO: 88015 - protein, 409 aa, Bacillus subtilis
MRGGNRLGAGRKVIPESEKKKRKSVYITDKLYTRIMDTDIENCNNFSQKCMALIELAMENLNKNNQEHSVKRNNILMVRDTKSTYNKTNNNFEKQNRGIKLTFIDLFAGIGGIRLGFEDKYTKCVFSSEWDKYAAQTYEANYGEKPHGDITKINENDIPDQDVLLAGFPCQPFSNIGKREGFAHERRNIIFDVLRILKKKQPKMFLLENVKGLLTNDNGNTFRVILDNLKSLGYSVFYEVMDAQNFGLPQRRERIVIVGFHPDLGINDFSFPKGNPDNKVPINAILEHNPTGYSISKRLQESYLFKKDDGKPQIVDFRCTYQVNTLVASYHKIQRLTGTFVKDGETGLRLFSELELKRLMGFPVDFKVPVSRTQMYRQFGNSVAVPMIKAVAGAMKERLLLAEMQVLKK

SEQ ID NO: 88016 - DNA, 1263 bp, Herpetosiphon aurantiacus
  CDS (1)..(1263): transl_table=11
atgcttaagtttatcgatttatttgctggtattggcggaatgcgactcggattcgagcaagcaatgcatgaattaggaatagagactgcatgtgttttatcctcggaaattgataaacatgcccaaactacctatgctatgaattttcatgaacaatctcaaggcgatataactcaaattcaagatttcccaagctttgattttttattagcaggctttccatgtcaaccattttcttatgcaggtaagcaaaaaggctttggcgatacacgtggcacactcttttttgagattgagcgaatattaaaagcttatcgacccaaagggtttttgctagagaatgtacgtggattaaccactcatgataagggacgaacgtttaagacaattttacaaaagctgcatgaattaaattatggcgtctatttgattttaaatagctcaaattttcaagttcctcagaatcggctacgagtatacatcgttgggcttgatcaatcacagccagaattaaccattacttctcacatcggcgcaactgactcacataaatttaaacaactatcaaatcaagctagcttatttgatacaaacaagataatgttggtaagagatattttagaagatcatccactggataaatataactgttctactgattttgttaataaattattagcatttattggacatccaatcaagctcaatggaaaaagactaattgattatcgtaatggtaattctattcattcttgggaacttggtattaaaggtgaatgcacgtcagacgaaattcaatttatgaatgctttgattgcgaaccggagaaagaagcactttggtgcacatcaagatggtaaaaaattaacgattgagcaaataaaaactttttttgagcatgatgaccttgattctattatgcaatcgctgataaccaaaggctatttgcaagaagttaatggccgttttaatccagttgccggaaatatgtcttttgaagtctttaaattcttagatcccgatagtgtctctattactttggttagtagtgatgcccataaaataggggtcgttcatcagaatcgtattcgtcgtataactccacgcgaatgcgctcggttacaaggctttcctgattcgtttcaatttcaccccaaagatagtctggcgtaccgccaatttggcaactccgtatcagttcccgtagttaaggctgtaattcttgatctctttaaatctgctgatttagcttcctgtttctag

SEQ ID NO: 88017 - protein, 420 aa, Herpetosiphon aurantiacus
MLKFIDLFAGIGGMRLGFEQAMHELGIETACVLSSEIDKHAQTTYAMNFHEQSQGDITQIQDFPSFDFLLAGFPCQPFSYAGKQKGFGDTRGTLFFEIERILKAYRPKGFLLENVRGLTTHDKGRTFKTILQKLHELNYGVYLILNSSNFQVPQNRLRVYIVGLDQSQPELTITSHIGATDSHKFKQLSNQASLFDTNKIMLVRDILEDHPLDKYNCSTDFVNKLLAFIGHPIKLNGKRLIDYRNGNSIHSWELGIKGECTSDEIQFMNALIANRRKKHFGAHQDGKKLTIEQIKTFFEHDDLDSIMQSLITKGYLQEVNGRFNPVAGNMSFEVFKFLDPDSVSITLVSSDAHKIGVVHQNRIRRITPRECARLQGFPDSFQFHPKDSLAYRQFGNSVSVPVVKAVILDLFKSADLASCF

SEQ ID NO: 88018 - DNA, 1056 bp, Dactylococcopsis salina
  CDS (1)..(1056): transl_table=11
atggagaaaaaacaattaaaattcattgatctgtttgctggtattggtggaatgcgtattccttttgaagaattaggtggaaagtgtgttttcagttcagagattgataagcattgtcaaagaacttatgaagctaattttggcgaaatgcctacaggagatataacaaaactatctgctgattctattccataccatgatctattattagcaggatttccttgccaagccttctctcaagggggtcgaaaacaagggtttcaagatgaaagaggtcaattattttttcaggttgccaagattctcaatgatcatcgaccgcaagctattttattagaaaatgtcaaaggtttaagaggacatgataaaggaagaactttacaaatgatcctctatgtattagaaaagctaaactatgttgtttcttggaagattatatcagcgacagactttaatttaccccagaaacgagaaagaatttttattgttggtttccaagacaaaaacaacaaaaatttaatctttgattttccaaagcctatagaattaacggcaaaagttggtgatctcttagagaaagaagttgatgagaagtacaccataacagaccgaatgtgggagggacatcaaaatagaaagaaagcacatcgaaaaagaggaaatggttttggtttttcattagttaatagaaacagttcctatactcgtacaatatcagctaggtattataaagatgggtcagaagttttagtagaacaagccaataaaaatcctagagtattaactcccagagaatgtgccagattgcaaggttttcctgaatcttttgtgataccagttagtgattgtcaggcttggaggcaatttgggaatagtgttccagtgtctgtcatcagggcaatcgctcaaaaaatgttgagctatattgatttaaccgagcaacaaaaagagtttaaaaaagttgatcttgatcaagtaattactcaaaagaaaaaacagttatatcctgaagattatcaagaacaatttatacaaaaggaattagcgctactatag

SEQ ID NO: 88019 - protein, 351 aa, Dactylococcopsis salina
MEKKQLKFIDLFAGIGGMRIPFEELGGKCVFSSEIDKHCQRTYEANFGEMPTGDITKLSADSIPYHDLLLAGFPCQAFSQGGRKQGFQDERGQLFFQVAKILNDHRPQAILLENVKGLRGHDKGRTLQMILYVLEKLNYVVSWKIISATDFNLPQKRERIFIVGFQDKNNKNLIFDFPKPIELTAKVGDLLEKEVDEKYTITDRMWEGHQNRKKAHRKRGNGFGFSLVNRNSSYTRTISARYYKDGSEVLVEQANKNPRVLTPRECARLQGFPESFVIPVSDCQAWRQFGNSVPVSVIRAIAQKMLSYIDLTEQQKEFKKVDLDQVITQKKKQLYPEDYQEQFIQKELALL

SEQ ID NO: 88020 - DNA, 1434 bp, Escherichia coli
  CDS (1)..(1434): transl_table=11
atgtctgaatttgaattactggcgcaggatctgcttgagaaagcagaagcggaagaacaactgcgacaggaaaatgataaaaagctgctcgggcaggtgctggaaatctatgaccagaagtacgtggctgaactgcttagaaaagttggtaaaaatgagtggagtcgcgagactcttaatcgctggattaatggtaagtgctcacctaagacgctgacgttagccgaagaggaacttctacgaaaaatgcttccggaagcgcctgcacatcaccctgactatgccttccggtttattgacctgtttgctgggattggaggtatacggaagggcttcgaaaccatcggtggccagtgcgtttttaccagtgaatggaataaagaggctgtgcgcacatataaagctaactggtttaacgatgctcaggaacacactttcaatctcgatattcgtgaagtcacgctcagtgataaacctgaagtacctgaaaacgatgcctatgcttacattaatgagcatgtgccggatcatgatgtacttctagcaggtttcccctgtcaaccgtttagccttgcgggcgtaagcaagaaaaactcgctcgggcgcgcgcatggtttcgaatgtgaggctcagggaacgcttttcttcgatgtggcgcgtattatccgcgcaaaaaaacctgccatctttgttcttgaaaacgttaaaaacctgaagagccatgacaagggtaaaacctttaaagtcatcatggataccctcgacgaactgggctatgaagttgcggatgcagctgagatgggcaaaaacgatcctaaagttatcgacggaaagcactttttacctcagcaccgagaacgtatcgttttggtcggtttccgccgtgatctgaacattcaccagggctttaccctgcgcgatattagtcgtttttatccggaacagcgtccgtcatttggcgaactgctggaacccgtggttgacagcaaatatatactgacgccgaaactctgggagtatctctataactacgccaaaaagcacgcagctaagggtaacggattcggttttggcctcgttaatcctgaaaataaagaaagcattgcccgtacgctttctgctcgctatcacaaagacgggtctgaaattctgatagaccgtggctgggatatggccacaggtgaaacagacttcgcgaacgaagaaaatcaggcgcatcggccccgcaggctgactccgcgagagtgcgcgcgccttatgggttttgaaaaagtagatggcaggccttttcgcattcctgtgtcagacactcagtcgtacaggcagttcggtaactccgtagtggtgcccgtgtttgaagccgtagccaaactgcttgaaccttatatcctgaaagcggttaatgccgattcgtgcaaggttgaacgaatctga

SEQ ID NO: 88021 - protein, 477 aa, Escherichia coli
MSEFELLAQDLLEKAEAEEQLRQENDKKLLGQVLEIYDQKYVAELLRKVGKNEWSRETLNRWINGKCSPKTLTLAEEELLRKMLPEAPAHHPDYAFRFIDLFAGIGGIRKGFETIGGQCVFTSEWNKEAVRTYKANWFNDAQEHTFNLDIREVTLSDKPEVPENDAYAYINEHVPDHDVLLAGFPCQPFSLAGVSKKNSLGRAHGFECEAQGTLFFDVARIIRAKKPAIFVLENVKNLKSHDKGKTFKVIMDTLDELGYEVADAAEMGKNDPKVIDGKHFLPQHRERIVLVGFRRDLNIHQGFTLRDISRFYPEQRPSFGELLEPVVDSKYILTPKLWEYLYNYAKKHAAKGNGFGFGLVNPENKESIARTLSARYHKDGSEILIDRGWDMATGETDFANEENQAHRPRRLTPRECARLMGFEKVDGRPFRIPVSDTQSYRQFGNSVVVPVFEAVAKLLEPYILKAVNADSCKVERI

SEQ ID NO: 88022 - DNA, 1254 bp, Escherichia coli
  CDS (1)..(1254): transl_table=11
atgttggcatggttactaaatatgttaaaggaagagttttcactttcagaagttgcagacattttgggcgtttcaaaagaaactttaaggcgttgggatactgctggaaaattagtttctcaaagaaatgacgaaaacaactatcgattttataaaaaagagcaacttaaaaattttgaacaagctcagtttttatttaaaagccagtggcctgatgagactaaaataagcaataatgtttatactgtattagagttatttgctggcgcaggggggatggctttaggtttagaaaaagccggtttaaaatctgttttactaaatgaaattgactcccatgcttgtaagacgttacgaaaaaataggcctgaatggaatgtggttgaaggtgatgtgagccaagtagacttcaccccttataggaataccgttgatgtgctggctggtggctttccttgccaggcattctcttatgcaggcaaaaaacttggttttgaagatacacggggcacccttttctttgaattcgcccgagccgctaaagaaatcaatccgaaagttcttttagcagagaatgttcgagggttgctaaatcatgatgctggacgaactttagaaacaataaaaaatattatcacagacttgggctacactttatttgagccaagagtgcttaaggctattttctacaaagtgccgcaaaaacgcgagcgtttgatcattgtagctgtaagaaatgatcttgctgatggcatcgattatgagtggccttcttcttacaataaaatattaacccttaaagatgcattaaaaaagggagagctgtatgatagcgacgtgccagaatctgaaggacaaaaatatcccaaaagaaaagcagagatcctaagtatggttcctcccggtggctactggagagatcttcctgaagatattcaaaaagaatacatgctcaagagtttttacttaggtgggggcaaaactggtatggctcgtcgtttgtcatgggatgaaccaagcctaacattaacatgcgccccagcacagaaacaaacagagcgttgccacccagaagaaacaagaccattaactgtgcgtgagtatgcaagaatacagaccttccccgatgaatgggtatttgaaggcccaatgtcagcgaaatataagcaaataggaaacgctgttcctgttaatctgtcatttgctgttggcaaatctgtggtacatcttttagataagataaataaaagatag

SEQ ID NO: 88023 - protein, 417 aa, Escherichia coli
MLAWLLNMLKEEFSLSEVADILGVSKETLRRWDTAGKLVSQRNDENNYRFYKKEQLKNFEQAQFLFKSQWPDETKISNNVYTVLELFAGAGGMALGLEKAGLKSVLLNEIDSHACKTLRKNRPEWNVVEGDVSQVDFTPYRNTVDVLAGGFPCQAFSYAGKKLGFEDTRGTLFFEFARAAKEINPKVLLAENVRGLLNHDAGRTLETIKNIITDLGYTLFEPRVLKAIFYKVPQKRERLIIVAVRNDLADGIDYEWPSSYNKILTLKDALKKGELYDSDVPESEGQKYPKRKAEILSMVPPGGYWRDLPEDIQKEYMLKSFYLGGGKTGMARRLSWDEPSLTLTCAPAQKQTERCHPEETRPLTVREYARIQTFPDEWVFEGPMSAKYKQIGNAVPVNLSFAVGKSVVHLLDKINKR

SEQ ID NO: 88024 - DNA, 1035 bp, Fusobacterium nucleatum
  CDS (1)..(1035): transl_table=11
atgaaattattaagtttattcagtggagcaggaggcttagatttaggttttgaaagagcaggatttgagataattgttgctaatgaatacgataaaacaatatgggaaacttatgaaaaaaatcataaagcaaaattgataaaaaaagatattagggaaattttatctgaagaactgcctaaaagcgatggaattataggtggacctccttgtcaatcttggagtgaagctggttcattaagaggaataaatgatccaagaggaaagttattttatgaatatattagaatattaaaagatattcaacctaaattttttttggcagaaaatgtaaaaggaatgttatcaaagagaaatactgaagcagtaaaagatataattaaagaatttgaagaagcagggtataatgtttttataaaattacttaatgcttttgattatggagtagctcaagatagggaaagagtgttttatgttggttttagaaaagatttaaatataagtaattttgaatttccttatcctattagtgaaaaagaaagaaaatatttaaaagatagtatatgggatttgaaagacaatgccttacctggaaaagataaaaataaaacaaatgctgatgattgtattgttgaaaatcatgaatatttaacaggaagttattcaactatttttatgagtagaaatcgtgtaagacaatgggaacaaccagcttttacagtacaagcctctggaagacaatgtcaattacaccctcaagcacctactatgataaaaatagataaaaatatgtataaatttgttgctggaaaggaaaatttatatagaagattgagtataagagaatgtgctagaatacaaggttttcctgatacatttaagttttactatacttcactagaagatggctataaaatggttggaaatgctgtgcctgtggatttagcatatataatagcaaaaagaataaaagaaactttaacagacaaagaaaagataaaaaaagaaattagacaaaaaactttgtttgattaa

SEQ ID NO: 88025 - protein, 344 aa, Fusobacterium nucleatum
MKLLSLFSGAGGLDLGFERAGFEIIVANEYDKTIWETYEKNHKAKLIKKDIREILSEELPKSDGIIGGPPCQSWSEAGSLRGINDPRGKLFYEYIRILKDIQPKFFLAENVKGMLSKRNTEAVKDIIKEFEEAGYNVFIKLLNAFDYGVAQDRERVFYVGFRKDLNISNFEFPYPISEKERKYLKDSIWDLKDNALPGKDKNKTNADDCIVENHEYLTGSYSTIFMSRNRVRQWEQPAFTVQASGRQCQLHPQAPTMIKIDKNMYKFVAGKENLYRRLSIRECARIQGFPDTFKFYYTSLEDGYKMVGNAVPVDLAYIIAKRIKETLTDKEKIKKEIRQKTLFD

SEQ ID NO: 88026 - DNA, 957 bp, Haemophilus aegyptius
  CDS (1)..(957): transl_table=11
atgaaagaatataaaacaatagatttgtttgctggaattggtggcattcgtctaggttttgaagcatttggatgtaaaaacgtattttcatcagaatgggataagtatgctcaaagtatgtatgaagtaaattttggcgaaaaaccttttggagatattaatgatatatctcctagcgatataccagatcatgatattttacttgctggatttccttgccaaccatttagtattgctggtaaaggattgggctttgctgatactagaggaacattattttttaatatagaagcaattttgaaagctaaaaaaccaaaagcttttttgctggaaaatgtaaaaagattaacaacacatgataatggtaatacatttaaagttattaacgataaattaaataagttaggatatacggtatatcataaagtattaaatacccttgattttggattaccacaaaaaagagagcgaatttacattgtgggttttttagataaattgcattttgaatttccaaagcctataggaaagtatgaagaactttctaatatattagagagtgatgatgttgttcctaataattattttctttcagatgaactaaaacggaaaagattaagttcaattactaaagatgtgccttatccttcaatttggcatgaaaatatttcaggaaatgtttctgctcttccatactcttgtgcattaagtgtcgggggaagttataattatctagttgtaaatggggtacgtcgattaactgggccagaaatgctaagattgcaaggatttccagatacttttgaaattaatataccttattctcaggtacgtaaagttgctggcaattcagttagtgttcctgtaattagggctattgctggttcaatgattaatagtttaaatatggcaactcgtaaaatatatcaagcaattcaactttcattattggactaa

SEQ ID NO: 88027 - protein, 318 aa, Haemophilus aegyptius
MKEYKTIDLFAGIGGIRLGFEAFGCKNVFSSEWDKYAQSMYEVNFGEKPFGDINDISPSDIPDHDILLAGFPCQPFSIAGKGLGFADTRGTLFFNIEAILKAKKPKAFLLENVKRLTTHDNGNTFKVINDKLNKLGYTVYHKVLNTLDFGLPQKRERIYIVGFLDKLHFEFPKPIGKYEELSNILESDDVVPNNYFLSDELKRKRLSSITKDVPYPSIWHENISGNVSALPYSCALSVGGSYNYLVVNGVRRLTGPEMLRLQGFPDTFEINIPYSQVRKVAGNSVSVPVIRAIAGSMINSLNMATRKIYQAIQLSLLD

SEQ ID NO: 88028 - DNA, 1077 bp, Haemophilus parainfluenzae
  CDS (1)..(1077): transl_table=11
atgaaagatgtgttagatgataacttgttagaagaacccgctgcacaatatagtttatttgaaccagagtccaaccctaatttacgagaaaaatttacttttattgatttatttgcaggtattggtggattccgcattgccatgcaaaatttaggaggtaaatgcattttctctagtgaatgggatgagcaagctcagaaaacttatgaggctaattttggtgatttgccttatggagatattaccttagaggaaacaaaggcttttattcctgaaaaatttgatattttatgtgctggttttccttgtcaggcattttctattgcaggaaaacgtggaggatttgaagatactagagggactttgttttttgatgttgcagaaattatacgtcgtcatcagcctaaagcattttttttagagaatgtaaaaggattaaaaaaccatgataaaggtaggacattaaaaactatattgaatgtactaagagaagatttaggttattttgttcctgaaccagcaattgttaatgctaagaattttggtgtgccacaaaatagagaaagaatttatattgtaggctttcataaaagcactggtgttaatagttttagttatccagaacctttagataaaattgtaactttcgctgatattcgggaagaaaaaacagttccaactaaatattacctatcaactcagtatattgatactttaagaaaacataaagaacgtcatgagagtaaaggtaatggttttggttatgaaattattccagatgatggaatagccaatgcgattgtagttggaggtatgggacgtgaacgtaatcttgtaattgatcatagaattacggattttactcctactacgaatattaaaggggaggtaaatcgtgaagggattcgtaaaatgacccctcgagaatgggcaagattgcaggggtttccagatagttatgttattccggtttctgatgcatcagcgtataaacaatttggtaattcagtagcagtgccggctattcaagctacaggtaagaaaattttagaaaaattaggaaatttatatgactga

SEQ ID NO: 88029 - protein, 358 aa, Haemophilus parainfluenzae
MKDVLDDNLLEEPAAQYSLFEPESNPNLREKFTFIDLFAGIGGFRIAMQNLGGKCIFSSEWDEQAQKTYEANFGDLPYGDITLEETKAFIPEKFDILCAGFPCQAFSIAGKRGGFEDTRGTLFFDVAEIIRRHQPKAFFLENVKGLKNHDKGRTLKTILNVLREDLGYFVPEPAIVNAKNFGVPQNRERIYIVGFHKSTGVNSFSYPEPLDKIVTFADIREEKTVPTKYYLSTQYIDTLRKHKERHESKGNGFGYEIIPDDGIANAIVVGGMGRERNLVIDHRITDFTPTTNIKGEVNREGIRKMTPREWARLQGFPDSYVIPVSDASAYKQFGNSVAVPAIQATGKKILEKLGNLYD

SEQ ID NO: 88030 - DNA, 993 bp, Haemophilus aegyptius
  CDS (1)..(993): transl_table=11
atgaatttaattagtcttttttcaggtgcagggggattagatcttggcttccaaaaagcaggatttcgtattatttgcgcaaatgaatatgataaatcaatatggaaaacatatgaaagtaatcattcagctaaattaatcaaaggcgatatatctaaaatttcttcagatgaatttcctaagtgtgatggaattattgggggaccgccttgtcaatcttggagtgaggggggatctcttagaggaattgatgatcctaggggcaaattgttttatgaatatattcggattttaaaacaaaaaaaaccaatattctttcttgccgaaaatgtcaaaggaatgatggctcagcgtcataataaggctgttcaagaatttatccaagaatttgataatgctggatatgatgtccatattattttgcttaatgcgaatgattatggtgtagctcaagatagaaaacgtgttttttatattggttttagaaaagagttaaatattaattatcttccacccattccacatttgataaagccaacatttaaggatgttatttgggacttaaaagataatccaattccagctttagataaaaataaaacaaatggtaataaatgtatttatcctaatcacgaatattttataggatcatattcaacaatttttatgagtagaaatcgtgttagacaatggaatgaaccagcattcacagttcaagcatctggacgacaatgtcaattacacccccaagctcctgtaatgttaaaagttagtaaaaatttaaataaatttgttgaaggaaaagaacatttatatcgcagactaactgttagagaatgcgcaagagtgcaaggatttccagatgattttatttttcattacgaaagtttgaatgatggttataaaatgatcggtaacgctgtgcctgtaaatttagcatatgaaatagctaagacaataaaatctgcattggaaatttgtaaaggtaattaa

SEQ ID NO: 88031 - protein, 330 aa, Haemophilus aegyptius
MNLISLFSGAGGLDLGFQKAGFRIICANEYDKSIWKTYESNHSAKLIKGDISKISSDEFPKCDGIIGGPPCQSWSEGGSLRGIDDPRGKLFYEYIRILKQKKPIFFLAENVKGMMAQRHNKAVQEFIQEFDNAGYDVHIILLNANDYGVAQDRKRVFYIGFRKELNINYLPPIPHLIKPTFKDVIWDLKDNPIPALDKNKTNGNKCIYPNHEYFIGSYSTIFMSRNRVRQWNEPAFTVQASGRQCQLHPQAPVMLKVSKNLNKFVEGKEHLYRRLTVRECARVQGFPDDFIFHYESLNDGYKMIGNAVPVNLAYEIAKTIKSALEICKGN

SEQ ID NO: 88032 - DNA, 993 bp, Methanobacterium thermoformicicum
  CDS (1)..(993): transl_table=11
atgaatatggacatagcgtcatttttttcgggtgctggaggtctcgacttagggtttacaaaagcaggttttaatattgtctttgctaacgacaattggaaagggtgctggaaaactttcgaaaaaaaccacggaataaaaataaataaaaaacccattgaatggttaaaaccctcagaaatacctgacgtggttggtttcatagggggacccccatgccagagctggagcctggcaggttcaatgtgcggggcagacgacccccgtggtaaaacattttatgcatacgtggatttagtcaaagaaaaagatcccctatttttcttggcagaaaacgtgccagggatagtttcaagaacacacctccctgaattcaaaagacttgtaaactcattcatagacatagggtacaacgtagaatataaggtgctcaacgcaaaggactacggcgtgccacaagacagaaaaagggtctttatcgtcgggtaccgtgaggacttaaacctaaaatttgagtttcctaaacctttaaacaagaaagtgaccctgagggacgctattggtgaccttcctgaacccaagcccgcgcttgaaaaaaacaggtcaaatggggaaaacttggaagtgccaaaccacgaatacatgacagggacattttcaagcaggtatatgtcaaggaacagggtaaggagttgggatgaagtttcatttacaattcaagcgggggggcgccatgccccatgccacccacaggctaataaaatgataaaggtgggacctgacaagttcatatttgatccagaaagtcctaaaccctaccgcaggttatccgtccgcgaatgcgctaggatacaaggttttcctgatgactttatattctattataaaaacgttgcagacggttatactatggttggtaacgctgttcctgtgaaattagcagaagaactagcaaaaaagataaaaaaagatttagagggcgttttgaattag

SEQ ID NO: 88033 - protein, 330 aa, Methanobacterium thermoformicicum
MNMDIASFFSGAGGLDLGFTKAGFNIVFANDNWKGCWKTFEKNHGIKINKKPIEWLKPSEIPDVVGFIGGPPCQSWSLAGSMCGADDPRGKTFYAYVDLVKEKDPLFFLAENVPGIVSRTHLPEFKRLVNSFIDIGYNVEYKVLNAKDYGVPQDRKRVFIVGYREDLNLKFEFPKPLNKKVTLRDAIGDLPEPKPALEKNRSNGENLEVPNHEYMTGTFSSRYMSRNRVRSWDEVSFTIQAGGRHAPCHPQANKMIKVGPDKFIFDPESPKPYRRLSVRECARIQGFPDDFIFYYKNVADGYTMVGNAVPVKLAEELAKKIKKDLEGVLN

SEQ ID NO: 88034 - DNA, 1257 bp, Moraxella sp
  CDS (1)..(1257): transl_table=11
atgaaacctgaaatattgaaattgattcgtagtaaattggatctaactcaaaagcaagcatctgaaattattgaagttagtgataaaacatggcaacagtgggaatcaggtaaaacagaaatgcatcctgcttattactcttttctccaagaaaaacttaaagataagattaactttgaggaactgagcgctcaaaaaacactccaaaagaagatattcgataaatacaatcagaatcaaattactaaaaatgcggaagaattagctgaaattactcatattgaagaaagaaaagatgcttatagcagtgatttcaaatttattgatttattttctggtatcggtggaataaggcaatcattcgaagtgaatggcggaaaatgcgtcttttcgtctgaaatagatccctttgcaaaatttacatattatacaaattttggtgtagtcccttttggagatattacaaaagttgaggctacaactattccacagcatgacattttatgtgcaggatttccgtgtcagccatttagccatattggtaaaagagaaggctttgaacatccaactcaaggaacaatgttccatgaaattgttcgtatcattgaaacaaaaaaaaccccagttttatttctagaaaatgttcctggtctcattaatcatgatgacggaaatacattaaaagtcatcattgaaacactagaagatatgggctacaaagttcatcatacggtactagacgctagtcattttggtatcccacaaaaacgtaagcgtttttacttagtagctttcctaaatcaaaatattcactttgagtttcctaaacctccaatgatttctaaagatatcggtgaagttttagaaagcgatgtaactggatatagcatttcagagcatttacaaaaaagttatctctttaaaaaagatgatggtaaaccttctttaattgacaaaaatacgactggggcagttaaaacattagtttctacctatcacaaaattcaacgattaacaggtacttttgttaaggatggagaaacaggtatccgtcttttaacaacgaatgaatgcaaagctattatgggttttccaaaagattttgttattcctgtatcaagaactcagatgtaccgtcaaatgggtaactctgtcgtagttccggtggttacaaaaattgcagaacagattagtttggcactaaaaactgttaaccaacaatccccgcaagaaaactttgaattagaactcgtttaa

SEQ ID NO: 88035 - protein, 418 aa, Moraxella sp
MKPEILKLIRSKLDLTQKQASEIIEVSDKTWQQWESGKTEMHPAYYSFLQEKLKDKINFEELSAQKTLQKKIFDKYNQNQITKNAEELAEITHIEERKDAYSSDFKFIDLFSGIGGIRQSFEVNGGKCVFSSEIDPFAKFTYYTNFGVVPFGDITKVEATTIPQHDILCAGFPCQPFSHIGKREGFEHPTQGTMFHEIVRIIETKKTPVLFLENVPGLINHDDGNTLKVIIETLEDMGYKVHHTVLDASHFGIPQKRKRFYLVAFLNQNIHFEFPKPPMISKDIGEVLESDVTGYSISEHLQKSYLFKKDDGKPSLIDKNTTGAVKTLVSTYHKIQRLTGTFVKDGETGIRLLTTNECKAIMGFPKDFVIPVSRTQMYRQMGNSVVVPVVTKIAEQISLALKTVNQQSPQENFELELV

SEQ ID NO: 88036 - DNA, 1251 bp, Psychrobacter sp
  CDS (1)..(1251): transl_table=11
atgaaatttcctgataatcatttttctgctgcgatagttgccgataccttatctgtatctaagcgaaatgtagagacttggacacagaatggcaagctagtaccagccttagaccctaatatacatgaaaagccctacacaaaagatcagttagaaaccttcgaacagttttctgcaatgtttaatagctcttggtgtgaggaaatggctgttgaacctagcagaagttactcgttagttgaattatttgctggtgcgggtggattagccttagggcttgagcaagcaggatttaagtctgtactactaaatgaaaaggacaaatatgcctgtgccacgcttcgtgccaaccgtccaaactggaacgtaatagaggatgatattgagaatgtggacttcacacacctaaacggcaaagtcgatttattaactggcggatttccttgccaaccgttctcgtatgcaggaaaacagctaggctttgaagatctaaggggtactttagtatttgagatggctagagcgataaaagagattaagcctaaggtgtttttagcagaaaacgttaaaggattagctgaaaatgacggtgggagaactctaagtatcattattaaagttctagaagatcttgggtacaaaatccttgagaaagaagtttataaagcaattttctataaagtacctcagaagcgagaaagacttataattataggtgttagaaccgatctatatgacaaattagcttatgaaaagccttccccttactacaaggttttaactgtggcagatgctttaaaagccggtgaactttacgatgtagatgttccagagtcaacaggacaactatacccagaacggaaggcagaaattatgtcatatgttcctgaagggggttattggcgcgacctaccaataagaattgcaaaagaatatatgatgaaaagtttttacctaggcggtggtaagactgggatggctagaagactatcgtgggatgagccaagccttacattggtatgcacacctgcacaaaagcaaacggaacgctgtcatcctagtgaaagtagaccactgactactagggagtatgcaagaatccagacatttcctgatgattgggaattcaaaggttctgttggtcagatctacaaacaaattggtaacgctgtgccagttaacttagccttagctataggtaaagctattatcagaatgcttaatgctgcaccaaaagatgtttttgagtaa

SEQ ID NO: 88037 - protein, 416 aa, Psychrobacter sp
MKFPDNHFSAAIVADTLSVSKRNVETWTQNGKLVPALDPNIHEKPYTKDQLETFEQFSAMFNSSWCEEMAVEPSRSYSLVELFAGAGGLALGLEQAGFKSVLLNEKDKYACATLRANRPNWNVIEDDIENVDFTHLNGKVDLLTGGFPCQPFSYAGKQLGFEDLRGTLVFEMARAIKEIKPKVFLAENVKGLAENDGGRTLSIIIKVLEDLGYKILEKEVYKAIFYKVPQKRERLIIIGVRTDLYDKLAYEKPSPYYKVLTVADALKAGELYDVDVPESTGQLYPERKAEIMSYVPEGGYWRDLPIRIAKEYMMKSFYLGGGKTGMARRLSWDEPSLTLVCTPAQKQTERCHPSESRPLTTREYARIQTFPDDWEFKGSVGQIYKQIGNAVPVNLALAIGKAIIRMLNAAPKDVFE

SEQ ID NO: 88038 - DNA, 993 bp, Neisseria gonorrhoeae
  CDS (1)..(993)
atgaaaatcattagtttgtttagcggttgcggcggtttggatttgggtttcgaaaaagcgggatttgaaatccccgccgccaacgaatacgataaaaccatttgggcaaccttcaaggcaaaccatccaaagacccatttgatagaaggcgatatacgcaagattaaagaagaagatttccctgaagaaatcgacgggattatcggcggcccaccctgccagtcttggtctgaagcgggagctttgcgcggcatcgacgatgcgcgcggacagttgtttttcgactacatccgtattttgaaaagcaaacagccaaaattctttttagcggaaaacgtcagcggaatgctggcaaaccgccacaacggagccgtacaaaacctgctgaaaatgtttgacggatgcggatacgacgtaaccttgactatggccaacgccaaagactacggtgtagcacaggaacgcaaaagggtcttctacatcggtttccgtaaagacttggaaataaaattttcttttccaaaaggttcgacggtcgaagacaaagacaagattacattgaaagacgttatttgggatttgcaggacacagccgtaccttccgccccgcaaaacaagaccaaccccgacgcagtcaacaacaacgaatattttaccggcagtttttcccctatttttatgagccggaaccgagttaaagcgtgggatgaacagggttttaccgtccaagcttcaggcaggcagtgccaactgcacccgcaagccccaaagatggaaaagcacggggcaaacgactaccgttttgctgccggcaaagaaacactatatcggaggatgacggtacgcgaagttgcaagaatccaaggctttcccgacaacttcaaattcatctatcaaaatgtcaacgacgcatacaaaatgattggcaacgccgtccccgtcaaccttgcctacgaaattgcagcggcaattaaaaaaaccctagaaaggtga

SEQ ID NO: 88039 - protein, 330 aa, Neisseria gonorrhoeae
MKIISLFSGCGGLDLGFEKAGFEIPAANEYDKTIWATFKANHPKTHLIEGDIRKIKEEDFPEEIDGIIGGPPCQSWSEAGALRGIDDARGQLFFDYIRILKSKQPKFFLAENVSGMLANRHNGAVQNLLKMFDGCGYDVTLTMANAKDYGVAQERKRVFYIGFRKDLEIKFSFPKGSTVEDKDKITLKDVIWDLQDTAVPSAPQNKTNPDAVNNNEYFTGSFSPIFMSRNRVKAWDEQGFTVQASGRQCQLHPQAPKMEKHGANDYRFAAGKETLYRRMTVREVARIQGFPDNFKFIYQNVNDAYKMIGNAVPVNLAYEIAAAIKKTLER

SEQ ID NO: 88040 - DNA, 1293 bp, Staphylococcus aureus
  CDS (1)..(1293): transl_table=11
gtgagattgaacaaaggaagtataattgaaaaaatgaaaaatcaaaatattaaaacacaaactgaattagctgaaaaaattgatatatctaaaagccaactatcattcatgttttcagatgaatatgagcctcttaaaaagaatgttattaagttggcagatgttttaaaagtatctcctaatgacattatattagacgaagaagaccaaatgccaattaactctgattttaatagatatgattataaattagatgaattcatagatgtaagcaatgtaagaaagaataaagattataatgtattcgaaacctttgccggggctggtggactagcactaggcttagaaagcgctggcttgtcaacttatggagcagttgaaattgataaaaatgccgcagaaactttgagaattaataggccaaaatggaaagttattgagaacgatattgaattcattgctgataatttggatgaatttatagatgaagagatagatatattgagtggggggtatccttgccaaacatttagttatgcaggaaaaagaaatggatttgcggatacaagaggaacactgttctatccatatagtaaaattttaagtaaattaaagcctaaagcttttatagcagaaaatgttagaggattagtcaatcacgacgatggcaaaacattagaagtaatgttaaaagtttttattaaggaaggttatgaggtttactggaatattttgaactcgtggaattatgatgtagcgcaaaaaagagaaagaatagtaattataggtatcagagaagatttagtaaaagaacagaaatatccatttagatttcctttagctcaagtatacaaacctgtattgaaagatgtactgaaagatgttccaaagagtaaagttacagcatacagtgacaaaaaaagagaagtaatgaaattagttccaccaggaggctgttgggtagatttacctgaacaaatagctaaagattatatggggaaaagttggtattcaggtggtggtaaaagaggaatggctagaaggataagttgggacgagccttgtttgacgttaacaacatctcctagtcaaaaacaaacagagagatgtcatcctgatgaaactcgaccatttagtatcagagagtatgctagaattcaatcgttccctgatgaatgggaattttctggaggagtaggtgcacaatacagacaaataggtaacgctgtacctgtaaatctagctaaatatataggtaaatctttagtacattatttaaatcaatttaattga

SEQ ID NO: 88041 - protein, 430 aa, Staphylococcus aureus
MRLNKGSIIEKMKNQNIKTQTELAEKIDISKSQLSFMFSDEYEPLKKNVIKLADVLKVSPNDIILDEEDQMPINSDFNRYDYKLDEFIDVSNVRKNKDYNVFETFAGAGGLALGLESAGLSTYGAVEIDKNAAETLRINRPKWKVIENDIEFIADNLDEFIDEEIDILSGGYPCQTFSYAGKRNGFADTRGTLFYPYSKILSKLKPKAFIAENVRGLVNHDDGKTLEVMLKVFIKEGYEVYWNILNSWNYDVAQKRERIVIIGIREDLVKEQKYPFRFPLAQVYKPVLKDVLKDVPKSKVTAYSDKKREVMKLVPPGGCWVDLPEQIAKDYMGKSWYSGGGKRGMARRISWDEPCLTLTTSPSQKQTERCHPDETRPFSIREYARIQSFPDEWEFSGGVGAQYRQIGNAVPVNLAKYIGKSLVHYLNQFN

SEQ ID NO: 88042 - DNA, 1170 bp, Lactococcus lactis
  CDS (1)..(1170): transl_table=11
atgactactatatcaagaaatacaggaacagaaatttctataatgattaaagaaaagcgactacgcctaaatatgactcaaaaagagcttgcagatgcagtgggcatgtcaaaaaacggagatagaaccataagaagatgggaaaatggtgaaacttgtccatcacagcttgaaatatctgctattttaagatttccagaaattgcaccatttgaaaatagaaaaacagctaaatataaaatgattgacctatttgcaggtattggagggacacgcttaggttttcatcaaacagaaaaagtaaagtctgtattttcatctgaaatagataaatttgctattaaaacttataaagcgaattttggagacgaacctcatggggatataacaaaaattgatgagaaagatatcccagaccatgatattcttgtcggtggatttccttgtcaagcatttagtcaagcaggaaaaaaattaggatttgatgatacacgtggaactttattttttgaaatagcaagaattataaaagaaaaacgccctaaagcatttctactcgaaaatgtaaaaaatttaaaaacccatgataaaggaagaacttttaaaacaatattaaatactttggaagaacttgattatgaagttcacacagcgctattcaaagcaagagattttggtcttccacaaaatagagaaaggatttatattgtaggttttgacagaaaatcaattagcaactattctgattttcaaatgcctacacctttacaagaaaaaactcgtgttggaaatattttagaatccgttgttgatgataaatatacaatatcagataaactttgggatgggcatcaaagaagaaaaactgaaaataaaaaaaatggcaaaggttttggatataccctctttaatcaagatagtgagtatacaaacactttatcagctcgttattataaagatggtagtgaaatactaattgaacagaaaaataaaaatcctcgaaaaattactcctagggaagctgctcgattacaaggttttccagaaaattttattatacctgttagcgatacccaagcttataaagaatttggaaactctgttgcagttcccaccattcatgctattgcagagaagatgttggaagttttagagaagtcaaaaaaataa

SEQ ID NO: 88043 - protein, 389 aa, Lactococcus lactis
MTTISRNTGTEISIMIKEKRLRLNMTQKELADAVGMSKNGDRTIRRWENGETCPSQLEISAILRFPEIAPFENRKTAKYKMIDLFAGIGGTRLGFHQTEKVKSVFSSEIDKFAIKTYKANFGDEPHGDITKIDEKDIPDHDILVGGFPCQAFSQAGKKLGFDDTRGTLFFEIARIIKEKRPKAFLLENVKNLKTHDKGRTFKTILNTLEELDYEVHTALFKARDFGLPQNRERIYIVGFDRKSISNYSDFQMPTPLQEKTRVGNILESVVDDKYTISDKLWDGHQRRKTENKKNGKGFGYTLFNQDSEYTNTLSARYYKDGSEILIEQKNKNPRKITPREAARLQGFPENFIIPVSDTQAYKEFGNSVAVPTIHAIAEKMLEVLEKSKK

SEQ ID NO: 88044 - DNA, 25 bp, Primer
atgcaggaaaatatatcagtaaccg

SEQ ID NO: 88045 - DNA, 23 bp, Primer
ttatcgtgaacgtcggccatgtt

SEQ ID NO: 88046 - protein, 613 aa, consensus
  MISC_FEATURE (1)..(613): consensus for the disclosure of xaa see table XV
FXGXGGXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDXXXXGXPCQXFSXXGXXXXXXXXXXXXXXXXXXXXXXXXXXXXXXXXXXXXXXXXXXXXLXXXXXXXXXXXXXXXXXPXXXXXENVXXXXXXXXXXXXXXXXXXXXXXXXXXXXXXXXXXXXXXXXXXXXXXXXXXXXXXXXXXXXXXPQXRXRXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXTXXEXXXXXXFXXXXXXXXXXXXXXXXXXXXXXXXXXXXXGNXV

SEQ ID NO: 88047 - protein, 16 aa, consensus
  MISC_FEATURE (1)..(16): consensus for the disclosure of xaa see table XV
XXXXXXXPCXXXXXXX

SEQ ID NO: 88048 - protein, 82 aa, consensus
  MISC_FEATURE (1)..(82): consensus for the disclosure of xaa see table XV
PXXXXXXNVXXXXXXXXXXXXXXXXXXXXXXXXXXXXXXXXXXXXXXXXXXXXXXXXXXXXXXXXXXXXXXXXXRXRXXXXX

SEQ ID NO: 88049 - DNA, 879 bp, Escherichia coli K12; identical to SEQ ID NO: 72417
  CDS (1)..(879)

SEQ ID NO: 88050 - protein, 292 aa, Escherichia coli K12; identical to SEQ ID NO: 72418

SEQ ID NO: 88051 - DNA, 897 bp, Haemophilus influenzae; identical to SEQ ID NO: 72419
  CDS (1)..(897)

SEQ ID NO: 88052 - protein, 298 aa, Haemophilus influenzae; identical to SEQ ID NO: 72420

SEQ ID NO: 88053 - DNA, 852 bp, Methanobacterium thermoautotrophicum; identical to SEQ ID NO: 72421
  CDS (1)..(852)

SEQ ID NO: 88054 - protein, 283 aa, Methanobacterium thermoautotrophicum; identical to SEQ ID NO: 72422

SEQ ID NO: 88055 - DNA, 942 bp, Halobacterium sp. NRC-1; identical to SEQ ID NO: 72423
  CDS (1)..(942)

SEQ ID NO: 88056 - protein, 313 aa, Halobacterium sp. NRC-1; identical to SEQ ID NO: 72424

SEQ ID NO: 88057 - DNA, 936 bp, Streptococcus pneumoniae; identical to SEQ ID NO: 72425
  CDS (1)..(936)

SEQ ID NO: 88058 - protein, 311 aa, Streptococcus pneumoniae; identical to SEQ ID NO: 72426

SEQ ID NO: 88059 - DNA, 900 bp, Sinorhizobium meliloti; identical to SEQ ID NO: 72427
  CDS (1)..(900)

SEQ ID NO: 88060 - protein, 299 aa, Sinorhizobium meliloti; identical to SEQ ID NO: 72428

SEQ ID NO: 88061 - DNA, 909 bp, Agrobacterium tumefaciens; identical to SEQ ID NO: 72429
  CDS (1)..(909)

SEQ ID NO: 88062 - protein, 302 aa, Agrobacterium tumefaciens; identical to SEQ ID NO: 72430

SEQ ID NO: 88063 - DNA, 912 bp, Agrobacterium tumefaciens; identical to SEQ ID NO: 72431
  CDS (1)..(912)

SEQ ID NO: 88064 - protein, 303 aa, Agrobacterium tumefaciens; identical to SEQ ID NO: 72432

SEQ ID NO: 88065 - DNA, 882 bp, Yersinia pestis; identical to SEQ ID NO: 72433
  CDS (1)..(882)

SEQ ID NO: 88066 - protein, 293 aa, Yersinia pestis; identical to SEQ ID NO: 72434

SEQ ID NO: 88067 - DNA, 879 bp, Salmonella enterica subsp. enterica serovar Typhi; identical to SEQ ID NO: 72435
  CDS (1)..(879)

SEQ ID NO: 88068 - protein, 292 aa, Salmonella enterica subsp. enterica serovar Typhi; identical to SEQ ID NO: 72436

SEQ ID NO: 88069 - DNA, 969 bp, Brucella melitensis; identical to SEQ ID NO: 72437
  CDS (1)..(969)

SEQ ID NO: 88070 - protein, 322 aa, Brucella melitensis; identical to SEQ ID NO: 72438

SEQ ID NO: 88071 - DNA, 885 bp, Agrobacterium tumefaciens; identical to SEQ ID NO: 72439
  CDS (1)..(885)

SEQ ID NO: 88072 - protein, 294 aa, Agrobacterium tumefaciens; identical to SEQ ID NO: 72440

SEQ ID NO: 88073 - DNA, 924 bp, Brucella melitensis; identical to SEQ ID NO: 72441
  CDS (1)..(924)

SEQ ID NO: 88074 - protein, 307 aa, Brucella melitensis; identical to SEQ ID NO: 72442

SEQ ID NO: 88075 - DNA, 885 bp, Nostoc sp. PCC 7120; identical to SEQ ID NO: 72443
  CDS (1)..(885)

SEQ ID NO: 88076 - protein, 294 aa, Nostoc sp. PCC 7120; identical to SEQ ID NO: 72444

SEQ ID NO: 88077 - DNA, 882 bp, Listeria innocua; identical to SEQ ID NO: 72445
  CDS (1)..(882)

SEQ ID NO: 88078 - protein, 293 aa, Listeria innocua; identical to SEQ ID NO: 72446

SEQ ID NO: 88079 - DNA, 1002 bp, Rhizobium meliloti; identical to SEQ ID NO: 72447
  CDS (1)..(1002)

SEQ ID NO: 88080 - protein, 333 aa, Rhizobium meliloti; identical to SEQ ID NO: 72448

SEQ ID NO: 88081 - DNA, 885 bp, Thermotoga maritima; identical to SEQ ID NO: 72449
  CDS (1)..(885)

SEQ ID NO: 88082 - protein, 294 aa, Thermotoga maritima; identical to SEQ ID NO: 72450

SEQ ID NO: 88083 - DNA, 915 bp, Sinorhizobium meliloti; identical to SEQ ID NO: 72451
  CDS (1)..(915)

SEQ ID NO: 88084 - protein, 304 aa, Sinorhizobium meliloti; identical to SEQ ID NO: 72452

SEQ ID NO: 88085 - DNA, 882 bp, Clostridium acetobutylicum; identical to SEQ ID NO: 72453
  CDS (1)..(882)

SEQ ID NO: 88086 - protein, 293 aa, Clostridium acetobutylicum; identical to SEQ ID NO: 72454

SEQ ID NO: 88087 - DNA, 906 bp, Corynebacterium glutamicum; identical to SEQ ID NO: 72455
  CDS (1)..(906)

SEQ ID NO: 88088 - protein, 301 aa, Corynebacterium glutamicum; identical to SEQ ID NO: 72456

SEQ ID NO: 88089 - DNA, 903 bp, Helicobacter pylori; identical to SEQ ID NO: 72457
  CDS (1)..(903)

SEQ ID NO: 88090 - protein, 300 aa, Helicobacter pylori; identical to SEQ ID NO: 72458

SEQ ID NO: 88091 - DNA, 879 bp, Pseudomonas aeruginosa; identical to SEQ ID NO: 72459
  CDS (1)..(879)

SEQ ID NO: 88092 - protein, 292 aa, Pseudomonas aeruginosa; identical to SEQ ID NO: 72460

SEQ ID NO: 88093 - DNA, 903 bp, Mycobacterium leprae; identical to SEQ ID NO: 72461
  CDS (1)..(903)

SEQ ID NO: 88094 - protein, 300 aa, Mycobacterium leprae; identical to SEQ ID NO: 72462

SEQ ID NO: 88095 - DNA, 888 bp, Staphylococcus aureus; identical to SEQ ID NO: 72463
  CDS (1)..(888)

SEQ ID NO: 88096 - protein, 295 aa, Staphylococcus aureus; identical to SEQ ID NO: 72464

SEQ ID NO: 88097 - DNA, 930 bp, Escherichia coli; identical to SEQ ID NO: 72465
  CDS (1)..(930)

SEQ ID NO: 88098 - protein, 309 aa, Escherichia coli; identical to SEQ ID NO: 72466

SEQ ID NO: 88099 - DNA, 885 bp, Rickettsia prowazekii; identical to SEQ ID NO: 72467
  CDS (1)..(885)

SEQ ID NO: 88100 - protein, 294 aa, Rickettsia prowazekii; identical to SEQ ID NO: 72468

SEQ ID NO: 88101 - DNA, 876 bp, Neisseria meningitidis; identical to SEQ ID NO: 72469
  CDS (1)..(876)

SEQ ID NO: 88102 - protein, 291 aa, Neisseria meningitidis; identical to SEQ ID NO: 72470

SEQ ID NO: 88103 - DNA, 918 bp, Pseudomonas aeruginosa; identical to SEQ ID NO: 72471
  CDS (1)..(918)

SEQ ID NO: 88104 - protein, 305 aa, Pseudomonas aeruginosa; identical to SEQ ID NO: 72472

SEQ ID NO: 88105 - DNA, 894 bp, Lactococcus lactis subsp. lactis; identical to SEQ ID NO: 72473
  CDS (1)..(894)

SEQ ID NO: 88106 - protein, 297 aa, Lactococcus lactis subsp. lactis; identical to SEQ ID NO: 72474

SEQ ID NO: 88107 - DNA, 882 bp, Sinorhizobium meliloti; identical to SEQ ID NO: 72475
  CDS (1)..(882)

SEQ ID NO: 88108 - protein, 293 aa, Sinorhizobium meliloti; identical to SEQ ID NO: 72476

SEQ ID NO: 88109 - DNA, 873 bp, Bacillus subtilis; identical to SEQ ID NO: 72477
  CDS (1)..(873)

SEQ ID NO: 88110 - protein, 290 aa, Bacillus subtilis; identical to SEQ ID NO: 72478

SEQ ID NO: 88111 - DNA, 870 bp, Methanococcus jannaschii; identical to SEQ ID NO: 72479
  CDS (1)..(870)

SEQ ID NO: 88112 - protein, 289 aa, Methanococcus jannaschii; identical to SEQ ID NO: 72480

SEQ ID NO: 88113 - DNA, 885 bp, Aquifex aeolicus; identical to SEQ ID NO: 72481
  CDS (1)..(885)

SEQ ID NO: 88114 - protein, 294 aa, Aquifex aeolicus; identical to SEQ ID NO: 72482

SEQ ID NO: 88115 - DNA, 870 bp, Sulfolobus solfataricus; identical to SEQ ID NO: 72483
  CDS (1)..(870)

SEQ ID NO: 88116 - protein, 289 aa, Sulfolobus solfataricus; identical to SEQ ID NO: 72484

SEQ ID NO: 88117 - DNA, 870 bp, Archaeoglobus fulgidus; identical to SEQ ID NO: 72485
  CDS (1)..(870)

SEQ ID NO: 88118 - protein, 289 aa, Archaeoglobus fulgidus; identical to SEQ ID NO: 72486

SEQ ID NO: 88119 - DNA, 897 bp, Campylobacter jejuni; identical to SEQ ID NO: 72487
  CDS (1)..(897)

SEQ ID NO: 88120 - protein, 298 aa, Campylobacter jejuni; identical to SEQ ID NO: 72488

SEQ ID NO: 88121 - DNA, 888 bp, Bacillus halodurans; identical to SEQ ID NO: 72489
  CDS (1)..(888)

SEQ ID NO: 88122 - protein, 295 aa, Bacillus halodurans; identical to SEQ ID NO: 72490

SEQ ID NO: 88123 - DNA, 885 bp, Caulobacter crescentus; identical to SEQ ID NO: 72491
  CDS (1)..(885)

SEQ ID NO: 88124 - protein, 294 aa, Caulobacter crescentus; identical to SEQ ID NO: 72492

SEQ ID NO: 88125 - DNA, 882 bp, Pseudomonas aeruginosa; identical to SEQ ID NO: 72493
  CDS (1)..(882)

SEQ ID NO: 88126 - protein, 293 aa, Pseudomonas aeruginosa; identical to SEQ ID NO: 72494

SEQ ID NO: 88127 - DNA, 879 bp, Bacillus halodurans; identical to SEQ ID NO: 72495
  CDS (1)..(879)

SEQ ID NO: 88128 - protein, 292 aa, Bacillus halodurans; identical to SEQ ID NO: 72496

SEQ ID NO: 88129 - DNA, 876 bp, Chlamydophila pneumoniae, Chlamydia pneumoniae; identical to SEQ ID NO: 72497
  CDS (1)..(876)

SEQ ID NO: 88130 - protein, 291 aa, Chlamydophila pneumoniae, Chlamydia pneumoniae; identical to SEQ ID NO: 72498

SEQ ID NO: 88131 - DNA, 936 bp, Streptococcus pneumoniae; identical to SEQ ID NO: 72499
  CDS (1)..(936)

SEQ ID NO: 88132 - protein, 311 aa, Streptococcus pneumoniae; identical to SEQ ID NO: 72500

SEQ ID NO: 88133 - DNA, 903 bp, Mycobacterium tuberculosis; identical to SEQ ID NO: 72501
  CDS (1)..(903)

SEQ ID NO: 88134 - protein, 300 aa, Mycobacterium tuberculosis; identical to SEQ ID NO: 72502

SEQ ID NO: 88135 - DNA, 885 bp, Pyrococcus abyssi; identical to SEQ ID NO: 72503
  CDS (1)..(885)

SEQ ID NO: 88136 - protein, 294 aa, Pyrococcus abyssi; identical to SEQ ID NO: 72504

SEQ ID NO: 88137 - DNA, 879 bp, Vibrio cholerae; identical to SEQ ID NO: 72505
  CDS (1)..(879)

SEQ ID NO: 88138 - protein, 292 aa, Vibrio cholerae; identical to SEQ ID NO: 72506

SEQ ID NO: 88139 - DNA, 861 bp, Clostridium acetobutylicum; identical to SEQ ID NO: 72507
  CDS (1)..(861)

SEQ ID NO: 88140 - protein, 286 aa, Clostridium acetobutylicum; identical to SEQ ID NO: 72508

SEQ ID NO: 88141 - DNA, 1469 bp, Arabidopsis thaliana (mouse-ear cress); identical to SEQ ID NO: 72509
  CDS (205)..(1299)

SEQ ID NO: 88142 - protein, 364 aa, Arabidopsis thaliana (mouse-ear cress); identical to SEQ ID NO: 72510

SEQ ID NO: 88143 - DNA, 1177 bp, Populus trichocarpa x Populus deltoides (western balsam poplar x cottonwood); identical to SEQ ID NO: 72511
  CDS (44)..(1144)

SEQ ID NO: 88144 - protein, 366 aa, Populus trichocarpa x Populus deltoides (western balsam poplar x cottonwood); identical to SEQ ID NO: 72512

SEQ ID NO: 88145 - DNA, 999 bp, Glycine max (soybean); identical to SEQ ID NO: 72513
  CDS (1)..(999)

SEQ ID NO: 88146 - protein, 332 aa, Glycine max (soybean); identical to SEQ ID NO: 72514

SEQ ID NO: 88147 - DNA, 960 bp, Escherichia coli; identical to SEQ ID NO: 72515
  CDS (1)..(960)

SEQ ID NO: 88148 - protein, 319 aa, Escherichia coli; identical to SEQ ID NO: 72516

SEQ ID NO: 88149 - DNA, 906 bp, Synechocystis sp; identical to SEQ ID NO: 72517
  CDS (1)..(906)

SEQ ID NO: 88150 - protein, 301 aa, Synechocystis sp; identical to SEQ ID NO: 72518

SEQ ID NO: 88151 - DNA, 1366 bp, Nicotiana tabacum (common tobacco); identical to SEQ ID NO: 72519
  CDS (41)..(1120)

SEQ ID NO: 88152 - protein, 359 aa, Nicotiana tabacum (common tobacco); identical to SEQ ID NO: 72520

SEQ ID NO: 88153 - DNA, 900 bp, Streptomyces coelicolor; identical to SEQ ID NO: 72521
  CDS (1)..(900)

SEQ ID NO: 88154 - protein, 299 aa, Streptomyces coelicolor; identical to SEQ ID NO: 72522

SEQ ID NO: 88155 - DNA, 954 bp, Streptomyces coelicolor; identical to SEQ ID NO: 72523
  CDS (1)..(954)

SEQ ID NO: 88156 - protein, 317 aa, Streptomyces coelicolor; identical to SEQ ID NO: 72524

SEQ ID NO: 88157 - DNA, 1361 bp, Triticum aestivum (common wheat); identical to SEQ ID NO: 72525
  CDS (52)..(1185)

SEQ ID NO: 88158 - protein, 377 aa, Triticum aestivum (common wheat); identical to SEQ ID NO: 72526

SEQ ID NO: 88159 - DNA, 1458 bp, Triticum aestivum (common wheat); identical to SEQ ID NO: 72527
  CDS (88)..(1254)

SEQ ID NO: 88160 - protein, 388 aa, Triticum aestivum (common wheat); identical to SEQ ID NO: 72528

SEQ ID NO: 88161 - DNA, 1400 bp, Zea mays (maize); identical to SEQ ID NO: 72529
  CDS (40)..(1182)

SEQ ID NO: 88162 - protein, 380 aa, Zea mays (maize); identical to SEQ ID NO: 72530

SEQ ID NO: 88163 - DNA, 1190 bp, Solanum tuberosum; identical to SEQ ID NO: 72531
  CDS (14)..(1078)

SEQ ID NO: 88164 - protein, 354 aa, Solanum tuberosum; identical to SEQ ID NO: 72532

SEQ ID NO: 88165 - DNA, 873 bp, Bacillus methanolicus; identical to SEQ ID NO: 72533
  CDS (1)..(873)

SEQ ID NO: 88166 - protein, 290 aa, Bacillus methanolicus; identical to SEQ ID NO: 72534

SEQ ID NO: 88167 - DNA, 921 bp, Burkholderia mallei ATCC 23344; identical to SEQ ID NO: 72535
  CDS (1)..(921)

SEQ ID NO: 88168 - protein, 306 aa, Burkholderia mallei ATCC 23344; identical to SEQ ID NO: 72536

SEQ ID NO: 88169 - DNA, 897 bp, Burkholderia mallei ATCC 23344; identical to SEQ ID NO: 72537
  CDS (1)..(897)

SEQ ID NO: 88170 - protein, 298 aa, Burkholderia mallei ATCC 23344; identical to SEQ ID NO: 72538

SEQ ID NO: 88171 - DNA, 903 bp, Burkholderia mallei ATCC 23344; identical to SEQ ID NO: 72539
  CDS (1)..(903)

SEQ ID NO: 88172 - protein, 300 aa, Burkholderia mallei ATCC 23344; identical to SEQ ID NO: 72540

SEQ ID NO: 88173 - DNA, 894 bp, Bacillus licheniformis DSM 13; identical to SEQ ID NO: 72541
  CDS (1)..(894)

SEQ ID NO: 88174 - protein, 297 aa, Bacillus licheniformis DSM 13; identical to SEQ ID NO: 72542

SEQ ID NO: 88175 - DNA, 897 bp, Bacillus cereus ZK; identical to SEQ ID NO: 72543
  CDS (1)..(897)

SEQ ID NO: 88176 - protein, 298 aa, Bacillus cereus ZK; identical to SEQ ID NO: 72544

SEQ ID NO: 88177 - DNA, 903 bp, Burkholderia pseudomallei K96243; identical to SEQ ID NO: 72545
  CDS (1)..(903)

SEQ ID NO: 88178 - protein, 300 aa, Burkholderia pseudomallei K96243; identical to SEQ ID NO: 72546

SEQ ID NO: 88179 - DNA, 888 bp, uncultured archaeon GZfos9D1; identical to SEQ ID NO: 72547
  CDS (1)..(888)

SEQ ID NO: 88180 - protein, 295 aa, uncultured archaeon GZfos9D1; identical to SEQ ID NO: 72548

SEQ ID NO: 88181 - DNA, 891 bp, uncultured archaeon GZfos37B2; identical to SEQ ID NO: 72549
  CDS (1)..(891)

SEQ ID NO: 88182 - protein, 296 aa, uncultured archaeon GZfos37B2; identical to SEQ ID NO: 72550

SEQ ID NO: 88183 - DNA, 888 bp, uncultured archaeon GZfos19A5; identical to SEQ ID NO: 72551
  CDS (1)..(888)

SEQ ID NO: 88184 - protein, 295 aa, uncultured archaeon GZfos19A5; identical to SEQ ID NO: 72552

SEQ ID NO: 88185 - DNA, 894 bp, Bacteroides fragilis; identical to SEQ ID NO: 72553
  CDS (1)..(894)

SEQ ID NO: 88186 - protein, 297 aa, Bacteroides fragilis; identical to SEQ ID NO: 72554

SEQ ID NO: 88187 - DNA, 888 bp, Bacillus licheniformis DSM 13; identical to SEQ ID NO: 72555
  CDS (1)..(888)

SEQ ID NO: 88188 - protein, 295 aa, Bacillus licheniformis DSM 13; identical to SEQ ID NO: 72556

SEQ ID NO: 88189 - DNA, 903 bp, Bacillus licheniformis DSM 13; identical to SEQ ID NO: 72557
  CDS (1)..(903)

SEQ ID NO: 88190 - protein, 300 aa, Bacillus licheniformis DSM 13; identical to SEQ ID NO: 72558

SEQ ID NO: 88191 - DNA, 897 bp, Mannheimia succiniciproducens MBEL55E; identical to SEQ ID NO: 72559
  CDS (1)..(897)

SEQ ID NO: 88192 - protein, 298 aa, Mannheimia succiniciproducens MBEL55E; identical to SEQ ID NO: 72560

SEQ ID NO: 88193 - DNA, 879 bp, Mannheimia succiniciproducens MBEL55E; identical to SEQ ID NO: 72561
  CDS (1)..(879)

SEQ ID NO: 88194 - protein, 292 aa, Mannheimia succiniciproducens MBEL55E; identical to SEQ ID NO: 72562

SEQ ID NO: 88195 - DNA, 882 bp, Symbiobacterium thermophilum; identical to SEQ ID NO: 72563
  CDS (1)..(882)

SEQ ID NO: 88196 - protein, 293 aa, Symbiobacterium thermophilum; identical to SEQ ID NO: 72564

SEQ ID NO: 88197 - DNA, 921 bp, Propionibacterium acnes; identical to SEQ ID NO: 72565
  CDS (1)..(921)

SEQ ID NO: 88198 - protein, 306 aa, Propionibacterium acnes; identical to SEQ ID NO: 72566

SEQ ID NO: 88199 - DNA, 882 bp, Propionibacterium acnes; identical to SEQ ID NO: 72567
  CDS (1)..(882)

SEQ ID NO: 88200 - protein, 293 aa, Propionibacterium acnes; identical to SEQ ID NO: 72568

SEQ ID NO: 88201 - DNA, 894 bp, Desulfotalea psychrophila; identical to SEQ ID NO: 72569
  CDS (1)..(894)

SEQ ID NO: 88202 - protein, 297 aa, Desulfotalea psychrophila; identical to SEQ ID NO: 72570

SEQ ID NO: 88203 - DNA, 888 bp, Debaryomyces hansenii CBS767; identical to SEQ ID NO: 72571
  CDS (1)..(888)

SEQ ID NO: 88204 - protein, 295 aa, Debaryomyces hansenii CBS767; identical to SEQ ID NO: 72572

SEQ ID NO: 88205 - DNA, 885 bp, Erwinia carotovora; identical to SEQ ID NO: 72573
  CDS (1)..(885)

SEQ ID NO: 88206 - protein, 294 aa, Erwinia carotovora; identical to SEQ ID NO: 72574

SEQ ID NO: 88207 - DNA, 885 bp, Erwinia carotovora; identical to SEQ ID NO: 72575
  CDS (1)..(885)

SEQ ID NO: 88208 - protein, 294 aa, Erwinia carotovora; identical to SEQ ID NO: 72576

SEQ ID NO: 88209 - DNA, 879 bp, Erwinia carotovora; identical to SEQ ID NO: 72577
  CDS (1)..(879)

SEQ ID NO: 88210 - protein, 292 aa, Erwinia carotovora; identical to SEQ ID NO: 72578

SEQ ID NO: 88211 - DNA, 918 bp, Erwinia carotovora; identical to SEQ ID NO: 72579
  CDS (1)..(918)

SEQ ID NO: 88212 - protein, 305 aa, Erwinia carotovora; identical to SEQ ID NO: 72580

SEQ ID NO: 88213 - DNA, 963 bp, Acinetobacter sp; identical to SEQ ID NO: 72581
  CDS (1)..(963)

SEQ ID NO: 88214 - protein, 320 aa, Acinetobacter sp; identical to SEQ ID NO: 72582

SEQ ID NO: 88215 - DNA, 885 bp, Bartonella quintana; identical to SEQ ID NO: 72583
  CDS (1)..(885)

SEQ ID NO: 88216 - protein, 294 aa, Bartonella quintana; identical to SEQ ID NO: 72584

SEQ ID NO: 88217 - DNA, 885 bp, Bartonella henselae; identical to SEQ ID NO: 72585
  CDS (1)..(885)

SEQ ID NO: 88218 - protein, 294 aa, Bartonella henselae; identical to SEQ ID NO: 72586

SEQ ID NO: 88219 - DNA, 888 bp, Staphylococcus aureus; identical to SEQ ID NO: 72587
  CDS (1)..(888)

SEQ ID NO: 88220 - protein, 295 aa, Staphylococcus aureus; identical to SEQ ID NO: 72588

SEQ ID NO: 88221 - DNA, 897 bp, Bacillus thuringiensis; identical to SEQ ID NO: 72589
  CDS (1)..(897)

SEQ ID NO: 88222 - protein, 298 aa, Bacillus thuringiensis; identical to SEQ ID NO: 72590

SEQ ID NO: 88223 - DNA, 888 bp, Photobacterium profundum; identical to SEQ ID NO: 72591
  CDS (1)..(888)

SEQ ID NO: 88224 - protein, 295 aa, Photobacterium profundum; identical to SEQ ID NO: 72592

SEQ ID NO: 88225 - DNA, 870 bp, Methanococcus maripaludis; identical to SEQ ID NO: 72593
  CDS (1)..(870)

SEQ ID NO: 88226 - protein, 289 aa, Methanococcus maripaludis; identical to SEQ ID NO: 72594

SEQ ID NO: 88227 - DNA, 903 bp, Parachlamydia sp; identical to SEQ ID NO: 72595
  CDS (1)..(903)

SEQ ID NO: 88228 - protein, 300 aa, Parachlamydia sp; identical to SEQ ID NO: 72596

SEQ ID NO: 88229 - DNA, 882 bp, Bdellovibrio bacteriovorus; identical to SEQ ID NO: 72597
  CDS (1)..(882)

SEQ ID NO: 88230 - protein, 293 aa, Bdellovibrio bacteriovorus; identical to SEQ ID NO: 72598

SEQ ID NO: 88231 - DNA, 924 bp, Rhodopseudomonas palustris; identical to SEQ ID NO: 72599
  CDS (1)..(924)

SEQ ID NO: 88232 - protein, 307 aa, Rhodopseudomonas palustris; identical to SEQ ID NO: 72600

SEQ ID NO: 88233 - DNA, 894 bp, Rhodopseudomonas palustris; identical to SEQ ID NO: 72601
  CDS (1)..(894)

SEQ ID NO: 88234 - protein, 297 aa, Rhodopseudomonas palustris; identical to SEQ ID NO: 72602

SEQ ID NO: 88235 - DNA, 879 bp, Rhodopseudomonas palustris; identical to SEQ ID NO: 72603
  CDS (1)..(879)

SEQ ID NO: 88236 - protein, 292 aa, Rhodopseudomonas palustris; identical to SEQ ID NO: 72604

SEQ ID NO: 88237 - DNA, 918 bp, Rhodopseudomonas palustris; identical to SEQ ID NO: 72605
  CDS (1)..(918)

SEQ ID NO: 88238 - protein, 305 aa, Rhodopseudomonas palustris; identical to SEQ ID NO: 72606

SEQ ID NO: 88239 - DNA, 906 bp, Corynebacterium diphtheriae; identical to SEQ ID NO: 72607
  CDS (1)..(906)

SEQ ID NO: 88240 - protein, 301 aa, Corynebacterium diphtheriae; identical to SEQ ID NO: 72608

SEQ ID NO: 88241 - DNA, 921 bp, Corynebacterium diphtheriae; identical to SEQ ID NO: 72609
  CDS (1)..(921)

SEQ ID NO: 88242 - protein, 306 aa, Corynebacterium diphtheriae; identical to SEQ ID NO: 72610

SEQ ID NO: 88243 - DNA, 1370 bp, Brachydanio rerio; identical to SEQ ID NO: 72611
  CDS (170)..(1144)

SEQ ID NO: 88244 - protein, 324 aa, Brachydanio rerio; identical to SEQ ID NO: 72612

SEQ ID NO: 88245 - DNA, 882 bp, Listeria monocytogenes; identical to SEQ ID NO: 72613
  CDS (1)..(882)

SEQ ID NO: 88246 - protein, 293 aa, Listeria monocytogenes; identical to SEQ ID NO: 72614

SEQ ID NO: 88247 - DNA, 879 bp, Desulfovibrio vulgaris; identical to SEQ ID NO: 72615
  CDS (1)..(879)

SEQ ID NO: 88248 - protein, 292 aa, Desulfovibrio vulgaris; identical to SEQ ID NO: 72616

SEQ ID NO: 88249 - DNA, 900 bp, Thermus thermophilus; identical to SEQ ID NO: 72617
  CDS (1)..(900)

SEQ ID NO: 88250 - protein, 299 aa, Thermus thermophilus; identical to SEQ ID NO: 72618

SEQ ID NO: 88251 - DNA, 897 bp, Bacillus cereus; identical to SEQ ID NO: 72619
  CDS (1)..(897)

SEQ ID NO: 88252 - protein, 298 aa, Bacillus cereus; identical to SEQ ID NO: 72620

SEQ ID NO: 88253 - DNA, 882 bp, Wolbachia pipientis wMel; identical to SEQ ID NO: 72621
  CDS (1)..(882)

SEQ ID NO: 88254 - protein, 293 aa, Wolbachia pipientis wMel; identical to SEQ ID NO: 72622

SEQ ID NO: 88255 - DNA, 903 bp, Mycobacterium paratuberculosis; identical to SEQ ID NO: 72623
  CDS (1)..(903)

SEQ ID NO: 88256 - protein, 300 aa, Mycobacterium paratuberculosis; identical to SEQ ID NO: 72624

SEQ ID NO: 88257 - DNA, 876 bp, Mycobacterium paratuberculosis; identical to SEQ ID NO: 72625
  CDS (1)..(876)

SEQ ID NO: 88258 - protein, 291 aa, Mycobacterium paratuberculosis; identical to SEQ ID NO: 72626

SEQ ID NO: 88259 - DNA, 873 bp, Geobacter sulfurreducens; identical to SEQ ID NO: 72627
  CDS (1)..(873)

SEQ ID NO: 88260 - protein, 290 aa, Geobacter sulfurreducens; identical to SEQ ID NO: 72628

SEQ ID NO: 88261 - DNA, 1500 bp, Methylophilus methylotrophus; identical to SEQ ID NO: 72629
  CDS (214)..(1104)

SEQ ID NO: 88262 - protein, 296 aa, Methylophilus methylotrophus; identical to SEQ ID NO: 72630

SEQ ID NO: 88263 - DNA, 897 bp, Agrobacterium tumefaciens; identical to SEQ ID NO: 72631
  CDS (1)..(897)

SEQ ID NO: 88264 - protein, 298 aa, Agrobacterium tumefaciens; identical to SEQ ID NO: 72632

SEQ ID NO: 88265 - DNA, 888 bp, Wolinella succinogenes; identical to SEQ ID NO: 72633
  CDS (1)..(888)

SEQ ID NO: 88266 - protein, 295 aa, Wolinella succinogenes; identical to SEQ ID NO: 72634

SEQ ID NO: 88267 - DNA, 894 bp, Vibrio vulnificus; identical to SEQ ID NO: 72635
  CDS (1)..(894)

SEQ ID NO: 88268 - protein, 297 aa, Vibrio vulnificus; identical to SEQ ID NO: 72636

SEQ ID NO: 88269 - DNA, 870 bp, Porphyromonas gingivalis; identical to SEQ ID NO: 72637
  CDS (1)..(870)

SEQ ID NO: 88270 - protein, 289 aa, Porphyromonas gingivalis; identical to SEQ ID NO: 72638

SEQ ID NO: 88271 - DNA, 900 bp, Photorhabdus luminescens; identical to SEQ ID NO: 72639
  CDS (1)..(900)

SEQ ID NO: 88272 - protein, 299 aa, Photorhabdus luminescens; identical to SEQ ID NO: 72640

SEQ ID NO: 88273 - DNA, 921 bp, Photorhabdus luminescens; identical to SEQ ID NO: 72641
  CDS (1)..(921)

SEQ ID NO: 88274 - protein, 306 aa, Photorhabdus luminescens; identical to SEQ ID NO: 72642

SEQ ID NO: 88275 - DNA, 882 bp, Gloeobacter violaceus; identical to SEQ ID NO: 72643
  CDS (1)..(882)

SEQ ID NO: 88276 - protein, 293 aa, Gloeobacter violaceus; identical to SEQ ID NO: 72644

SEQ ID NO: 88277 - DNA, 876 bp, Chromobacterium violaceum; identical to SEQ ID NO: 72645
  CDS (1)..(876)

SEQ ID NO: 88278 - protein, 291 aa, Chromobacterium violaceum; identical to SEQ ID NO: 72646

SEQ ID NO: 88279 - DNA, 903 bp, Chromobacterium violaceum; identical to SEQ ID NO: 72647
  CDS (1)..(903)

SEQ ID NO: 88280 - protein, 300 aa, Chromobacterium violaceum; identical to SEQ ID NO: 72648

SEQ ID NO: 88281 - DNA, 909 bp, Synechococcus sp; identical to SEQ ID NO: 72649
  CDS (1)..(909)

SEQ ID NO: 88282 - protein, 302 aa, Synechococcus sp; identical to SEQ ID NO: 72650

SEQ ID NO: 88283 - DNA, 960 bp, Rhodopirellula baltica; identical to SEQ ID NO: 72651
  CDS (1)..(960)

SEQ ID NO: 88284 - protein, 319 aa, Rhodopirellula baltica; identical to SEQ ID NO: 72652

SEQ ID NO: 88285 - DNA, 984 bp, Rhodopirellula baltica; identical to SEQ ID NO: 72653
  CDS (1)..(984)

SEQ ID NO: 88286 - protein, 327 aa, Rhodopirellula baltica; identical to SEQ ID NO: 72654

SEQ ID NO: 88287 - DNA, 945 bp, Rhodopirellula baltica; identical to SEQ ID NO: 72655
  CDS (1)..(945)

SEQ ID NO: 88288 - protein, 314 aa, Rhodopirellula baltica; identical to SEQ ID NO: 72656

SEQ ID NO: 88289 - DNA, 909 bp, Prochlorococcus marinus subsp; identical to SEQ ID NO: 72657
  CDS (1)..(909)

SEQ ID NO: 88290 - protein, 302 aa, Prochlorococcus marinus subsp; identical to SEQ ID NO: 72658

SEQ ID NO: 88291 - DNA, 909 bp, Prochlorococcus marinus; identical to SEQ ID NO: 72659
  CDS (1)..(909)

SEQ ID NO: 88292 - protein, 302 aa, Prochlorococcus marinus; identical to SEQ ID NO: 72660

SEQ ID NO: 88293 - DNA, 882 bp, Helicobacter hepaticus; identical to SEQ ID NO: 72661
  CDS (1)..(882)

SEQ ID NO: 88294 - protein, 293 aa, Helicobacter hepaticus; identical to SEQ ID NO: 72662

SEQ ID NO: 88295 - DNA, 894 bp, Haemophilus ducreyi; identical to SEQ ID NO: 72663
  CDS (1)..(894)

SEQ ID NO: 88296 - protein, 297 aa, Haemophilus ducreyi; identical to SEQ ID NO: 72664

SEQ ID NO: 88297 - DNA, 879 bp, Candidatus Blochmannia floridanus; identical to SEQ ID NO: 72665
  CDS (1)..(879)

SEQ ID NO: 88298 - protein, 292 aa, Candidatus Blochmannia floridanus; identical to SEQ ID NO: 72666

SEQ ID NO: 88299 - DNA, 879 bp, Bordetella pertussis; identical to SEQ ID NO: 72667
  CDS (1)..(879)

SEQ ID NO: 88300 - protein, 292 aa, Bordetella pertussis; identical to SEQ ID NO: 72668

SEQ ID NO: 88301 - DNA, 891 bp, Bordetella parapertussis; identical to SEQ ID NO: 72669
  CDS (1)..(891)

SEQ ID NO: 88302 - protein, 296 aa, Bordetella parapertussis; identical to SEQ ID NO: 72670

SEQ ID NO: 88303 - DNA, 900 bp, Bordetella parapertussis; identical to SEQ ID NO: 72671
  CDS (1)..(900)

SEQ ID NO: 88304 - protein, 299 aa, Bordetella parapertussis; identical to SEQ ID NO: 72672

SEQ ID NO: 88305 - DNA, 906 bp, Bordetella bronchiseptica; identical to SEQ ID NO: 72673
  CDS (1)..(906)

SEQ ID NO: 88306 - protein, 301 aa, Bordetella bronchiseptica; identical to SEQ ID NO: 72674

SEQ ID NO: 88307 - DNA, 900 bp, Bordetella bronchiseptica; identical to SEQ ID NO: 72675
  CDS (1)..(900)

SEQ ID NO: 88308 - protein, 299 aa, Bordetella bronchiseptica; identical to SEQ ID NO: 72676

SEQ ID NO: 88309 - DNA, 885 bp, Escherichia coli; identical to SEQ ID NO: 72677
  CDS (1)..(885)

SEQ ID NO: 88310 - protein, 294 aa, Escherichia coli; identical to SEQ ID NO: 72678

SEQ ID NO: 88311 - DNA, 1062 bp, Oryza sativa; identical to SEQ ID NO: 72679
  CDS (1)..(1062)

SEQ ID NO: 88312 - protein, 353 aa, Oryza sativa; identical to SEQ ID NO: 72680

SEQ ID NO: 88313 - DNA, 822 bp, Oryza sativa; identical to SEQ ID NO: 72681
  CDS (1)..(822)

SEQ ID NO: 88314 - protein, 273 aa, Oryza sativa; identical to SEQ ID NO: 72682

SEQ ID NO: 88315 - DNA, 879 bp, Bacillus cereus; identical to SEQ ID NO: 72683
  CDS (1)..(879)

SEQ ID NO: 88316 - protein, 292 aa, Bacillus cereus; identical to SEQ ID NO: 72684

SEQ ID NO: 88317 - DNA, 897 bp, Bacillus cereus; identical to SEQ ID NO: 72685
  CDS (1)..(897)

SEQ ID NO: 88318 - protein, 298 aa, Bacillus cereus; identical to SEQ ID NO: 72686

SEQ ID NO: 88319 - DNA, 897 bp, Bacillus anthracis; identical to SEQ ID NO: 72687
  CDS (1)..(897)

SEQ ID NO: 88320 - protein, 298 aa, Bacillus anthracis; identical to SEQ ID NO: 72688

SEQ ID NO: 88321 - DNA, 948 bp, Streptomyces avermitilis; identical to SEQ ID NO: 72689
  CDS (1)..(948)

SEQ ID NO: 88322 - protein, 315 aa, Streptomyces avermitilis; identical to SEQ ID NO: 72690

SEQ ID NO: 88323 - DNA, 900 bp, Streptomyces avermitilis; identical to SEQ ID NO: 72691
  CDS (1)..(900)

SEQ ID NO: 88324 - protein, 299 aa, Streptomyces avermitilis; identical to SEQ ID NO: 72692

SEQ ID NO: 88325 - DNA, 879 bp, Nitrosomonas europaea; identical to SEQ ID NO: 72693
  CDS (1)..(879)

SEQ ID NO: 88326 - protein, 292 aa, Nitrosomonas europaea; identical to SEQ ID NO: 72694

SEQ ID NO: 88327 - DNA, 906 bp, Enterococcus faecalis; identical to SEQ ID NO: 72695
  CDS (34)..(906)

SEQ ID NO: 88328 - protein, 290 aa, Enterococcus faecalis; identical to SEQ ID NO: 72696

SEQ ID NO: 88329 - DNA, 870 bp, Coxiella burnetii; identical to SEQ ID NO: 72697
  CDS (1)..(870)

SEQ ID NO: 88330 - protein, 289 aa, Coxiella burnetii; identical to SEQ ID NO: 72698

SEQ ID NO: 88331 - DNA, 921 bp, Streptomyces cinnamonensis; identical to SEQ ID NO: 72699
  CDS (1)..(921)

SEQ ID NO: 88332 - protein, 306 aa, Streptomyces cinnamonensis; identical to SEQ ID NO: 72700

SEQ ID NO: 88333 - DNA, 879 bp, Vibrio parahaemolyticus; identical to SEQ ID NO: 72701
  CDS (1)..(879)

SEQ ID NO: 88334 - protein, 292 aa, Vibrio parahaemolyticus; identical to SEQ ID NO: 72702

SEQ ID NO: 88335 - DNA, 915 bp, Vibrio parahaemolyticus; identical to SEQ ID NO: 72703
  CDS (1)..(915)

SEQ ID NO: 88336 - protein, 304 aa, Vibrio parahaemolyticus; identical to SEQ ID NO: 72704

SEQ ID NO: 88337 - DNA, 867 bp, Pseudomonas putida; identical to SEQ ID NO: 72705
  CDS (1)..(867)

SEQ ID NO: 88338 - protein, 288 aa, Pseudomonas putida; identical to SEQ ID NO: 72706

SEQ ID NO: 88339 - DNA, 870 bp, Lactobacillus plantarum; identical to SEQ ID NO: 72707
  CDS (1)..(870)

SEQ ID NO: 88340 - protein, 289 aa, Lactobacillus plantarum; identical to SEQ ID NO: 72708

SEQ ID NO: 88341 - DNA, 873 bp, Lactobacillus plantarum; identical to SEQ ID NO: 72709
  CDS (1)..(873)

SEQ ID NO: 88342 - protein, 290 aa, Lactobacillus plantarum; identical to SEQ ID NO: 72710

SEQ ID NO: 88343 - DNA, 885 bp, Clostridium tetani; identical to SEQ ID NO: 72711
  CDS (1)..(885)

SEQ ID NO: 88344 - protein, 294 aa, Clostridium tetani; identical to SEQ ID NO: 72712

SEQ ID NO: 88345 - DNA, 951 bp, Bradyrhizobium japonicum; identical to SEQ ID NO: 72713
  CDS (1)..(951)

SEQ ID NO: 88346 - protein, 316 aa, Bradyrhizobium japonicum; identical to SEQ ID NO: 72714

SEQ ID NO: 88347 - DNA, 876 bp, Bradyrhizobium japonicum; identical to SEQ ID NO: 72715
  CDS (1)..(876)

SEQ ID NO: 88348 - protein, 291 aa, Bradyrhizobium japonicum; identical to SEQ ID NO: 72716

SEQ ID NO: 88349 - DNA, 918 bp, Bradyrhizobium japonicum; identical to SEQ ID NO: 72717
  CDS (1)..(918)

SEQ ID NO: 88350 - protein, 305 aa, Bradyrhizobium japonicum; identical to SEQ ID NO: 72718

SEQ ID NO: 88351 - DNA, 927 bp, Bradyrhizobium japonicum; identical to SEQ ID NO: 72719
  CDS (1)..(927)

SEQ ID NO: 88352 - protein, 308 aa, Bradyrhizobium japonicum; identical to SEQ ID NO: 72720

SEQ ID NO: 88353 - DNA, 906 bp, Bradyrhizobium japonicum; identical to SEQ ID NO: 72721
  CDS (1)..(906)

SEQ ID NO: 88354 - protein, 301 aa, Bradyrhizobium japonicum; identical to SEQ ID NO: 72722

SEQ ID NO: 88355 - DNA, 930 bp, Bacteroides thetaiotaomicron; identical to SEQ ID NO: 72723
  CDS (1)..(930)

SEQ ID NO: 88356 - protein, 309 aa, Bacteroides thetaiotaomicron; identical to SEQ ID NO: 72724

SEQ ID NO: 88357 - DNA, 894 bp, Bacteroides thetaiotaomicron; identical to SEQ ID NO: 72725
  CDS (1)..(894)

SEQ ID NO: 88358 - protein, 297 aa, Bacteroides thetaiotaomicron; identical to SEQ ID NO: 72726

SEQ ID NO: 88359 - DNA, 927 bp, Oceanobacillus iheyensis; identical to SEQ ID NO: 72727
  CDS (1)..(927)

SEQ ID NO: 88360 - protein, 308 aa, Oceanobacillus iheyensis; identical to SEQ ID NO: 72728

SEQ ID NO: 88361 - DNA, 888 bp, Escherichia coli O6; identical to SEQ ID NO: 72729
  CDS (1)..(888)

SEQ ID NO: 88362 - protein, 295 aa, Escherichia coli O6; identical to SEQ ID NO: 72730

SEQ ID NO: 88363 - DNA, 918 bp, Brucella suis; identical to SEQ ID NO: 72731
  CDS (1)..(918)

SEQ ID NO: 88364 - protein, 305 aa, Brucella suis; identical to SEQ ID NO: 72732

SEQ ID NO: 88365 - DNA, 953 bp, Phytophthora infestans; identical to SEQ ID NO: 72733
  CDS (1)..(879)

SEQ ID NO: 88366 - protein, 292 aa, Phytophthora infestans; identical to SEQ ID NO: 72734

SEQ ID NO: 88367 - DNA, 1059 bp, Corynebacterium glutamicum; identical to SEQ ID NO: 72735
  CDS (101)..(1039)

SEQ ID NO: 88368 - protein, 312 aa, Corynebacterium glutamicum; identical to SEQ ID NO: 72736

SEQ ID NO: 88369 - DNA, 909 bp, Xanthomonas campestris; identical to SEQ ID NO: 72737
  CDS (1)..(909)

SEQ ID NO: 88370 - protein, 302 aa, Xanthomonas campestris; identical to SEQ ID NO: 72738

SEQ ID NO: 88371 - DNA, 909 bp, Xanthomonas axonopodis; identical to SEQ ID NO: 72739
  CDS (1)..(909)

SEQ ID NO: 88372 - protein, 302 aa, Xanthomonas axonopodis; identical to SEQ ID NO: 72740

SEQ ID NO: 88373 - DNA, 933 bp, Desulfobacula toluolica; identical to SEQ ID NO: 72741
  CDS (1)..(933)

SEQ ID NO: 88374 - protein, 310 aa, Desulfobacula toluolica; identical to SEQ ID NO: 72742

SEQ ID NO: 88375 - DNA, 897 bp, Pyrococcus furiosus; identical to SEQ ID NO: 72743
  CDS (1)..(897)

SEQ ID NO: 88376 - protein, 298 aa, Pyrococcus furiosus; identical to SEQ ID NO: 72744

SEQ ID NO: 88377 - DNA, 906 bp, Salmonella typhimurium; identical to SEQ ID NO: 72745
  CDS (1)..(906)

SEQ ID NO: 88378 - protein, 301 aa, Salmonella typhimurium; identical to SEQ ID NO: 72746

SEQ ID NO: 88379 - DNA, 906 bp, Pyrobaculum aerophilum; identical to SEQ ID NO: 72747
  CDS (1)..(906)

SEQ ID NO: 88380 - protein, 301 aa, Pyrobaculum aerophilum; identical to SEQ ID NO: 72748

SEQ ID NO: 88381 - DNA, 1201 bp, Yersinia enterocolitica; identical to SEQ ID NO: 72749
  CDS (278)..(1159)

SEQ ID NO: 88382 - protein, 293 aa, Yersinia enterocolitica; identical to SEQ ID NO: 72750

SEQ ID NO: 88383 - DNA, 1726 bp, Methylobacillus glycogenes; identical to SEQ ID NO: 72751
  CDS (472)..(1344)

SEQ ID NO: 88384 - protein, 290 aa, Methylobacillus glycogenes; identical to SEQ ID NO: 72752

SEQ ID NO: 88385 - DNA, 882 bp, Thermococcus litoralis; identical to SEQ ID NO: 72753
  CDS (1)..(882)

SEQ ID NO: 88386 - protein, 293 aa, Thermococcus litoralis; identical to SEQ ID NO: 72754

SEQ ID NO: 88387 - DNA, 891 bp, Rhizobium loti; identical to SEQ ID NO: 72755
  CDS (1)..(891)

SEQ ID NO: 88388 - protein, 296 aa, Rhizobium loti; identical to SEQ ID NO: 72756

SEQ ID NO: 88389 - DNA, 1044 bp, Oryza sativa; identical to SEQ ID NO: 72757
  CDS (1)..(1044)

SEQ ID NO: 88390 - protein, 347 aa, Oryza sativa; identical to SEQ ID NO: 72758

SEQ ID NO: 88391 - DNA, 891 bp, Bradyrhizobium japonicum; identical to SEQ ID NO: 72759
  CDS (1)..(891)

SEQ ID NO: 88392 - protein, 296 aa, Bradyrhizobium japonicum; identical to SEQ ID NO: 72760

SEQ ID NO: 88393 - DNA, 885 bp, Buchnera aphidicola; identical to SEQ ID NO: 72761
  CDS (1)..(885)

SEQ ID NO: 88394 - protein, 294 aa, Buchnera aphidicola; identical to SEQ ID NO: 72762

SEQ ID NO: 88395 - DNA, 885 bp, Buchnera aphidicola; identical to SEQ ID NO: 72763
  CDS (1)..(885)

SEQ ID NO: 88396 - protein, 294 aa, Buchnera aphidicola; identical to SEQ ID NO: 72764

SEQ ID NO: 88397 - DNA, 891 bp, Chlorobium tepidum; identical to SEQ ID NO: 72765
  CDS (1)..(891)

SEQ ID NO: 88398 - protein, 296 aa, Chlorobium tepidum; identical to SEQ ID NO: 72766

SEQ ID NO: 88399 - DNA, 876 bp, Clostridium perfringens; identical to SEQ ID NO: 72767
  CDS (1)..(876)

SEQ ID NO: 88400 - protein, 291 aa, Clostridium perfringens; identical to SEQ ID NO: 72768

SEQ ID NO: 88401 - DNA, 1134 bp, Coix lachryma; identical to SEQ ID NO: 72769
  CDS (1)..(1134)

SEQ ID NO: 88402 - protein, 377 aa, Coix lachryma; identical to SEQ ID NO: 72770

SEQ ID NO: 88403 - DNA, 906 bp, Corynebacterium efficiens; identical to SEQ ID NO: 72771
  CDS (1)..(906)

SEQ ID NO: 88404 - protein, 301 aa, Corynebacterium efficiens; identical to SEQ ID NO: 72772

SEQ ID NO: 88405 - DNA, 924 bp, Leptospira interrogans; identical to SEQ ID NO: 72773
  CDS (1)..(924)

SEQ ID NO: 88406 - protein, 307 aa, Leptospira interrogans; identical to SEQ ID NO: 72774

SEQ ID NO: 88407 - DNA, 903 bp, Methanopyrus kandleri; identical to SEQ ID NO: 72775
  CDS (1)..(903)

SEQ ID NO: 88408 - protein, 300 aa, Methanopyrus kandleri; identical to SEQ ID NO: 72776

SEQ ID NO: 88409 - DNA, 876 bp, Methanosarcina mazei; identical to SEQ ID NO: 72777
  CDS (1)..(876)

SEQ ID NO: 88410 - protein, 291 aa, Methanosarcina mazei; identical to SEQ ID NO: 72778

SEQ ID NO: 88411 - DNA, 888 bp, Oceanobacillus iheyensis; identical to SEQ ID NO: 72779
  CDS (1)..(888)

SEQ ID NO: 88412 - protein, 295 aa, Oceanobacillus iheyensis; identical to SEQ ID NO: 72780

SEQ ID NO: 88413 - DNA, 897 bp, Pasteurella multocida; identical to SEQ ID NO: 72781
  CDS (1)..(897)

SEQ ID NO: 88414 - protein, 298 aa, Pasteurella multocida; identical to SEQ ID NO: 72782

SEQ ID NO: 88415 - DNA, 909 bp, Prochlorococcus marinus; identical to SEQ ID NO: 72783
  CDS (1)..(909)

SEQ ID NO: 88416 - protein, 302 aa, Prochlorococcus marinus; identical to SEQ ID NO: 72784

SEQ ID NO: 88417 - DNA, 885 bp, Ralstonia solanacearum; identical to SEQ ID NO: 72785
  CDS (1)..(885)

SEQ ID NO: 88418 - protein, 294 aa, Ralstonia solanacearum; identical to SEQ ID NO: 72786

SEQ ID NO: 88419 - DNA, 882 bp, Rhizobium loti; identical to SEQ ID NO: 72787
  CDS (1)..(882)

SEQ ID NO: 88420 - protein, 293 aa, Rhizobium loti; identical to SEQ ID NO: 72788

SEQ ID NO: 88421 - DNA, 885 bp, Rickettsia montana; identical to SEQ ID NO: 72789
  CDS (1)..(885)

SEQ ID NO: 88422 - protein, 294 aa, Rickettsia montana; identical to SEQ ID NO: 72790

SEQ ID NO: 88423 - DNA, 885 bp, Rickettsia typhi; identical to SEQ ID NO: 72791
  CDS (1)..(885)

SEQ ID NO: 88424 - protein, 294 aa, Rickettsia typhi; identical to SEQ ID NO: 72792

SEQ ID NO: 88425 - DNA, 885 bp, Shewanella oneidensis; identical to SEQ ID NO: 72793
  CDS (1)..(885)

SEQ ID NO: 88426 - protein, 294 aa, Shewanella oneidensis; identical to SEQ ID NO: 72794

SEQ ID NO: 88427 - DNA, 888 bp, Staphylococcus aureus; identical to SEQ ID NO: 72795
  CDS (1)..(888)

SEQ ID NO: 88428 - protein, 295 aa, Staphylococcus aureus; identical to SEQ ID NO: 72796

SEQ ID NO: 88429 - DNA, 882 bp, Streptococcus mutans; identical to SEQ ID NO: 72797
  CDS (1)..(882)

SEQ ID NO: 88430 - protein, 293 aa, Streptococcus mutans; identical to SEQ ID NO: 72798

SEQ ID NO: 88431 - DNA, 891 bp, Synechococcus elongatus; identical to SEQ ID NO: 72799
  CDS (1)..(891)

SEQ ID NO: 88432 - protein, 296 aa, Synechococcus elongatus; identical to SEQ ID NO: 72800

SEQ ID NO: 88433 - DNA, 894 bp, Thermoanaerobacter tengcongensis; identical to SEQ ID NO: 72801
  CDS (1)..(894)

SEQ ID NO: 88434 - protein, 297 aa, Thermoanaerobacter tengcongensis; identical to SEQ ID NO: 72802

SEQ ID NO: 88435 - DNA, 897 bp, Wigglesworthia glossinidia brevipalpis; identical to SEQ ID NO: 72803
  CDS (1)..(897)

SEQ ID NO: 88436 - protein, 298 aa, Wigglesworthia glossinidia brevipalpis; identical to SEQ ID NO: 72804

SEQ ID NO: 88437 - DNA, 909 bp, Xanthomonas campestris; identical to SEQ ID NO: 72805
  CDS (1)..(909)

SEQ ID NO: 88438 - protein, 302 aa, Xanthomonas campestris; identical to SEQ ID NO: 72806

SEQ ID NO: 88439 - DNA, 909 bp, Xylella fastidiosa; identical to SEQ ID NO: 72807
  CDS (1)..(909)

SEQ ID NO: 88440 - protein, 302 aa, Xylella fastidiosa; identical to SEQ ID NO: 72808

SEQ ID NO: 88441 - DNA, 21 bp, Primer
atgttcacgggaagtattgtc

SEQ ID NO: 88442 - DNA, 24 bp, Primer
ttacagcaaaccggcatgcttaag

SEQ ID NO: 88443 - protein, 300 aa, consensus; identical to SEQ ID NO: 72811
  MISC_FEATURE (1)..(300): consensus for the disclosure of xaa see table XV

SEQ ID NO: 88444 - protein, 48 aa, consensus; identical to SEQ ID NO: 72812
  MISC_FEATURE (1)..(48): consensus for the disclosure of xaa see table XV

SEQ ID NO: 88445 - protein, 71 aa, consensus; identical to SEQ ID NO: 72813
  MISC_FEATURE (1)..(71): consensus for the disclosure of xaa see table XV

SEQ ID NO: 88446 - DNA, 1161 bp, Escherichia coli; identical to SEQ ID NO: 30820
  CDS (1)..(1161)

SEQ ID NO: 88447 - protein, 386 aa, Escherichia coli; identical to SEQ ID NO: 30821

SEQ ID NO: 88448 - DNA, 1863 bp, Archaeoglobus fulgidus DSM 4304; identical to SEQ ID NO: 30822
  CDS (1)..(1863): transl_table=11

SEQ ID NO: 88449 - protein, 620 aa, Archaeoglobus fulgidus DSM 4304; identical to SEQ ID NO: 30823

SEQ ID NO: 88450 - DNA, 1062 bp, Thermotoga maritima MSB8; identical to SEQ ID NO: 30824
  CDS (1)..(1062): transl_table=11

SEQ ID NO: 88451 - protein, 353 aa, Thermotoga maritima MSB8; identical to SEQ ID NO: 30825

SEQ ID NO: 88452 - DNA, 1176 bp, Vibrio cholerae O1 biovar eltor str. N16961; identical to SEQ ID NO: 30826
  CDS (1)..(1176): transl_table=11

SEQ ID NO: 88453 - protein, 391 aa, Vibrio cholerae O1 biovar eltor str. N16961; identical to SEQ ID NO: 30827

SEQ ID NO: 88454 - DNA, 1164 bp, Pasteurella multocida subsp. multocida str. Pm70; identical to SEQ ID NO: 30828
  CDS (1)..(1164): transl_table=11

SEQ ID NO: 88455 - protein, 387 aa, Pasteurella multocida subsp. multocida str. Pm70; identical to SEQ ID NO: 30829

SEQ ID NO: 88456 - DNA, 1098 bp, Pseudomonas aeruginosa PAO1; identical to SEQ ID NO: 30830
  CDS (1)..(1098): transl_table=11

SEQ ID NO: 88457 - protein, 365 aa, Pseudomonas aeruginosa PAO1; identical to SEQ ID NO: 30831

SEQ ID NO: 88458 - DNA, 1089 bp, Neisseria meningitidis MC58; identical to SEQ ID NO: 30832
  CDS (1)..(1089): transl_table=11

SEQ ID NO: 88459 - protein, 362 aa, Neisseria meningitidis MC58; identical to SEQ ID NO: 30833

SEQ ID NO: 88460 - DNA, 1074 bp, Campylobacter jejuni subsp. jejuni NCTC 11168; identical to SEQ ID NO: 30834
  CDS (1)..(1074): transl_table=11

SEQ ID NO: 88461 - protein, 357 aa, Campylobacter jejuni subsp. jejuni NCTC 11168; identical to SEQ ID NO: 30835

SEQ ID NO: 88462 - DNA, 1161 bp, Salmonella typhimurium LT2; identical to SEQ ID NO: 30836
  CDS (1)..(1161): transl_table=11

SEQ ID NO: 88463 - protein, 386 aa, Salmonella typhimurium LT2; identical to SEQ ID NO: 30837

SEQ ID NO: 88464 - DNA, 1116 bp, Ralstonia solanacearum GMI1000; identical to SEQ ID NO: 30838
  CDS (1)..(1116): transl_table=11

SEQ ID NO: 88465 - protein, 371 aa, Ralstonia solanacearum GMI1000; identical to SEQ ID NO: 30839

SEQ ID NO: 88466 - DNA, 1221 bp, Xanthomonas campestris pv. campestris str. ATCC 33913; identical to SEQ ID NO: 30840
  CDS (1)..(1221): transl_table=11

SEQ ID NO: 88467 - protein, 406 aa, Xanthomonas campestris pv. campestris str. ATCC 33913; identical to SEQ ID NO: 30841

SEQ ID NO: 88468 - DNA, 1209 bp, Xanthomonas axonopodis pv. citri str. 306; identical to SEQ ID NO: 30842
  CDS (1)..(1209): transl_table=11

SEQ ID NO: 88469 - protein, 402 aa, Xanthomonas axonopodis pv. citri str. 306; identical to SEQ ID NO: 30843

SEQ ID NO: 88470 - DNA, 1107 bp, Leptospira interrogans serovar Lai str. 56601; identical to SEQ ID NO: 30844
  CDS (1)..(1107): transl_table=11

SEQ ID NO: 88471 - protein, 368 aa, Leptospira interrogans serovar Lai str. 56601; identical to SEQ ID NO: 30845

SEQ ID NO: 88472 - DNA, 2016 bp, Shewanella oneidensis MR-1; identical to SEQ ID NO: 30846
  CDS (1)..(2016): transl_table=11

SEQ ID NO: 88473 - protein, 671 aa, Shewanella oneidensis MR-1; identical to SEQ ID NO: 30847

SEQ ID NO: 88474 - DNA, 1095 bp, Pseudomonas syringae pv. tomato str. DC3000; identical to SEQ ID NO: 30848
  CDS (1)..(1095): transl_table=11

SEQ ID NO: 88475 - protein, 364 aa, Pseudomonas syringae pv. tomato str. DC3000; identical to SEQ ID NO: 30849

SEQ ID NO: 88476 - DNA, 1179 bp, Vibrio parahaemolyticus RIMD 2210633; identical to SEQ ID NO: 30850
  CDS (1)..(1179): transl_table=11

SEQ ID NO: 88477 - protein, 392 aa, Vibrio parahaemolyticus RIMD 2210633; identical to SEQ ID NO: 30851

SEQ ID NO: 88478 - DNA, 1068 bp, Nitrosomonas europaea ATCC 19718; identical to SEQ ID NO: 30852
  CDS (1)..(1068): transl_table=11

SEQ ID NO: 88479 - protein, 355 aa, Nitrosomonas europaea ATCC 19718; identical to SEQ ID NO: 30853

SEQ ID NO: 88480 - DNA, 1098 bp, Helicobacter hepaticus ATCC 51449; identical to SEQ ID NO: 30854
  CDS (1)..(1098): transl_table=11

SEQ ID NO: 88481 - protein, 365 aa, Helicobacter hepaticus ATCC 51449; identical to SEQ ID NO: 30855

SEQ ID NO: 88482 - DNA, 1164 bp, Haemophilus ducreyi 35000HP; identical to SEQ ID NO: 30856
  CDS (1)..(1164): transl_table=11

SEQ ID NO: 88483 - protein, 387 aa, Haemophilus ducreyi 35000HP; identical to SEQ ID NO: 30857

SEQ ID NO: 88484 - DNA, 1086 bp, Bordetella bronchiseptica RB50; identical to SEQ ID NO: 30858
  CDS (1)..(1086): transl_table=11

SEQ ID NO: 88485 - protein, 361 aa, Bordetella bronchiseptica RB50; identical to SEQ ID NO: 30859

SEQ ID NO: 88486 - DNA, 1074 bp, Chromobacterium violaceum ATCC 12472; identical to SEQ ID NO: 30860
  CDS (1)..(1074): transl_table=11

SEQ ID NO: 88487 - protein, 357 aa, Chromobacterium violaceum ATCC 12472; identical to SEQ ID NO: 30861

SEQ ID NO: 88488 - DNA, 1068 bp, Wolinella succinogenes DSM 1740; identical to SEQ ID NO: 30862
  CDS (1)..(1068): transl_table=11

SEQ ID NO: 88489 - protein, 355 aa, Wolinella succinogenes DSM 1740; identical to SEQ ID NO: 30863

SEQ ID NO: 88490 - DNA, 1158 bp, Photorhabdus luminescens subsp. laumondii TTO1; identical to SEQ ID NO: 30864
  CDS (1)..(1158): transl_table=11

SEQ ID NO: 88491 - protein, 385 aa, Photorhabdus luminescens subsp. laumondii TTO1; identical to SEQ ID NO: 30865

SEQ ID NO: 88492 - DNA, 1077 bp, Geobacter sulfurreducens PCA; identical to SEQ ID NO: 30866
  CDS (1)..(1077): transl_table=11

SEQ ID NO: 88493 - protein, 358 aa, Geobacter sulfurreducens PCA; identical to SEQ ID NO: 30867

SEQ ID NO: 88494 - DNA, 1776 bp, Nanoarchaeum equitans Kin4-M; identical to SEQ ID NO: 30868
  CDS (1)..(1776): transl_table=11

SEQ ID NO: 88495 - protein, 591 aa, Nanoarchaeum equitans Kin4-M; identical to SEQ ID NO: 30869

SEQ ID NO: 88496 - DNA, 1158 bp, Yersinia pestis biovar Medievalis str. 91001; identical to SEQ ID NO: 30870
  CDS (1)..(1158): transl_table=11

SEQ ID NO: 88497 - protein, 385 aa, Yersinia pestis biovar Medievalis str. 91001; identical to SEQ ID NO: 30871

SEQ ID NO: 88498 - DNA, 1176 bp, Desulfovibrio vulgaris subsp. vulgaris str. Hildenborough; identical to SEQ ID NO: 30872
  CDS (1)..(1176): transl_table=11

SEQ ID NO: 88499 - protein, 391 aa, Desulfovibrio vulgaris subsp. vulgaris str. Hildenborough; identical to SEQ ID NO: 30873

SEQ ID NO: 88500 - DNA, 1110 bp, Acinetobacter sp. ADP1; identical to SEQ ID NO: 30874
  CDS (1)..(1110): transl_table=11

SEQ ID NO: 88501 - protein, 369 aa, Acinetobacter sp. ADP1; identical to SEQ ID NO: 30875

SEQ ID NO: 88502 - DNA, 1107 bp, Desulfotalea psychrophila LSv54; identical to SEQ ID NO: 30876
  CDS (1)..(1107): transl_table=11

SEQ ID NO: 88503 - protein, 368 aa, Desulfotalea psychrophila LSv54; identical to SEQ ID NO: 30877

SEQ ID NO: 88504 - DNA, 1161 bp, Mannheimia succiniciproducens MBEL55E; identical to SEQ ID NO: 30878
  CDS (1)..(1161): transl_table=11

SEQ ID NO: 88505 - protein, 386 aa, Mannheimia succiniciproducens MBEL55E; identical to SEQ ID NO: 30879

SEQ ID NO: 88506 - DNA, 1083 bp, Burkholderia mallei ATCC 23344; identical to SEQ ID NO: 30880
  CDS (1)..(1083): transl_table=11

SEQ ID NO: 88507 - protein, 360 aa, Burkholderia mallei ATCC 23344; identical to SEQ ID NO: 30881

SEQ ID NO: 88508 - DNA, 1089 bp, Methylococcus capsulatus str. Bath; identical to SEQ ID NO: 30882
  CDS (1)..(1089): transl_table=11

SEQ ID NO: 88509 - protein, 362 aa, Methylococcus capsulatus str. Bath; identical to SEQ ID NO: 30883

SEQ ID NO: 88510 - DNA, 1176 bp, Photobacterium profundum SS9; identical to SEQ ID NO: 30884
  CDS (1)..(1176): transl_table=11

SEQ ID NO: 88511 - protein, 391 aa, Photobacterium profundum SS9; identical to SEQ ID NO: 30885

SEQ ID NO: 88512 - DNA, 1125 bp, Xylella fastidiosa Ann-1; identical to SEQ ID NO: 30886
  CDS (1)..(1125)

SEQ ID NO: 88513 - protein, 374 aa, Xylella fastidiosa Ann-1; identical to SEQ ID NO: 30887

SEQ ID NO: 88514 - DNA, 1098 bp, Azotobacter vinelandii; identical to SEQ ID NO: 30888
  CDS (1)..(1098)

SEQ ID NO: 88515 - protein, 365 aa, Azotobacter vinelandii; identical to SEQ ID NO: 30889

SEQ ID NO: 88516 - DNA, 1158 bp, Haemophilus somnus 129PT; identical to SEQ ID NO: 30890
  CDS (1)..(1158)

SEQ ID NO: 88517 - protein, 385 aa, Haemophilus somnus 129PT; identical to SEQ ID NO: 30891

SEQ ID NO: 88518 - DNA, 1110 bp, Desulfovibrio desulfuricans G20; identical to SEQ ID NO: 30892
  CDS (1)..(1110)

SEQ ID NO: 88519 - protein, 369 aa, Desulfovibrio desulfuricans G20; identical to SEQ ID NO: 30893

SEQ ID NO: 88520 - DNA, 1158 bp, Actinobacillus pleuropneumoniae serovar 1 str. 4074; identical to SEQ ID NO: 30894
  CDS (1)..(1158)

SEQ ID NO: 88521 - protein, 385 aa, Actinobacillus pleuropneumoniae serovar 1 str. 4074; identical to SEQ ID NO: 30895

SEQ ID NO: 88522 - DNA, 1182 bp, Psychrobacter sp. 273-4; identical to SEQ ID NO: 30896
  CDS (1)..(1182)

SEQ ID NO: 88523 - protein, 393 aa, Psychrobacter sp. 273-4; identical to SEQ ID NO: 30897

SEQ ID NO: 88524 - DNA, 1092 bp, Dechloromonas aromatica RCB; identical to SEQ ID NO: 30898
  CDS (1)..(1092)

SEQ ID NO: 88525 - protein, 363 aa, Dechloromonas aromatica RCB; identical to SEQ ID NO: 30899

SEQ ID NO: 88526 - DNA, 1149 bp, Ralstonia eutropha JMP134; identical to SEQ ID NO: 30900
  CDS (1)..(1149)

SEQ ID NO: 88527 - protein, 382 aa, Ralstonia eutropha JMP134; identical to SEQ ID NO: 30901

SEQ ID NO: 88528 - DNA, 1068 bp, Methylobacillus flagellatus KT; identical to SEQ ID NO: 30902
  CDS (1)..(1068)

SEQ ID NO: 88529 - protein, 355 aa, Methylobacillus flagellatus KT; identical to SEQ ID NO: 30903

SEQ ID NO: 88530 - DNA, 1116 bp, Rubrobacter xylanophilus DSM 9941; identical to SEQ ID NO: 30904
  CDS (1)..(1116)

SEQ ID NO: 88531 - protein, 371 aa, Rubrobacter xylanophilus DSM 9941; identical to SEQ ID NO: 30905

SEQ ID NO: 88532 - DNA, 1083 bp, Burkholderia cepacia R1808; identical to SEQ ID NO: 30906
  CDS (1)..(1083)

SEQ ID NO: 88533 - protein, 360 aa, Burkholderia cepacia R1808; identical to SEQ ID NO: 30907

SEQ ID NO: 88534 - DNA, 1113 bp, Rubrivivax gelatinosus PM1; identical to SEQ ID NO: 30908
  CDS (1)..(1113)

SEQ ID NO: 88535 - protein, 370 aa, Rubrivivax gelatinosus PM1; identical to SEQ ID NO: 30909

SEQ ID NO: 88536 - DNA, 1095 bp, Pseudomonas fluorescens PfO-1; identical to SEQ ID NO: 30910
  CDS (1)..(1095)

SEQ ID NO: 88537 - protein, 364 aa, Pseudomonas fluorescens PfO-1; identical to SEQ ID NO: 30911

SEQ ID NO: 88538 - DNA, 1164 bp, Ralstonia metallidurans CH34; identical to SEQ ID NO: 30912
  CDS (1)..(1164)

SEQ ID NO: 88539 - protein, 387 aa, Ralstonia metallidurans CH34; identical to SEQ ID NO: 30913

SEQ ID NO: 88540 - DNA, 1107 bp, Magnetococcus sp. MC-1; identical to SEQ ID NO: 30914
  CDS (1)..(1107)

SEQ ID NO: 88541 - protein, 368 aa, Magnetococcus sp. MC-1; identical to SEQ ID NO: 30915

SEQ ID NO: 88542 - DNA, 1068 bp, Geobacter metallireducens GS-15; identical to SEQ ID NO: 30916
  CDS (1)..(1068)

SEQ ID NO: 88543 - protein, 355 aa, Geobacter metallireducens GS-15; identical to SEQ ID NO: 30917

SEQ ID NO: 88544 - DNA, 1122 bp, Microbulbifer degradans 2-40; identical to SEQ ID NO: 30918
  CDS (1)..(1122)

SEQ ID NO: 88545 - protein, 373 aa, Microbulbifer degradans 2-40; identical to SEQ ID NO: 30919

SEQ ID NO: 88546 - DNA, 1098 bp, Thiobacillus denitrificans ATCC 25259; identical to SEQ ID NO: 30920
  CDS (1)..(1098)

SEQ ID NO: 88547 - protein, 365 aa, Thiobacillus denitrificans ATCC 25259; identical to SEQ ID NO: 30921

SEQ ID NO: 88548 - DNA, 1083 bp, Polaromonas sp. JS666; identical to SEQ ID NO: 30922
  CDS (1)..(1083)

SEQ ID NO: 88549 - protein, 360 aa, Polaromonas sp. JS666; identical to SEQ ID NO: 30923

SEQ ID NO: 88550 - DNA, 1128 bp, Neisseria meningitidis; identical to SEQ ID NO: 30924
  CDS (1)..(1128): transl_table=11

SEQ ID NO: 88551 - protein, 375 aa, Neisseria meningitidis; identical to SEQ ID NO: 30925

SEQ ID NO: 88552 - DNA, 1089 bp, Aquifex aeolicus; identical to SEQ ID NO: 30926
  CDS (1)..(1089): transl_table=11

SEQ ID NO: 88553 - protein, 362 aa, Aquifex aeolicus; identical to SEQ ID NO: 30927

SEQ ID NO: 88554 - DNA, 1158 bp, Buchnera aphidicola; identical to SEQ ID NO: 30928
  CDS (1)..(1158): transl_table=11

SEQ ID NO: 88555 - protein, 385 aa, Buchnera aphidicola; identical to SEQ ID NO: 30929

SEQ ID NO: 88556 - DNA, 1158 bp, Buchnera aphidicola; identical to SEQ ID NO: 30930
  CDS (1)..(1158): transl_table=11

SEQ ID NO: 88557 - protein, 385 aa, Buchnera aphidicola; identical to SEQ ID NO: 30931

SEQ ID NO: 88558 - DNA, 1116 bp, Buchnera aphidicola; identical to SEQ ID NO: 30932
  CDS (1)..(1116): transl_table=11

SEQ ID NO: 88559 - protein, 371 aa, Buchnera aphidicola; identical to SEQ ID NO: 30933

SEQ ID NO: 88560 - DNA, 1164 bp, Erwinia herbicola; identical to SEQ ID NO: 30934
  CDS (1)..(1164): transl_table=11

SEQ ID NO: 88561 - protein, 387 aa, Erwinia herbicola; identical to SEQ ID NO: 30935

SEQ ID NO: 88562 - DNA, 1158 bp, Haemophilus influenzae; identical to SEQ ID NO: 30936
  CDS (1)..(1158): transl_table=11

SEQ ID NO: 88563 - protein, 385 aa, Haemophilus influenzae; identical to SEQ ID NO: 30937

SEQ ID NO: 88564 - DNA, 1098 bp, Pseudomonas stutzeri; identical to SEQ ID NO: 30938
  CDS (1)..(1098): transl_table=11

SEQ ID NO: 88565 - protein, 365 aa, Pseudomonas stutzeri; identical to SEQ ID NO: 30939

SEQ ID NO: 88566 - DNA, 24 bp, Primer
atgacatcggaaaacccgttactg

SEQ ID NO: 88567 - DNA, 25 bp, Primer
ttaggttggatcaacaggcactacg

SEQ ID NO: 88568 - protein, 391 aa, consensus; identical to SEQ ID NO: 30942
  MISC_FEATURE (1)..(391): consensus for the disclosure of xaa see table XV

SEQ ID NO: 88569 - protein, 33 aa, consensus; identical to SEQ ID NO: 30943
  MISC_FEATURE (1)..(33): consensus for the disclosure of xaa see table XV

SEQ ID NO: 88570 - protein, 14 aa, consensus
  MISC_FEATURE (1)..(14): consensus for the disclosure of xaa see table XV
XXXLGXXXXXXXXX

SEQ ID NO: 88571 - protein, 42 aa, consensus; identical to SEQ ID NO: 30945
  MISC_FEATURE (1)..(42): consensus for the disclosure of xaa see table XV

SEQ ID NO: 88572 - protein, 36 aa, consensus; identical to SEQ ID NO: 30946
  MISC_FEATURE (1)..(36): consensus for the disclosure of xaa see table XV

SEQ ID NO: 88573 - protein, 56 aa, consensus; identical to SEQ ID NO: 30947
  MISC_FEATURE (1)..(56): consensus for the disclosure of xaa see table XV

SEQ ID NO: 88574 - DNA, 1332 bp, Escherichia coli; identical to SEQ ID NO: 63709
  CDS (1)..(1332)

SEQ ID NO: 88575 - protein, 443 aa, Escherichia coli; identical to SEQ ID NO: 63710

SEQ ID NO: 88576 - DNA, 1305 bp, Vibrio fischeri ES114; identical to SEQ ID NO: 63711
  CDS (1)..(1305)

SEQ ID NO: 88577 - protein, 434 aa, Vibrio fischeri ES114; identical to SEQ ID NO: 63712

SEQ ID NO: 88578 - DNA, 1260 bp, Vibrio fischeri ES114; identical to SEQ ID NO: 63713
  CDS (1)..(1260)

SEQ ID NO: 88579 - protein, 419 aa, Vibrio fischeri ES114; identical to SEQ ID NO: 63714

SEQ ID NO: 88580 - DNA, 1242 bp, Helicobacter pylori 26695; identical to SEQ ID NO: 63715
  CDS (1)..(1242): transl_table=11

SEQ ID NO: 88581 - protein, 413 aa, Helicobacter pylori 26695; identical to SEQ ID NO: 63716

SEQ ID NO: 88582 - DNA, 1254 bp, Vibrio cholerae O1 biovar eltor str. N16961; identical to SEQ ID NO: 63717
  CDS (1)..(1254): transl_table=11

SEQ ID NO: 88583 - protein, 417 aa, Vibrio cholerae O1 biovar eltor str. N16961; identical to SEQ ID NO: 63718

SEQ ID NO: 88584 - DNA, 1242 bp, Pasteurella multocida subsp. multocida str. Pm70; identical to SEQ ID NO: 63719
  CDS (1)..(1242): transl_table=11

SEQ ID NO: 88585 - protein, 413 aa, Pasteurella multocida subsp. multocida str. Pm70; identical to SEQ ID NO: 63720

SEQ ID NO: 88586 - DNA, 1251 bp, Campylobacter jejuni subsp. jejuni NCTC 11168; identical to SEQ ID NO: 63721
  CDS (1)..(1251): transl_table=11

SEQ ID NO: 88587 - protein, 416 aa, Campylobacter jejuni subsp. jejuni NCTC 11168; identical to SEQ ID NO: 63722

SEQ ID NO: 88588 - DNA, 1332 bp, Salmonella typhimurium LT2; identical to SEQ ID NO: 63723
  CDS (1)..(1332): transl_table=11

SEQ ID NO: 88589 - protein, 443 aa, Salmonella typhimurium LT2; identical to SEQ ID NO: 63724

SEQ ID NO: 88590 - DNA, 1332 bp, Salmonella typhimurium LT2; identical to SEQ ID NO: 63725
  CDS (1)..(1332): transl_table=11

SEQ ID NO: 88591 - protein, 443 aa, Salmonella typhimurium LT2; identical to SEQ ID NO: 63726

SEQ ID NO: 88592 - DNA, 1287 bp, Yersinia pestis KIM; identical to SEQ ID NO: 63727
  CDS (1)..(1287): transl_table=11

SEQ ID NO: 88593 - protein, 428 aa, Yersinia pestis KIM; identical to SEQ ID NO: 63728

SEQ ID NO: 88594 - DNA, 1119 bp, Shigella flexneri 2a str. 301; identical to SEQ ID NO: 63729
  CDS (1)..(1119): transl_table=11

SEQ ID NO: 88595 - protein, 372 aa, Shigella flexneri 2a str. 301; identical to SEQ ID NO: 63730

SEQ ID NO: 88596 - DNA, 1332 bp, Shigella flexneri 2a str. 301; identical to SEQ ID NO: 63731
  CDS (1)..(1332): transl_table=11

SEQ ID NO: 88597 - protein, 443 aa, Shigella flexneri 2a str. 301; identical to SEQ ID NO: 63732

SEQ ID NO: 88598 - DNA, 1332 bp, Shigella flexneri 2a str. 301; identical to SEQ ID NO: 63733
  CDS (1)..(1332): transl_table=11

SEQ ID NO: 88599 - protein, 443 aa, Shigella flexneri 2a str. 301; identical to SEQ ID NO: 63734

SEQ ID NO: 88600 - DNA, 1272 bp, Shigella flexneri 2a str. 301; identical to SEQ ID NO: 63735
  CDS (1)..(1272): transl_table=11

SEQ ID NO: 88601 - protein, 423 aa, Shigella flexneri 2a str. 301; identical to SEQ ID NO: 63736

SEQ ID NO: 88602 - DNA, 1293 bp, Shewanella oneidensis MR-1; identical to SEQ ID NO: 63737
  CDS (1)..(1293): transl_table=11

SEQ ID NO: 88603 - protein, 430 aa, Shewanella oneidensis MR-1; identical to SEQ ID NO: 63738

SEQ ID NO: 88604 - DNA, 1281 bp, Lactobacillus plantarum WCFS1; identical to SEQ ID NO: 63739
  CDS (1)..(1281): transl_table=11

SEQ ID NO: 88605 - protein, 426 aa, Lactobacillus plantarum WCFS1; identical to SEQ ID NO: 63740

SEQ ID NO: 88606 - DNA, 1326 bp, Vibrio parahaemolyticus RIMD 2210633; identical to SEQ ID NO: 63741
  CDS (1)..(1326): transl_table=11

SEQ ID NO: 88607 - protein, 441 aa, Vibrio parahaemolyticus RIMD 2210633; identical to SEQ ID NO: 63742

SEQ ID NO: 88608 - DNA, 1257 bp, Vibrio parahaemolyticus RIMD 2210633; identical to SEQ ID NO: 63743
  CDS (1)..(1257): transl_table=11

SEQ ID NO: 88609 - protein, 418 aa, Vibrio parahaemolyticus RIMD 2210633; identical to SEQ ID NO: 63744

SEQ ID NO: 88610 - DNA, 1230 bp, Salmonella enterica subsp. enterica serovar Typhi Ty2; identical to SEQ ID NO: 63745
  CDS (1)..(1230): transl_table=11

SEQ ID NO: 88611 - protein, 409 aa, Salmonella enterica subsp. enterica serovar Typhi Ty2; identical to SEQ ID NO: 63746

SEQ ID NO: 88612 - DNA, 1320 bp, Bacillus cereus ATCC 14579; identical to SEQ ID NO: 63747
  CDS (1)..(1320): transl_table=11

SEQ ID NO: 88613 - protein, 439 aa, Bacillus cereus ATCC 14579; identical to SEQ ID NO: 63748

SEQ ID NO: 88614 - DNA, 1380 bp, Helicobacter hepaticus ATCC 51449; identical to SEQ ID NO: 63749
  CDS (1)..(1380): transl_table=11

SEQ ID NO: 88615 - protein, 459 aa, Helicobacter hepaticus ATCC 51449; identical to SEQ ID NO: 63750

SEQ ID NO: 88616 - DNA, 1290 bp, Wigglesworthia glossinidia endosymbiont of Glossina brevipalpis; identical to SEQ ID NO: 63751
  CDS (1)..(1290): transl_table=11

SEQ ID NO: 88617 - protein, 429 aa, Wigglesworthia glossinidia endosymbiont of Glossina brevipalpis; identical to SEQ ID NO: 63752

SEQ ID NO: 88618 - DNA, 1299 bp, Chromobacterium violaceum ATCC 12472; identical to SEQ ID NO: 63753
  CDS (1)..(1299): transl_table=11

SEQ ID NO: 88619 - protein, 432 aa, Chromobacterium violaceum ATCC 12472; identical to SEQ ID NO: 63754

SEQ ID NO: 88620 - DNA, 1299 bp, Photorhabdus luminescens subsp. laumondii TTO1; identical to SEQ ID NO: 63755
  CDS (1)..(1299): transl_table=11

SEQ ID NO: 88621 - protein, 432 aa, Photorhabdus luminescens subsp. laumondii TTO1; identical to SEQ ID NO: 63756

SEQ ID NO: 88622 - DNA, 1254 bp, Vibrio vulnificus YJ016; identical to SEQ ID NO: 63757
  CDS (1)..(1254): transl_table=11

SEQ ID NO: 88623 - protein, 417 aa, Vibrio vulnificus YJ016; identical to SEQ ID NO: 63758

SEQ ID NO: 88624 - DNA, 1344 bp, Corynebacterium diphtheriae NCTC 13129; identical to SEQ ID NO: 63759
  CDS (1)..(1344): transl_table=11

SEQ ID NO: 88625 - protein, 447 aa, Corynebacterium diphtheriae NCTC 13129; identical to SEQ ID NO: 63760

SEQ ID NO: 88626 - DNA, 1320 bp, Bacillus thuringiensis serovar konkukian str. 97-27; identical to SEQ ID NO: 63761
  CDS (1)..(1320): transl_table=11

SEQ ID NO: 88627 - protein, 439 aa, Bacillus thuringiensis serovar konkukian str. 97-27; identical to SEQ ID NO: 63762

SEQ ID NO: 88628 - DNA, 1290 bp, Erwinia carotovora subsp. atroseptica SCRI1043; identical to SEQ ID NO: 63763
  CDS (1)..(1290)

SEQ ID NO: 88629 - protein, 429 aa, Erwinia carotovora subsp. atroseptica SCRI1043; identical to SEQ ID NO: 63764

SEQ ID NO: 88630 - DNA, 1416 bp, Propionibacterium acnes KPA171202; identical to SEQ ID NO: 63765
  CDS (1)..(1416): transl_table=11

SEQ ID NO: 88631 - protein, 471 aa, Propionibacterium acnes KPA171202; identical to SEQ ID NO: 63766

SEQ ID NO: 88632 - DNA, 1302 bp, Yersinia pseudotuberculosis IP 32953; identical to SEQ ID NO: 63767
  CDS (1)..(1302): transl_table=11

SEQ ID NO: 88633 - protein, 433 aa, Yersinia pseudotuberculosis IP 32953; identical to SEQ ID NO: 63768

SEQ ID NO: 88634 - DNA, 1296 bp, Legionella pneumophila str. Lens; identical to SEQ ID NO: 63769
  CDS (1)..(1296): transl_table=11

SEQ ID NO: 88635 - protein, 431 aa, Legionella pneumophila str. Lens; identical to SEQ ID NO: 63770

SEQ ID NO: 88636 - DNA, 1254 bp, Photobacterium profundum SS9; identical to SEQ ID NO: 63771
  CDS (1)..(1254): transl_table=11

SEQ ID NO: 88637 - protein, 417 aa, Photobacterium profundum SS9; identical to SEQ ID NO: 63772

SEQ ID NO: 88638 - DNA, 1257 bp, Photobacterium profundum SS9; identical to SEQ ID NO: 63773
  CDS (1)..(1257): transl_table=11

SEQ ID NO: 88639 - protein, 418 aa, Photobacterium profundum SS9; identical to SEQ ID NO: 63774

SEQ ID NO: 88640 - DNA, 1332 bp, Photobacterium profundum SS9; identical to SEQ ID NO: 63775
  CDS (1)..(1332): transl_table=11

SEQ ID NO: 88641 - protein, 443 aa, Photobacterium profundum SS9; identical to SEQ ID NO: 63776

SEQ ID NO: 88642 - DNA, 1395 bp, Photobacterium profundum SS9; identical to SEQ ID NO: 63777
  CDS (1)..(1395): transl_table=11

SEQ ID NO: 88643 - protein, 464 aa, Photobacterium profundum SS9; identical to SEQ ID NO: 63778

SEQ ID NO: 88644 - DNA, 1329 bp, Zymomonas mobilis subsp. mobilis ZM4; identical to SEQ ID NO: 63779
  CDS (1)..(1329): transl_table=11

SEQ ID NO: 88645 - protein, 442 aa, Zymomonas mobilis subsp. mobilis ZM4; identical to SEQ ID NO: 63780

SEQ ID NO: 88646 - DNA, 1263 bp, Francisella tularensis subsp. tularensis Schu 4; identical to SEQ ID NO: 63781
  CDS (1)..(1263): transl_table=11

SEQ ID NO: 88647 - protein, 420 aa, Francisella tularensis subsp. tularensis Schu 4; identical to SEQ ID NO: 63782

SEQ ID NO: 88648 - DNA, 1224 bp, Francisella tularensis subsp. tularensis Schu 4; identical to SEQ ID NO: 63783
  CDS (1)..(1224): transl_table=11

SEQ ID NO: 88649 - protein, 407 aa, Francisella tularensis subsp. tularensis Schu 4; identical to SEQ ID NO: 63784

SEQ ID NO: 88650 - DNA, 1251 bp, Campylobacter jejuni RM1221; identical to SEQ ID NO: 63785
  CDS (1)..(1251): transl_table=11

SEQ ID NO: 88651 - protein, 416 aa, Campylobacter jejuni RM1221; identical to SEQ ID NO: 63786

SEQ ID NO: 88652 - DNA, 1278 bp, Pseudomonas syringae pv. syringae B728a; identical to SEQ ID NO: 63787
  CDS (1)..(1278)

SEQ ID NO: 88653 - protein, 425 aa, Pseudomonas syringae pv. syringae B728a; identical to SEQ ID NO: 63788

SEQ ID NO: 88654 - DNA, 1230 bp, Actinobacillus pleuropneumoniae serovar 1 str. 4074; identical to SEQ ID NO: 63789
  CDS (1)..(1230)

SEQ ID NO: 88655 - protein, 409 aa, Actinobacillus pleuropneumoniae serovar 1 str. 4074; identical to SEQ ID NO: 63790

SEQ ID NO: 88656 - DNA, 1281 bp, Pseudomonas fluorescens PfO-1; identical to SEQ ID NO: 63791
  CDS (1)..(1281)

SEQ ID NO: 88657 - protein, 426 aa, Pseudomonas fluorescens PfO-1; identical to SEQ ID NO: 63792

SEQ ID NO: 88658 - DNA, 1284 bp, Campylobacter lari RM2100; identical to SEQ ID NO: 63793
  CDS (1)..(1284): transl_table=11

SEQ ID NO: 88659 - protein, 427 aa, Campylobacter lari RM2100; identical to SEQ ID NO: 63794

SEQ ID NO: 88660 - DNA, 1296 bp, Aeromonas salmonicida; identical to SEQ ID NO: 63795
  CDS (1)..(1296): transl_table=11

SEQ ID NO: 88661 - protein, 431 aa, Aeromonas salmonicida; identical to SEQ ID NO: 63796

SEQ ID NO: 88662 - DNA, 1299 bp, Citrobacter freundii; identical to SEQ ID NO: 63797
  CDS (1)..(1299): transl_table=11

SEQ ID NO: 88663 - protein, 432 aa, Citrobacter freundii; identical to SEQ ID NO: 63798

SEQ ID NO: 88664 - DNA, 1290 bp, Escherichia coli; identical to SEQ ID NO: 63799
  CDS (1)..(1290): transl_table=11

SEQ ID NO: 88665 - protein, 429 aa, Escherichia coli; identical to SEQ ID NO: 63800

SEQ ID NO: 88666 - DNA, 1239 bp, Haemophilus influenzae; identical to SEQ ID NO: 63801
  CDS (1)..(1239): transl_table=11

SEQ ID NO: 88667 - protein, 412 aa, Haemophilus influenzae; identical to SEQ ID NO: 63802

SEQ ID NO: 88668 - DNA, 1290 bp, Shigella flexneri; identical to SEQ ID NO: 63803
  CDS (1)..(1290)

SEQ ID NO: 88669 - protein, 429 aa, Shigella flexneri; identical to SEQ ID NO: 63804

SEQ ID NO: 88670 - DNA, 1332 bp, Escherichia coli; identical to SEQ ID NO: 63805
  CDS (1)..(1332)

SEQ ID NO: 88671 - protein, 443 aa, Escherichia coli; identical to SEQ ID NO: 63806

SEQ ID NO: 88672 - DNA, 1272 bp, Escherichia coli; identical to SEQ ID NO: 63807
  CDS (1)..(1272): transl_table=11

SEQ ID NO: 88673 - protein, 423 aa, Escherichia coli; identical to SEQ ID NO: 63808

SEQ ID NO: 88674 - DNA, 26 bp, Primer
atgagtacttcagatagcattgtatc

SEQ ID NO: 88675 - DNA, 27 bp, Primer
ttaaaacagtttgtatacgatgttcag

SEQ ID NO: 88676 - protein, 463 aa, consensus; identical to SEQ ID NO: 63811
  MISC_FEATURE (1)..(463): consensus for the disclosure of xaa see table XV

SEQ ID NO: 88677 - protein, 54 aa, consensus; identical to SEQ ID NO: 63812
  MISC_FEATURE (1)..(54): consensus for the disclosure of xaa see table XV

SEQ ID NO: 88678 - protein, 40 aa, consensus; identical to SEQ ID NO: 63813
  MISC_FEATURE (1)..(40): consensus for the disclosure of xaa see table XV

SEQ ID NO: 88679 - protein, 42 aa, consensus; identical to SEQ ID NO: 63814
  MISC_FEATURE (1)..(42): consensus for the disclosure of xaa see table XV

SEQ ID NO: 88680 - protein, 24 aa, consensus
  MISC_FEATURE (1)..(24): consensus for the disclosure of xaa see table XV
XXXXXXXXXXXXXXXXXXXXXXXX

SEQ ID NO: 88681 - protein, 37 aa, consensus; identical to SEQ ID NO: 63816
  MISC_FEATURE (1)..(37): consensus for the disclosure of xaa see table XV

SEQ ID NO: 88682 - protein, 31 aa, consensus; identical to SEQ ID NO: 63817
  MISC_FEATURE (1)..(31): consensus for the disclosure of xaa see table XV

SEQ ID NO: 88683 - protein, 59 aa, consensus; identical to SEQ ID NO: 63818
  MISC_FEATURE (1)..(59): consensus for the disclosure of xaa see table XV

SEQ ID NO: 88684 - DNA, 336 bp, Escherichia coli; identical to SEQ ID NO: 48937
  CDS (1)..(336)

SEQ ID NO: 88685 - protein, 111 aa, Escherichia coli; identical to SEQ ID NO: 48938

SEQ ID NO: 88686 - DNA, 333 bp, Synechocystis sp. PCC 6803; identical to SEQ ID NO: 48939
  CDS (1)..(333): transl_table=11

SEQ ID NO: 88687 - protein, 110 aa, Synechocystis sp. PCC 6803; identical to SEQ ID NO: 48940

SEQ ID NO: 88688 - DNA, 390 bp, Pseudomonas putida KT2440; identical to SEQ ID NO: 48941
  CDS (1)..(390): transl_table=11

SEQ ID NO: 88689 - protein, 129 aa, Pseudomonas putida KT2440; identical to SEQ ID NO: 48942

SEQ ID NO: 88690 - DNA, 336 bp, Escherichia coli CFT073; identical to SEQ ID NO: 48943
  CDS (1)..(336): transl_table=11

SEQ ID NO: 88691 - protein, 111 aa, Escherichia coli CFT073; identical to SEQ ID NO: 48944

SEQ ID NO: 88692 - DNA, 363 bp, Bradyrhizobium japonicum USDA 110; identical to SEQ ID NO: 48945
  CDS (1)..(363)

SEQ ID NO: 88693 - protein, 120 aa, Bradyrhizobium japonicum USDA 110; identical to SEQ ID NO: 48946

SEQ ID NO: 88694 - DNA, 327 bp, Ruegeria sp. PR1b; identical to SEQ ID NO: 48947
  CDS (1)..(327): transl_table=11

SEQ ID NO: 88695 - protein, 108 aa, Ruegeria sp. PR1b; identical to SEQ ID NO: 48948

SEQ ID NO: 88696 - DNA, 330 bp, Nitrosomonas europaea ATCC 19718; identical to SEQ ID NO: 48949
  CDS (1)..(330): transl_table=11

SEQ ID NO: 88697 - protein, 109 aa, Nitrosomonas europaea ATCC 19718; identical to SEQ ID NO: 48950

SEQ ID NO: 88698 - DNA, 351 bp, Photorhabdus luminescens subsp. laumondii TTO1; identical to SEQ ID NO: 48951
  CDS (1)..(351): transl_table=11

SEQ ID NO: 88699 - protein, 116 aa, Photorhabdus luminescens subsp. laumondii TTO1; identical to SEQ ID NO: 48952

SEQ ID NO: 88700 - DNA, 318 bp, Pseudomonas aeruginosa; identical to SEQ ID NO: 48953
  CDS (1)..(318): transl_table=11

SEQ ID NO: 88701 - protein, 105 aa, Pseudomonas aeruginosa; identical to SEQ ID NO: 48954

SEQ ID NO: 88702 - DNA, 20 bp, Primer
atgcccgctaatgctcgctc

SEQ ID NO: 88703 - DNA, 24 bp, Primer
ttattcgtcgtcgccaatctcatc

SEQ ID NO: 88704 - protein, 89 aa, consensus; identical to SEQ ID NO: 48957
  MISC_FEATURE (1)..(89): consensus for the disclosure of xaa see table XV

SEQ ID NO: 88705 - protein, 102 aa, consensus; identical to SEQ ID NO: 48958
  MISC_FEATURE (1)..(102): consensus for the disclosure of xaa see table XV

SEQ ID NO: 88706 - DNA, 1008 bp, Escherichia coli; identical to SEQ ID NO: 42264
  CDS (1)..(1008)

SEQ ID NO: 88707 - protein, 335 aa, Escherichia coli; identical to SEQ ID NO: 42265

SEQ ID NO: 88708 - DNA, 1014 bp, Staphylococcus aureus subsp. aureus COL; identical to SEQ ID NO: 42266
  CDS (1)..(1014)

SEQ ID NO: 88709 - protein, 337 aa, Staphylococcus aureus subsp. aureus COL; identical to SEQ ID NO: 42267

SEQ ID NO: 88710 - DNA, 1176 bp, Xanthomonas oryzae pv. oryzae KACC10331; identical to SEQ ID NO: 42268
  CDS (1)..(1176)

SEQ ID NO: 88711 - protein, 391 aa, Xanthomonas oryzae pv. oryzae KACC10331; identical to SEQ ID NO: 42269

SEQ ID NO: 88712 - DNA, 1008 bp, Bacillus halodurans C-125; identical to SEQ ID NO: 42270
  CDS (1)..(1008): transl_table=11

SEQ ID NO: 88713 - protein, 335 aa, Bacillus halodurans C-125; identical to SEQ ID NO: 42271

SEQ ID NO: 88714 - DNA, 1002 bp, Pseudomonas aeruginosa PAO1; identical to SEQ ID NO: 42272
  CDS (1)..(1002): transl_table=11

SEQ ID NO: 88715 - protein, 333 aa, Pseudomonas aeruginosa PAO1; identical to SEQ ID NO: 42273

SEQ ID NO: 88716 - DNA, 1017 bp, Halobacterium salinarum NRC-1; identical to SEQ ID NO: 42274
  CDS (1)..(1017): transl_table=11

SEQ ID NO: 88717 - protein, 338 aa, Halobacterium salinarum NRC-1; identical to SEQ ID NO: 42275

SEQ ID NO: 88718 - DNA, 1017 bp, Deinococcus radiodurans R1; identical to SEQ ID NO: 42276
  CDS (1)..(1017): transl_table=11

SEQ ID NO: 88719 - protein, 338 aa, Deinococcus radiodurans R1; identical to SEQ ID NO: 42277

SEQ ID NO: 88720 - DNA, 1044 bp, Mycoplasma pulmonis UAB CTIP; identical to SEQ ID NO: 42278
  CDS (1)..(1044): transl_table=4

SEQ ID NO: 88721 - protein, 347 aa, Mycoplasma pulmonis UAB CTIP; identical to SEQ ID NO: 42279

SEQ ID NO: 88722 - DNA, 1008 bp, Agrobacterium tumefaciens str. C58; identical to SEQ ID NO: 42280
  CDS (1)..(1008): transl_table=11

SEQ ID NO: 88723 - protein, 335 aa, Agrobacterium tumefaciens str. C58; identical to SEQ ID NO: 42281

SEQ ID NO: 88724 - DNA, 1026 bp, Staphylococcus aureus subsp. aureus Mu50; identical to SEQ ID NO: 42282
  CDS (1)..(1026): transl_table=11

SEQ ID NO: 88725 - protein, 341 aa, Staphylococcus aureus subsp. aureus Mu50; identical to SEQ ID NO: 42283

SEQ ID NO: 88726 - DNA, 990 bp, Sinorhizobium meliloti 1021; identical to SEQ ID NO: 42284
  CDS (1)..(990): transl_table=11

SEQ ID NO: 88727 - protein, 329 aa, Sinorhizobium meliloti 1021; identical to SEQ ID NO: 42285

SEQ ID NO: 88728 - DNA, 1014 bp, Caulobacter crescentus CB15; identical to SEQ ID NO: 42286
  CDS (1)..(1014): transl_table=11

SEQ ID NO: 88729 - protein, 337 aa, Caulobacter crescentus CB15; identical to SEQ ID NO: 42287

SEQ ID NO: 88730 - DNA, 1008 bp, Salmonella typhimurium LT2; identical to SEQ ID NO: 42288
  CDS (1)..(1008): transl_table=11

SEQ ID NO: 88731 - protein, 335 aa, Salmonella typhimurium LT2; identical to SEQ ID NO: 42289

SEQ ID NO: 88732 - DNA, 996 bp, Listeria innocua Clip11262; identical to SEQ ID NO: 42290
  CDS (1)..(996): transl_table=11

SEQ ID NO: 88733 - protein, 331 aa, Listeria innocua Clip11262; identical to SEQ ID NO: 42291

SEQ ID NO: 88734 - DNA, 1053 bp, Ralstonia solanacearum GMI1000; identical to SEQ ID NO: 42292
  CDS (1)..(1053): transl_table=11

SEQ ID NO: 88735 - protein, 350 aa, Ralstonia solanacearum GMI1000; identical to SEQ ID NO: 42293

SEQ ID NO: 88736 - DNA, 1002 bp, Agrobacterium tumefaciens str. C58; identical to SEQ ID NO: 42294
  CDS (1)..(1002): transl_table=11

SEQ ID NO: 88737 - protein, 333 aa, Agrobacterium tumefaciens str. C58; identical to SEQ ID NO: 42295

SEQ ID NO: 88738 - DNA, 984 bp, Brucella melitensis 16M; identical to SEQ ID NO: 42296
  CDS (1)..(984): transl_table=11

SEQ ID NO: 88739 - protein, 327 aa, Brucella melitensis 16M; identical to SEQ ID NO: 42297

SEQ ID NO: 88740 - DNA, 981 bp, Corynebacterium glutamicum ATCC 13032; identical to SEQ ID NO: 42298
  CDS (1)..(981): transl_table=11

SEQ ID NO: 88741 - protein, 326 aa, Corynebacterium glutamicum ATCC 13032; identical to SEQ ID NO: 42299

SEQ ID NO: 88742 - DNA, 999 bp, Streptococcus pyogenes MGAS8232; identical to SEQ ID NO: 42300
  CDS (1)..(999): transl_table=11

SEQ ID NO: 88743 - protein, 332 aa, Streptococcus pyogenes MGAS8232; identical to SEQ ID NO: 42301

SEQ ID NO: 88744 - DNA, 1101 bp, Streptomyces coelicolor A3(2); identical to SEQ ID NO: 42302
  CDS (1)..(1101)

SEQ ID NO: 88745 - protein, 366 aa, Streptomyces coelicolor A3(2); identical to SEQ ID NO: 42303

SEQ ID NO: 88746 - DNA, 1110 bp, Xanthomonas axonopodis pv. citri str. 306; identical to SEQ ID NO: 42304
  CDS (1)..(1110): transl_table=11

SEQ ID NO: 88747 - protein, 369 aa, Xanthomonas axonopodis pv. citri str. 306; identical to SEQ ID NO: 42305

SEQ ID NO: 88748 - DNA, 1056 bp, Yersinia pestis KIM; identical to SEQ ID NO: 42306
  CDS (1)..(1056): transl_table=11

SEQ ID NO: 88749 - protein, 351 aa, Yersinia pestis KIM; identical to SEQ ID NO: 42307

SEQ ID NO: 88750 - DNA, 1002 bp, Oceanobacillus iheyensis HTE831; identical to SEQ ID NO: 42308
  CDS (1)..(1002): transl_table=11

SEQ ID NO: 88751 - protein, 333 aa, Oceanobacillus iheyensis HTE831; identical to SEQ ID NO: 42309

SEQ ID NO: 88752 - DNA, 912 bp, Oceanobacillus iheyensis HTE831; identical to SEQ ID NO: 42310
  CDS (1)..(912): transl_table=11

SEQ ID NO: 88753 - protein, 303 aa, Oceanobacillus iheyensis HTE831; identical to SEQ ID NO: 42311

SEQ ID NO: 88754 - DNA, 1020 bp, Oceanobacillus iheyensis HTE831; identical to SEQ ID NO: 42312
  CDS (1)..(1020): transl_table=11

SEQ ID NO: 88755 - protein, 339 aa, Oceanobacillus iheyensis HTE831; identical to SEQ ID NO: 42313

SEQ ID NO: 88756 - DNA, 987 bp, Streptococcus agalactiae NEM316; identical to SEQ ID NO: 42314
  CDS (1)..(987): transl_table=11

SEQ ID NO: 88757 - protein, 328 aa, Streptococcus agalactiae NEM316; identical to SEQ ID NO: 42315

SEQ ID NO: 88758 - DNA, 1041 bp, Corynebacterium efficiens YS-314; identical to SEQ ID NO: 42316
  CDS (1)..(1041): transl_table=11

SEQ ID NO: 88759 - protein, 346 aa, Corynebacterium efficiens YS-314; identical to SEQ ID NO: 42317

SEQ ID NO: 88760 - DNA, 966 bp, Corynebacterium efficiens YS-314; identical to SEQ ID NO: 42318
  CDS (1)..(966): transl_table=11

SEQ ID NO: 88761 - protein, 321 aa, Corynebacterium efficiens YS-314; identical to SEQ ID NO: 42319

SEQ ID NO: 88762 - DNA, 1005 bp, Pseudomonas putida KT2440; identical to SEQ ID NO: 42320
  CDS (1)..(1005): transl_table=11

SEQ ID NO: 88763 - protein, 334 aa, Pseudomonas putida KT2440; identical to SEQ ID NO: 42321

SEQ ID NO: 88764 - DNA, 981 bp, Pseudomonas putida KT2440; identical to SEQ ID NO: 42322
  CDS (1)..(981): transl_table=11

SEQ ID NO: 88765 - protein, 326 aa, Pseudomonas putida KT2440; identical to SEQ ID NO: 42323

SEQ ID NO: 88766 - DNA, 996 bp, Staphylococcus epidermidis ATCC 12228; identical to SEQ ID NO: 42324
  CDS (1)..(996): transl_table=11

SEQ ID NO: 88767 - protein, 331 aa, Staphylococcus epidermidis ATCC 12228; identical to SEQ ID NO: 42325

SEQ ID NO: 88768 - DNA, 1047 bp, Staphylococcus epidermidis ATCC 12228; identical to SEQ ID NO: 42326
  CDS (1)..(1047): transl_table=11

SEQ ID NO: 88769 - protein, 348 aa, Staphylococcus epidermidis ATCC 12228; identical to SEQ ID NO: 42327

SEQ ID NO: 88770 - DNA, 1008 bp, Bradyrhizobium japonicum USDA 110; identical to SEQ ID NO: 42328
  CDS (1)..(1008)

SEQ ID NO: 88771 - protein, 335 aa, Bradyrhizobium japonicum USDA 110; identical to SEQ ID NO: 42329

SEQ ID NO: 88772 - DNA, 1014 bp, Bradyrhizobium japonicum USDA 110; identical to SEQ ID NO: 42330
  CDS (1)..(1014)

SEQ ID NO: 88773 - protein, 337 aa, Bradyrhizobium japonicum USDA 110; identical to SEQ ID NO: 42331

SEQ ID NO: 88774 - DNA, 1002 bp, Pseudomonas syringae pv. tomato str. DC3000; identical to SEQ ID NO: 42332
  CDS (1)..(1002): transl_table=11

SEQ ID NO: 88775 - protein, 333 aa, Pseudomonas syringae pv. tomato str. DC3000; identical to SEQ ID NO: 42333

SEQ ID NO: 88776 - DNA, 987 bp, Enterococcus faecalis V583; identical to SEQ ID NO: 42334
  CDS (1)..(987): transl_table=11

SEQ ID NO: 88777 - protein, 328 aa, Enterococcus faecalis V583; identical to SEQ ID NO: 42335

SEQ ID NO: 88778 - DNA, 1017 bp, Streptomyces avermitilis MA-4680; identical to SEQ ID NO: 42336
  CDS (1)..(1017)

SEQ ID NO: 88779 - protein, 338 aa, Streptomyces avermitilis MA-4680; identical to SEQ ID NO: 42337

SEQ ID NO: 88780 - DNA, 1008 bp, Streptomyces avermitilis MA-4680; identical to SEQ ID NO: 42338
  CDS (1)..(1008)

SEQ ID NO: 88781 - protein, 335 aa, Streptomyces avermitilis MA-4680; identical to SEQ ID NO: 42339

SEQ ID NO: 88782 - DNA, 972 bp, Bordetella bronchiseptica RB50; identical to SEQ ID NO: 42340
  CDS (1)..(972): transl_table=11

SEQ ID NO: 88783 - protein, 323 aa, Bordetella bronchiseptica RB50; identical to SEQ ID NO: 42341

SEQ ID NO: 88784 - DNA, 1026 bp, Bordetella bronchiseptica RB50; identical to SEQ ID NO: 42342
  CDS (1)..(1026): transl_table=11

SEQ ID NO: 88785 - protein, 341 aa, Bordetella bronchiseptica RB50; identical to SEQ ID NO: 42343

SEQ ID NO: 88786 - DNA, 1032 bp, Chromobacterium violaceum ATCC 12472; identical to SEQ ID NO: 42344
  CDS (1)..(1032): transl_table=11

SEQ ID NO: 88787 - protein, 343 aa, Chromobacterium violaceum ATCC 12472; identical to SEQ ID NO: 42345

SEQ ID NO: 88788 - DNA, 1017 bp, Rhodopseudomonas palustris CGA009; identical to SEQ ID NO: 42346
  CDS (1)..(1017): transl_table=11

SEQ ID NO: 88789 - protein, 338 aa, Rhodopseudomonas palustris CGA009; identical to SEQ ID NO: 42347

SEQ ID NO: 88790 - DNA, 1122 bp, Mycobacterium avium subsp. paratuberculosis str. k10; identical to SEQ ID NO: 42348
  CDS (1)..(1122): transl_table=11

SEQ ID NO: 88791 - protein, 373 aa, Mycobacterium avium subsp. paratuberculosis str. k10; identical to SEQ ID NO: 42349

SEQ ID NO: 88792 - DNA, 1032 bp, Mycobacterium avium subsp. paratuberculosis str. k10; identical to SEQ ID NO: 42350
  CDS (1)..(1032): transl_table=11

SEQ ID NO: 88793 - protein, 343 aa, Mycobacterium avium subsp. paratuberculosis str. k10; identical to SEQ ID NO: 42351

SEQ ID NO: 88794 - DNA, 1011 bp, Bdellovibrio bacteriovorus HD100; identical to SEQ ID NO: 42352
  CDS (1)..(1011): transl_table=11

SEQ ID NO: 88795 - protein, 336 aa, Bdellovibrio bacteriovorus HD100; identical to SEQ ID NO: 42353

SEQ ID NO: 88796 - DNA, 972 bp, Anopheles gambiae str. PEST; identical to SEQ ID NO: 42354
  CDS (1)..(972)

SEQ ID NO: 88797 - protein, 323 aa, Anopheles gambiae str. PEST; identical to SEQ ID NO: 42355

SEQ ID NO: 88798 - DNA, 1014 bp, Staphylococcus aureus subsp. aureus MRSA252; identical to SEQ ID NO: 42356
  CDS (1)..(1014): transl_table=11

SEQ ID NO: 88799 - protein, 337 aa, Staphylococcus aureus subsp. aureus MRSA252; identical to SEQ ID NO: 42357

SEQ ID NO: 88800 - DNA, 1023 bp, Acinetobacter sp. ADP1; identical to SEQ ID NO: 42358
  CDS (1)..(1023): transl_table=11

SEQ ID NO: 88801 - protein, 340 aa, Acinetobacter sp. ADP1; identical to SEQ ID NO: 42359

SEQ ID NO: 88802 - DNA, 981 bp, Erwinia carotovora subsp. atroseptica SCRI1043; identical to SEQ ID NO: 42360
  CDS (1)..(981)

SEQ ID NO: 88803 - protein, 326 aa, Erwinia carotovora subsp. atroseptica SCRI1043; identical to SEQ ID NO: 42361

SEQ ID NO: 88804 - DNA, 981 bp, Propionibacterium acnes KPA171202; identical to SEQ ID NO: 42362
  CDS (1)..(981): transl_table=11

SEQ ID NO: 88805 - protein, 326 aa, Propionibacterium acnes KPA171202; identical to SEQ ID NO: 42363

SEQ ID NO: 88806 - DNA, 1014 bp, Symbiobacterium thermophilum IAM 14863; identical to SEQ ID NO: 42364
  CDS (1)..(1014): transl_table=11

SEQ ID NO: 88807 - protein, 337 aa, Symbiobacterium thermophilum IAM 14863; identical to SEQ ID NO: 42365

SEQ ID NO: 88808 - DNA, 993 bp, Bacillus licheniformis ATCC 14580; identical to SEQ ID NO: 42366
  CDS (1)..(993): transl_table=11

SEQ ID NO: 88809 - protein, 330 aa, Bacillus licheniformis ATCC 14580; identical to SEQ ID NO: 42367

SEQ ID NO: 88810 - DNA, 1038 bp, Mannheimia succiniciproducens MBEL55E; identical to SEQ ID NO: 42368
  CDS (1)..(1038): transl_table=11

SEQ ID NO: 88811 - protein, 345 aa, Mannheimia succiniciproducens MBEL55E; identical to SEQ ID NO: 42369

SEQ ID NO: 88812 - DNA, 1008 bp, Bacillus licheniformis ATCC 14580; identical to SEQ ID NO: 42370
  CDS (1)..(1008): transl_table=11

SEQ ID NO: 88813 - protein, 335 aa, Bacillus licheniformis ATCC 14580; identical to SEQ ID NO: 42371

SEQ ID NO: 88814 - DNA, 1002 bp, Burkholderia mallei ATCC 23344; identical to SEQ ID NO: 42372
  CDS (1)..(1002): transl_table=11

SEQ ID NO: 88815 - protein, 333 aa, Burkholderia mallei ATCC 23344; identical to SEQ ID NO: 42373

SEQ ID NO: 88816 - DNA, 1059 bp, Burkholderia pseudomallei K96243; identical to SEQ ID NO: 42374
  CDS (1)..(1059): transl_table=11

SEQ ID NO: 88817 - protein, 352 aa, Burkholderia pseudomallei K96243; identical to SEQ ID NO: 42375

SEQ ID NO: 88818 - DNA, 1185 bp, Nocardia farcinica IFM 10152; identical to SEQ ID NO: 42376
  CDS (1)..(1185): transl_table=11

SEQ ID NO: 88819 - protein, 394 aa, Nocardia farcinica IFM 10152; identical to SEQ ID NO: 42377

SEQ ID NO: 88820 - DNA, 1032 bp, Nocardia farcinica IFM 10152; identical to SEQ ID NO: 42378
  CDS (1)..(1032): transl_table=11

SEQ ID NO: 88821 - protein, 343 aa, Nocardia farcinica IFM 10152; identical to SEQ ID NO: 42379

SEQ ID NO: 88822 - DNA, 993 bp, Nocardia farcinica IFM 10152; identical to SEQ ID NO: 42380
  CDS (1)..(993): transl_table=11

SEQ ID NO: 88823 - protein, 330 aa, Nocardia farcinica IFM 10152; identical to SEQ ID NO: 42381

SEQ ID NO: 88824 - DNA, 1029 bp, Haloarcula marismortui ATCC 43049; identical to SEQ ID NO: 42382
  CDS (1)..(1029): transl_table=11

SEQ ID NO: 88825 - protein, 342 aa, Haloarcula marismortui ATCC 43049; identical to SEQ ID NO: 42383

SEQ ID NO: 88826 - DNA, 1011 bp, Geobacillus kaustophilus HTA426; identical to SEQ ID NO: 42384
  CDS (1)..(1011): transl_table=11

SEQ ID NO: 88827 - protein, 336 aa, Geobacillus kaustophilus HTA426; identical to SEQ ID NO: 42385

SEQ ID NO: 88828 - DNA, 984 bp, Idiomarina loihiensis L2TR; identical to SEQ ID NO: 42386
  CDS (1)..(984): transl_table=11

SEQ ID NO: 88829 - protein, 327 aa, Idiomarina loihiensis L2TR; identical to SEQ ID NO: 42387

SEQ ID NO: 88830 - DNA, 1005 bp, Silicibacter pomeroyi DSS-3; identical to SEQ ID NO: 42388
  CDS (1)..(1005): transl_table=11

SEQ ID NO: 88831 - protein, 334 aa, Silicibacter pomeroyi DSS-3; identical to SEQ ID NO: 42389

SEQ ID NO: 88832 - DNA, 999 bp, Bacillus clausii KSM-K16; identical to SEQ ID NO: 42390
  CDS (1)..(999): transl_table=11

SEQ ID NO: 88833 - protein, 332 aa, Bacillus clausii KSM-K16; identical to SEQ ID NO: 42391

SEQ ID NO: 88834 - DNA, 1005 bp, Bacillus clausii KSM-K16; identical to SEQ ID NO: 42392
  CDS (1)..(1005): transl_table=11

SEQ ID NO: 88835 - protein, 334 aa, Bacillus clausii KSM-K16; identical to SEQ ID NO: 42393

SEQ ID NO: 88836 - DNA, 984 bp, Rhodobacter sphaeroides 2.4.1; identical to SEQ ID NO: 42394
  CDS (1)..(984)

SEQ ID NO: 88837 - protein, 327 aa, Rhodobacter sphaeroides 2.4.1; identical to SEQ ID NO: 42395

SEQ ID NO: 88838 - DNA, 996 bp, Azotobacter vinelandii; identical to SEQ ID NO: 42396
  CDS (1)..(996)

SEQ ID NO: 88839 - protein, 331 aa, Azotobacter vinelandii; identical to SEQ ID NO: 42397

SEQ ID NO: 88840 - DNA, 1050 bp, Actinobacillus pleuropneumoniae serovar 1 str. 4074; identical to SEQ ID NO: 42398
  CDS (1)..(1050)

SEQ ID NO: 88841 - protein, 349 aa, Actinobacillus pleuropneumoniae serovar 1 str. 4074; identical to SEQ ID NO: 42399

SEQ ID NO: 88842 - DNA, 972 bp, Pseudomonas aeruginosa UCBPP-PA14; identical to SEQ ID NO: 42400
  CDS (1)..(972)

SEQ ID NO: 88843 - protein, 323 aa, Pseudomonas aeruginosa UCBPP-PA14; identical to SEQ ID NO: 42401

SEQ ID NO: 88844 - DNA, 1005 bp, Dechloromonas aromatica RCB; identical to SEQ ID NO: 42402
  CDS (1)..(1005)

SEQ ID NO: 88845 - protein, 334 aa, Dechloromonas aromatica RCB; identical to SEQ ID NO: 42403

SEQ ID NO: 88846 - DNA, 1026 bp, Ralstonia eutropha JMP134; identical to SEQ ID NO: 42404
  CDS (1)..(1026)

SEQ ID NO: 88847 - protein, 341 aa, Ralstonia eutropha JMP134; identical to SEQ ID NO: 42405

SEQ ID NO: 88848 - DNA, 1002 bp, Methylobacillus flagellatus KT; identical to SEQ ID NO: 42406
  CDS (1)..(1002)

SEQ ID NO: 88849 - protein, 333 aa, Methylobacillus flagellatus KT; identical to SEQ ID NO: 42407

SEQ ID NO: 88850 - DNA, 990 bp, Exiguobacterium sp. 255-15; identical to SEQ ID NO: 42408
  CDS (1)..(990)

SEQ ID NO: 88851 - protein, 329 aa, Exiguobacterium sp. 255-15; identical to SEQ ID NO: 42409

SEQ ID NO: 88852 - DNA, 987 bp, Mesorhizobium sp. BNC1; identical to SEQ ID NO: 42410
  CDS (1)..(987)

SEQ ID NO: 88853 - protein, 328 aa, Mesorhizobium sp. BNC1; identical to SEQ ID NO: 42411

SEQ ID NO: 88854 - DNA, 1011 bp, Exiguobacterium sp. 255-15; identical to SEQ ID NO: 42412
  CDS (1)..(1011)

SEQ ID NO: 88855 - protein, 336 aa, Exiguobacterium sp. 255-15; identical to SEQ ID NO: 42413

SEQ ID NO: 88856 - DNA, 1050 bp, Burkholderia cepacia R18194; identical to SEQ ID NO: 42414
  CDS (1)..(1050)

SEQ ID NO: 88857 - protein, 349 aa, Burkholderia cepacia R18194; identical to SEQ ID NO: 42415

SEQ ID NO: 88858 - DNA, 999 bp, Burkholderia cepacia R1808; identical to SEQ ID NO: 42416
  CDS (1)..(999)

SEQ ID NO: 88859 - protein, 332 aa, Burkholderia cepacia R1808; identical to SEQ ID NO: 42417

SEQ ID NO: 88860 - DNA, 1032 bp, Burkholderia cepacia R1808; identical to SEQ ID NO: 42418
  CDS (1)..(1032)

SEQ ID NO: 88861 - protein, 343 aa, Burkholderia cepacia R1808; identical to SEQ ID NO: 42419

SEQ ID NO: 88862 - DNA, 996 bp, Listeria monocytogenes str. 1/2a F6854; identical to SEQ ID NO: 42420
  CDS (1)..(996): transl_table=11

SEQ ID NO: 88863 - protein, 331 aa, Listeria monocytogenes str. 1/2a F6854; identical to SEQ ID NO: 42421

SEQ ID NO: 88864 - DNA, 1044 bp, Rubrivivax gelatinosus PM1; identical to SEQ ID NO: 42422
  CDS (1)..(1044)

SEQ ID NO: 88865 - protein, 347 aa, Rubrivivax gelatinosus PM1; identical to SEQ ID NO: 42423

SEQ ID NO: 88866 - DNA, 1002 bp, Pseudomonas fluorescens PfO-1; identical to SEQ ID NO: 42424
  CDS (1)..(1002)

SEQ ID NO: 88867 - protein, 333 aa, Pseudomonas fluorescens PfO-1; identical to SEQ ID NO: 42425

SEQ ID NO: 88868 - DNA, 1002 bp, Rhodospirillum rubrum; identical to SEQ ID NO: 42426
  CDS (1)..(1002)

SEQ ID NO: 88869 - protein, 333 aa, Rhodospirillum rubrum; identical to SEQ ID NO: 42427

SEQ ID NO: 88870 - DNA, 1017 bp, Ralstonia metallidurans CH34; identical to SEQ ID NO: 42428
  CDS (1)..(1017)

SEQ ID NO: 88871 - protein, 338 aa, Ralstonia metallidurans CH34; identical to SEQ ID NO: 42429

SEQ ID NO: 88872 - DNA, 1020 bp, Ralstonia metallidurans CH34; identical to SEQ ID NO: 42430
  CDS (1)..(1020)

SEQ ID NO: 88873 - protein, 339 aa, Ralstonia metallidurans CH34; identical to SEQ ID NO: 42431

SEQ ID NO: 88874 - DNA, 999 bp, Burkholderia fungorum LB400; identical to SEQ ID NO: 42432
  CDS (1)..(999)

SEQ ID NO: 88875 - protein, 332 aa, Burkholderia fungorum LB400; identical to SEQ ID NO: 42433

SEQ ID NO: 88876 - DNA, 1002 bp, Burkholderia fungorum LB400; identical to SEQ ID NO: 42434
  CDS (1)..(1002)

SEQ ID NO: 88877 - protein, 333 aa, Burkholderia fungorum LB400; identical to SEQ ID NO: 42435

SEQ ID NO: 88878 - DNA, 996 bp, Burkholderia fungorum LB400; identical to SEQ ID NO: 42436
  CDS (1)..(996)

SEQ ID NO: 88879 - protein, 331 aa, Burkholderia fungorum LB400; identical to SEQ ID NO: 42437

SEQ ID NO: 88880 - DNA, 1020 bp, Burkholderia fungorum LB400; identical to SEQ ID NO: 42438
  CDS (1)..(1020)

SEQ ID NO: 88881 - protein, 339 aa, Burkholderia fungorum LB400; identical to SEQ ID NO: 42439

SEQ ID NO: 88882 - DNA, 993 bp, Novosphingobium aromaticivorans DSM 12444; identical to SEQ ID NO: 42440
  CDS (1)..(993)

SEQ ID NO: 88883 - protein, 330 aa, Novosphingobium aromaticivorans DSM 12444; identical to SEQ ID NO: 42441

SEQ ID NO: 88884 - DNA, 1014 bp, Cytophaga hutchinsonii; identical to SEQ ID NO: 42442
  CDS (1)..(1014)

SEQ ID NO: 88885 - protein, 337 aa, Cytophaga hutchinsonii; identical to SEQ ID NO: 42443

SEQ ID NO: 88886 - DNA, 987 bp, Silicibacter sp. TM1040; identical to SEQ ID NO: 42444
  CDS (1)..(987)

SEQ ID NO: 88887 - protein, 328 aa, Silicibacter sp. TM1040; identical to SEQ ID NO: 42445

SEQ ID NO: 88888 - DNA, 1020 bp, Psychrobacter sp. 273-4; identical to SEQ ID NO: 42446
  CDS (1)..(1020)

SEQ ID NO: 88889 - protein, 339 aa, Psychrobacter sp. 273-4; identical to SEQ ID NO: 42447

SEQ ID NO: 88890 - DNA, 1020 bp, Rubrobacter xylanophilus DSM 9941; identical to SEQ ID NO: 42448
  CDS (1)..(1020)

SEQ ID NO: 88891 - protein, 339 aa, Rubrobacter xylanophilus DSM 9941; identical to SEQ ID NO: 42449

SEQ ID NO: 88892 - DNA, 1002 bp, Polaromonas sp. JS666; identical to SEQ ID NO: 42450
  CDS (1)..(1002)

SEQ ID NO: 88893 - protein, 333 aa, Polaromonas sp. JS666; identical to SEQ ID NO: 42451

SEQ ID NO: 88894 - DNA, 954 bp, Corynebacterium glutamicum; identical to SEQ ID NO: 42452
  CDS (1)..(954): transl_table=11

SEQ ID NO: 88895 - protein, 317 aa, Corynebacterium glutamicum; identical to SEQ ID NO: 42453

SEQ ID NO: 88896 - DNA, 981 bp, uncultured bacterium 311; identical to SEQ ID NO: 42454
  CDS (1)..(981): transl_table=11

SEQ ID NO: 88897 - protein, 326 aa, uncultured bacterium 311; identical to SEQ ID NO: 42455

SEQ ID NO: 88898 - DNA, 1035 bp, Yersinia enterocolitica; identical to SEQ ID NO: 42456
  CDS (1)..(1035): transl_table=11

SEQ ID NO: 88899 - protein, 344 aa, Yersinia enterocolitica; identical to SEQ ID NO: 42457

SEQ ID NO: 88900 - DNA, 942 bp, Bacillus subtilis; identical to SEQ ID NO: 42458
  CDS (1)..(942): transl_table=11

SEQ ID NO: 88901 - protein, 313 aa, Bacillus subtilis; identical to SEQ ID NO: 42459

SEQ ID NO: 88902 - DNA, 1020 bp, Bacillus subtilis; identical to SEQ ID NO: 42460
  CDS (1)..(1020): transl_table=11

SEQ ID NO: 88903 - protein, 339 aa, Bacillus subtilis; identical to SEQ ID NO: 42461

SEQ ID NO: 88904 - DNA, 1005 bp, Bacillus subtilis; identical to SEQ ID NO: 42462
  CDS (1)..(1005): transl_table=11

SEQ ID NO: 88905 - protein, 334 aa, Bacillus subtilis; identical to SEQ ID NO: 42463

SEQ ID NO: 88906 - DNA, 1011 bp, Bacillus subtilis; identical to SEQ ID NO: 42464
  CDS (1)..(1011): transl_table=11

SEQ ID NO: 88907 - protein, 336 aa, Bacillus subtilis; identical to SEQ ID NO: 42465

SEQ ID NO: 88908 - DNA, 1002 bp, Bacillus subtilis; identical to SEQ ID NO: 42466
  CDS (1)..(1002): transl_table=11

SEQ ID NO: 88909 - protein, 333 aa, Bacillus subtilis; identical to SEQ ID NO: 42467

SEQ ID NO: 88910 - DNA, 26 bp, Primer
atgactgataaaaccattgcgttttc

SEQ ID NO: 88911 - DNA, 26 bp, Primer
ttatcccaacaactcttccttaacat

SEQ ID NO: 88912 - protein, 413 aa, consensus; identical to SEQ ID NO: 42470
  MISC_FEATURE (1)..(413): consensus for the disclosure of xaa see table XV

SEQ ID NO: 88913 - protein, 82 aa, consensus; identical to SEQ ID NO: 42471
  MISC_FEATURE (1)..(82): consensus for the disclosure of xaa see table XV

SEQ ID NO: 88914 - protein, 26 aa, consensus
  MISC_FEATURE (1)..(26): consensus for the disclosure of xaa see table XV
XXXXXXXXXXXXXAXXXXXXXXXXXX

SEQ ID NO: 88915 - DNA, 1488 bp, Escherichia coli; identical to SEQ ID NO: 64321
  CDS (1)..(1488)

SEQ ID NO: 88916 - protein, 495 aa, Escherichia coli [sequence omitted]

SEQ ID NO: 88917 - DNA, 1554 bp, Gluconobacter oxydans 621H; identical to SEQ ID NO: 64323
  CDS (1)..(1554)

SEQ ID NO: 88918 - protein, 517 aa, Gluconobacter oxydans 621H; identical to SEQ ID NO: 64324

SEQ ID NO: 88919 - DNA, 1170 bp, Lactobacillus acidophilus NCFM; identical to SEQ ID NO: 64325
  CDS (1)..(1170)

SEQ ID NO: 88920 - protein, 389 aa, Lactobacillus acidophilus NCFM; identical to SEQ ID NO: 64326

SEQ ID NO: 88921 - DNA, 1563 bp, Wolbachia endosymbiont strain TRS of Brugia malayi; identical to SEQ ID NO: 64327
  CDS (1)..(1563)

SEQ ID NO: 88922 - protein, 520 aa, Wolbachia endosymbiont strain TRS of Brugia malayi; identical to SEQ ID NO: 64328

SEQ ID NO: 88923 - DNA, 1377 bp, Ureaplasma parvum serovar 3 str. ATCC 700970; identical to SEQ ID NO: 64329
  CDS (1)..(1377): transl_table=4

SEQ ID NO: 88924 - protein, 458 aa, Ureaplasma parvum serovar 3 str. ATCC 700970; identical to SEQ ID NO: 64330

SEQ ID NO: 88925 - DNA, 1014 bp, Aquifex aeolicus VF5; identical to SEQ ID NO: 64331
  CDS (1)..(1014): transl_table=11

SEQ ID NO: 88926 - protein, 337 aa, Aquifex aeolicus VF5; identical to SEQ ID NO: 64332

SEQ ID NO: 88927 - DNA, 1458 bp, Treponema pallidum subsp. pallidum str. Nichols; identical to SEQ ID NO: 64333
  CDS (1)..(1458): transl_table=11

SEQ ID NO: 88928 - protein, 485 aa, Treponema pallidum subsp. pallidum str. Nichols; identical to SEQ ID NO: 64334

SEQ ID NO: 88929 - DNA, 1035 bp, Thermotoga maritima MSB8; identical to SEQ ID NO: 64335
  CDS (1)..(1035): transl_table=11

SEQ ID NO: 88930 - protein, 344 aa, Thermotoga maritima MSB8; identical to SEQ ID NO: 64336

SEQ ID NO: 88931 - DNA, 1488 bp, Vibrio cholerae O1 biovar eltor str. N16961; identical to SEQ ID NO: 64337
  CDS (1)..(1488): transl_table=11

SEQ ID NO: 88932 - protein, 495 aa, Vibrio cholerae O1 biovar eltor str. N16961; identical to SEQ ID NO: 64338

SEQ ID NO: 88933 - DNA, 1485 bp, Pasteurella multocida subsp. multocida str. Pm70; identical to SEQ ID NO: 64339
  CDS (1)..(1485): transl_table=11

SEQ ID NO: 88934 - protein, 494 aa, Pasteurella multocida subsp. multocida str. Pm70; identical to SEQ ID NO: 64340

SEQ ID NO: 88935 - DNA, 1482 bp, Pseudomonas aeruginosa PAO1; identical to SEQ ID NO: 64341
  CDS (1)..(1482): transl_table=11

SEQ ID NO: 88936 - protein, 493 aa, Pseudomonas aeruginosa PAO1; identical to SEQ ID NO: 64342

SEQ ID NO: 88937 - DNA, 1518 bp, Neisseria meningitidis Z2491; identical to SEQ ID NO: 64343
  CDS (1)..(1518): transl_table=11

SEQ ID NO: 88938 - protein, 505 aa, Neisseria meningitidis Z2491; identical to SEQ ID NO: 64344

SEQ ID NO: 88939 - DNA, 1206 bp, Deinococcus radiodurans R1; identical to SEQ ID NO: 64345
  CDS (1)..(1206): transl_table=11

SEQ ID NO: 88940 - protein, 401 aa, Deinococcus radiodurans R1; identical to SEQ ID NO: 64346

SEQ ID NO: 88941 - DNA, 1305 bp, Chlamydia muridarum; identical to SEQ ID NO: 64347
  CDS (1)..(1305): transl_table=11

SEQ ID NO: 88942 - protein, 434 aa, Chlamydia muridarum; identical to SEQ ID NO: 64348

SEQ ID NO: 88943 - DNA, 1512 bp, Xylella fastidiosa 9a5c; identical to SEQ ID NO: 64349
  CDS (1)..(1512): transl_table=11

SEQ ID NO: 88944 - protein, 503 aa, Xylella fastidiosa 9a5c; identical to SEQ ID NO: 64350

SEQ ID NO: 88945 - DNA, 1653 bp, Mycoplasma pulmonis UAB CTIP; identical to SEQ ID NO: 64351
  CDS (1)..(1653): transl_table=4

SEQ ID NO: 88946 - protein, 550 aa, Mycoplasma pulmonis UAB CTIP; identical to SEQ ID NO: 64352

SEQ ID NO: 88947 - DNA, 1032 bp, Mycobacterium tuberculosis CDC1551; identical to SEQ ID NO: 64353
  CDS (1)..(1032): transl_table=11

SEQ ID NO: 88948 - protein, 343 aa, Mycobacterium tuberculosis CDC1551; identical to SEQ ID NO: 64354

SEQ ID NO: 88949 - DNA, 1062 bp, Clostridium acetobutylicum ATCC 824; identical to SEQ ID NO: 64355
  CDS (1)..(1062): transl_table=11

SEQ ID NO: 88950 - protein, 353 aa, Clostridium acetobutylicum ATCC 824; identical to SEQ ID NO: 64356

SEQ ID NO: 88951 - DNA, 1629 bp, Sinorhizobium meliloti 1021; identical to SEQ ID NO: 64357
  CDS (1)..(1629): transl_table=11

SEQ ID NO: 88952 - protein, 542 aa, Sinorhizobium meliloti 1021; identical to SEQ ID NO: 64358

SEQ ID NO: 88953 - DNA, 1647 bp, Caulobacter crescentus CB15; identical to SEQ ID NO: 64359
  CDS (1)..(1647): transl_table=11

SEQ ID NO: 88954 - protein, 548 aa, Caulobacter crescentus CB15; identical to SEQ ID NO: 64360

SEQ ID NO: 88955 - DNA, 1377 bp, Synechocystis sp. PCC 6803; identical to SEQ ID NO: 64361
  CDS (1)..(1377): transl_table=11

SEQ ID NO: 88956 - protein, 458 aa, Synechocystis sp. PCC 6803; identical to SEQ ID NO: 64362

SEQ ID NO: 88957 - DNA, 1119 bp, Listeria innocua Clip11262; identical to SEQ ID NO: 64363
  CDS (1)..(1119): transl_table=11

SEQ ID NO: 88958 - protein, 372 aa, Listeria innocua Clip11262; identical to SEQ ID NO: 64364

SEQ ID NO: 88959 - DNA, 1278 bp, Nostoc sp. PCC 7120; identical to SEQ ID NO: 64365
  CDS (1)..(1278): transl_table=11

SEQ ID NO: 88960 - protein, 425 aa, Nostoc sp. PCC 7120; identical to SEQ ID NO: 64366

SEQ ID NO: 88961 - DNA, 1617 bp, Agrobacterium tumefaciens str. C58; identical to SEQ ID NO: 64367
  CDS (1)..(1617): transl_table=11

SEQ ID NO: 88962 - protein, 538 aa, Agrobacterium tumefaciens str. C58; identical to SEQ ID NO: 64368

SEQ ID NO: 88963 - DNA, 999 bp, Corynebacterium glutamicum ATCC 13032; identical to SEQ ID NO: 64369
  CDS (1)..(999): transl_table=11

SEQ ID NO: 88964 - protein, 332 aa, Corynebacterium glutamicum ATCC 13032; identical to SEQ ID NO: 64370

SEQ ID NO: 88965 - DNA, 1074 bp, Fusobacterium nucleatum subsp. nucleatum ATCC 25586; identical to SEQ ID NO: 64371
  CDS (1)..(1074): transl_table=11

SEQ ID NO: 88966 - protein, 357 aa, Fusobacterium nucleatum subsp. nucleatum ATCC 25586; identical to SEQ ID NO: 64372

SEQ ID NO: 88967 - DNA, 1041 bp, Thermoanaerobacter tengcongensis MB4; identical to SEQ ID NO: 64373
  CDS (1)..(1041): transl_table=11

SEQ ID NO: 88968 - protein, 346 aa, Thermoanaerobacter tengcongensis MB4; identical to SEQ ID NO: 64374

SEQ ID NO: 88969 - DNA, 1023 bp, Streptomyces coelicolor A3(2); identical to SEQ ID NO: 64375
  CDS (1)..(1023)

SEQ ID NO: 88970 - protein, 340 aa, Streptomyces coelicolor A3(2); identical to SEQ ID NO: 64376

SEQ ID NO: 88971 - DNA, 1512 bp, Xanthomonas campestris pv. campestris str. ATCC 33913; identical to SEQ ID NO: 64377
  CDS (1)..(1512): transl_table=11

SEQ ID NO: 88972 - protein, 503 aa, Xanthomonas campestris pv. campestris str. ATCC 33913; identical to SEQ ID NO: 64378

SEQ ID NO: 88973 - DNA, 1176 bp, Staphylococcus aureus subsp. aureus MW2; identical to SEQ ID NO: 64379
  CDS (1)..(1176): transl_table=11

SEQ ID NO: 88974 - protein, 391 aa, Staphylococcus aureus subsp. aureus MW2; identical to SEQ ID NO: 64380

SEQ ID NO: 88975 - DNA, 1107 bp, Bacillus anthracis str. A2012; identical to SEQ ID NO: 64381
  CDS (1)..(1107): transl_table=11

SEQ ID NO: 88976 - protein, 368 aa, Bacillus anthracis str. A2012; identical to SEQ ID NO: 64382

SEQ ID NO: 88977 - DNA, 1566 bp, Chlorobium tepidum TLS; identical to SEQ ID NO: 64383
  CDS (1)..(1566): transl_table=11

SEQ ID NO: 88978 - protein, 521 aa, Chlorobium tepidum TLS; identical to SEQ ID NO: 64384

SEQ ID NO: 88979 - DNA, 1506 bp, Yersinia pestis KIM; identical to SEQ ID NO: 64385
  CDS (1)..(1506): transl_table=11

SEQ ID NO: 88980 - protein, 501 aa, Yersinia pestis KIM; identical to SEQ ID NO: 64386

SEQ ID NO: 88981 - DNA, 1188 bp, Thermosynechococcus elongatus BP-1; identical to SEQ ID NO: 64387
  CDS (1)..(1188): transl_table=11

SEQ ID NO: 88982 - protein, 395 aa, Thermosynechococcus elongatus BP-1; identical to SEQ ID NO: 64388

SEQ ID NO: 88983 - DNA, 1140 bp, Streptococcus agalactiae 2603V/R; identical to SEQ ID NO: 64389
  CDS (1)..(1140): transl_table=11

SEQ ID NO: 88984 - protein, 379 aa, Streptococcus agalactiae 2603V/R; identical to SEQ ID NO: 64390

SEQ ID NO: 88985 - DNA, 1095 bp, Oceanobacillus iheyensis HTE831; identical to SEQ ID NO: 64391
  CDS (1)..(1095): transl_table=11

SEQ ID NO: 88986 - protein, 364 aa, Oceanobacillus iheyensis HTE831; identical to SEQ ID NO: 64392

SEQ ID NO: 88987 - DNA, 1068 bp, Bifidobacterium longum NCC2705; identical to SEQ ID NO: 64393
  CDS (1)..(1068): transl_table=11

SEQ ID NO: 88988 - protein, 355 aa, Bifidobacterium longum NCC2705; identical to SEQ ID NO: 64394

SEQ ID NO: 88989 - DNA, 1614 bp, Brucella suis 1330; identical to SEQ ID NO: 64395
  CDS (1)..(1614): transl_table=11

SEQ ID NO: 88990 - protein, 537 aa, Brucella suis 1330; identical to SEQ ID NO: 64396

SEQ ID NO: 88991 - DNA, 1383 bp, Leptospira interrogans serovar Lai str. 56601; identical to SEQ ID NO: 64397
  CDS (1)..(1383): transl_table=11

SEQ ID NO: 88992 - protein, 460 aa, Leptospira interrogans serovar Lai str. 56601; identical to SEQ ID NO: 64398

SEQ ID NO: 88993 - DNA, 1500 bp, Shewanella oneidensis MR-1; identical to SEQ ID NO: 64399
  CDS (1)..(1500): transl_table=11

SEQ ID NO: 88994 - protein, 499 aa, Shewanella oneidensis MR-1; identical to SEQ ID NO: 64400

SEQ ID NO: 88995 - DNA, 1794 bp, Mycoplasma penetrans HF-2; identical to SEQ ID NO: 64401
  CDS (1)..(1794): transl_table=4

SEQ ID NO: 88996 - protein, 597 aa, Mycoplasma penetrans HF-2; identical to SEQ ID NO: 64402

SEQ ID NO: 88997 - DNA, 1224 bp, Staphylococcus epidermidis ATCC 12228; identical to SEQ ID NO: 64403
  CDS (1)..(1224): transl_table=11

SEQ ID NO: 88998 - protein, 407 aa, Staphylococcus epidermidis ATCC 12228; identical to SEQ ID NO: 64404

SEQ ID NO: 88999 - DNA, 1611 bp, Bradyrhizobium japonicum USDA 110; identical to SEQ ID NO: 64405
  CDS (1)..(1611)

SEQ ID NO: 89000 - protein, 536 aa, Bradyrhizobium japonicum USDA 110; identical to SEQ ID NO: 64406

SEQ ID NO: 89001 - DNA, 1086 bp, Clostridium tetani E88; identical to SEQ ID NO: 64407
  CDS (1)..(1086): transl_table=11

SEQ ID NO: 89002 - protein, 361 aa, Clostridium tetani E88; identical to SEQ ID NO: 64408

SEQ ID NO: 89003 - DNA, 960 bp, Tropheryma whipplei str. Twist; identical to SEQ ID NO: 64409
  CDS (1)..(960): transl_table=11

SEQ ID NO: 89004 - protein, 319 aa, Tropheryma whipplei str. Twist; identical to SEQ ID NO: 64410

SEQ ID NO: 89005 - DNA, 1503 bp, Salmonella enterica subsp. enterica serovar Typhi Ty2; identical to SEQ ID NO: 64411
  CDS (1)..(1503): transl_table=11

SEQ ID NO: 89006 - protein, 500 aa, Salmonella enterica subsp. enterica serovar Typhi Ty2; identical to SEQ ID NO: 64412

SEQ ID NO: 89007 - DNA, 1320 bp, Bacteroides thetaiotaomicron VPI-5482; identical to SEQ ID NO: 64413
  CDS (1)..(1320): transl_table=11

SEQ ID NO: 89008 - protein, 439 aa, Bacteroides thetaiotaomicron VPI-5482; identical to SEQ ID NO: 64414

SEQ ID NO: 89009 - DNA, 1200 bp, Enterococcus faecalis V583; identical to SEQ ID NO: 64415
  CDS (1)..(1200): transl_table=11

SEQ ID NO: 89010 - protein, 399 aa, Enterococcus faecalis V583; identical to SEQ ID NO: 64416

SEQ ID NO: 89011 - DNA, 1512 bp, Coxiella burnetii RSA 493; identical to SEQ ID NO: 64417
  CDS (1)..(1512): transl_table=11

SEQ ID NO: 89012 - protein, 503 aa, Coxiella burnetii RSA 493; identical to SEQ ID NO: 64418

SEQ ID NO: 89013 - DNA, 1305 bp, Chlamydophila caviae GPIC; identical to SEQ ID NO: 64419
  CDS (1)..(1305): transl_table=11

SEQ ID NO: 89014 - protein, 434 aa, Chlamydophila caviae GPIC; identical to SEQ ID NO: 64420

SEQ ID NO: 89015 - DNA, 1107 bp, Bacillus cereus ATCC 14579; identical to SEQ ID NO: 64421
  CDS (1)..(1107): transl_table=11

SEQ ID NO: 89016 - protein, 368 aa, Bacillus cereus ATCC 14579; identical to SEQ ID NO: 64422

SEQ ID NO: 89017 - DNA, 1473 bp, Nitrosomonas europaea ATCC 19718; identical to SEQ ID NO: 64423
  CDS (1)..(1473): transl_table=11

SEQ ID NO: 89018 - protein, 490 aa, Nitrosomonas europaea ATCC 19718; identical to SEQ ID NO: 64424

SEQ ID NO: 89019 - DNA, 1128 bp, Helicobacter hepaticus ATCC 51449; identical to SEQ ID NO: 64425
  CDS (1)..(1128): transl_table=11

SEQ ID NO: 89020 - protein, 375 aa, Helicobacter hepaticus ATCC 51449; identical to SEQ ID NO: 64426

SEQ ID NO: 89021 - DNA, 1497 bp, Rhodopirellula baltica SH 1; identical to SEQ ID NO: 64427
  CDS (1)..(1497): transl_table=11

SEQ ID NO: 89022 - protein, 498 aa, Rhodopirellula baltica SH 1; identical to SEQ ID NO: 64428

SEQ ID NO: 89023 - DNA, 1485 bp, Wigglesworthia glossinidia endosymbiont of Glossina brevipalpis; identical to SEQ ID NO: 64429
  CDS (1)..(1485): transl_table=11

SEQ ID NO: 89024 - protein, 494 aa, Wigglesworthia glossinidia endosymbiont of Glossina brevipalpis; identical to SEQ ID NO: 64430

SEQ ID NO: 89025 - DNA, 1482 bp, Haemophilus ducreyi 35000HP; identical to SEQ ID NO: 64431
  CDS (1)..(1482): transl_table=11

SEQ ID NO: 89026 - protein, 493 aa, Haemophilus ducreyi 35000HP; identical to SEQ ID NO: 64432

SEQ ID NO: 89027 - DNA, 1419 bp, Prochlorococcus marinus subsp. marinus str. CCMP1375; identical to SEQ ID NO: 64433
  CDS (1)..(1419): transl_table=11

SEQ ID NO: 89028 - protein, 472 aa, Prochlorococcus marinus subsp. marinus str. CCMP1375; identical to SEQ ID NO: 64434

SEQ ID NO: 89029 - DNA, 1506 bp, Candidatus Blochmannia floridanus; identical to SEQ ID NO: 64435
  CDS (1)..(1506): transl_table=11

SEQ ID NO: 89030 - protein, 501 aa, Candidatus Blochmannia floridanus; identical to SEQ ID NO: 64436

SEQ ID NO: 89031 - DNA, 1479 bp, Bordetella bronchiseptica RB50; identical to SEQ ID NO: 64437
  CDS (1)..(1479): transl_table=11

SEQ ID NO: 89032 - protein, 492 aa, Bordetella bronchiseptica RB50; identical to SEQ ID NO: 64438

SEQ ID NO: 89033 - DNA, 1449 bp, Prochlorococcus marinus str. MIT 9313; identical to SEQ ID NO: 64439
  CDS (1)..(1449): transl_table=11

SEQ ID NO: 89034 - protein, 482 aa, Prochlorococcus marinus str. MIT 9313; identical to SEQ ID NO: 64440

SEQ ID NO: 89035 - DNA, 1428 bp, Synechococcus sp. WH 8102; identical to SEQ ID NO: 64441
  CDS (1)..(1428): transl_table=11

SEQ ID NO: 89036 - protein, 475 aa, Synechococcus sp. WH 8102; identical to SEQ ID NO: 64442

SEQ ID NO: 89037 - DNA, 1479 bp, Chromobacterium violaceum ATCC 12472; identical to SEQ ID NO: 64443
  CDS (1)..(1479): transl_table=11

SEQ ID NO: 89038 - protein, 492 aa, Chromobacterium violaceum ATCC 12472; identical to SEQ ID NO: 64444

SEQ ID NO: 89039 - DNA, 1335 bp, Porphyromonas gingivalis W83; identical to SEQ ID NO: 64445
  CDS (1)..(1335): transl_table=11

SEQ ID NO: 89040 - protein, 444 aa, Porphyromonas gingivalis W83; identical to SEQ ID NO: 64446

SEQ ID NO: 89041 - DNA, 1152 bp, Gloeobacter violaceus PCC 7421; identical to SEQ ID NO: 64447
  CDS (1)..(1152): transl_table=11

SEQ ID NO: 89042 - protein, 383 aa, Gloeobacter violaceus PCC 7421; identical to SEQ ID NO: 64448

SEQ ID NO: 89043 - DNA, 1509 bp, Photorhabdus luminescens subsp. laumondii TTO1; identical to SEQ ID NO: 64449
  CDS (1)..(1509): transl_table=11

SEQ ID NO: 89044 - protein, 502 aa, Photorhabdus luminescens subsp. laumondii TTO1; identical to SEQ ID NO: 64450

SEQ ID NO: 89045 - DNA, 1614 bp, Rhodopseudomonas palustris CGA009; identical to SEQ ID NO: 64451
  CDS (1)..(1614): transl_table=11

SEQ ID NO: 89046 - protein, 537 aa, Rhodopseudomonas palustris CGA009; identical to SEQ ID NO: 64452

SEQ ID NO: 89047 - DNA, 1158 bp, Geobacter sulfurreducens PCA; identical to SEQ ID NO: 64453
  CDS (1)..(1158): transl_table=11

SEQ ID NO: 89048 - protein, 385 aa, Geobacter sulfurreducens PCA; identical to SEQ ID NO: 64454

SEQ ID NO: 89049 - DNA, 1389 bp, Bdellovibrio bacteriovorus HD100; identical to SEQ ID NO: 64455
  CDS (1)..(1389): transl_table=11

SEQ ID NO: 89050 - protein, 462 aa, Bdellovibrio bacteriovorus HD100; identical to SEQ ID NO: 64456

SEQ ID NO: 89051 - DNA, 1488 bp, Treponema denticola ATCC 35405; identical to SEQ ID NO: 64457
  CDS (1)..(1488): transl_table=11

SEQ ID NO: 89052 - protein, 495 aa, Treponema denticola ATCC 35405; identical to SEQ ID NO: 64458

SEQ ID NO: 89053 - DNA, 1755 bp, Mycoplasma mycoides subsp. mycoides SC str. PG1; identical to SEQ ID NO: 64459
  CDS (1)..(1755): transl_table=4

SEQ ID NO: 89054 - protein, 584 aa, Mycoplasma mycoides subsp. mycoides SC str. PG1; identical to SEQ ID NO: 64460

SEQ ID NO: 89055 - DNA, 1275 bp, Parachlamydia sp. UWE25; identical to SEQ ID NO: 64461
  CDS (1)..(1275): transl_table=11

SEQ ID NO: 89056 - protein, 424 aa, Parachlamydia sp. UWE25; identical to SEQ ID NO: 64462

SEQ ID NO: 89057 - DNA, 1287 bp, Desulfovibrio vulgaris subsp. vulgaris str. Hildenborough; identical to SEQ ID NO: 64463
  CDS (1)..(1287): transl_table=11

SEQ ID NO: 89058 - protein, 428 aa, Desulfovibrio vulgaris subsp. vulgaris str. Hildenborough; identical to SEQ ID NO: 64464

SEQ ID NO: 89059 - DNA, 1587 bp, Bartonella henselae str. Houston-1; identical to SEQ ID NO: 64465
  CDS (1)..(1587): transl_table=11

SEQ ID NO: 89060 - protein, 528 aa, Bartonella henselae str. Houston-1; identical to SEQ ID NO: 64466

SEQ ID NO: 89061 - DNA, 1485 bp, Acinetobacter sp. ADP1; identical to SEQ ID NO: 64467
  CDS (1)..(1485): transl_table=11

SEQ ID NO: 89062 - protein, 494 aa, Acinetobacter sp. ADP1; identical to SEQ ID NO: 64468

SEQ ID NO: 89063 - DNA, 1530 bp, Erwinia carotovora subsp. atroseptica SCRI1043; identical to SEQ ID NO: 64469
  CDS (1)..(1530)

SEQ ID NO: 89064 - protein, 509 aa, Erwinia carotovora subsp. atroseptica SCRI1043; identical to SEQ ID NO: 64470

SEQ ID NO: 89065 - DNA, 1416 bp, Mesoplasma florum L1; identical to SEQ ID NO: 64471
  CDS (1)..(1416): transl_table=4

SEQ ID NO: 89066 - protein, 471 aa, Mesoplasma florum L1; identical to SEQ ID NO: 64472

SEQ ID NO: 89067 - DNA, 972 bp, Propionibacterium acnes KPA171202; identical to SEQ ID NO: 64473
  CDS (1)..(972): transl_table=11

SEQ ID NO: 89068 - protein, 323 aa, Propionibacterium acnes KPA171202; identical to SEQ ID NO: 64474

SEQ ID NO: 89069 - DNA, 999 bp, Leifsonia xyli subsp. xyli str. CTCB07; identical to SEQ ID NO: 64475
  CDS (1)..(999): transl_table=11

SEQ ID NO: 89070 - protein, 332 aa, Leifsonia xyli subsp. xyli str. CTCB07; identical to SEQ ID NO: 64476

SEQ ID NO: 89071 - DNA, 1401 bp, Desulfotalea psychrophila LSv54; identical to SEQ ID NO: 64477
  CDS (1)..(1401): transl_table=11

SEQ ID NO: 89072 - protein, 466 aa, Desulfotalea psychrophila LSv54; identical to SEQ ID NO: 64478

SEQ ID NO: 89073 - DNA, 1449 bp, Borrelia garinii PBi; identical to SEQ ID NO: 64479
  CDS (1)..(1449): transl_table=11

SEQ ID NO: 89074 - protein, 482 aa, Borrelia garinii PBi; identical to SEQ ID NO: 64480

SEQ ID NO: 89075 - DNA, 1083 bp, Symbiobacterium thermophilum IAM 14863; identical to SEQ ID NO: 64481
  CDS (1)..(1083): transl_table=11

SEQ ID NO: 89076 - protein, 360 aa, Symbiobacterium thermophilum IAM 14863; identical to SEQ ID NO: 64482

SEQ ID NO: 89077 - DNA, 1506 bp, Mannheimia succiniciproducens MBEL55E; identical to SEQ ID NO: 64483
  CDS (1)..(1506): transl_table=11

SEQ ID NO: 89078 - protein, 501 aa, Mannheimia succiniciproducens MBEL55E; identical to SEQ ID NO: 64484

SEQ ID NO: 89079 - DNA, 1263 bp, Bacteroides fragilis YCH46; identical to SEQ ID NO: 64485
  CDS (1)..(1263): transl_table=11

SEQ ID NO: 89080 - protein, 420 aa, Bacteroides fragilis YCH46; identical to SEQ ID NO: 64486

SEQ ID NO: 89081 - DNA, 1500 bp, Methylococcus capsulatus str. Bath; identical to SEQ ID NO: 64487
  CDS (1)..(1500): transl_table=11

SEQ ID NO: 89082 - protein, 499 aa, Methylococcus capsulatus str. Bath; identical to SEQ ID NO: 64488

SEQ ID NO: 89083 - DNA, 1029 bp, Nocardia farcinica IFM 10152; identical to SEQ ID NO: 64489
  CDS (1)..(1029): transl_table=11

SEQ ID NO: 89084 - protein, 342 aa, Nocardia farcinica IFM 10152; identical to SEQ ID NO: 64490

SEQ ID NO: 89085 - DNA, 1479 bp, Legionella pneumophila str. Paris; identical to SEQ ID NO: 64491
  CDS (1)..(1479): transl_table=11

SEQ ID NO: 89086 - protein, 492 aa, Legionella pneumophila str. Paris; identical to SEQ ID NO: 64492

SEQ ID NO: 89087 - DNA, 1488 bp, Photobacterium profundum SS9; identical to SEQ ID NO: 64493
  CDS (1)..(1488): transl_table=11

SEQ ID NO: 89088 - protein, 495 aa, Photobacterium profundum SS9; identical to SEQ ID NO: 64494

SEQ ID NO: 89089 - DNA, 1548 bp, Anaplasma marginale str. St. Maries; identical to SEQ ID NO: 64495
  CDS (1)..(1548): transl_table=11

SEQ ID NO: 89090 - protein, 515 aa, Anaplasma marginale str. St. Maries; identical to SEQ ID NO: 64496

SEQ ID NO: 89091 - DNA, 1500 bp, Idiomarina loihiensis L2TR; identical to SEQ ID NO: 64497
  CDS (1)..(1500): transl_table=11

SEQ ID NO: 89092 - protein, 499 aa, Idiomarina loihiensis L2TR; identical to SEQ ID NO: 64498

SEQ ID NO: 89093 - DNA, 1476 bp, Azoarcus sp. EbN1; identical to SEQ ID NO: 64499
  CDS (1)..(1476): transl_table=11

SEQ ID NO: 89094 - protein, 491 aa, Azoarcus sp. EbN1; identical to SEQ ID NO: 64500

SEQ ID NO: 89095 - DNA, 1626 bp, Zymomonas mobilis subsp. mobilis ZM4; identical to SEQ ID NO: 64501
  CDS (1)..(1626): transl_table=11

SEQ ID NO: 89096 - protein, 541 aa, Zymomonas mobilis subsp. mobilis ZM4; identical to SEQ ID NO: 64502

SEQ ID NO: 89097 - DNA, 1470 bp, Francisella tularensis subsp. tularensis Schu 4; identical to SEQ ID NO: 64503
  CDS (1)..(1470): transl_table=11

SEQ ID NO: 89098 - protein, 489 aa, Francisella tularensis subsp. tularensis Schu 4; identical to SEQ ID NO: 64504

SEQ ID NO: 89099 - DNA, 1326 bp, Synechococcus elongatus PCC 6301; identical to SEQ ID NO: 64505
  CDS (1)..(1326): transl_table=11

SEQ ID NO: 89100 - protein, 441 aa, Synechococcus elongatus PCC 6301; identical to SEQ ID NO: 64506

SEQ ID NO: 89101 - DNA, 1089 bp, Campylobacter jejuni RM1221; identical to SEQ ID NO: 64507
  CDS (1)..(1089): transl_table=11

SEQ ID NO: 89102 - protein, 362 aa, Campylobacter jejuni RM1221; identical to SEQ ID NO: 64508

SEQ ID NO: 89103 - DNA, 1476 bp, Dehalococcoides ethenogenes 195; identical to SEQ ID NO: 64509
  CDS (1)..(1476): transl_table=11

SEQ ID NO: 89104 - protein, 491 aa, Dehalococcoides ethenogenes 195; identical to SEQ ID NO: 64510

SEQ ID NO: 89105 - DNA, 1608 bp, Rhodobacter sphaeroides 2.4.1; identical to SEQ ID NO: 64511
  CDS (1)..(1608)

SEQ ID NO: 89106 - protein, 535 aa, Rhodobacter sphaeroides 2.4.1; identical to SEQ ID NO: 64512

SEQ ID NO: 89107 - DNA, 1509 bp, Magnetospirillum magnetotacticum MS-1; identical to SEQ ID NO: 64513
  CDS (1)..(1509)

SEQ ID NO: 89108 - protein, 502 aa, Magnetospirillum magnetotacticum MS-1; identical to SEQ ID NO: 64514

SEQ ID NO: 89109 - DNA, 1098 bp, Leuconostoc mesenteroides subsp. mesenteroides ATCC 8293; identical to SEQ ID NO: 64515
  CDS (1)..(1098)

SEQ ID NO: 89110 - protein, 365 aa, Leuconostoc mesenteroides subsp. mesenteroides ATCC 8293; identical to SEQ ID NO: 64516

SEQ ID NO: 89111 - DNA, 1419 bp, Azotobacter vinelandii; identical to SEQ ID NO: 64517
  CDS (1)..(1419)

SEQ ID NO: 89112 - protein, 472 aa, Azotobacter vinelandii; identical to SEQ ID NO: 64518

SEQ ID NO: 89113 - DNA, 1389 bp, Desulfitobacterium hafniense DCB-2; identical to SEQ ID NO: 64519
  CDS (1)..(1389)

SEQ ID NO: 89114 - protein, 462 aa, Desulfitobacterium hafniense DCB-2; identical to SEQ ID NO: 64520

SEQ ID NO: 89115 - DNA, 1272 bp, Nostoc punctiforme PCC 73102; identical to SEQ ID NO: 64521
  CDS (1)..(1272)

SEQ ID NO: 89116 - protein, 423 aa, Nostoc punctiforme PCC 73102; identical to SEQ ID NO: 64522

SEQ ID NO: 89117 - DNA, 933 bp, Bifidobacterium longum DJO10A; identical to SEQ ID NO: 64523
  CDS (1)..(933)

SEQ ID NO: 89118 - protein, 310 aa, Bifidobacterium longum DJO10A; identical to SEQ ID NO: 64524

SEQ ID NO: 89119 - DNA, 1482 bp, Actinobacillus pleuropneumoniae serovar 1 str. 4074; identical to SEQ ID NO: 64525
  CDS (1)..(1482)

SEQ ID NO: 89120 - protein, 493 aa, Actinobacillus pleuropneumoniae serovar 1 str. 4074; identical to SEQ ID NO: 64526

SEQ ID NO: 89121 - DNA, 1485 bp, Psychrobacter sp. 273-4; identical to SEQ ID NO: 64527
  CDS (1)..(1485)

SEQ ID NO: 89122 - protein, 494 aa, Psychrobacter sp. 273-4; identical to SEQ ID NO: 64528

SEQ ID NO: 89123 - DNA, 1473 bp, Dechloromonas aromatica RCB; identical to SEQ ID NO: 64529
  CDS (1)..(1473)

SEQ ID NO: 89124 - protein, 490 aa, Dechloromonas aromatica RCB; identical to SEQ ID NO: 64530

SEQ ID NO: 89125 - DNA, 1488 bp, Haemophilus influenzae R2846; identical to SEQ ID NO: 64531
  CDS (1)..(1488)

SEQ ID NO: 89126 - protein, 495 aa, Haemophilus influenzae R2846; identical to SEQ ID NO: 64532

SEQ ID NO: 89127 - DNA, 1467 bp, Methylobacillus flagellatus KT; identical to SEQ ID NO: 64533
  CDS (1)..(1467)

SEQ ID NO: 89128 - protein, 488 aa, Methylobacillus flagellatus KT; identical to SEQ ID NO: 64534

SEQ ID NO: 89129 - DNA, 1275 bp, Crocosphaera watsonii WH 8501; identical to SEQ ID NO: 64535
  CDS (1)..(1275)

SEQ ID NO: 89130 - protein, 424 aa, Crocosphaera watsonii WH 8501; identical to SEQ ID NO: 64536

SEQ ID NO: 89131 - DNA, 1128 bp, Exiguobacterium sp. 255-15; identical to SEQ ID NO: 64537
  CDS (1)..(1128)

SEQ ID NO: 89132 - protein, 375 aa, Exiguobacterium sp. 255-15; identical to SEQ ID NO: 64538

SEQ ID NO: 89133 - DNA, 1611 bp, Mesorhizobium sp. BNC1; identical to SEQ ID NO: 64539
  CDS (1)..(1611)

SEQ ID NO: 89134 - protein, 536 aa, Mesorhizobium sp. BNC1; identical to SEQ ID NO: 64540

SEQ ID NO: 89135 - DNA, 1146 bp, Rubrobacter xylanophilus DSM 9941; identical to SEQ ID NO: 64541
  CDS (1)..(1146)

SEQ ID NO: 89136 - protein, 381 aa, Rubrobacter xylanophilus DSM 9941; identical to SEQ ID NO: 64542

SEQ ID NO: 89137 - DNA, 1554 bp, Ehrlichia canis str. Jake; identical to SEQ ID NO: 64543
  CDS (1)..(1554)

SEQ ID NO: 89138 - protein, 517 aa, Ehrlichia canis str. Jake; identical to SEQ ID NO: 64544

SEQ ID NO: 89139 - DNA, 1479 bp, Rubrivivax gelatinosus PM1; identical to SEQ ID NO: 64545
  CDS (1)..(1479)

SEQ ID NO: 89140 - protein, 492 aa, Rubrivivax gelatinosus PM1; identical to SEQ ID NO: 64546

SEQ ID NO: 89141 - DNA, 1551 bp, Rhodospirillum rubrum; identical to SEQ ID NO: 64547
  CDS (1)..(1551)

SEQ ID NO: 89142 - protein, 516 aa, Rhodospirillum rubrum; identical to SEQ ID NO: 64548

SEQ ID NO: 89143 - DNA, 1476 bp, Ralstonia metallidurans CH34; identical to SEQ ID NO: 64549
  CDS (1)..(1476)

SEQ ID NO: 89144 - protein, 491 aa, Ralstonia metallidurans CH34; identical to SEQ ID NO: 64550

SEQ ID NO: 89145 - DNA, 1476 bp, Burkholderia fungorum LB400; identical to SEQ ID NO: 64551
  CDS (1)..(1476)

SEQ ID NO: 89146 - protein, 491 aa, Burkholderia fungorum LB400; identical to SEQ ID NO: 64552

SEQ ID NO: 89147 - DNA, 1521 bp, Magnetococcus sp. MC-1; identical to SEQ ID NO: 64553
  CDS (1)..(1521)

SEQ ID NO: 89148 - protein, 506 aa, Magnetococcus sp. MC-1; identical to SEQ ID NO: 64554

SEQ ID NO: 89149 - DNA, 1635 bp, Novosphingobium aromaticivorans DSM 12444; identical to SEQ ID NO: 64555
  CDS (1)..(1635)

SEQ ID NO: 89150 - protein, 544 aa, Novosphingobium aromaticivorans DSM 12444; identical to SEQ ID NO: 64556

SEQ ID NO: 89151 - DNA, 1257 bp, Cytophaga hutchinsonii; identical to SEQ ID NO: 64557
  CDS (1)..(1257)

SEQ ID NO: 89152 - protein, 418 aa, Cytophaga hutchinsonii; identical to SEQ ID NO: 64558

SEQ ID NO: 89153 - DNA, 1482 bp, Microbulbifer degradans 2-40; identical to SEQ ID NO: 64559
  CDS (1)..(1482)

SEQ ID NO: 89154 - protein, 493 aa, Microbulbifer degradans 2-40; identical to SEQ ID NO: 64560

SEQ ID NO: 89155 - DNA, 1422 bp, Oenococcus oeni PSU-1; identical to SEQ ID NO: 64561
  CDS (1)..(1422)

SEQ ID NO: 89156 - protein, 473 aa, Oenococcus oeni PSU-1; identical to SEQ ID NO: 64562

SEQ ID NO: 89157 - DNA, 1089 bp, Pediococcus pentosaceus ATCC 25745; identical to SEQ ID NO: 64563
  CDS (1)..(1089)

SEQ ID NO: 89158 - protein, 362 aa, Pediococcus pentosaceus ATCC 25745; identical to SEQ ID NO: 64564

SEQ ID NO: 89159 - DNA, 1281 bp, Trichodesmium erythraeum IMS101; identical to SEQ ID NO: 64565
  CDS (1)..(1281)

SEQ ID NO: 89160 - protein, 426 aa, Trichodesmium erythraeum IMS101; identical to SEQ ID NO: 64566

SEQ ID NO: 89161 - DNA, 1089 bp, Moorella thermoacetica ATCC 39073; identical to SEQ ID NO: 64567
  CDS (1)..(1089)

SEQ ID NO: 89162 - protein, 362 aa, Moorella thermoacetica ATCC 39073; identical to SEQ ID NO: 64568

SEQ ID NO: 89163 - DNA, 1479 bp, Thiobacillus denitrificans ATCC 25259; identical to SEQ ID NO: 64569
  CDS (1)..(1479)

SEQ ID NO: 89164 - protein, 492 aa, Thiobacillus denitrificans ATCC 25259; identical to SEQ ID NO: 64570

SEQ ID NO: 89165 - DNA, 1617 bp, Silicibacter sp. TM1040; identical to SEQ ID NO: 64571
  CDS (1)..(1617)

SEQ ID NO: 89166 - protein, 538 aa, Silicibacter sp. TM1040; identical to SEQ ID NO: 64572

SEQ ID NO: 89167 - DNA, 1512 bp, Rickettsia akari str. Hartford; identical to SEQ ID NO: 64573
  CDS (1)..(1512)

SEQ ID NO: 89168 - protein, 503 aa, Rickettsia akari str. Hartford; identical to SEQ ID NO: 64574

SEQ ID NO: 89169 - DNA, 1476 bp, Ralstonia eutropha JMP134; identical to SEQ ID NO: 64575
  CDS (1)..(1476)

SEQ ID NO: 89170 - protein, 491 aa, Ralstonia eutropha JMP134; identical to SEQ ID NO: 64576

SEQ ID NO: 89171 - DNA, 1329 bp, Chloroflexus aurantiacus; identical to SEQ ID NO: 64577
  CDS (1)..(1329)

SEQ ID NO: 89172 - protein, 442 aa, Chloroflexus aurantiacus; identical to SEQ ID NO: 64578

SEQ ID NO: 89173 - DNA, 1521 bp, Polaromonas sp. JS666; identical to SEQ ID NO: 64579
  CDS (1)..(1521)

SEQ ID NO: 89174 - protein, 506 aa, Polaromonas sp. JS666; identical to SEQ ID NO: 64580

SEQ ID NO: 89175 - DNA, 1116 bp, Bacillus subtilis; identical to SEQ ID NO: 64581
  CDS (1)..(1116): transl_table=11

SEQ ID NO: 89176 - protein, 371 aa, Bacillus subtilis; identical to SEQ ID NO: 64582

SEQ ID NO: 89177 - DNA, 1449 bp, Borrelia burgdorferi; identical to SEQ ID NO: 64583
  CDS (1)..(1449): transl_table=11

SEQ ID NO: 89178 - protein, 482 aa, Borrelia burgdorferi; identical to SEQ ID NO: 64584

SEQ ID NO: 89179 - DNA, 1488 bp, Buchnera aphidicola; identical to SEQ ID NO: 64585
  CDS (1)..(1488): transl_table=11

SEQ ID NO: 89180 - protein, 495 aa, Buchnera aphidicola; identical to SEQ ID NO: 64586

SEQ ID NO: 89181 - DNA, 1494 bp, Buchnera aphidicola; identical to SEQ ID NO: 64587
  CDS (1)..(1494): transl_table=11

SEQ ID NO: 89182 - protein, 497 aa, Buchnera aphidicola; identical to SEQ ID NO: 64588

SEQ ID NO: 89183 - DNA, 1188 bp, Helicobacter pylori J99; identical to SEQ ID NO: 64589
  CDS (1)..(1188): transl_table=11

SEQ ID NO: 89184 - protein, 395 aa, Helicobacter pylori J99; identical to SEQ ID NO: 64590

SEQ ID NO: 89185 - DNA, 1164 bp, Thermus thermophilus; identical to SEQ ID NO: 64591
  CDS (1)..(1164): transl_table=11

SEQ ID NO: 89186 - protein, 387 aa, Thermus thermophilus; identical to SEQ ID NO: 64592

SEQ ID NO: 89187 - DNA, 26 bp, Primer
atgaacaaagaaattttggctgtagt

SEQ ID NO: 89188 - DNA, 22 bp, Primer
ttacgcttcgtcaccgaaccag

SEQ ID NO: 89189 - protein, 427 aa, consensus; identical to SEQ ID NO: 64595
  MISC_FEATURE (1)..(427): consensus for the disclosure of xaa see table XV

SEQ ID NO: 89190 - protein, 153 aa, consensus; identical to SEQ ID NO: 64596
  MISC_FEATUREG301566 (1)..(153): consensus for the disclosure of xaa see table XV

SEQ ID NO: 89191 - DNA, 1344 bp, Escherichia coli K12; identical to SEQ ID NO: 25117
  CDS (1)..(1344)

SEQ ID NO: 89192 - protein, 447 aa, Escherichia coli K12; identical to SEQ ID NO: 25118

SEQ ID NO: 89193 - DNA, 1215 bp, Vibrio cholerae; identical to SEQ ID NO: 25119
  CDS (1)..(1215)

SEQ ID NO: 89194 - protein, 404 aa, Vibrio cholerae; identical to SEQ ID NO: 25120

SEQ ID NO: 89195 - DNA, 1215 bp, Listeria monocytogenes; identical to SEQ ID NO: 25121
  CDS (1)..(1215)

SEQ ID NO: 89196 - protein, 404 aa, Listeria monocytogenes; identical to SEQ ID NO: 25122

SEQ ID NO: 89197 - DNA, 1224 bp, Agrobacterium tumefaciens; identical to SEQ ID NO: 25123
  CDS (1)..(1224)

SEQ ID NO: 89198 - protein, 407 aa, Agrobacterium tumefaciens; identical to SEQ ID NO: 25124

SEQ ID NO: 89199 - DNA, 1410 bp, Salmonella enterica subsp. enterica serovar Typhi; identical to SEQ ID NO: 25125
  CDS (1)..(1410)

SEQ ID NO: 89200 - protein, 469 aa, Salmonella enterica subsp. enterica serovar Typhi; identical to SEQ ID NO: 25126

SEQ ID NO: 89201 - DNA, 1368 bp, Yersinia pestis; identical to SEQ ID NO: 25127
  CDS (1)..(1368)

SEQ ID NO: 89202 - protein, 455 aa, Yersinia pestis; identical to SEQ ID NO: 25128

SEQ ID NO: 89203 - DNA, 1203 bp, Nostoc sp. PCC 7120; identical to SEQ ID NO: 25129
  CDS (1)..(1203)

SEQ ID NO: 89204 - protein, 400 aa, Nostoc sp. PCC 7120; identical to SEQ ID NO: 25130

SEQ ID NO: 89205 - DNA, 1215 bp, Listeria innocua; identical to SEQ ID NO: 25131
  CDS (1)..(1215)

SEQ ID NO: 89206 - protein, 404 aa, Listeria innocua; identical to SEQ ID NO: 25132

SEQ ID NO: 89207 - DNA, 2317 bp, Saccharomyces cerevisiae; identical to SEQ ID NO: 25133
  CDS (762)..(2024)

SEQ ID NO: 89208 - protein, 420 aa, Saccharomyces cerevisiae; identical to SEQ ID NO: 25134

SEQ ID NO: 89209 - DNA, 1239 bp, Mus musculus (house mouse); identical to SEQ ID NO: 25135
  CDS (1)..(1239)

SEQ ID NO: 89210 - protein, 412 aa, Mus musculus (house mouse); identical to SEQ ID NO: 25136

SEQ ID NO: 89211 - DNA, 2098 bp, Methanococcus vannielii; identical to SEQ ID NO: 25137
  CDS (798)..(1991)

SEQ ID NO: 89212 - protein, 397 aa, Methanococcus vannielii; identical to SEQ ID NO: 25138

SEQ ID NO: 89213 - DNA, 2171 bp, Streptomyces coelicolor; identical to SEQ ID NO: 25139
  CDS (317)..(1780)

SEQ ID NO: 89214 - protein, 487 aa, Streptomyces coelicolor; identical to SEQ ID NO: 25140

SEQ ID NO: 89215 - DNA, 1212 bp, Bacillus subtilis; identical to SEQ ID NO: 25141
  CDS (1)..(1212)

SEQ ID NO: 89216 - protein, 403 aa, Bacillus subtilis; identical to SEQ ID NO: 25142

SEQ ID NO: 89217 - DNA, 1206 bp, Aquifex aeolicus; identical to SEQ ID NO: 25143
  CDS (1)..(1206)

SEQ ID NO: 89218 - protein, 401 aa, Aquifex aeolicus; identical to SEQ ID NO: 25144

SEQ ID NO: 89219 - DNA, 1206 bp, Staphylococcus aureus; identical to SEQ ID NO: 25145
  CDS (1)..(1206)

SEQ ID NO: 89220 - protein, 401 aa, Staphylococcus aureus; identical to SEQ ID NO: 25146

SEQ ID NO: 89221 - DNA, 1203 bp, Clostridium acetobutylicum; identical to SEQ ID NO: 25147
  CDS (1)..(1203)

SEQ ID NO: 89222 - protein, 400 aa, Clostridium acetobutylicum; identical to SEQ ID NO: 25148

SEQ ID NO: 89223 - DNA, 1221 bp, Campylobacter jejuni; identical to SEQ ID NO: 25149
  CDS (1)..(1221)

SEQ ID NO: 89224 - protein, 406 aa, Campylobacter jejuni; identical to SEQ ID NO: 25150

SEQ ID NO: 89225 - DNA, 1239 bp, Pseudomonas aeruginosa; identical to SEQ ID NO: 25151
  CDS (22)..(1239)

SEQ ID NO: 89226 - protein, 405 aa, Pseudomonas aeruginosa; identical to SEQ ID NO: 25152

SEQ ID NO: 89227 - DNA, 1230 bp, Bacillus halodurans; identical to SEQ ID NO: 25153
  CDS (1)..(1230)

SEQ ID NO: 89228 - protein, 409 aa, Bacillus halodurans; identical to SEQ ID NO: 25154

SEQ ID NO: 89229 - DNA, 1191 bp, Halobacterium sp. NRC-1; identical to SEQ ID NO: 25155
  CDS (1)..(1191)

SEQ ID NO: 89230 - protein, 396 aa, Halobacterium sp. NRC-1; identical to SEQ ID NO: 25156

SEQ ID NO: 89231 - DNA, 1221 bp, Sulfolobus solfataricus; identical to SEQ ID NO: 25157
  CDS (1)..(1221)

SEQ ID NO: 89232 - protein, 406 aa, Sulfolobus solfataricus; identical to SEQ ID NO: 25158

SEQ ID NO: 89233 - DNA, 1173 bp, Archaeoglobus fulgidus; identical to SEQ ID NO: 25159
  CDS (1)..(1173)

SEQ ID NO: 89234 - protein, 390 aa, Archaeoglobus fulgidus; identical to SEQ ID NO: 25160

SEQ ID NO: 89235 - DNA, 1209 bp, Deinococcus radiodurans; identical to SEQ ID NO: 25161
  CDS (1)..(1209)

SEQ ID NO: 89236 - protein, 402 aa, Deinococcus radiodurans; identical to SEQ ID NO: 25162

SEQ ID NO: 89237 - DNA, 1197 bp, Lactococcus lactis subsp. lactis; identical to SEQ ID NO: 25163
  CDS (1)..(1197)

SEQ ID NO: 89238 - protein, 398 aa, Lactococcus lactis subsp. lactis; identical to SEQ ID NO: 25164

SEQ ID NO: 89239 - DNA, 1188 bp, Methanococcus jannaschii; identical to SEQ ID NO: 25165
  CDS (1)..(1188)

SEQ ID NO: 89240 - protein, 395 aa, Methanococcus jannaschii; identical to SEQ ID NO: 25166

SEQ ID NO: 89241 - DNA, 1197 bp, Mycobacterium tuberculosis; identical to SEQ ID NO: 25167
  CDS (1)..(1197)

SEQ ID NO: 89242 - protein, 398 aa, Mycobacterium tuberculosis; identical to SEQ ID NO: 25168

SEQ ID NO: 89243 - DNA, 1335 bp, Haemophilus influenzae; identical to SEQ ID NO: 25169
  CDS (1)..(1335)

SEQ ID NO: 89244 - protein, 444 aa, Haemophilus influenzae; identical to SEQ ID NO: 25170

SEQ ID NO: 89245 - DNA, 1200 bp, Methanobacterium thermoautotrophicum; identical to SEQ ID NO: 25171
  CDS (1)..(1200)

SEQ ID NO: 89246 - protein, 399 aa, Methanobacterium thermoautotrophicum; identical to SEQ ID NO: 25172

SEQ ID NO: 89247 - DNA, 1344 bp, Neisseria meningitidis; identical to SEQ ID NO: 25173
  CDS (1)..(1344)

SEQ ID NO: 89248 - protein, 447 aa, Neisseria meningitidis; identical to SEQ ID NO: 25174

SEQ ID NO: 89249 - DNA, 1200 bp, Mycobacterium leprae; identical to SEQ ID NO: 25175
  CDS (1)..(1200)

SEQ ID NO: 89250 - protein, 399 aa, Mycobacterium leprae; identical to SEQ ID NO: 25176

SEQ ID NO: 89251 - DNA, 1248 bp, Streptococcus pneumoniae; identical to SEQ ID NO: 25177
  CDS (1)..(1248)

SEQ ID NO: 89252 - protein, 415 aa, Streptococcus pneumoniae; identical to SEQ ID NO: 25178

SEQ ID NO: 89253 - DNA, 1206 bp, Xylella fastidiosa; identical to SEQ ID NO: 25179
  CDS (1)..(1206)

SEQ ID NO: 89254 - protein, 401 aa, Xylella fastidiosa; identical to SEQ ID NO: 25180

SEQ ID NO: 89255 - DNA, 1230 bp, Thermotoga maritima; identical to SEQ ID NO: 25181
  CDS (1)..(1230)

SEQ ID NO: 89256 - protein, 409 aa, Thermotoga maritima; identical to SEQ ID NO: 25182

SEQ ID NO: 89257 - DNA, 1227 bp, Caulobacter crescentus; identical to SEQ ID NO: 25183
  CDS (1)..(1227)

SEQ ID NO: 89258 - protein, 408 aa, Caulobacter crescentus; identical to SEQ ID NO: 25184

SEQ ID NO: 89259 - DNA, 1194 bp, Streptomyces clavuligerus; identical to SEQ ID NO: 25185
  CDS (1)..(1194)

SEQ ID NO: 89260 - protein, 397 aa, Streptomyces clavuligerus; identical to SEQ ID NO: 25186

SEQ ID NO: 89261 - DNA, 2449 bp, Streptomyces lavendulae; identical to SEQ ID NO: 25187
  CDS (535)..(1983)

SEQ ID NO: 89262 - protein, 482 aa, Streptomyces lavendulae; identical to SEQ ID NO: 25188

SEQ ID NO: 89263 - DNA, 1203 bp, Synechocystis sp; identical to SEQ ID NO: 25189
  CDS (1)..(1203)

SEQ ID NO: 89264 - protein, 400 aa, Synechocystis sp; identical to SEQ ID NO: 25190

SEQ ID NO: 89265 - DNA, 1233 bp, Schizosaccharomyces pombe; identical to SEQ ID NO: 25191
  CDS (1)..(1233)

SEQ ID NO: 89266 - protein, 410 aa, Schizosaccharomyces pombe; identical to SEQ ID NO: 25192

SEQ ID NO: 89267 - DNA, 1245 bp, Ashbya gossypii; identical to SEQ ID NO: 25193
  CDS (1)..(1245)

SEQ ID NO: 89268 - protein, 414 aa, Ashbya gossypii; identical to SEQ ID NO: 25194

SEQ ID NO: 89269 - DNA, 1245 bp, Brachydanio rerio; identical to SEQ ID NO: 25195
  CDS (1)..(1245)

SEQ ID NO: 89270 - protein, 414 aa, Brachydanio rerio; identical to SEQ ID NO: 25196

SEQ ID NO: 89271 - DNA, 1206 bp, Symbiobacterium thermophilum; identical to SEQ ID NO: 25197
  CDS (1)..(1206)

SEQ ID NO: 89272 - protein, 401 aa, Symbiobacterium thermophilum; identical to SEQ ID NO: 25198

SEQ ID NO: 89273 - DNA, 1425 bp, Propionibacterium acnes; identical to SEQ ID NO: 25199
  CDS (1)..(1425)

SEQ ID NO: 89274 - protein, 474 aa, Propionibacterium acnes; identical to SEQ ID NO: 25200

SEQ ID NO: 89275 - DNA, 1437 bp, Leifsonia xyli; identical to SEQ ID NO: 25201
  CDS (1)..(1437)

SEQ ID NO: 89276 - protein, 478 aa, Leifsonia xyli; identical to SEQ ID NO: 25202

SEQ ID NO: 89277 - DNA, 1197 bp, Desulfotalea psychrophila; identical to SEQ ID NO: 25203
  CDS (1)..(1197)

SEQ ID NO: 89278 - protein, 398 aa, Desulfotalea psychrophila; identical to SEQ ID NO: 25204

SEQ ID NO: 89279 - DNA, 1251 bp, Debaryomyces hansenii CBS767; identical to SEQ ID NO: 25205
  CDS (1)..(1251)

SEQ ID NO: 89280 - protein, 416 aa, Debaryomyces hansenii CBS767; identical to SEQ ID NO: 25206

SEQ ID NO: 89281 - DNA, 1263 bp, Kluyveromyces lactis NRRL Y; identical to SEQ ID NO: 25207
  CDS (1)..(1263)

SEQ ID NO: 89282 - protein, 420 aa, Kluyveromyces lactis NRRL Y; identical to SEQ ID NO: 25208

SEQ ID NO: 89283 - DNA, 1347 bp, Erwinia carotovora; identical to SEQ ID NO: 25209
  CDS (1)..(1347)

SEQ ID NO: 89284 - protein, 448 aa, Erwinia carotovora; identical to SEQ ID NO: 25210

SEQ ID NO: 89285 - DNA, 1341 bp, Acinetobacter sp; identical to SEQ ID NO: 25211
  CDS (1)..(1341)

SEQ ID NO: 89286 - protein, 446 aa, Acinetobacter sp; identical to SEQ ID NO: 25212

SEQ ID NO: 89287 - DNA, 1263 bp, Candida glabrata CBS138; identical to SEQ ID NO: 25213
  CDS (1)..(1263)

SEQ ID NO: 89288 - protein, 420 aa, Candida glabrata CBS138; identical to SEQ ID NO: 25214

SEQ ID NO: 89289 - DNA, 1206 bp, Bacillus thuringiensis; identical to SEQ ID NO: 25215
  CDS (1)..(1206)

SEQ ID NO: 89290 - protein, 401 aa, Bacillus thuringiensis; identical to SEQ ID NO: 25216

SEQ ID NO: 89291 - DNA, 1188 bp, Picrophilus torridus; identical to SEQ ID NO: 25217
  CDS (1)..(1188)

SEQ ID NO: 89292 - protein, 395 aa, Picrophilus torridus; identical to SEQ ID NO: 25218

SEQ ID NO: 89293 - DNA, 1215 bp, Photobacterium profundum; identical to SEQ ID NO: 25219
  CDS (1)..(1215)

SEQ ID NO: 89294 - protein, 404 aa, Photobacterium profundum; identical to SEQ ID NO: 25220

SEQ ID NO: 89295 - DNA, 1338 bp, Rhodopseudomonas palustris; identical to SEQ ID NO: 25221
  CDS (1)..(1338)

SEQ ID NO: 89296 - protein, 445 aa, Rhodopseudomonas palustris; identical to SEQ ID NO: 25222

SEQ ID NO: 89297 - DNA, 1191 bp, Photorhabdus luminescens; identical to SEQ ID NO: 25223
  CDS (1)..(1191)

SEQ ID NO: 89298 - protein, 396 aa, Photorhabdus luminescens; identical to SEQ ID NO: 25224

SEQ ID NO: 89299 - DNA, 1227 bp, Neurospora crassa; identical to SEQ ID NO: 25225
  CDS (1)..(1227)

SEQ ID NO: 89300 - protein, 408 aa, Neurospora crassa; identical to SEQ ID NO: 25226

SEQ ID NO: 89301 - DNA, 1332 bp, Haemophilus ducreyi; identical to SEQ ID NO: 25227
  CDS (1)..(1332)

SEQ ID NO: 89302 - protein, 443 aa, Haemophilus ducreyi; identical to SEQ ID NO: 25228

SEQ ID NO: 89303 - DNA, 1733 bp, Xenopus laevis; identical to SEQ ID NO: 25229
  CDS (81)..(1316)

SEQ ID NO: 89304 - protein, 411 aa, Xenopus laevis; identical to SEQ ID NO: 25230

SEQ ID NO: 89305 - DNA, 1455 bp, Streptomyces avermitilis; identical to SEQ ID NO: 25231
  CDS (1)..(1455)

SEQ ID NO: 89306 - protein, 484 aa, Streptomyces avermitilis; identical to SEQ ID NO: 25232

SEQ ID NO: 89307 - DNA, 1209 bp, Bacteroides thetaiotaomicron; identical to SEQ ID NO: 25233
  CDS (1)..(1209)

SEQ ID NO: 89308 - protein, 402 aa, Bacteroides thetaiotaomicron; identical to SEQ ID NO: 25234

SEQ ID NO: 89309 - DNA, 1215 bp, Vibrio vulnificus; identical to SEQ ID NO: 25235
  CDS (1)..(1215)

SEQ ID NO: 89310 - protein, 404 aa, Vibrio vulnificus; identical to SEQ ID NO: 25236

SEQ ID NO: 89311 - DNA, 1516 bp, Arabidopsis thaliana; identical to SEQ ID NO: 25237
  CDS (1)..(1485)

SEQ ID NO: 89312 - protein, 494 aa, Arabidopsis thaliana; identical to SEQ ID NO: 25238

SEQ ID NO: 89313 - DNA, 1206 bp, Bacillus cereus; identical to SEQ ID NO: 25239
  CDS (1)..(1206)

SEQ ID NO: 89314 - protein, 401 aa, Bacillus cereus; identical to SEQ ID NO: 25240

SEQ ID NO: 89315 - DNA, 1239 bp, Bifidobacterium longum; identical to SEQ ID NO: 25241
  CDS (1)..(1239)

SEQ ID NO: 89316 - protein, 412 aa, Bifidobacterium longum; identical to SEQ ID NO: 25242

SEQ ID NO: 89317 - DNA, 1338 bp, Bordetella bronchiseptica; identical to SEQ ID NO: 25243
  CDS (1)..(1338)

SEQ ID NO: 89318 - protein, 445 aa, Bordetella bronchiseptica; identical to SEQ ID NO: 25244

SEQ ID NO: 89319 - DNA, 1338 bp, Bradyrhizobium japonicum; identical to SEQ ID NO: 25245
  CDS (1)..(1338)

SEQ ID NO: 89320 - protein, 445 aa, Bradyrhizobium japonicum; identical to SEQ ID NO: 25246

SEQ ID NO: 89321 - DNA, 1221 bp, Brucella suis; identical to SEQ ID NO: 25247
  CDS (1)..(1221)

SEQ ID NO: 89322 - protein, 406 aa, Brucella suis; identical to SEQ ID NO: 25248

SEQ ID NO: 89323 - DNA, 1206 bp, Buchnera aphidicola; identical to SEQ ID NO: 25249
  CDS (1)..(1206)

SEQ ID NO: 89324 - protein, 401 aa, Buchnera aphidicola; identical to SEQ ID NO: 25250

SEQ ID NO: 89325 - DNA, 1230 bp, Buchnera aphidicola; identical to SEQ ID NO: 25251
  CDS (1)..(1230)

SEQ ID NO: 89326 - protein, 409 aa, Buchnera aphidicola; identical to SEQ ID NO: 25252

SEQ ID NO: 89327 - DNA, 1338 bp, Burkholderia multivorans; identical to SEQ ID NO: 25253
  CDS (1)..(1338)

SEQ ID NO: 89328 - protein, 445 aa, Burkholderia multivorans; identical to SEQ ID NO: 25254

SEQ ID NO: 89329 - DNA, 1206 bp, Chlorobium tepidum; identical to SEQ ID NO: 25255
  CDS (1)..(1206)

SEQ ID NO: 89330 - protein, 401 aa, Chlorobium tepidum; identical to SEQ ID NO: 25256

SEQ ID NO: 89331 - DNA, 1227 bp, Chromobacterium violaceum; identical to SEQ ID NO: 25257
  CDS (1)..(1227)

SEQ ID NO: 89332 - protein, 408 aa, Chromobacterium violaceum; identical to SEQ ID NO: 25258

SEQ ID NO: 89333 - DNA, 1218 bp, Clostridium perfringens; identical to SEQ ID NO: 25259
  CDS (1)..(1218)

SEQ ID NO: 89334 - protein, 405 aa, Clostridium perfringens; identical to SEQ ID NO: 25260

SEQ ID NO: 89335 - DNA, 1197 bp, Clostridium tetani; identical to SEQ ID NO: 25261
  CDS (1)..(1197)

SEQ ID NO: 89336 - protein, 398 aa, Clostridium tetani; identical to SEQ ID NO: 25262

SEQ ID NO: 89337 - DNA, 1200 bp, Corynebacterium diphtheriae; identical to SEQ ID NO: 25263
  CDS (1)..(1200)

SEQ ID NO: 89338 - protein, 399 aa, Corynebacterium diphtheriae; identical to SEQ ID NO: 25264

SEQ ID NO: 89339 - DNA, 1206 bp, Corynebacterium efficiens; identical to SEQ ID NO: 25265
  CDS (1)..(1206)

SEQ ID NO: 89340 - protein, 401 aa, Corynebacterium efficiens; identical to SEQ ID NO: 25266

SEQ ID NO: 89341 - DNA, 1206 bp, Corynebacterium glutamicum; identical to SEQ ID NO: 25267
  CDS (1)..(1206)

SEQ ID NO: 89342 - protein, 401 aa, Corynebacterium glutamicum; identical to SEQ ID NO: 25268

SEQ ID NO: 89343 - DNA, 1191 bp, Desulfovibrio vulgaris; identical to SEQ ID NO: 25269
  CDS (1)..(1191)

SEQ ID NO: 89344 - protein, 396 aa, Desulfovibrio vulgaris; identical to SEQ ID NO: 25270

SEQ ID NO: 89345 - DNA, 1274 bp, Drosophila melanogaster; identical to SEQ ID NO: 25271
  CDS (15)..(1274)

SEQ ID NO: 89346 - protein, 419 aa, Drosophila melanogaster; identical to SEQ ID NO: 25272

SEQ ID NO: 89347 - DNA, 1221 bp, Geobacter sulfurreducens; identical to SEQ ID NO: 25273
  CDS (1)..(1221)

SEQ ID NO: 89348 - protein, 406 aa, Geobacter sulfurreducens; identical to SEQ ID NO: 25274

SEQ ID NO: 89349 - DNA, 1197 bp, Gloeobacter violaceus; identical to SEQ ID NO: 25275
  CDS (1)..(1197)

SEQ ID NO: 89350 - protein, 398 aa, Gloeobacter violaceus; identical to SEQ ID NO: 25276

SEQ ID NO: 89351 - DNA, 1215 bp, Helicobacter hepaticus; identical to SEQ ID NO: 25277
  CDS (1)..(1215)

SEQ ID NO: 89352 - protein, 404 aa, Helicobacter hepaticus; identical to SEQ ID NO: 25278

SEQ ID NO: 89353 - DNA, 1236 bp, Lactobacillus plantarum; identical to SEQ ID NO: 25279
  CDS (1)..(1236)

SEQ ID NO: 89354 - protein, 411 aa, Lactobacillus plantarum; identical to SEQ ID NO: 25280

SEQ ID NO: 89355 - DNA, 1212 bp, Leptospira interrogans; identical to SEQ ID NO: 25281
  CDS (1)..(1212)

SEQ ID NO: 89356 - protein, 403 aa, Leptospira interrogans; identical to SEQ ID NO: 25282

SEQ ID NO: 89357 - DNA, 1185 bp, Methanopyrus kandleri; identical to SEQ ID NO: 25283
  CDS (1)..(1185)

SEQ ID NO: 89358 - protein, 394 aa, Methanopyrus kandleri; identical to SEQ ID NO: 25284

SEQ ID NO: 89359 - DNA, 1185 bp, Methanosarcina mazei; identical to SEQ ID NO: 25285
  CDS (1)..(1185)

SEQ ID NO: 89360 - protein, 394 aa, Methanosarcina mazei; identical to SEQ ID NO: 25286

SEQ ID NO: 89361 - DNA, 1194 bp, Methanococcus maripaludis; identical to SEQ ID NO: 25287
  CDS (1)..(1194)

SEQ ID NO: 89362 - protein, 397 aa, Methanococcus maripaludis; identical to SEQ ID NO: 25288

SEQ ID NO: 89363 - DNA, 1215 bp, Moritella abyssi; identical to SEQ ID NO: 25289
  CDS (1)..(1215)

SEQ ID NO: 89364 - protein, 404 aa, Moritella abyssi; identical to SEQ ID NO: 25290

SEQ ID NO: 89365 - DNA, 1215 bp, Moritella profunda; identical to SEQ ID NO: 25291
  CDS (1)..(1215)

SEQ ID NO: 89366 - protein, 404 aa, Moritella profunda; identical to SEQ ID NO: 25292

SEQ ID NO: 89367 - DNA, 1197 bp, Mycobacterium paratuberculosis; identical to SEQ ID NO: 25293
  CDS (1)..(1197)

SEQ ID NO: 89368 - protein, 398 aa, Mycobacterium paratuberculosis; identical to SEQ ID NO: 25294

SEQ ID NO: 89369 - DNA, 1215 bp, Nitrosomonas europaea; identical to SEQ ID NO: 25295
  CDS (1)..(1215)

SEQ ID NO: 89370 - protein, 404 aa, Nitrosomonas europaea; identical to SEQ ID NO: 25296

SEQ ID NO: 89371 - DNA, 1254 bp, Oceanobacillus iheyensis; identical to SEQ ID NO: 25297
  CDS (1)..(1254)

SEQ ID NO: 89372 - protein, 417 aa, Oceanobacillus iheyensis; identical to SEQ ID NO: 25298

SEQ ID NO: 89373 - DNA, 1338 bp, Pasteurella multocida; identical to SEQ ID NO: 25299
  CDS (1)..(1338)

SEQ ID NO: 89374 - protein, 445 aa, Pasteurella multocida; identical to SEQ ID NO: 25300

SEQ ID NO: 89375 - DNA, 1215 bp, Photorhabdus luminescens; identical to SEQ ID NO: 25301
  CDS (1)..(1215)

SEQ ID NO: 89376 - protein, 404 aa, Photorhabdus luminescens; identical to SEQ ID NO: 25302

SEQ ID NO: 89377 - DNA, 1209 bp, Prochlorococcus marinus; identical to SEQ ID NO: 25303
  CDS (1)..(1209)

SEQ ID NO: 89378 - protein, 402 aa, Prochlorococcus marinus; identical to SEQ ID NO: 25304

SEQ ID NO: 89379 - DNA, 1206 bp, Prochlorococcus marinus; identical to SEQ ID NO: 25305
  CDS (1)..(1206)

SEQ ID NO: 89380 - protein, 401 aa, Prochlorococcus marinus; identical to SEQ ID NO: 25306

SEQ ID NO: 89381 - DNA, 1215 bp, Prochlorococcus marinus subsp; identical to SEQ ID NO: 25307
  CDS (1)..(1215)

SEQ ID NO: 89382 - protein, 404 aa, Prochlorococcus marinus subsp; identical to SEQ ID NO: 25308

SEQ ID NO: 89383 - DNA, 1218 bp, Pseudomonas putida; identical to SEQ ID NO: 25309
  CDS (1)..(1218)

SEQ ID NO: 89384 - protein, 405 aa, Pseudomonas putida; identical to SEQ ID NO: 25310

SEQ ID NO: 89385 - DNA, 1218 bp, Pseudomonas syringae; identical to SEQ ID NO: 25311
  CDS (1)..(1218)

SEQ ID NO: 89386 - protein, 405 aa, Pseudomonas syringae; identical to SEQ ID NO: 25312

SEQ ID NO: 89387 - DNA, 1233 bp, Pyrococcus furiosus; identical to SEQ ID NO: 25313
  CDS (1)..(1233)

SEQ ID NO: 89388 - protein, 410 aa, Pyrococcus furiosus; identical to SEQ ID NO: 25314

SEQ ID NO: 89389 - DNA, 1338 bp, Ralstonia solanacearum; identical to SEQ ID NO: 25315
  CDS (1)..(1338)

SEQ ID NO: 89390 - protein, 445 aa, Ralstonia solanacearum; identical to SEQ ID NO: 25316

SEQ ID NO: 89391 - DNA, 1224 bp, Rhizobium loti; identical to SEQ ID NO: 25317
  CDS (1)..(1224)

SEQ ID NO: 89392 - protein, 407 aa, Rhizobium loti; identical to SEQ ID NO: 25318

SEQ ID NO: 89393 - DNA, 1218 bp, Rhizobium meliloti; identical to SEQ ID NO: 25319
  CDS (1)..(1218)

SEQ ID NO: 89394 - protein, 405 aa, Rhizobium meliloti; identical to SEQ ID NO: 25320

SEQ ID NO: 89395 - DNA, 1215 bp, Rhodopirellula baltica; identical to SEQ ID NO: 25321
  CDS (1)..(1215)

SEQ ID NO: 89396 - protein, 404 aa, Rhodopirellula baltica; identical to SEQ ID NO: 25322

SEQ ID NO: 89397 - DNA, 1188 bp, Rhodococcus fascians; identical to SEQ ID NO: 25323
  CDS (1)..(1188)

SEQ ID NO: 89398 - protein, 395 aa, Rhodococcus fascians; identical to SEQ ID NO: 25324

SEQ ID NO: 89399 - DNA, 1224 bp, Shewanella oneidensis; identical to SEQ ID NO: 25325
  CDS (1)..(1224)

SEQ ID NO: 89400 - protein, 407 aa, Shewanella oneidensis; identical to SEQ ID NO: 25326

SEQ ID NO: 89401 - DNA, 1215 bp, Staphylococcus epidermidis; identical to SEQ ID NO: 25327
  CDS (10)..(1215)

SEQ ID NO: 89402 - protein, 401 aa, Staphylococcus epidermidis; identical to SEQ ID NO: 25328

SEQ ID NO: 89403 - DNA, 1215 bp, Streptomyces avermitilis; identical to SEQ ID NO: 25329
  CDS (1)..(1215)

SEQ ID NO: 89404 - protein, 404 aa, Streptomyces avermitilis; identical to SEQ ID NO: 25330

SEQ ID NO: 89405 - DNA, 1446 bp, Streptomyces coelicolor; identical to SEQ ID NO: 25331
  CDS (1)..(1446)

SEQ ID NO: 89406 - protein, 481 aa, Streptomyces coelicolor; identical to SEQ ID NO: 25332

SEQ ID NO: 89407 - DNA, 1191 bp, Streptococcus mutans; identical to SEQ ID NO: 25333
  CDS (1)..(1191)

SEQ ID NO: 89408 - protein, 396 aa, Streptococcus mutans; identical to SEQ ID NO: 25334

SEQ ID NO: 89409 - DNA, 1173 bp, Sulfolobus tokodaii; identical to SEQ ID NO: 25335
  CDS (1)..(1173)

SEQ ID NO: 89410 - protein, 390 aa, Sulfolobus tokodaii; identical to SEQ ID NO: 25336

SEQ ID NO: 89411 - DNA, 1206 bp, Synechococcus elongatus; identical to SEQ ID NO: 25337
  CDS (1)..(1206)

SEQ ID NO: 89412 - protein, 401 aa, Synechococcus elongatus; identical to SEQ ID NO: 25338

SEQ ID NO: 89413 - DNA, 1212 bp, Synechococcus sp; identical to SEQ ID NO: 25339
  CDS (1)..(1212)

SEQ ID NO: 89414 - protein, 403 aa, Synechococcus sp; identical to SEQ ID NO: 25340

SEQ ID NO: 89415 - DNA, 1218 bp, Thermoplasma acidophilum; identical to SEQ ID NO: 25341
  CDS (1)..(1218)

SEQ ID NO: 89416 - protein, 405 aa, Thermoplasma acidophilum; identical to SEQ ID NO: 25342

SEQ ID NO: 89417 - DNA, 1203 bp, Thermus thermophilus; identical to SEQ ID NO: 25343
  CDS (1)..(1203)

SEQ ID NO: 89418 - protein, 400 aa, Thermus thermophilus; identical to SEQ ID NO: 25344

SEQ ID NO: 89419 - DNA, 1233 bp, Thermoanaerobacter tengcongensis; identical to SEQ ID NO: 25345
  CDS (1)..(1233)

SEQ ID NO: 89420 - protein, 410 aa, Thermoanaerobacter tengcongensis; identical to SEQ ID NO: 25346

SEQ ID NO: 89421 - DNA, 1212 bp, Vibrio vulnificus; identical to SEQ ID NO: 25347
  CDS (1)..(1212)

SEQ ID NO: 89422 - protein, 403 aa, Vibrio vulnificus; identical to SEQ ID NO: 25348

SEQ ID NO: 89423 - DNA, 1215 bp, Wolinella succinogenes; identical to SEQ ID NO: 25349
  CDS (1)..(1215)

SEQ ID NO: 89424 - protein, 404 aa, Wolinella succinogenes; identical to SEQ ID NO: 25350

SEQ ID NO: 89425 - DNA, 1194 bp, Xanthomonas campestris; identical to SEQ ID NO: 25351
  CDS (1)..(1194)

SEQ ID NO: 89426 - protein, 397 aa, Xanthomonas campestris; identical to SEQ ID NO: 25352

SEQ ID NO: 89427 - DNA, 1206 bp, Xylella fastidiosa; identical to SEQ ID NO: 25353
  CDS (1)..(1206)

SEQ ID NO: 89428 - protein, 401 aa, Xylella fastidiosa; identical to SEQ ID NO: 25354

SEQ ID NO: 89429 - DNA, 24 bp, Primer
atgacgacgattctcaagcatctc

SEQ ID NO: 89430 - DNA, 25 bp, Primer
ttactggcctttgttttccagattc

SEQ ID NO: 89431 - protein, 409 aa, consensus; identical to SEQ ID NO: 25521
  MISC_FEATURE (1)..(409): consensus for the disclosure of xaa see table XV

SEQ ID NO: 89432 - protein, 36 aa, consensus; identical to SEQ ID NO: 25515
  MISC_FEATURE (1)..(36): consensus for the disclosure of xaa see table XV

SEQ ID NO: 89433 - protein, 42 aa, consensus; identical to SEQ ID NO: 25516
  MISC_FEATURE (1)..(42): consensus for the disclosure of xaa see table XV

SEQ ID NO: 89434 - protein, 18 aa, consensus
  MISC_FEATURE (1)..(18): consensus for the disclosure of xaa see table XV
XXXXXNXXXXXXXXXXXX

SEQ ID NO: 89435 - protein, 13 aa, consensus
  MISC_FEATURE (1)..(13): consensus for the disclosure of xaa see table XV
XXXXXXXGXXXXX

SEQ ID NO: 89436 - protein, 36 aa, consensus; identical to SEQ ID NO: 25519
  MISC_FEATURE (1)..(36): consensus for the disclosure of xaa see table XV

SEQ ID NO: 89437 - protein, 37 aa, consensus; identical to SEQ ID NO: 25520
  MISC_FEATURE (1)..(37): consensus for the disclosure of xaa see table XV

SEQ ID NO: 89438 - DNA, 725 bp, Escherichia coli K12; identical to SEQ ID NO: 31626
  CDS (4)..(432)

SEQ ID NO: 89439 - protein, 142 aa, Escherichia coli K12 [sequence omitted]

SEQ ID NO: 89440 - DNA, 982 bp, Spinacia oleracea (spinach); identical to SEQ ID NO: 31628
  CDS (40)..(792)

SEQ ID NO: 89441 - protein, 250 aa, Spinacia oleracea (spinach); identical to SEQ ID NO: 31629

SEQ ID NO: 89442 - DNA, 444 bp, Mycobacterium tuberculosis; identical to SEQ ID NO: 31630
  CDS (1)..(444)

SEQ ID NO: 89443 - protein, 147 aa, Mycobacterium tuberculosis; identical to SEQ ID NO: 31631

SEQ ID NO: 89444 - DNA, 453 bp, Chlamydia trachomatis; identical to SEQ ID NO: 31632
  CDS (1)..(453)

SEQ ID NO: 89445 - protein, 150 aa, Chlamydia trachomatis; identical to SEQ ID NO: 31633

SEQ ID NO: 89446 - DNA, 429 bp, Pseudomonas aeruginosa; identical to SEQ ID NO: 31634
  CDS (1)..(429)

SEQ ID NO: 89447 - protein, 142 aa, Pseudomonas aeruginosa; identical to SEQ ID NO: 31635

SEQ ID NO: 89448 - DNA, 474 bp, Caulobacter crescentus; identical to SEQ ID NO: 31636
  CDS (1)..(474)

SEQ ID NO: 89449 - protein, 157 aa, Caulobacter crescentus; identical to SEQ ID NO: 31637

SEQ ID NO: 89450 - DNA, 757 bp, Arabidopsis thaliana (mouse-ear cress); identical to SEQ ID NO: 31638
  CDS (1)..(726)

SEQ ID NO: 89451 - protein, 241 aa, Arabidopsis thaliana (mouse-ear cress); identical to SEQ ID NO: 31639

SEQ ID NO: 89452 - DNA, 465 bp, Agrobacterium tumefaciens; identical to SEQ ID NO: 31640
  CDS (1)..(465)

SEQ ID NO: 89453 - protein, 154 aa, Agrobacterium tumefaciens; identical to SEQ ID NO: 31641

SEQ ID NO: 89454 - DNA, 465 bp, Brucella melitensis; identical to SEQ ID NO: 31642
  CDS (1)..(465)

SEQ ID NO: 89455 - protein, 154 aa, Brucella melitensis; identical to SEQ ID NO: 31643

SEQ ID NO: 89456 - DNA, 438 bp, Listeria monocytogenes; identical to SEQ ID NO: 31644
  CDS (1)..(438)

SEQ ID NO: 89457 - protein, 145 aa, Listeria monocytogenes; identical to SEQ ID NO: 31645

SEQ ID NO: 89458 - DNA, 456 bp, Nostoc sp. PCC 7120; identical to SEQ ID NO: 31646
  CDS (1)..(456)

SEQ ID NO: 89459 - protein, 151 aa, Nostoc sp. PCC 7120; identical to SEQ ID NO: 31647

SEQ ID NO: 89460 - DNA, 438 bp, Haloarcula marismortui; identical to SEQ ID NO: 31648
  CDS (1)..(438)

SEQ ID NO: 89461 - protein, 145 aa, Haloarcula marismortui; identical to SEQ ID NO: 31649

SEQ ID NO: 89462 - DNA, 441 bp, Mycoplasma genitalium; identical to SEQ ID NO: 31650
  CDS (1)..(441): transl_table=4

SEQ ID NO: 89463 - protein, 146 aa, Mycoplasma genitalium; identical to SEQ ID NO: 31651

SEQ ID NO: 89464 - DNA, 441 bp, Borrelia burgdorferi (Lyme disease spirochete); identical to SEQ ID NO: 31652
  CDS (1)..(441)

SEQ ID NO: 89465 - protein, 146 aa, Borrelia burgdorferi (Lyme disease spirochete); identical to SEQ ID NO: 31653

SEQ ID NO: 89466 - DNA, 429 bp, Pyrococcus horikoshii; identical to SEQ ID NO: 31654
  CDS (1)..(429)

SEQ ID NO: 89467 - protein, 142 aa, Pyrococcus horikoshii; identical to SEQ ID NO: 31655

SEQ ID NO: 89468 - DNA, 432 bp, Neisseria meningitidis; identical to SEQ ID NO: 31656
  CDS (1)..(432)

SEQ ID NO: 89469 - protein, 143 aa, Neisseria meningitidis; identical to SEQ ID NO: 31657

SEQ ID NO: 89470 - DNA, 429 bp, Vibrio cholerae; identical to SEQ ID NO: 31658
  CDS (1)..(429)

SEQ ID NO: 89471 - protein, 142 aa, Vibrio cholerae; identical to SEQ ID NO: 31659

SEQ ID NO: 89472 - DNA, 423 bp, Methanococcus jannaschii; identical to SEQ ID NO: 31660
  CDS (1)..(423)

SEQ ID NO: 89473 - protein, 140 aa, Methanococcus jannaschii; identical to SEQ ID NO: 31661

SEQ ID NO: 89474 - DNA, 435 bp, Clostridium acetobutylicum; identical to SEQ ID NO: 31662
  CDS (1)..(435)

SEQ ID NO: 89475 - protein, 144 aa, Clostridium acetobutylicum; identical to SEQ ID NO: 31663

SEQ ID NO: 89476 - DNA, 483 bp, Helicobacter pylori; identical to SEQ ID NO: 31664
  CDS (19)..(444)

SEQ ID NO: 89477 - protein, 141 aa, Helicobacter pylori; identical to SEQ ID NO: 31665

SEQ ID NO: 89478 - DNA, 429 bp, Treponema pallidum subsp. pallidum (syphilis spirochete); identical to SEQ ID NO: 31666
  CDS (1)..(429)

SEQ ID NO: 89479 - protein, 142 aa, Treponema pallidum subsp. pallidum (syphilis spirochete); identical to SEQ ID NO: 31667

SEQ ID NO: 89480 - DNA, 849 bp, Methanobacterium thermoautotrophicum; identical to SEQ ID NO: 31668
  CDS (1)..(849)

SEQ ID NO: 89481 - protein, 282 aa, Methanobacterium thermoautotrophicum; identical to SEQ ID NO: 31669

SEQ ID NO: 89482 - DNA, 525 bp, Deinococcus radiodurans; identical to SEQ ID NO: 31670
  CDS (1)..(525)

SEQ ID NO: 89483 - protein, 174 aa, Deinococcus radiodurans; identical to SEQ ID NO: 31671

SEQ ID NO: 89484 - DNA, 426 bp, Campylobacter jejuni; identical to SEQ ID NO: 31672
  CDS (1)..(426)

SEQ ID NO: 89485 - protein, 141 aa, Campylobacter jejuni; identical to SEQ ID NO: 31673

SEQ ID NO: 89486 - DNA, 447 bp, Ureaplasma urealyticum; identical to SEQ ID NO: 31674
  CDS (1)..(447): transl_table=4

SEQ ID NO: 89487 - protein, 148 aa, Ureaplasma urealyticum; identical to SEQ ID NO: 31675

SEQ ID NO: 89488 - DNA, 438 bp, Staphylococcus aureus; identical to SEQ ID NO: 31676
  CDS (1)..(438)

SEQ ID NO: 89489 - protein, 145 aa, Staphylococcus aureus; identical to SEQ ID NO: 31677

SEQ ID NO: 89490 - DNA, 522 bp, Plasmodium falciparum; identical to SEQ ID NO: 31678
  CDS (1)..(522)

SEQ ID NO: 89491 - protein, 173 aa, Plasmodium falciparum; identical to SEQ ID NO: 31679

SEQ ID NO: 89492 - DNA, 468 bp, Rickettsia prowazekii; identical to SEQ ID NO: 31680
  CDS (1)..(468)

SEQ ID NO: 89493 - protein, 155 aa, Rickettsia prowazekii; identical to SEQ ID NO: 31681

SEQ ID NO: 89494 - DNA, 429 bp, Xylella fastidiosa; identical to SEQ ID NO: 31682
  CDS (1)..(429)

SEQ ID NO: 89495 - protein, 142 aa, Xylella fastidiosa; identical to SEQ ID NO: 31683

SEQ ID NO: 89496 - DNA, 438 bp, Halobacterium sp. NRC-1; identical to SEQ ID NO: 31684
  CDS (1)..(438)

SEQ ID NO: 89497 - protein, 145 aa, Halobacterium sp. NRC-1; identical to SEQ ID NO: 31685

SEQ ID NO: 89498 - DNA, 429 bp, Buchnera sp; identical to SEQ ID NO: 31686
  CDS (1)..(429)

SEQ ID NO: 89499 - protein, 142 aa, Buchnera sp; identical to SEQ ID NO: 31687

SEQ ID NO: 89500 - DNA, 447 bp, Lactococcus lactis subsp. lactis; identical to SEQ ID NO: 31688
  CDS (1)..(447)

SEQ ID NO: 89501 - protein, 148 aa, Lactococcus lactis subsp. lactis; identical to SEQ ID NO: 31689

SEQ ID NO: 89502 - DNA, 429 bp, Haemophilus influenzae; identical to SEQ ID NO: 31690
  CDS (1)..(429)

SEQ ID NO: 89503 - protein, 142 aa, Haemophilus influenzae; identical to SEQ ID NO: 31691

SEQ ID NO: 89504 - DNA, 471 bp, Archaeoglobus fulgidus; identical to SEQ ID NO: 31692
  CDS (1)..(471)

SEQ ID NO: 89505 - protein, 156 aa, Archaeoglobus fulgidus; identical to SEQ ID NO: 31693

SEQ ID NO: 89506 - DNA, 438 bp, Bacillus subtilis; identical to SEQ ID NO: 31694
  CDS (1)..(438)

SEQ ID NO: 89507 - protein, 145 aa, Bacillus subtilis; identical to SEQ ID NO: 31695

SEQ ID NO: 89508 - DNA, 450 bp, Thermotoga maritima; identical to SEQ ID NO: 31696
  CDS (1)..(450)

SEQ ID NO: 89509 - protein, 149 aa, Thermotoga maritima; identical to SEQ ID NO: 31697

SEQ ID NO: 89510 - DNA, 468 bp, Aeropyrum pernix; identical to SEQ ID NO: 31698
  CDS (1)..(468)

SEQ ID NO: 89511 - protein, 155 aa, Aeropyrum pernix; identical to SEQ ID NO: 31699

SEQ ID NO: 89512 - DNA, 450 bp, Chlamydophila pneumoniae, Chlamydia pneumoniae; identical to SEQ ID NO: 31700
  CDS (1)..(450)

SEQ ID NO: 89513 - protein, 149 aa, Chlamydophila pneumoniae, Chlamydia pneumoniae; identical to SEQ ID NO: 31701

SEQ ID NO: 89514 - DNA, 435 bp, Mycoplasma pulmonis; identical to SEQ ID NO: 31702
  CDS (1)..(435): transl_table=4

SEQ ID NO: 89515 - protein, 144 aa, Mycoplasma pulmonis; identical to SEQ ID NO: 31703

SEQ ID NO: 89516 - DNA, 447 bp, Streptococcus pneumoniae; identical to SEQ ID NO: 31704
  CDS (1)..(447)

SEQ ID NO: 89517 - protein, 148 aa, Streptococcus pneumoniae; identical to SEQ ID NO: 31705

SEQ ID NO: 89518 - DNA, 435 bp, Aquifex aeolicus; identical to SEQ ID NO: 31706
  CDS (1)..(435)

SEQ ID NO: 89519 - protein, 144 aa, Aquifex aeolicus; identical to SEQ ID NO: 31707

SEQ ID NO: 89520 - DNA, 438 bp, Bacillus halodurans; identical to SEQ ID NO: 31708
  CDS (1)..(438)

SEQ ID NO: 89521 - protein, 145 aa, Bacillus halodurans; identical to SEQ ID NO: 31709

SEQ ID NO: 89522 - DNA, 438 bp, Staphylococcus carnosus; identical to SEQ ID NO: 31710
  CDS (1)..(438)

SEQ ID NO: 89523 - protein, 145 aa, Staphylococcus carnosus; identical to SEQ ID NO: 31711

SEQ ID NO: 89524 - DNA, 438 bp, Sulfolobus acidocaldarius; identical to SEQ ID NO: 31712
  CDS (1)..(438)

SEQ ID NO: 89525 - protein, 145 aa, Sulfolobus acidocaldarius; identical to SEQ ID NO: 31713

SEQ ID NO: 89526 - DNA, 492 bp, Saccharomyces cerevisiae; identical to SEQ ID NO: 31714
  CDS (1)..(492)

SEQ ID NO: 89527 - protein, 163 aa, Saccharomyces cerevisiae; identical to SEQ ID NO: 31715

SEQ ID NO: 89528 - DNA, 444 bp, Mycobacterium leprae; identical to SEQ ID NO: 31716
  CDS (1)..(444)

SEQ ID NO: 89529 - protein, 147 aa, Mycobacterium leprae; identical to SEQ ID NO: 31717

SEQ ID NO: 89530 - DNA, 429 bp, chloroplast Porphyra purpurea; identical to SEQ ID NO: 31718
  CDS (1)..(429)

SEQ ID NO: 89531 - protein, 142 aa, chloroplast Porphyra purpurea; identical to SEQ ID NO: 31719

SEQ ID NO: 89532 - DNA, 450 bp, Sulfolobus solfataricus; identical to SEQ ID NO: 31720
  CDS (1)..(450)

SEQ ID NO: 89533 - protein, 149 aa, Sulfolobus solfataricus; identical to SEQ ID NO: 31721

SEQ ID NO: 89534 - DNA, 456 bp, Synechocystis sp; identical to SEQ ID NO: 31722
  CDS (1)..(456)

SEQ ID NO: 89535 - protein, 151 aa, Synechocystis sp; identical to SEQ ID NO: 31723

SEQ ID NO: 89536 - DNA, 420 bp, chloroplast Odontella sinensis; identical to SEQ ID NO: 31724
  CDS (1)..(420)

SEQ ID NO: 89537 - protein, 139 aa, chloroplast Odontella sinensis; identical to SEQ ID NO: 31725

SEQ ID NO: 89538 - DNA, 444 bp, Streptomyces coelicolor; identical to SEQ ID NO: 31726
  CDS (1)..(444)

SEQ ID NO: 89539 - protein, 147 aa, Streptomyces coelicolor; identical to SEQ ID NO: 31727

SEQ ID NO: 89540 - DNA, 474 bp, Schizosaccharomyces pombe; identical to SEQ ID NO: 31728
  CDS (1)..(474)

SEQ ID NO: 89541 - protein, 157 aa, Schizosaccharomyces pombe; identical to SEQ ID NO: 31729

SEQ ID NO: 89542 - DNA, 540 bp, Burkholderia mallei ATCC 23344; identical to SEQ ID NO: 31730
  CDS (112)..(540)

SEQ ID NO: 89543 - protein, 142 aa, Burkholderia mallei ATCC 23344; identical to SEQ ID NO: 31731

SEQ ID NO: 89544 - DNA, 438 bp, Bacillus cereus ZK; identical to SEQ ID NO: 31732
  CDS (1)..(438)

SEQ ID NO: 89545 - protein, 145 aa, Bacillus cereus ZK; identical to SEQ ID NO: 31733

SEQ ID NO: 89546 - DNA, 462 bp, Bacteroides fragilis; identical to SEQ ID NO: 31734
  CDS (1)..(462)

SEQ ID NO: 89547 - protein, 153 aa, Bacteroides fragilis; identical to SEQ ID NO: 31735

SEQ ID NO: 89548 - DNA, 438 bp, Bacillus licheniformis DSM 13; identical to SEQ ID NO: 31736
  CDS (1)..(438)

SEQ ID NO: 89549 - protein, 145 aa, Bacillus licheniformis DSM 13; identical to SEQ ID NO: 31737

SEQ ID NO: 89550 - DNA, 444 bp, Mannheimia succiniciproducens MBEL55E; identical to SEQ ID NO: 31738
  CDS (1)..(444)

SEQ ID NO: 89551 - protein, 147 aa, Mannheimia succiniciproducens MBEL55E; identical to SEQ ID NO: 31739

SEQ ID NO: 89552 - DNA, 465 bp, Borrelia garinii PBi; identical to SEQ ID NO: 31740
  CDS (1)..(465)

SEQ ID NO: 89553 - protein, 154 aa, Borrelia garinii PBi; identical to SEQ ID NO: 31741

SEQ ID NO: 89554 - DNA, 432 bp, Symbiobacterium thermophilum; identical to SEQ ID NO: 31742
  CDS (1)..(432)

SEQ ID NO: 89555 - protein, 143 aa, Symbiobacterium thermophilum; identical to SEQ ID NO: 31743

SEQ ID NO: 89556 - DNA, 468 bp, Rickettsia typhi; identical to SEQ ID NO: 31744
  CDS (1)..(468)

SEQ ID NO: 89557 - protein, 155 aa, Rickettsia typhi; identical to SEQ ID NO: 31745

SEQ ID NO: 89558 - DNA, 444 bp, Propionibacterium acnes; identical to SEQ ID NO: 31746
  CDS (1)..(444)

SEQ ID NO: 89559 - protein, 147 aa, Propionibacterium acnes; identical to SEQ ID NO: 31747

SEQ ID NO: 89560 - DNA, 447 bp, Leifsonia xyli; identical to SEQ ID NO: 31748
  CDS (1)..(447)

SEQ ID NO: 89561 - protein, 148 aa, Leifsonia xyli; identical to SEQ ID NO: 31749

SEQ ID NO: 89562 - DNA, 429 bp, Desulfotalea psychrophila; identical to SEQ ID NO: 31750
  CDS (1)..(429)

SEQ ID NO: 89563 - protein, 142 aa, Desulfotalea psychrophila; identical to SEQ ID NO: 31751

SEQ ID NO: 89564 - DNA, 432 bp, Gracilaria tenuistipitata var; identical to SEQ ID NO: 31752
  CDS (1)..(432)

SEQ ID NO: 89565 - protein, 143 aa, Gracilaria tenuistipitata var; identical to SEQ ID NO: 31753

SEQ ID NO: 89566 - DNA, 525 bp, Debaryomyces hansenii CBS767; identical to SEQ ID NO: 31754
  CDS (1)..(525)

SEQ ID NO: 89567 - protein, 174 aa, Debaryomyces hansenii CBS767; identical to SEQ ID NO: 31755

SEQ ID NO: 89568 - DNA, 468 bp, Kluyveromyces lactis NRRL Y; identical to SEQ ID NO: 31756
  CDS (1)..(468)

SEQ ID NO: 89569 - protein, 155 aa, Kluyveromyces lactis NRRL Y; identical to SEQ ID NO: 31757

SEQ ID NO: 89570 - DNA, 453 bp, Mesoplasma florum; identical to SEQ ID NO: 31758
  CDS (1)..(453): transl_table=4

SEQ ID NO: 89571 - protein, 150 aa, Mesoplasma florum; identical to SEQ ID NO: 31759

SEQ ID NO: 89572 - DNA, 429 bp, Acinetobacter sp; identical to SEQ ID NO: 31760
  CDS (1)..(429)

SEQ ID NO: 89573 - protein, 142 aa, Acinetobacter sp; identical to SEQ ID NO: 31761

SEQ ID NO: 89574 - DNA, 504 bp, Candida glabrata CBS138; identical to SEQ ID NO: 31762
  CDS (1)..(504)

SEQ ID NO: 89575 - protein, 167 aa, Candida glabrata CBS138; identical to SEQ ID NO: 31763

SEQ ID NO: 89576 - DNA, 465 bp, Bartonella quintana; identical to SEQ ID NO: 31764
  CDS (1)..(465)

SEQ ID NO: 89577 - protein, 154 aa, Bartonella quintana; identical to SEQ ID NO: 31765

SEQ ID NO: 89578 - DNA, 465 bp, Bartonella henselae; identical to SEQ ID NO: 31766
  CDS (1)..(465)

SEQ ID NO: 89579 - protein, 154 aa, Bartonella henselae; identical to SEQ ID NO: 31767

SEQ ID NO: 89580 - DNA, 477 bp, Fremyella diplosiphon; identical to SEQ ID NO: 31768
  CDS (1)..(477)

SEQ ID NO: 89581 - protein, 158 aa, Fremyella diplosiphon; identical to SEQ ID NO: 31769

SEQ ID NO: 89582 - DNA, 435 bp, Mycoplasma mobile; identical to SEQ ID NO: 31770
  CDS (1)..(435): transl_table=4

SEQ ID NO: 89583 - protein, 144 aa, Mycoplasma mobile; identical to SEQ ID NO: 31771

SEQ ID NO: 89584 - DNA, 429 bp, Photobacterium profundum; identical to SEQ ID NO: 31772
  CDS (1)..(429)

SEQ ID NO: 89585 - protein, 142 aa, Photobacterium profundum; identical to SEQ ID NO: 31773

SEQ ID NO: 89586 - DNA, 432 bp, Parachlamydia sp; identical to SEQ ID NO: 31774
  CDS (1)..(432)

SEQ ID NO: 89587 - protein, 143 aa, Parachlamydia sp; identical to SEQ ID NO: 31775

SEQ ID NO: 89588 - DNA, 441 bp, Bdellovibrio bacteriovorus; identical to SEQ ID NO: 31776
  CDS (1)..(441)

SEQ ID NO: 89589 - protein, 146 aa, Bdellovibrio bacteriovorus; identical to SEQ ID NO: 31777

SEQ ID NO: 89590 - DNA, 456 bp, Mycoplasma mycoides; identical to SEQ ID NO: 31778
  CDS (1)..(456): transl_table=4

SEQ ID NO: 89591 - protein, 151 aa, Mycoplasma mycoides; identical to SEQ ID NO: 31779

SEQ ID NO: 89592 - DNA, 444 bp, Corynebacterium diphtheriae; identical to SEQ ID NO: 31780
  CDS (1)..(444)

SEQ ID NO: 89593 - protein, 147 aa, Corynebacterium diphtheriae; identical to SEQ ID NO: 31781

SEQ ID NO: 89594 - DNA, 459 bp, Onion yellows phytoplasma; identical to SEQ ID NO: 31782
  CDS (1)..(459)

SEQ ID NO: 89595 - protein, 152 aa, Onion yellows phytoplasma; identical to SEQ ID NO: 31783

SEQ ID NO: 89596 - DNA, 435 bp, Desulfovibrio vulgaris; identical to SEQ ID NO: 31784
  CDS (1)..(435)

SEQ ID NO: 89597 - protein, 144 aa, Desulfovibrio vulgaris; identical to SEQ ID NO: 31785

SEQ ID NO: 89598 - DNA, 492 bp, Thermus thermophilus; identical to SEQ ID NO: 31786
  CDS (1)..(492)

SEQ ID NO: 89599 - protein, 163 aa, Thermus thermophilus; identical to SEQ ID NO: 31787

SEQ ID NO: 89600 - DNA, 450 bp, Leptospira interrogans; identical to SEQ ID NO: 31788
  CDS (1)..(450)

SEQ ID NO: 89601 - protein, 149 aa, Leptospira interrogans; identical to SEQ ID NO: 31789

SEQ ID NO: 89602 - DNA, 438 bp, Bacillus cereus; identical to SEQ ID NO: 31790
  CDS (1)..(438)

SEQ ID NO: 89603 - protein, 145 aa, Bacillus cereus; identical to SEQ ID NO: 31791

SEQ ID NO: 89604 - DNA, 459 bp, Wolbachia pipientis wMel; identical to SEQ ID NO: 31792
  CDS (1)..(459)

SEQ ID NO: 89605 - protein, 152 aa, Wolbachia pipientis wMel; identical to SEQ ID NO: 31793

SEQ ID NO: 89606 - DNA, 429 bp, Treponema denticola; identical to SEQ ID NO: 31794
  CDS (1)..(429)

SEQ ID NO: 89607 - protein, 142 aa, Treponema denticola; identical to SEQ ID NO: 31795

SEQ ID NO: 89608 - DNA, 444 bp, Mycobacterium paratuberculosis; identical to SEQ ID NO: 31796
  CDS (1)..(444)

SEQ ID NO: 89609 - protein, 147 aa, Mycobacterium paratuberculosis; identical to SEQ ID NO: 31797

SEQ ID NO: 89610 - DNA, 432 bp, Geobacter sulfurreducens; identical to SEQ ID NO: 31798
  CDS (1)..(432)

SEQ ID NO: 89611 - protein, 143 aa, Geobacter sulfurreducens; identical to SEQ ID NO: 31799

SEQ ID NO: 89612 - DNA, 444 bp, Lactobacillus johnsonii; identical to SEQ ID NO: 31800
  CDS (1)..(444)

SEQ ID NO: 89613 - protein, 147 aa, Lactobacillus johnsonii; identical to SEQ ID NO: 31801

SEQ ID NO: 89614 - DNA, 489 bp, Nanoarchaeum equitans; identical to SEQ ID NO: 31802
  CDS (1)..(489)

SEQ ID NO: 89615 - protein, 162 aa, Nanoarchaeum equitans; identical to SEQ ID NO: 31803

SEQ ID NO: 89616 - DNA, 471 bp, Ashbya gossypii; identical to SEQ ID NO: 31804
  CDS (1)..(471)

SEQ ID NO: 89617 - protein, 156 aa, Ashbya gossypii; identical to SEQ ID NO: 31805

SEQ ID NO: 89618 - DNA, 690 bp, Oryza sativa; identical to SEQ ID NO: 31806
  CDS (1)..(690)

SEQ ID NO: 89619 - protein, 229 aa, Oryza sativa; identical to SEQ ID NO: 31807

SEQ ID NO: 89620 - DNA, 420 bp, Wolinella succinogenes; identical to SEQ ID NO: 31808
  CDS (1)..(420)

SEQ ID NO: 89621 - protein, 139 aa, Wolinella succinogenes; identical to SEQ ID NO: 31809

SEQ ID NO: 89622 - DNA, 429 bp, Vibrio vulnificus; identical to SEQ ID NO: 31810
  CDS (1)..(429)

SEQ ID NO: 89623 - protein, 142 aa, Vibrio vulnificus; identical to SEQ ID NO: 31811

SEQ ID NO: 89624 - DNA, 456 bp, Porphyromonas gingivalis; identical to SEQ ID NO: 31812
  CDS (1)..(456)

SEQ ID NO: 89625 - protein, 151 aa, Porphyromonas gingivalis; identical to SEQ ID NO: 31813

SEQ ID NO: 89626 - DNA, 429 bp, Photorhabdus luminescens; identical to SEQ ID NO: 31814
  CDS (1)..(429)

SEQ ID NO: 89627 - protein, 142 aa, Photorhabdus luminescens; identical to SEQ ID NO: 31815

SEQ ID NO: 89628 - DNA, 459 bp, Gloeobacter violaceus; identical to SEQ ID NO: 31816
  CDS (1)..(459)

SEQ ID NO: 89629 - protein, 152 aa, Gloeobacter violaceus; identical to SEQ ID NO: 31817

SEQ ID NO: 89630 - DNA, 429 bp, Chromobacterium violaceum; identical to SEQ ID NO: 31818
  CDS (1)..(429)

SEQ ID NO: 89631 - protein, 142 aa, Chromobacterium violaceum; identical to SEQ ID NO: 31819

SEQ ID NO: 89632 - DNA, 552 bp, Neurospora crassa; identical to SEQ ID NO: 31820
  CDS (1)..(552)

SEQ ID NO: 89633 - protein, 183 aa, Neurospora crassa; identical to SEQ ID NO: 31821

SEQ ID NO: 89634 - DNA, 453 bp, Synechococcus sp; identical to SEQ ID NO: 31822
  CDS (1)..(453)

SEQ ID NO: 89635 - protein, 150 aa, Synechococcus sp; identical to SEQ ID NO: 31823

SEQ ID NO: 89636 - DNA, 456 bp, Rhodopirellula baltica; identical to SEQ ID NO: 31824
  CDS (1)..(456)

SEQ ID NO: 89637 - protein, 151 aa, Rhodopirellula baltica; identical to SEQ ID NO: 31825

SEQ ID NO: 89638 - DNA, 432 bp, Prochlorococcus marinus subsp; identical to SEQ ID NO: 31826
  CDS (1)..(432)

SEQ ID NO: 89639 - protein, 143 aa, Prochlorococcus marinus subsp; identical to SEQ ID NO: 31827

SEQ ID NO: 89640 - DNA, 453 bp, Prochlorococcus marinus; identical to SEQ ID NO: 31828
  CDS (1)..(453)

SEQ ID NO: 89641 - protein, 150 aa, Prochlorococcus marinus; identical to SEQ ID NO: 31829

SEQ ID NO: 89642 - DNA, 453 bp, Prochlorococcus marinus; identical to SEQ ID NO: 31830
  CDS (1)..(453)

SEQ ID NO: 89643 - protein, 150 aa, Prochlorococcus marinus; identical to SEQ ID NO: 31831

SEQ ID NO: 89644 - DNA, 429 bp, Helicobacter hepaticus; identical to SEQ ID NO: 31832
  CDS (1)..(429)

SEQ ID NO: 89645 - protein, 142 aa, Helicobacter hepaticus; identical to SEQ ID NO: 31833

SEQ ID NO: 89646 - DNA, 423 bp, Haemophilus ducreyi; identical to SEQ ID NO: 31834
  CDS (1)..(423)

SEQ ID NO: 89647 - protein, 140 aa, Haemophilus ducreyi; identical to SEQ ID NO: 31835

SEQ ID NO: 89648 - DNA, 420 bp, Candidatus Blochmannia floridanus; identical to SEQ ID NO: 31836
  CDS (1)..(420)

SEQ ID NO: 89649 - protein, 139 aa, Candidatus Blochmannia floridanus; identical to SEQ ID NO: 31837

SEQ ID NO: 89650 - DNA, 429 bp, Bordetella pertussis; identical to SEQ ID NO: 31838
  CDS (1)..(429)

SEQ ID NO: 89651 - protein, 142 aa, Bordetella pertussis; identical to SEQ ID NO: 31839

SEQ ID NO: 89652 - DNA, 618 bp, Arabidopsis thaliana; identical to SEQ ID NO: 31840
  CDS (1)..(618)

SEQ ID NO: 89653 - protein, 205 aa, Arabidopsis thaliana; identical to SEQ ID NO: 31841

SEQ ID NO: 89654 - DNA, 1001 bp, Chlorarachnion sp; identical to SEQ ID NO: 31842
  CDS (48)..(869)

SEQ ID NO: 89655 - protein, 273 aa, Chlorarachnion sp; identical to SEQ ID NO: 31843

SEQ ID NO: 89656 - DNA, 453 bp, Chlamydophila caviae; identical to SEQ ID NO: 31844
  CDS (1)..(453)

SEQ ID NO: 89657 - protein, 150 aa, Chlamydophila caviae; identical to SEQ ID NO: 31845

SEQ ID NO: 89658 - DNA, 444 bp, Streptomyces avermitilis; identical to SEQ ID NO: 31846
  CDS (1)..(444)

SEQ ID NO: 89659 - protein, 147 aa, Streptomyces avermitilis; identical to SEQ ID NO: 31847

SEQ ID NO: 89660 - DNA, 435 bp, Nitrosomonas europaea; identical to SEQ ID NO: 31848
  CDS (1)..(435)

SEQ ID NO: 89661 - protein, 144 aa, Nitrosomonas europaea; identical to SEQ ID NO: 31849

SEQ ID NO: 89662 - DNA, 429 bp, Coxiella burnetii; identical to SEQ ID NO: 31850
  CDS (1)..(429)

SEQ ID NO: 89663 - protein, 142 aa, Coxiella burnetii; identical to SEQ ID NO: 31851

SEQ ID NO: 89664 - DNA, 426 bp, Tropheryma whipplei; identical to SEQ ID NO: 31852
  CDS (1)..(426)

SEQ ID NO: 89665 - protein, 141 aa, Tropheryma whipplei; identical to SEQ ID NO: 31853

SEQ ID NO: 89666 - DNA, 603 bp, Dictyostelium discoideum; identical to SEQ ID NO: 31854
  CDS (1)..(603)

SEQ ID NO: 89667 - protein, 200 aa, Dictyostelium discoideum; identical to SEQ ID NO: 31855

SEQ ID NO: 89668 - DNA, 429 bp, Xylella fastidiosa; identical to SEQ ID NO: 31856
  CDS (1)..(429)

SEQ ID NO: 89669 - protein, 142 aa, Xylella fastidiosa; identical to SEQ ID NO: 31857

SEQ ID NO: 89670 - DNA, 429 bp, Vibrio parahaemolyticus; identical to SEQ ID NO: 31858
  CDS (1)..(429)

SEQ ID NO: 89671 - protein, 142 aa, Vibrio parahaemolyticus; identical to SEQ ID NO: 31859

SEQ ID NO: 89672 - DNA, 429 bp, Pseudomonas syringae; identical to SEQ ID NO: 31860
  CDS (1)..(429)

SEQ ID NO: 89673 - protein, 142 aa, Pseudomonas syringae; identical to SEQ ID NO: 31861

SEQ ID NO: 89674 - DNA, 444 bp, Lactobacillus plantarum; identical to SEQ ID NO: 31862
  CDS (1)..(444)

SEQ ID NO: 89675 - protein, 147 aa, Lactobacillus plantarum; identical to SEQ ID NO: 31863

SEQ ID NO: 89676 - DNA, 435 bp, Clostridium tetani; identical to SEQ ID NO: 31864
  CDS (1)..(435)

SEQ ID NO: 89677 - protein, 144 aa, Clostridium tetani; identical to SEQ ID NO: 31865

SEQ ID NO: 89678 - DNA, 462 bp, Bacteroides thetaiotaomicron; identical to SEQ ID NO: 31866
  CDS (1)..(462)

SEQ ID NO: 89679 - protein, 153 aa, Bacteroides thetaiotaomicron; identical to SEQ ID NO: 31867

SEQ ID NO: 89680 - DNA, 438 bp, Staphylococcus epidermidis; identical to SEQ ID NO: 31868
  CDS (1)..(438)

SEQ ID NO: 89681 - protein, 145 aa, Staphylococcus epidermidis; identical to SEQ ID NO: 31869

SEQ ID NO: 89682 - DNA, 444 bp, Yersinia pestis; identical to SEQ ID NO: 31870
  CDS (1)..(444)

SEQ ID NO: 89683 - protein, 147 aa, Yersinia pestis; identical to SEQ ID NO: 31871

SEQ ID NO: 89684 - DNA, 429 bp, Wigglesworthia glossinidia brevipalpis; identical to SEQ ID NO: 31872
  CDS (1)..(429)

SEQ ID NO: 89685 - protein, 142 aa, Wigglesworthia glossinidia brevipalpis; identical to SEQ ID NO: 31873

SEQ ID NO: 89686 - DNA, 459 bp, Synechococcus elongatus; identical to SEQ ID NO: 31874
  CDS (1)..(459)

SEQ ID NO: 89687 - protein, 152 aa, Synechococcus elongatus; identical to SEQ ID NO: 31875

SEQ ID NO: 89688 - DNA, 447 bp, Streptococcus mutans; identical to SEQ ID NO: 31876
  CDS (1)..(447)

SEQ ID NO: 89689 - protein, 148 aa, Streptococcus mutans; identical to SEQ ID NO: 31877

SEQ ID NO: 89690 - DNA, 447 bp, Streptococcus agalactiae; identical to SEQ ID NO: 31878
  CDS (1)..(447)

SEQ ID NO: 89691 - protein, 148 aa, Streptococcus agalactiae; identical to SEQ ID NO: 31879

SEQ ID NO: 89692 - DNA, 429 bp, Shewanella oneidensis; identical to SEQ ID NO: 31880
  CDS (1)..(429)

SEQ ID NO: 89693 - protein, 142 aa, Shewanella oneidensis; identical to SEQ ID NO: 31881

SEQ ID NO: 89694 - DNA, 438 bp, Oceanobacillus iheyensis; identical to SEQ ID NO: 31882
  CDS (1)..(438)

SEQ ID NO: 89695 - protein, 145 aa, Oceanobacillus iheyensis; identical to SEQ ID NO: 31883

SEQ ID NO: 89696 - DNA, 441 bp, Mycoplasma penetrans; identical to SEQ ID NO: 31884
  CDS (1)..(441): transl_table=4

SEQ ID NO: 89697 - protein, 146 aa, Mycoplasma penetrans; identical to SEQ ID NO: 31885

SEQ ID NO: 89698 - DNA, 444 bp, Corynebacterium efficiens; identical to SEQ ID NO: 31886
  CDS (1)..(444)

SEQ ID NO: 89699 - protein, 147 aa, Corynebacterium efficiens; identical to SEQ ID NO: 31887

SEQ ID NO: 89700 - DNA, 465 bp, Brucella suis; identical to SEQ ID NO: 31888
  CDS (1)..(465)

SEQ ID NO: 89701 - protein, 154 aa, Brucella suis; identical to SEQ ID NO: 31889

SEQ ID NO: 89702 - DNA, 450 bp, Bifidobacterium longum; identical to SEQ ID NO: 31890
  CDS (1)..(450)

SEQ ID NO: 89703 - protein, 149 aa, Bifidobacterium longum; identical to SEQ ID NO: 31891

SEQ ID NO: 89704 - DNA, 447 bp, Streptococcus pyogenes; identical to SEQ ID NO: 31892
  CDS (1)..(447)

SEQ ID NO: 89705 - protein, 148 aa, Streptococcus pyogenes; identical to SEQ ID NO: 31893

SEQ ID NO: 89706 - DNA, 453 bp, Chlorobium tepidum; identical to SEQ ID NO: 31894
  CDS (1)..(453)

SEQ ID NO: 89707 - protein, 150 aa, Chlorobium tepidum; identical to SEQ ID NO: 31895

SEQ ID NO: 89708 - DNA, 375 bp, Candidatus Tremblaya princeps; identical to SEQ ID NO: 31896
  CDS (1)..(375)

SEQ ID NO: 89709 - protein, 124 aa, Candidatus Tremblaya princeps; identical to SEQ ID NO: 31897

SEQ ID NO: 89710 - DNA, 429 bp, Xanthomonas axonopodis; identical to SEQ ID NO: 31898
  CDS (1)..(429)

SEQ ID NO: 89711 - protein, 142 aa, Xanthomonas axonopodis; identical to SEQ ID NO: 31899

SEQ ID NO: 89712 - DNA, 444 bp, Corynebacterium glutamicum; identical to SEQ ID NO: 31900
  CDS (1)..(444)

SEQ ID NO: 89713 - protein, 147 aa, Corynebacterium glutamicum; identical to SEQ ID NO: 31901

SEQ ID NO: 89714 - DNA, 429 bp, Streptococcus pyogenes; identical to SEQ ID NO: 31902
  CDS (1)..(429)

SEQ ID NO: 89715 - protein, 142 aa, Streptococcus pyogenes; identical to SEQ ID NO: 31903

SEQ ID NO: 89716 - DNA, 489 bp, Methanosarcina mazei; identical to SEQ ID NO: 31904
  CDS (1)..(489)

SEQ ID NO: 89717 - protein, 162 aa, Methanosarcina mazei; identical to SEQ ID NO: 31905

SEQ ID NO: 89718 - DNA, 432 bp, Thermoanaerobacter tengcongensis; identical to SEQ ID NO: 31906
  CDS (1)..(432)

SEQ ID NO: 89719 - protein, 143 aa, Thermoanaerobacter tengcongensis; identical to SEQ ID NO: 31907

SEQ ID NO: 89720 - DNA, 435 bp, Fusobacterium nucleatum; identical to SEQ ID NO: 31908
  CDS (1)..(435)

SEQ ID NO: 89721 - protein, 144 aa, Fusobacterium nucleatum; identical to SEQ ID NO: 31909

SEQ ID NO: 89722 - DNA, 432 bp, Methanosarcina acetivorans; identical to SEQ ID NO: 31910
  CDS (1)..(432)

SEQ ID NO: 89723 - protein, 143 aa, Methanosarcina acetivorans; identical to SEQ ID NO: 31911

SEQ ID NO: 89724 - DNA, 480 bp, Methanopyrus kandleri; identical to SEQ ID NO: 31912
  CDS (1)..(480)

SEQ ID NO: 89725 - protein, 159 aa, Methanopyrus kandleri; identical to SEQ ID NO: 31913

SEQ ID NO: 89726 - DNA, 429 bp, Pyrococcus furiosus; identical to SEQ ID NO: 31914
  CDS (1)..(429)

SEQ ID NO: 89727 - protein, 142 aa, Pyrococcus furiosus; identical to SEQ ID NO: 31915

SEQ ID NO: 89728 - DNA, 435 bp, Clostridium perfringens; identical to SEQ ID NO: 31916
  CDS (1)..(435)

SEQ ID NO: 89729 - protein, 144 aa, Clostridium perfringens; identical to SEQ ID NO: 31917

SEQ ID NO: 89730 - DNA, 429 bp, Ralstonia solanacearum; identical to SEQ ID NO: 31918
  CDS (1)..(429)

SEQ ID NO: 89731 - protein, 142 aa, Ralstonia solanacearum; identical to SEQ ID NO: 31919

SEQ ID NO: 89732 - DNA, 564 bp, Pyrobaculum aerophilum; identical to SEQ ID NO: 31920
  CDS (1)..(564)

SEQ ID NO: 89733 - protein, 187 aa, Pyrobaculum aerophilum; identical to SEQ ID NO: 31921

SEQ ID NO: 89734 - DNA, 465 bp, Rhizobium meliloti; identical to SEQ ID NO: 31922
  CDS (1)..(465)

SEQ ID NO: 89735 - protein, 154 aa, Rhizobium meliloti; identical to SEQ ID NO: 31923

SEQ ID NO: 89736 - DNA, 702 bp, Oryza sativa; identical to SEQ ID NO: 31924
  CDS (1)..(702)

SEQ ID NO: 89737 - protein, 233 aa, Oryza sativa; identical to SEQ ID NO: 31925

SEQ ID NO: 89738 - DNA, 465 bp, Rhizobium loti; identical to SEQ ID NO: 31926
  CDS (1)..(465)

SEQ ID NO: 89739 - protein, 154 aa, Rhizobium loti; identical to SEQ ID NO: 31927

SEQ ID NO: 89740 - DNA, 429 bp, Pasteurella multocida; identical to SEQ ID NO: 31928
  CDS (1)..(429)

SEQ ID NO: 89741 - protein, 142 aa, Pasteurella multocida; identical to SEQ ID NO: 31929

SEQ ID NO: 89742 - DNA, 846 bp, Ceratopteris richardii; identical to SEQ ID NO: 31930
  CDS (54)..(479): n means a or g or c or t/u

SEQ ID NO: 89743 - protein, 141 aa, Ceratopteris richardii; identical to SEQ ID NO: 31931
  misc_feature (101)..(101): Xaa can be Arg or Gln or Leu or Pro
  misc_feature (134)..(134): Xaa can be Asn or Asp or His or Tyr

SEQ ID NO: 89744 - DNA, 414 bp, Arabidopsis thaliana; identical to SEQ ID NO: 31932
  CDS (1)..(414)

SEQ ID NO: 89745 - protein, 137 aa, Arabidopsis thaliana; identical to SEQ ID NO: 31933

SEQ ID NO: 89746 - DNA, 432 bp, Cyanidium caldarium; identical to SEQ ID NO: 31934
  CDS (1)..(432)

SEQ ID NO: 89747 - protein, 143 aa, Cyanidium caldarium; identical to SEQ ID NO: 31935

SEQ ID NO: 89748 - DNA, 432 bp, Guillardia theta; identical to SEQ ID NO: 31936
  CDS (1)..(432)

SEQ ID NO: 89749 - protein, 143 aa, Guillardia theta; identical to SEQ ID NO: 31937

SEQ ID NO: 89750 - DNA, 435 bp, Buchnera aphidicola; identical to SEQ ID NO: 31938
  CDS (1)..(435)

SEQ ID NO: 89751 - protein, 144 aa, Buchnera aphidicola; identical to SEQ ID NO: 31939

SEQ ID NO: 89752 - DNA, 618 bp, Drosophila melanogaster; identical to SEQ ID NO: 31940
  CDS (31)..(567)

SEQ ID NO: 89753 - protein, 178 aa, Drosophila melanogaster; identical to SEQ ID NO: 31941

SEQ ID NO: 89754 - DNA, 839 bp, Homo sapiens; identical to SEQ ID NO: 31942
  CDS (40)..(576)

SEQ ID NO: 89755 - protein, 178 aa, Homo sapiens; identical to SEQ ID NO: 31943

SEQ ID NO: 89756 - DNA, 26 bp, Primer
atgaaaacttttacagctaaaccaga

SEQ ID NO: 89757 - DNA, 24 bp, Primer
ttagatgtcaagaacttgcggttg

SEQ ID NO: 89758 - protein, 162 aa, consensus; identical to SEQ ID NO: 31946
  MISC_FEATURE (1)..(162): consensus for the disclosure of xaa see table XV

SEQ ID NO: 89759 - protein, 58 aa, consensus; identical to SEQ ID NO: 31947
  MISC_FEATURE (1)..(58): consensus for the disclosure of xaa see table XV

SEQ ID NO: 89760 - protein, 26 aa, consensus
  MISC_FEATURE (1)..(26): consensus for the disclosure of xaa see table XV
XXXXXXXMXXXXXXXXXXXXXXXXXX

SEQ ID NO: 89761 - DNA, 318 bp, Escherichia coli K12; identical to SEQ ID NO: 26631
  CDS (1)..(318)

SEQ ID NO: 89762 - protein, 105 aa, Escherichia coli K12; identical to SEQ ID NO: 26632

SEQ ID NO: 89763 - DNA, 318 bp, Salmonella typhimurium; identical to SEQ ID NO: 26633
  CDS (1)..(318)

SEQ ID NO: 89764 - protein, 105 aa, Salmonella typhimurium; identical to SEQ ID NO: 26634

SEQ ID NO: 89765 - DNA, 318 bp, Haemophilus influenzae; identical to SEQ ID NO: 26635
  CDS (1)..(318)

SEQ ID NO: 89766 - protein, 105 aa, Haemophilus influenzae; identical to SEQ ID NO: 26636

SEQ ID NO: 89767 - DNA, 318 bp, Yersinia pestis; identical to SEQ ID NO: 26637
  CDS (1)..(318)

SEQ ID NO: 89768 - protein, 105 aa, Yersinia pestis; identical to SEQ ID NO: 26638

SEQ ID NO: 89769 - DNA, 318 bp, Yersinia pseudotuberculosis IP 32953; identical to SEQ ID NO: 26639
  CDS (1)..(318)

SEQ ID NO: 89770 - protein, 105 aa, Yersinia pseudotuberculosis IP 32953; identical to SEQ ID NO: 26640

SEQ ID NO: 89771 - DNA, 318 bp, Erwinia carotovora; identical to SEQ ID NO: 26641
  CDS (1)..(318)

SEQ ID NO: 89772 - protein, 105 aa, Erwinia carotovora; identical to SEQ ID NO: 26642

SEQ ID NO: 89773 - DNA, 318 bp, Photobacterium profundum; identical to SEQ ID NO: 26643
  CDS (1)..(318)

SEQ ID NO: 89774 - protein, 105 aa, Photobacterium profundum; identical to SEQ ID NO: 26644

SEQ ID NO: 89775 - DNA, 318 bp, Haemophilus ducreyi; identical to SEQ ID NO: 26645
  CDS (1)..(318)

SEQ ID NO: 89776 - protein, 105 aa, Haemophilus ducreyi; identical to SEQ ID NO: 26646

SEQ ID NO: 89777 - DNA, 318 bp, Pasteurella multocida; identical to SEQ ID NO: 26647
  CDS (1)..(318)

SEQ ID NO: 89778 - protein, 105 aa, Pasteurella multocida; identical to SEQ ID NO: 26648

SEQ ID NO: 89779 - DNA, 318 bp, Photorhabdus luminescens; identical to SEQ ID NO: 26649
  CDS (1)..(318)

SEQ ID NO: 89780 - protein, 105 aa, Photorhabdus luminescens; identical to SEQ ID NO: 26650

SEQ ID NO: 89781 - DNA, 315 bp, Shewanella oneidensis; identical to SEQ ID NO: 26651
  CDS (1)..(315)

SEQ ID NO: 89782 - protein, 104 aa, Shewanella oneidensis; identical to SEQ ID NO: 26652

SEQ ID NO: 89783 - DNA, 321 bp, Vibrio parahaemolyticus; identical to SEQ ID NO: 26653
  CDS (1)..(321)

SEQ ID NO: 89784 - protein, 106 aa, Vibrio parahaemolyticus; identical to SEQ ID NO: 26654

SEQ ID NO: 89785 - DNA, 318 bp, Vibrio vulnificus; identical to SEQ ID NO: 26655
  CDS (1)..(318)

SEQ ID NO: 89786 - protein, 105 aa, Vibrio vulnificus; identical to SEQ ID NO: 26656

SEQ ID NO: 89787 - DNA, 20 bp, Primer
atggctgaatggagcggcga

SEQ ID NO: 89788 - DNA, 22 bp, Primer
ttagtattcccacgtctccggg

SEQ ID NO: 89789 - protein, 97 aa, consensus; identical to SEQ ID NO: 27310
  MISC_FEATURE (1)..(97): consensus for the disclosure of xaa see table XV

SEQ ID NO: 89790 - protein, 97 aa, consensus; identical to SEQ ID NO: 27309
  MISC_FEATURE (1)..(97): consensus for the disclosure of xaa see table XV

SEQ ID NO: 89791 - DNA, 1647 bp, Escherichia coli
  CDS (1)..(1647)
atgtcaaacaaaccctttatctaccaggcacctttcccgatggggaaagacaataccgaatactatctactcacttccgattacgttagcgttgccgacttcgacggcgaaaccatcctgaaagtggaaccagaagccctgaccctgctggcgcagcaagcctttcacgacgcttcttttatgctccgcccggcacaccagaaacaggttgcggctattcttcacgatccagaagccagcgaaaacgacaagtacgtggcgctgcaattcttaagaaactccgaaatcgccgccaaaggcgtgctgccgacctgccaggataccggcaccgcgatcatcgtcggtaaaaaaggccagcgcgtgtggaccggcggcggtgatgaagaaacgctgtcgaaaggcgtctataacacctatatcgaagataacctgcgctattcacagaatgcggcgctggacatgtacaaagaggtcaacaccggcactaacctgcctgcgcaaatcgacctgtacgcggtagatggcgatgagtacaaattcctttgcgttgcgaaaggcggcggctctgccaacaaaacgtatctctaccaggaaaccaaagccctgctgactcccggcaaactgaaaaacttcctcgtcgagaaaatgcgtaccctcggtactgcagcctgcccgccgtaccatatcgcgtttgtgattggcggtacgtctgcggaaaccaacctgaaaaccgtcaagttagcaagcgctcactattacgatgaactgccgacggaagggaacgaacatggtcaggcgttccgcgatgtccagctggaacaggaactgctggaagaggcccagaaactcggtcttggcgcgcagtttggcggtaaatacttcgcgcacgacattcgcgttatccgtctgccacgtcacggcgcatcctgcccggtcggcatgggcgtctcctgctccgctgaccgtaacattaaagcgaaaatcaaccgcgaaggtatctggatcgaaaaactggaacacaacccaggccagtacattccacaagaactgcgccaggccggtgaaggcgaagcggtgaaagttgaccttaaccgcccgatgaaagagatcctcgcccagctttcgcaatacccggtatccactcgtttgtcgctcaccggcaccattatcgtgggccgagatattgcacacgccaagctgaaagagctgattgacgccggtaaagaacttccgcagtacatcaaagatcacccgatctactacgcgggtccggcgaaaacccctgccggttatccatcaggttcacttggcccaaccaccgcaggccgtatggactcctacgtggatctgctgcaatcccacggcggcagcatgatcatgctggcgaaaggtaaccgcagtcagcaggttaccgacgcgtgtcataaacacggcggcttctacctcggtagcatcggcggtccggcggcggtactggcgcagcagagcatcaagcatctggagtgcgtcgcttatccggagctgggtatggaagctatctggaaaatcgaagtagaagatttcccggcgtttatcctggtcgatgacaaaggtaacgacttcttccagcaaatcgtcaacaaacagtgcgcgaactgcactaagtaa

SEQ ID NO: 89792 - protein, 548 aa, Escherichia coli
MSNKPFIYQAPFPMGKDNTEYYLLTSDYVSVADFDGETILKVEPEALTLLAQQAFHDASFMLRPAHQKQVAAILHDPEASENDKYVALQFLRNSEIAAKGVLPTCQDTGTAIIVGKKGQRVWTGGGDEETLSKGVYNTYIEDNLRYSQNAALDMYKEVNTGTNLPAQIDLYAVDGDEYKFLCVAKGGGSANKTYLYQETKALLTPGKLKNFLVEKMRTLGTAACPPYHIAFVIGGTSAETNLKTVKLASAHYYDELPTEGNEHGQAFRDVQLEQELLEEAQKLGLGAQFGGKYFAHDIRVIRLPRHGASCPVGMGVSCSADRNIKAKINREGIWIEKLEHNPGQYIPQELRQAGEGEAVKVDLNRPMKEILAQLSQYPVSTRLSLTGTIIVGRDIAHAKLKELIDAGKELPQYIKDHPIYYAGPAKTPAGYPSGSLGPTTAGRMDSYVDLLQSHGGSMIMLAKGNRSQQVTDACHKHGGFYLGSIGGPAAVLAQQSIKHLECVAYPELGMEAIWKIEVEDFPAFILVDDKGNDFFQQIVNKQCANCTK

SEQ ID NO: 89793 - DNA, 1545 bp, Mesorhizobium loti MAFF303099
  CDS (1)..(1545): transl_table=11
gtgggaaatagaacacggaccatagccggcaaggacatcacaaggagcgtggccgacgcccttcagtacatctcgtactaccatcctccagattatatccggtctctttcgcaggcctacgcgcgcgaacagagtccagcggcgaagaacgcaatagggcagattctgctgaactcccgcatggcggccttcgggcggcggccgatctgccaggacaccggccttgtggtcgtcttcgcgaaggtcggcatggaaacccgcatcaaatcaacgatcagtttcgcagacctcgtgaacgagggcgtccgtcaggcatatctcgacccggacaatccccttcgggcctcgatcgttgccgatccgctcgccggacgggtcaatactcgtgacaacacgccggcggtcgtccacgttgaccttgtacaaggtaaccagattgagatcaccattgccgcaaaaggcggcgggtcagagaacaaagcacgttttaccaccttgaaccccagcgcctccgtttccgactgggtgattgacacagtatcgacgcttggcagtgggtggtgtccgcccggcctgatctccgtcggcatcggtggtagcgctgaaaaggcgatgctgctggccaaggaggccatgaacaagcccatcgacatgtcggaactaatcgccagggggccgtcaagcgcggaggaggcattgcggattgagctttatgagcggattaacgcgctgggcatcggcgcccaaggcctcggtggcctgacgacagtcgtcgatgtcaaggttgcgacgtatcctacccatgcggcgtccaagcccgtggcgctcattccgcaatgcgccgccaaccggcacctgaagtttaccttggatggctccggaccaatcagggtgcagccgcccgatttgtgcgaatggcccgacattggaaccgacgaattgagtccagccggcgtgcgaagagtcaacctcgatgcgttgaccaaggaagagacggcatcgtggcgctgtggtgaaacgctccttctgtccggaaagatgctgacaggccgtgacgccgcccacaagcgaatggtcgagctgatcgacgccggcaaaccgcttccgttcgatctgcagggacgcgtgatatactacgttggacccgtccgcgccgtgcgagatgaggtcgtcggaccggctggcccaacaacctccagccgcttggacgattttacggacaaggtgctcgccgaaaccgggcttttcgcgatggtgggcaaagcggagaggggacgagcggccatcgagtcgatcgtaagacataaaacgccgtatctcatcgcagtgggtggggctgcctacctgatatcaaaatcaattaagtcagcgcggctcattgccttcgaagacctgggtatggaagcagtctatgaattcgaggtgcaggatatgcccgtgatcatggctgtcgatgttgatggaaactccattcacaattcagggcctcttgagtggcgcaagcgcatggcggccgacagcatcgcacgcaacatcggcgtttga

SEQ ID NO: 89794 - protein, 514 aa, Mesorhizobium loti MAFF303099
MGNRTRTIAGKDITRSVADALQYISYYHPPDYIRSLSQAYAREQSPAAKNAIGQILLNSRMAAFGRRPICQDTGLVVVFAKVGMETRIKSTISFADLVNEGVRQAYLDPDNPLRASIVADPLAGRVNTRDNTPAVVHVDLVQGNQIEITIAAKGGGSENKARFTTLNPSASVSDWVIDTVSTLGSGWCPPGLISVGIGGSAEKAMLLAKEAMNKPIDMSELIARGPSSAEEALRIELYERINALGIGAQGLGGLTTVVDVKVATYPTHAASKPVALIPQCAANRHLKFTLDGSGPIRVQPPDLCEWPDIGTDELSPAGVRRVNLDALTKEETASWRCGETLLLSGKMLTGRDAAHKRMVELIDAGKPLPFDLQGRVIYYVGPVRAVRDEVVGPAGPTTSSRLDDFTDKVLAETGLFAMVGKAERGRAAIESIVRHKTPYLIAVGGAAYLISKSIKSARLIAFEDLGMEAVYEFEVQDMPVIMAVDVDGNSIHNSGPLEWRKRMAADSIARNIGV

SEQ ID NO: 89795 - DNA, 1539 bp, Bacillus halodurans C-125
  CDS (1)..(1539): transl_table=11
atggagaaactgcaggaaagcatgtatcaactcatcgtcgaaacgtcaaccaatttaccgaatgatgtgcgccgtgcgattgcagaagcaaaggcaaaagagaacgctggaacacgggcagcactttctttatcgaccataacagaaaacattaaaatggccgatgaaaatatctctccaatctgtcaagatactgggatgccaacatttgaaataaaggttcccgttggcgtcaaccaaattgagatgaagaaggcgatctatgcagccattgaacaggcaacaaaagatggaaagcttcgtcccaattctgttgattcgctaacagggaaaaatagtggcaacaaccttggagaaggaacgccggtcatccattttgaacaatgggaagaggattacattgatgcccgcttgatcctaaagggaggcggctgtgaaaacaaaaacattcaatatagcttacctgctgaactagaaggtttaggccgtgctggacgtgaccttgacggaatccgtaaatgcattatgcactcggtataccaagctcaaggacaaggctgtagcgctggttttatcggtgttggtattggcggagaccggacaacgagctatagccttgcgaaggagcagctgttccgcaaagtcgatgatgtgaatccgaatgacgacttgcgaaagctcgaagaatacgtattagagaatgcaaataaacttgggatcggtacgatgggctttggtggagaagcaacccttttaggctgtaaggtcggggcgatgaaccgtctcccagcaagcttttttgtctctgttgcgtacaactgctgggcgtttcgtcgtctcggcgtcgagctagacgcggaaaccggtgagattaaaaaatggctctacaaagatggtgaacgagtcgacttaaatgaagtggcaagccaagtcgctgcaaccgctgagacaacggaagtacgtgaggttgtgcttgaagcgccagttacagaagagcaaattcgggaattaaaggtcggggatgtcgttattattaatggcatgcttcacaccggtcgagatgcgatccaccatcacttaatggatcatgatgcaccgatcgacttggacggacaaatcatttaccactgcggaccggtcatgctccaagatgacgcaggggaatggcatgtaaaggcagcaggtccaacgacaagtattcgtgaagagccgtaccaaggagacattatgaaaaaattcggcattcgtgcagtcattggaaaaggtggcatgggaccaaaaacattgaaagccttacaggagcatggcggtgtgtatttgaatgcgattggcggcgctgctcaatattatgcggactgtattaagaaagtgaagggtgtcgacttaatggaatttggaattcctgaagcgatgtggcatttagaagtggaagggttcgcagcgattgtgacgatggattctcatggaaatagtcttcacgaagatgtcgataaatcatcacttgaaaagctcgaacaatttgcagaaaaggtcttttaa

SEQ ID NO: 89796 - protein, 512 aa, Bacillus halodurans C-125
MEKLQESMYQLIVETSTNLPNDVRRAIAEAKAKENAGTRAALSLSTITENIKMADENISPICQDTGMPTFEIKVPVGVNQIEMKKAIYAAIEQATKDGKLRPNSVDSLTGKNSGNNLGEGTPVIHFEQWEEDYIDARLILKGGGCENKNIQYSLPAELEGLGRAGRDLDGIRKCIMHSVYQAQGQGCSAGFIGVGIGGDRTTSYSLAKEQLFRKVDDVNPNDDLRKLEEYVLENANKLGIGTMGFGGEATLLGCKVGAMNRLPASFFVSVAYNCWAFRRLGVELDAETGEIKKWLYKDGERVDLNEVASQVAATAETTEVREVVLEAPVTEEQIRELKVGDVVIINGMLHTGRDAIHHHLMDHDAPIDLDGQIIYHCGPVMLQDDAGEWHVKAAGPTTSIREEPYQGDIMKKFGIRAVIGKGGMGPKTLKALQEHGGVYLNAIGGAAQYYADCIKKVKGVDLMEFGIPEAMWHLEVEGFAAIVTMDSHGNSLHEDVDKSSLEKLEQFAEKVF

SEQ ID NO: 89797 - DNA, 1524 bp, Pseudomonas aeruginosa PAO1
  CDS (1)..(1524): transl_table=11
atggccgtgatcaagcaagacgacctgatccagagcgtcgccgatgccctgcagttcatctcctactaccacccggtcgatttcatccaggccatgcatgaggcctacctgcgcgaagaatcgccggctgcccgcgactccatggcgcagatcctgatcaactcgcgcatgtgcgccaccggccaccgcccgatctgccaggacaccgggatcgtcaccgtgttcgtccgggtcggcatggacgtgcgctgggacggcgctaccatgagcgtcgacgatatgatcaacgaaggcgtgcgtcgcgcctacaacctgccggagaacgtcctgcgcgcctcgatcctggccgacccggccggcgcgcggaagaacaccaaggacaacacgccggcggtgatccactactccatcgttcccggcgacaaggtcgaagtcgatgtcgcggccaagggcggcggctcggagaacaagtcgaagatggccatgctcaacccgtccgactcgatcgtcgactgggtgctgaaaaccgtaccgaccatgggcgccggctggtgcccgccgggcatgctcggcatcggcatcggcggcaccgcggagaaagcagcggtgatggcgaaggaagtcctcatggacccgatcgacatccacgaactgaaggcccgcggcccgcagaaccgcatcgaggaactgcgcctggagctgttcgagaaggtcaaccagttgggcatcggtgcccagggcctgggcggcctgaccaccgtgctcgacgtcaagatcatggactacccgacccacgccgcctcgctgccggtgtgcatgatccccaactgcgccgcgacccgccacgcccacttcgtgctcgacggctccggccccgccgaactggaagcgccgtcgctcgacgcctacccggagatcgtctgggaagccggcccgtccgcgcgccgcgtcgacctggacaagatcaccccggaagaggtgcaaagctggaaaccgggcgagaccctgctgctcaacggcaagatgctcaccggccgcgacgccgcgcacaagcgcatggtcgacatgctgaacaagggcgaaacgctgccggtggacctgaaaggccgcttcatctattacgtcggcccggtcgatccggtcggcgacgaggtggtcggcccggccggtcccaccaccgccacccggatggacaagttcacccgccagatcctcgaacagaccggcctgctgggcatgatcggcaagtccgagcgcggtcccatcgccatcgaggcgatcaaggacaacaaggcggtatacctgatggccgtcggcggcgccgcctacctggtcgcccaggcgatcaagaagtccaaggtgctggccttcgccgaactgggcatggaagcgatctacgagttcgaggtaaaggacatgccggtcaccgtcgcggttgacaccaacggcgagtcggtgcacatcaccggcccagcggtctggcagaagaagatcgccgaaagcctggcggtcgaggtcaagtaa

SEQ ID NO: 89798 - protein, 507 aa, Pseudomonas aeruginosa PAO1
MAVIKQDDLIQSVADALQFISYYHPVDFIQAMHEAYLREESPAARDSMAQILINSRMCATGHRPICQDTGIVTVFVRVGMDVRWDGATMSVDDMINEGVRRAYNLPENVLRASILADPAGARKNTKDNTPAVIHYSIVPGDKVEVDVAAKGGGSENKSKMAMLNPSDSIVDWVLKTVPTMGAGWCPPGMLGIGIGGTAEKAAVMAKEVLMDPIDIHELKARGPQNRIEELRLELFEKVNQLGIGAQGLGGLTTVLDVKIMDYPTHAASLPVCMIPNCAATRHAHFVLDGSGPAELEAPSLDAYPEIVWEAGPSARRVDLDKITPEEVQSWKPGETLLLNGKMLTGRDAAHKRMVDMLNKGETLPVDLKGRFIYYVGPVDPVGDEVVGPAGPTTATRMDKFTRQILEQTGLLGMIGKSERGPIAIEAIKDNKAVYLMAVGGAAYLVAQAIKKSKVLAFAELGMEAIYEFEVKDMPVTVAVDTNGESVHITGPAVWQKKIAESLAVEVK

SEQ ID NO: 89799 - DNA, 1524 bp, Neisseria meningitidis MC58
  CDS (1)..(1524): transl_table=11
atgaccgtcatcaaacaggaagactttatccaaagcatttgcgatgccttccaattcatcagctactatcatcccaaagactacatcgacgcgctttataaggcgtggcagaaggaagaaaatcctgccgccaaagacgcgatgacgcagattttggtcaacagccgtatgtgtgcggaaaacaaccgccccatctgccaagacacaggtatcgcaaccgtcttcctcaaagtcggtatgaacgtccaatgggatgcggacatgagcgtggaagagatggttaacgaaggcgtacgccgcgcctacacttgggaaggcaatacgctgcgcgcttccgtcctcgccgatccggccggcaaacgccaaaacaccaaagacaacacccccgccgtcatccatatgagcatcgtgccgggcggtaaagtcgaagtaacctgcgcggcaaaaggcggcggctctgaaaacaaatccaaactcgccatgctcaatccttccgacaacatcgtcgattgggtattgaaaaccatcccgaccatgggcgcgggctggtgtcctcccggcatcttgggtatcggcatcggcggcacgcccgaaaaagccgtgctgatggcaaaagagtccctgatgagccacatcgacattcaagaattgcaggaaaaggccgcgtccggcgcggaattgtccaccaccgaagccctgcgcctcgaactctttgaaaaagtcaacgcgctgggcatcggcgcacaaggcttgggcggactgaccaccgtgttggacgtgaaaatcctcgattatccgacccacgccgcctccaaaccgattgccatgattccgaactgcgccgccacccgccacgtcgaatttgaattggacggctcaggccctgtcgaactcacgccgccgcgcgtcgaagactggcccgatttgacttacagccccgacaacggcaaacgcgtcgatgtcgacaagctgaccaaagaagaagtggcaagctggaaaaccggcgacgtattgctgttgaacggcaaaatcctcaccggccgcgatgccgcacacaaacgcctcgtcgatatgctcaacaaaggcgaagaattgcccgtcgatttcaccaaccgcctgatttactacgtcggccccgtcgatccggtcggcgatgaagtcgtcggtccggcaggtccgaccacagccacccgcatggacaaattcacccgccaaatgctcgaacaaaccgacctcttgggcatgatcggcaaatccgagcgcggcgtggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagatagcaaaggcgaatccatccacgccaccgccccgcgcaaatggcaggcgaaaatcggcatcatccccgtcgaatcttga

SEQ ID NO: 89800 - protein, 507 aa, Neisseria meningitidis MC58
MTVIKQEDFIQSICDAFQFISYYHPKDYIDALYKAWQKEENPAAKDAMTQILVNSRMCAENNRPICQDTGIATVFLKVGMNVQWDADMSVEEMVNEGVRRAYTWEGNTLRASVLADPAGKRQNTKDNTPAVIHMSIVPGGKVEVTCAAKGGGSENKSKLAMLNPSDNIVDWVLKTIPTMGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDWPDLTYSPDNGKRVDVDKLTKEEVASWKTGDVLLLNGKILTGRDAAHKRLVDMLNKGEELPVDFTNRLIYYVGPVDPVGDEVVGPAGPTTATRMDKFTRQMLEQTDLLGMIGKSERGVATCEAIADNKAVYLMAVGGAAYLVAKAIKSSKVLAFPELGMEAIYEFEVKDMPVTVAVDSKGESIHATAPRKWQAKIGIIPVES

SEQ ID NO: 89801 - DNA, 1641 bp, Neisseria meningitidis Z2491
  CDS (1)..(1641): transl_table=11
ttgtctttaccgtacaaacgctggcactatttcaacctgataaaaaacagccttcaaaaaggttgtttaaaacagcagcagacacttaccgccacaaccttgaaaaggaacacaatcatgaccgtcatcaaacaggaagactttatccaaagcatttgcgatgccttccaattcatcagctactaccatcccaaagactacatcgacgcgctttataaggcgtggcagaaggaagaaaaccccgccgccaaagacgcgatgacgcagattttggtcaacagccgcatgtgtgccgaaaacaaccgccccatctgccaagataccggtatcgcgaccgtgtttttgaaagtcggtatggatgtgcaatgggatgcagacatgagcgtcgaagagatggttaacgaaggcgtgcgccgcgcctacacttgggaaggcaatacgctgcgcgcttccgttctcgccgaccccgccggcaaacgccaaaataccaaagacaacacgcccgccgtcatccatatgagcatcgtgccgggcgacaaagtcgaagtaacctgcgcggcaaaaggcggcggttctgaaaacaaatccaaactcgccatgctcaacccttccgacaacatcgtcgattgggtattgaaaaccattccgaccatgggcgcgggctggtgtcctcccggcatcttgggcatcggcatcggcggtacgcccgaaaaagccgtgttgatggcgaaagaatccctgatgagccacatcgacatccaagaattgcaggaaaaagccgcgtccggcgcggaattgtccaccaccgaagccctgcgcctcgaactctttgaaaaagtcaacgcgctaggcatcggcgcgcaaggcttgggcggtctgaccaccgtgttggacgtgaaaatcctcgattacccgacccacgccgcctccaaaccgattgccatgattccgaactgcgccgccacccgccacgtcgaatttgaattggacggctcaggccctgtcgaactcacgccgccgcgcgtcgaagactggcccgatttgacttacagccccgacaacggcaaacgcgtcgatgtcgacaagctgaccaaagaagaagtggcaagctggaaaaccggcgacgtattgctgttgaacggcaaaatcctcaccggccgcgatgccgcacacaaacgcctcgtcgatatgctcgacaaaggcgaagaattgcccgtcgatttcaccaaccgcctgatttactacgtcggccccgtcgatccggtcggcgacgaaatcgtcggcccagcaggtccgaccaccgccacccgcatggacaaattcacccgccaaatgctcgaacaaaccgacctcttgggcatgatcggcaaatccgagcgcggcgcggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagacagcaaaggcgaatccatccacgccaccgccccgccccaatggcaggcgaaaatcggcatcatccccgtcaaatcttga

SEQ ID NO: 89802 - protein, 546 aa, Neisseria meningitidis Z2491
MSLPYKRWHYFNLIKNSLQKGCLKQQQTLTATTLKRNTIMTVIKQEDFIQSICDAFQFISYYHPKDYIDALYKAWQKEENPAAKDAMTQILVNSRMCAENNRPICQDTGIATVFLKVGMDVQWDADMSVEEMVNEGVRRAYTWEGNTLRASVLADPAGKRQNTKDNTPAVIHMSIVPGDKVEVTCAAKGGGSENKSKLAMLNPSDNIVDWVLKTIPTMGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDWPDLTYSPDNGKRVDVDKLTKEEVASWKTGDVLLLNGKILTGRDAAHKRLVDMLDKGEELPVDFTNRLIYYVGPVDPVGDEIVGPAGPTTATRMDKFTRQMLEQTDLLGMIGKSERGAATCEAIADNKAVYLMAVGGAAYLVAKAIKSSKVLAFPELGMEAIYEFEVKDMPVTVAVDSKGESIHATAPPQWQAKIGIIPVKS

SEQ ID NO: 89803 - DNA, 1656 bp, Xylella fastidiosa 9a5c
  CDS (1)..(1656): transl_table=11
ttggaagaaaatttaagcgataagcggggtagggatgtaagcggtttcagtggggggatcgcaatgtttatcctatggctgatgtattcagggggattacaatggcaacgttttttagtcagccataagggccagccggtgtcattgatcaaacaagaagactttatccagtccatcgctgatgcgctgcaatacatcagttactaccatccggtcgattacatcaagactctggttttggcgtatgagcgcgaggaatcgcccgccgctaaagatgcaatggcgcagattttgattaactcacgtatgtgtgcggaggggcgccgcccgatttgccaagatacagggattgtcacggtgttccttagcatcgggatggaggtacgttgggatgacgtcacgatggatgtggaagagatggtgaatgagggggttcgccgtgcctatcgtcatccggataacacgctacgtgcgtctgtgcttgctgatcctgccggcaagcgctgcaatacgagggacaatacgccagcagtcgttaacgtcaaggttgtttctgggggccatgttgaagtgattgttgctgccaagggagggggatcggaggccaagagcaaatttgcaatgctaaatccatcggattccatcgttgattgggtcctggacactgtgccaaccatgggggctggctggtgcccaccagggatgcttgggatcggtatcggtggtacggctgagaaagcgatgctgctcgctaaggaagcgttgatggaaccgattgacatccaggatttgatggtacgcggcccttccaatcgtgctgaagaattacgcttggagttgtacgagaaggtcaatgctttggggatcggtgctcagggggtgggtggggtgacgacggtattagacattaaagtcaaagattatccaacgcatgctgctaatttgccggtagcgatgatccctaattgtgcgtccacacgccatgcccatttcacattggacggtagcggtccagttgctctggaaccgccgtcattagagcattggcctaagttgagctatctcccggagtctgcccgccaggtgaatttgaatacgatgaccagggatgaggtggcgcagttcaaaccaggtgaggtgttgctactcagcggcaaattgttgacggggcgagatgctgcgcataagcgtatcgttgagatgctcaacaagggggagacattaccagttgatttcacgaatcgctttatctactacgtgggtccggtggatcctgtgcgtgatgaagtcgtcggtcctgcgggtccaaccacagcaacgcgtatggataagttcacgcgtcagatgctggagcaggccgggttgctcggtatggtgggcaaggccgagcgtggccctactgccatcgctgcaatccgtgacaacaaagccgtgtatctgatggcggtgggaggggcggcttatcttgtgtccaaggcgatcaaaacgagccggatactggcttttgaagatcttggcatggaggcaatttatgagtttgaagtcaaggagatgcctgtaacagtggcggttgattgcaacggtgagtcgatacatacaactgggccgcgtgagtggcggagccggatcggaaaaattccggttgttgtggagtag

SEQ ID NO: 89804 - protein, 551 aa, Xylella fastidiosa 9a5c
MEENLSDKRGRDVSGFSGGIAMFILWLMYSGGLQWQRFLVSHKGQPVSLIKQEDFIQSIADALQYISYYHPVDYIKTLVLAYEREESPAAKDAMAQILINSRMCAEGRRPICQDTGIVTVFLSIGMEVRWDDVTMDVEEMVNEGVRRAYRHPDNTLRASVLADPAGKRCNTRDNTPAVVNVKVVSGGHVEVIVAAKGGGSEAKSKFAMLNPSDSIVDWVLDTVPTMGAGWCPPGMLGIGIGGTAEKAMLLAKEALMEPIDIQDLMVRGPSNRAEELRLELYEKVNALGIGAQGVGGVTTVLDIKVKDYPTHAANLPVAMIPNCASTRHAHFTLDGSGPVALEPPSLEHWPKLSYLPESARQVNLNTMTRDEVAQFKPGEVLLLSGKLLTGRDAAHKRIVEMLNKGETLPVDFTNRFIYYVGPVDPVRDEVVGPAGPTTATRMDKFTRQMLEQAGLLGMVGKAERGPTAIAAIRDNKAVYLMAVGGAAYLVSKAIKTSRILAFEDLGMEAIYEFEVKEMPVTVAVDCNGESIHTTGPREWRSRIGKIPVVVE

SEQ ID NO: 89805 - DNA, 1647 bp, Escherichia coli K12
  CDS (1)..(1647): transl_table=11
atgtcaaacaaaccctttcattatcaggctccttttccactcaaaaaagatgatactgagtattacctgctaaccagcgaacacgttagcgtatctgaatttgaagggcaggagattttgaaagtcgcacccgaagcgttaactctgttggcgcgccaggcgtttcatgatgcgtcgttcatgctgcgtccggcgcaccaacaacaggtggccgacattctgcgtgacccggaggccagcgaaaatgataaatatgtggcgctgcaattcctgcgtaactccgacatcgcggcgaaaggcgttctgccaacctgtcaggataccggcaccgcgattattgttggtaaaaaagggcagcgtgtatggaccggtggtggtgatgaagcggcgctggcgcgcggtgtctataacacttatatcgaagataatctgcgctactcgcaaaacgcgccgctggatatgtataaagaagtgaataccggcaccaatctgccagcgcagatcgatctttatgccgttgatggcgacgaatacaaattcctctgtatcgccaaaggtggtggttcggcaaacaagacgtatctctatcaggaaaccaaagcgttactgacgccggggaaactgaaaaattacctggttgagaagatgcgcacgctgggtacggcggcctgtcctccgtatcatattgcgttcgttattggtggaacttctgcagaaacgaaccttaaaacggtgaaactggcttccgcgaaatactatgatgaactgccaacggaagggaatgagcacggtcaggcgttccgcgatgtggaactggaaaaagaattgctgatcgaagcgcaaaatcttggtctgggtgcgcagtttggtggtaaatacttcgctcacgacatccgcgtgattcgcctgccacgtcacggcgcatcctgcccggtcggtatgggcgtctcctgctctgctgaccgtaatatcaaagcgaagatcaaccgtcaggggatctggatcgaaaaactggaacataatccaggcaaatatatcccggaagagctgcgcaaagcgggagaaggcgaagcggtgcgcgttgaccttaaccgtccgatgaaagagatcctcgcacagttgtcgcagtatcccgtttctacacgcttatcgcttaacggcacgattatcgtcggtcgtgatattgctcacgccaaactgaaagagcggatggataacggtgaagggctgccgcagtacatcaaagatcatccgatttactacgcgggtccggccaaaacgccggaaggttatgcctccggttctcttggcccaacgaccgccggacggatggattcttatgtcgatcaactgcaagcgcagggcggaagtatgatcatgctggcgaaaggcaaccgcagccagcaggtgacggatgcctgtaaaaaacacggcggcttctaccttggcagtatcggtggtccggccgctgtattggcgcagggaagtattaagagcctggaatgtgttgaatatccggaactgggaatggaagccatctggaaaattgaagtggaagatttcccggcgtttatccttgtggatgataaaggaaatgacttcttccagcagatacaactcacacaatgcacccgctgtgtgaaataa

SEQ ID NO: 89806 - protein, 548 aa, Escherichia coli K12
MSNKPFHYQAPFPLKKDDTEYYLLTSEHVSVSEFEGQEILKVAPEALTLLARQAFHDASFMLRPAHQQQVADILRDPEASENDKYVALQFLRNSDIAAKGVLPTCQDTGTAIIVGKKGQRVWTGGGDEAALARGVYNTYIEDNLRYSQNAPLDMYKEVNTGTNLPAQIDLYAVDGDEYKFLCIAKGGGSANKTYLYQETKALLTPGKLKNYLVEKMRTLGTAACPPYHIAFVIGGTSAETNLKTVKLASAKYYDELPTEGNEHGQAFRDVELEKELLIEAQNLGLGAQFGGKYFAHDIRVIRLPRHGASCPVGMGVSCSADRNIKAKINRQGIWIEKLEHNPGKYIPEELRKAGEGEAVRVDLNRPMKEILAQLSQYPVSTRLSLNGTIIVGRDIAHAKLKERMDNGEGLPQYIKDHPIYYAGPAKTPEGYASGSLGPTTAGRMDSYVDQLQAQGGSMIMLAKGNRSQQVTDACKKHGGFYLGSIGGPAAVLAQGSIKSLECVEYPELGMEAIWKIEVEDFPAFILVDDKGNDFFQQIQLTQCTRCVK

SEQ ID NO: 89807 - DNA, 1524 bp, Ralstonia solanacearum GMI1000
  CDS (1)..(1524): transl_table=11
atgaccgtcattcgtcaagaagacctcatccagagcgtcgccgactccctgcagtacatcagctattaccacccgatggactacatcactgctctgggccaggcctatgagcaggagcagagcccggccgccaaggatgccatcgcgcagatcctgaccaacagccgcatgtgcgccgaaggcaagcgcccgatctgccaggacaccggcatcgtcaccgtgttcctgaaagtcggcatgaacgtgcgctgggacggcgccacgatgagcctggaagacatggtcaacgaaggcgtgcgccgcgcctataacgaccaggacaacaagctgcgcgccagcgtcctggccgacccggccggcaagcgcaccaacacgaaggacaacaccccggcggtgatcaacatgtccatcgtgccgggcgacacagtggacgtgatcgtcgcggccaagggcggcggctccgaggccaagtccaagttcgtgatgctcaacccgtccgactcgatcgtcgactgggtgctcaagacggtgccgaccatgggcgccggctggtgcccgccgggcatgctgggcatcggcatcggcggcaccgccgagaaggcgatgctgctggccaaggaagccctgatggagccgatcgacatccaggacctgatcgcgcgcggcccgtcgaaccgcgccgaagagctgcgcatcgagctctacgaaaaggtcaacgcactgggtatcggggcccagggcctgggcggcctcgccaccgtgctcgacgtgaagatcaaggactacccgacccacgccgccaacctgccggtggccatgatcccgaactgcgcggccacccgccacgcgcacttcacgctggacggcagcggcgtcgccaagctcgaagcgccggacctgtcgcaatggccgaaggtcgagtgggcgccgaacaccgaaacctccaagcgcgttgatctgaacgcgctcacgccggaagaagtcgcctcgtggaagccgggccaaaccctgctgctcaacggcaagatgctcacgggccgcgacgccgcgcacaagcgcatcgccgacatgctggcccgcggcgaacagttgccgatcgacttcaccaaccgcgtgatctactacgtcggcccggtcgatccggtgcgcgacgaggtggtcggtccggccggccccaccacggccacgcgcatggacaagttcaccgagacgatgctcgccaagaccggcctgatcgccatggtcggcaaggccgagcgcggtccggtcgccatcgaggccatccagaagcacaagtcggcctacctgatggccgtgggcggcgcggcctaccttgtgtccaaggccatccgcggcgcgaaggtgctggcattcgaagacctgggcatggaagccatctacgaattcgacgtgaaggacatgcccgtcaccgtggcggtcgacagcgcgggcacctcggtgcacaagaccggcccggcggaatggcaggccaagatcggcaagatcccggtcgccgcggcgtga

SEQ ID NO: 89808 - protein, 507 aa, Ralstonia solanacearum GMI1000
MTVIRQEDLIQSVADSLQYISYYHPMDYITALGQAYEQEQSPAAKDAIAQILTNSRMCAEGKRPICQDTGIVTVFLKVGMNVRWDGATMSLEDMVNEGVRRAYNDQDNKLRASVLADPAGKRTNTKDNTPAVINMSIVPGDTVDVIVAAKGGGSEAKSKFVMLNPSDSIVDWVLKTVPTMGAGWCPPGMLGIGIGGTAEKAMLLAKEALMEPIDIQDLIARGPSNRAEELRIELYEKVNALGIGAQGLGGLATVLDVKIKDYPTHAANLPVAMIPNCAATRHAHFTLDGSGVAKLEAPDLSQWPKVEWAPNTETSKRVDLNALTPEEVASWKPGQTLLLNGKMLTGRDAAHKRIADMLARGEQLPIDFTNRVIYYVGPVDPVRDEVVGPAGPTTATRMDKFTETMLAKTGLIAMVGKAERGPVAIEAIQKHKSAYLMAVGGAAYLVSKAIRGAKVLAFEDLGMEAIYEFDVKDMPVTVAVDSAGTSVHKTGPAEWQAKIGKIPVAAA

SEQ ID NO: 89809 - DNA, 1677 bp, Streptomyces coelicolor A3(2)
  CDS (1)..(1677)
atgggcgagatgcctgagttcgcgtacaccgatctgctcccccagggcgaggacaccactccgtaccggctggtgaccgccgagggtgtcgccaccttcgaggccgacgggcggaccttcctcaaggtggagccggaggccctgcgcaagctggccgaggaggccgttcacgacatccagcactacctgcgcccggcgcacctggcacagctgcgccgcatcatcgacgacccggaggcgtccggcaacgacaagttcgtcgccctggacctgctgaagaacgcgaacatcgcggctgcgggcgtgctgccgatgtgccaggacaccggcacggcgatcgtcatgggcaagcgcggccagaacgtgctcaccgagggcggtgacgaggaggccctgagccggggcatctacgacgcgtacaagaacctgaacctgcgctactcccagatggccccgctgaccatgtgggaggagaagaacaccggctccaacctccccgcccagatcgagctgtacgcgaccgacggcggcgcctacaagttcctcttcatggcgaagggcggcggctcggccaacaagtccttcctctaccaggagacgaaggccgtcctgaacgagtcctccatgatgaagttcctggaggagaagatccgctcgctcggcacggccgcctgcccgccgtaccacctggcgatcgtggtcggcggcacgtcggccgagtacgcgctgaagaccgcgaagtacgcctccgcgcactacctggacgagatcccggccgagggctcggagctcgggcacggcttccgggacaaggagctggaggagaaggtcttcgagctgacccagaagatcggcatcggcgctcagttcggcggcaagtacttctgccacgacgtgcgcgtggtgcggctgccccggcacggggcgtcctgcccggtcgccatcgcggtgtcctgctcggcggaccggcaggcggtcgcgaagatcaccgccgagggcgtcttcctggagcagctggagaccgacccggcgcggttcctgccggagaccacggacgagcatctggaggaggagggcgacgtcgtcaaggtcgacctcaaccagccgatggacgacatcctcgccgagctgaccaggcacccggtcaagacccggctgtcgctgaccggtccgctggtggtggcccgcgacatcgcgcacgccaagatcaaggagcggctggacgcgggcgaggagatgccgcagtacctgaaggaccacccggtgtactacgcgggccccgcgaagacgcccgagggctacgcctccgggtccttcggtccgaccaccgccgggcgcatggactcctacgtcgagcagttccaggcggcgggcggctccaaggtgatgctggccaagggcaaccggagcaagcaggtcaccgacgcgtgcgacgcgcacggcggcttctacctgggctcgatcggcgggcccgcggcgcggctcgcacaggactgcatcaagaaggtcgaggtcgtcgagtacgaggagctcggcatggaggcggtctggaagatcgaggtcgaggacttccccgcgttcatcgtggtggacgacaagggcaacgacttcttccaggacccggcgcccgcgccgacgttcacgacgattccggtacgggggccgggcctggcgtaa

SEQ ID NO: 89810 - protein, 558 aa, Streptomyces coelicolor A3(2)
MGEMPEFAYTDLLPQGEDTTPYRLVTAEGVATFEADGRTFLKVEPEALRKLAEEAVHDIQHYLRPAHLAQLRRIIDDPEASGNDKFVALDLLKNANIAAAGVLPMCQDTGTAIVMGKRGQNVLTEGGDEEALSRGIYDAYKNLNLRYSQMAPLTMWEEKNTGSNLPAQIELYATDGGAYKFLFMAKGGGSANKSFLYQETKAVLNESSMMKFLEEKIRSLGTAACPPYHLAIVVGGTSAEYALKTAKYASAHYLDEIPAEGSELGHGFRDKELEEKVFELTQKIGIGAQFGGKYFCHDVRVVRLPRHGASCPVAIAVSCSADRQAVAKITAEGVFLEQLETDPARFLPETTDEHLEEEGDVVKVDLNQPMDDILAELTRHPVKTRLSLTGPLVVARDIAHAKIKERLDAGEEMPQYLKDHPVYYAGPAKTPEGYASGSFGPTTAGRMDSYVEQFQAAGGSKVMLAKGNRSKQVTDACDAHGGFYLGSIGGPAARLAQDCIKKVEVVEYEELGMEAVWKIEVEDFPAFIVVDDKGNDFFQDPAPAPTFTTIPVRGPGLA

SEQ ID NO: 89811 - DNA, 1512 bp, Chlorobium tepidum TLS
  CDS (1)..(1512): transl_table=11
atgatcgccttgatcaccgagacctccacgaatctgccgagcgacgttcgcaaggccatcgccgatgccgttggcaatgatgctgccgattcgagggccggacttgccatgtctgccatcacgctcaatatcgacatggcggtcgataatgtcggcccggtttgccaggataccggtatgcctaccttcttcgtgcacacgccgaaaggcgctgaccagctcgccatgaagcgcgacatcgaggaggctgtcgtcgaggcaacccgaaccggcaagcttcgtcccaatgcggtcgattcgctgaccggtaagaactccggcaacaaccttggctgccatgtgccggtgatccatttcgagccgtgggatcgcgacgagatcgaggtgaagctcatcctcaaaggcggcggctgcgagaacaaaaacatccagtactcgctgcctgccgatattcccggacttggccgcgcggctcgcgacctcgacggcgtgcgtaagtgcatcctccacgccgtgtaccaggcgcagggacaggggtgcagccccggcttcatcggcgtcggcgtcggtggcgaccgcaccagcagcttcgagctggccaagaagcagttgctccgctcggtcgatgacaccaattccgatgcggtgctggccgaactcgaacaggagattctcgacaaggctaaccgcctgaacatcgggccgatgggctttgccggcaagaccacgctgcttggctgcaagatcggcacatcgcatcgcgttccggctagcttctttgtctcggtagcctacaattgctgggcctatcgccgtcttggcgtcatcatcgacccgaaagagggttcgatttccgagtggcagtaccgctatccgggcgaaatcaagcgcatggcgcgcggcgcgggcattccgctgacgggccgtgaggtggtgctcaccgcgccggtcagcgaggagacgatccgctcgctcaaggttggcgacatcgtgatcgttgatggcgaaatgcacaccggacgcgatgccttccaccactacatcatgcaccatgatctgcccgagggtctcgacatccgcggcggcatcatctaccactgcggcccggtgatgctcaagaacgaggcgggcgagtacacggtcgttgctgccgggccgaccacttcgattcgcgaggagccttaccagtcggacgtgatcgaaaagctcggacttcgcgcggtgattggcaagggcggcatggggccgaagacgcttgcgggcttgcagaagcacggtgcggtctatctcaacgccatcggcggtgcggcgcagtactacgccaggtgcatcgaaaaggtgaccggcgtcgatttcttggaagagatgggcgtgccggaggcgatgtggcacttgcaggccaaagccttcccgtgcatcgtcacgatggacgcgcacggcaacagcctgcacaagcaggtcgatgaggagtccttcgcgatgcttgaaaacatcggcaaggagcaggcgtaa

SEQ ID NO: 89812 - protein, 503 aa, Chlorobium tepidum TLS
MIALITETSTNLPSDVRKAIADAVGNDAADSRAGLAMSAITLNIDMAVDNVGPVCQDTGMPTFFVHTPKGADQLAMKRDIEEAVVEATRTGKLRPNAVDSLTGKNSGNNLGCHVPVIHFEPWDRDEIEVKLILKGGGCENKNIQYSLPADIPGLGRAARDLDGVRKCILHAVYQAQGQGCSPGFIGVGVGGDRTSSFELAKKQLLRSVDDTNSDAVLAELEQEILDKANRLNIGPMGFAGKTTLLGCKIGTSHRVPASFFVSVAYNCWAYRRLGVIIDPKEGSISEWQYRYPGEIKRMARGAGIPLTGREVVLTAPVSEETIRSLKVGDIVIVDGEMHTGRDAFHHYIMHHDLPEGLDIRGGIIYHCGPVMLKNEAGEYTVVAAGPTTSIREEPYQSDVIEKLGLRAVIGKGGMGPKTLAGLQKHGAVYLNAIGGAAQYYARCIEKVTGVDFLEEMGVPEAMWHLQAKAFPCIVTMDAHGNSLHKQVDEESFAMLENIGKEQA

SEQ ID NO: 89813 - DNA, 1644 bp, Yersinia pestis KIM
  CDS (1)..(1644): transl_table=11
atgtcaaacaaaccgttccactatcaggatcccttcccgctcaaggaagatgatactgaatattaccttgtcagtgataaacatgtctcagttgcacagtttgaaggacacgacatcctaaaagtcgagccggaagccctgaccctcctcgctcaacaggctttccacgatgcctctttcctcctgcgccccgctcaccaaaaacaagttgccgccattctggatgacccggaagccagcgaaaacgataaatatgtcgccctgcaattcctacgtaactctgagatttcggctaaagggattttacccacctgtcaagataccggcaccgcgatcatcatgggcaaaaaaggccagcgggtctggactgggggtaacgatgccgaagcgttatcacgtggggtctataacacctttattgaagataacctgcgctattcacaaaacgccgcgctggatatgtataaggaagtgaataccggtaccaacctgccagcacagatcgatctatacagcaccgaaggtgaagagtacaaattcttgtttgtgactaaaggcggcggttcagccaataaaacctatctgtatcaggaaaccaaagccctgctcacaccgggcaggctgaaagcgtttttggtcgagaaaatgcgcacattgggtaccgcggcttgcccgccttatcacattgcctttgtcatcggcggtacctctgccgaaagtacgctgaagacggttaaactggcctcgaccaaatattacgatggcttgccgaccgaagggaatgaacacggccaagcgttccgtgacactgcgttagagcaagaattgctggaagcagcacaagatttaggtctgggcgcgcaatttggcggcaaatactttgcccacgatgttcgggtcgttcgcctgccacgccacggagcctcctgcccggtcggcatgggggtatcttgttctgctgaccgtaatatcaaaggcaaaattaaccgcaaaggcatttggttggagaaactggaacagaatccagggaaatatattcccgaacatttgcgccacagcactgaaggccaagtggttaaaattgatcttaaccgcccgatgcctgaaattttaaaagagctgtcacagtacccggtctccacccgcctgtcgttaagcggcaccattattgttggccgtgatatcgcccatgccaaattaaaagagcggctggataacggtgaaggcttaccacaatacattaaagatcatccgatctattacgccggaccggccaaaacccccgaaggctatgcttcaggatcactcgggccaaccaccgcagggcgcatggactcttacgtggatctgctgcaatcccacgggggtagcatgatcatgttagccaaaggcaaccgtagccagcaagtgaccgacgcctgccataaacacgggggcttctatctgggcagcatcggtggcccggcagcggtattggcgcaaaacagtattaagagtctggaatgtgtggaatatcctgaattagggatggaagccatctggaagattgaagtggaagacttcccagcctttattttagttgatgataagggcaatgatttcttccagcagatccaagcggcaaaatgcaaccgttgtggctga

SEQ ID NO: 89814 - protein, 547 aa, Yersinia pestis KIM
MSNKPFHYQDPFPLKEDDTEYYLVSDKHVSVAQFEGHDILKVEPEALTLLAQQAFHDASFLLRPAHQKQVAAILDDPEASENDKYVALQFLRNSEISAKGILPTCQDTGTAIIMGKKGQRVWTGGNDAEALSRGVYNTFIEDNLRYSQNAALDMYKEVNTGTNLPAQIDLYSTEGEEYKFLFVTKGGGSANKTYLYQETKALLTPGRLKAFLVEKMRTLGTAACPPYHIAFVIGGTSAESTLKTVKLASTKYYDGLPTEGNEHGQAFRDTALEQELLEAAQDLGLGAQFGGKYFAHDVRVVRLPRHGASCPVGMGVSCSADRNIKGKINRKGIWLEKLEQNPGKYIPEHLRHSTEGQVVKIDLNRPMPEILKELSQYPVSTRLSLSGTIIVGRDIAHAKLKERLDNGEGLPQYIKDHPIYYAGPAKTPEGYASGSLGPTTAGRMDSYVDLLQSHGGSMIMLAKGNRSQQVTDACHKHGGFYLGSIGGPAAVLAQNSIKSLECVEYPELGMEAIWKIEVEDFPAFILVDDKGNDFFQQIQAAKCNRCG

SEQ ID NO: 89815 - DNA, 1620 bp, Brucella suis 1330
  CDS (1)..(1620): transl_table=11
atggcagaagcaagcaccgccgatcttttccctcttggcgaagacgacaccccttatcgcaaactgacttcggattatgtgtcggtggacacgttcaaggggcaggaagtcctgactgtggacccggaagggcttcgcctgctttcagaagtagcctttgccgatatcaaccatctgctgcgccccggccatctgcaacagcttgcaaagattcttcaggatcccgaagcaaccgacaatgaccgcttcgtcgcctacgaccttttgaagaacgccaatatcgcagccggcggcgtgctgcccatgtgccaggataccggcacggccattatcatgggcaagaagggccgccgcgtctggaccgaaggcggcgatgccgatgcgctcggcgccggtgtgctggacgcctataacaagaagaacctgcgttattcgcagctcgccccgctttcgatgttcgaggaaaagaacaccaagaacaacctgcccgcgcagatcgatatctatgaagaaggcgaagacgcctacaagttcctgttcgttgccaagggcggcggttcggcgaacaagacgtttctctatcagggaacgccttcgcttctgacgcatgaccgcatgattgatttcctcaaggacaaaatcctgagcctcggcacagccgcctgcccgccctatcatctggccatcgtcattggcggcacttcggcggaaatgaacctgaagacggtgaagcttgcttccacgcgctatctcgacagcctgccgaccaaaggctcggaaaccggccacgccttccgcgaccttgaaatggaagcagaaattcacaagctgacccagtcgctcggtgtcggcgcgcagttcggcggcaaatatttctgccatgacgtgcgcgtcatccgcctgccccgccacggcgcttcgctgccgatcggcatcggcgtttcctgttcggccgaccgtcaggcgaagggcaagatcaccaaggacggcattttccttgagcagcttgaagccaatccggcaaaatacatgccggatatcgacgaggaaaagctgaccgcgcatgtggtcaagatcgacctcaaccagccgatgtcggaaatactcaaggaactctcgaagcatccggtcaagacgcgtctttcgctctccggcccgatcatcgtggcgcgcgatctggcacatgcgaaaatccgcgaacggctggaaaacggcgagccaatgccggattacttcaagaaccacccgatctattatgcgggccccgccaagacgcccgcgggctatgcttccggctccttcgggccgacaacggcaggccgcatggattcctacgtggaccagttccagtctttcggcggctccatggtcatgctcgccaagggcaaccgttcgcgccaggtgcgcgaagcctgcggccagcacgggggcttctatctcggctccatcggcgggccggccgcacgtcttgcgcaagactgcatcaaaaaggtggaagtcgtcgagtacccggaacttggcatggaggccatctggcgcattgaagtcgaagatttcccggctttcatcgttatcgatgacaagggcaatgacttcttcaaggaattcaacctgagttga

SEQ ID NO: 89816 - protein, 539 aa, Brucella suis 1330
MAEASTADLFPLGEDDTPYRKLTSDYVSVDTFKGQEVLTVDPEGLRLLSEVAFADINHLLRPGHLQQLAKILQDPEATDNDRFVAYDLLKNANIAAGGVLPMCQDTGTAIIMGKKGRRVWTEGGDADALGAGVLDAYNKKNLRYSQLAPLSMFEEKNTKNNLPAQIDIYEEGEDAYKFLFVAKGGGSANKTFLYQGTPSLLTHDRMIDFLKDKILSLGTAACPPYHLAIVIGGTSAEMNLKTVKLASTRYLDSLPTKGSETGHAFRDLEMEAEIHKLTQSLGVGAQFGGKYFCHDVRVIRLPRHGASLPIGIGVSCSADRQAKGKITKDGIFLEQLEANPAKYMPDIDEEKLTAHVVKIDLNQPMSEILKELSKHPVKTRLSLSGPIIVARDLAHAKIRERLENGEPMPDYFKNHPIYYAGPAKTPAGYASGSFGPTTAGRMDSYVDQFQSFGGSMVMLAKGNRSRQVREACGQHGGFYLGSIGGPAARLAQDCIKKVEVVEYPELGMEAIWRIEVEDFPAFIVIDDKGNDFFKEFNLS

SEQ ID NO: 89817 - DNA, 1551 bp, Shewanella oneidensis MR-1
  CDS (1)..(1551): transl_table=11
atgtcatctcaccatgaaacgtctgaaaatgtagtgattaaacaagccgacttcattgaaagtgtggcggatgccctgcaatacatctcctactaccaccccaaagattttgtcgatgccatgagcgaagcttatgagcgtgaacaaagtgctgcggcgaaggatgcaattgcacaaattttgattaactcgcgcatgtctgccgaaggcaaacgtccactgtgccaagacacgggtatcgtgaccacgtttgttaaagtgggtatgggggttaagtgggataaaactgatatgaccattcaacaaatggtcgatgaaggtgtgcgtcgtgcttacaccaacccagataatccactgcgtgcatcaattgtggcggatcctgcaggtagccgtaaaaacaccaaagacaacaccccatcagttgtgcatatcgatatggtgccaggtaatcatgttgaagttgctatcgcagcaaaaggcggcggcagtgaaaacaaagctaagatggtgatgttaaacccatcggacgatatcgccgcttgggttgaaaaaacgctgcccaccatgggcgcgggctggtgtcctcctggtatgctcggtatcggtattggcggcaccgctgaaaaagcggccgtattggccaaagaagccctgatggaaagcgtggatatccatgagttaatggcgcgcggtgcacaaactacagaagaaaaactgcgtttagatatctttgaacgtgccaacaacttaggtattggtgcgcaggggcttggcgggttaaccacggttttagacgtgaaaatcaagtctgcaccgacccacgcggcatcaaaacctgtggtgatgatccccaactgcgccgcaactcgtcacgtgcatttccacttagacggcacgggtcctgctgatcttgcgccgccatcactcagcgactggccagaaatcacccgcgaagtgggcagcgatgtgcgccgtgttaacttagacacagtcacacaagccgatatcgaacagtggcagagcggtgaaaccctgctgctgagcggtaaaatgctcaccggccgtgacgctgcccataaacgtatccaaagcctgattgaaagcggcgaaggtttaccagaaggcgtcgactttactggtaagtttatttattacgttggcccagttgaccccgtgggtaatgaagtggtggggcctgcaggacctacaaccgcgacccgtatggacaagtttactgacctgatgctggataagactggcctgatgggcatgatcggtaaggctgagcgtggtcctgcaaccgttgaatctatcaagaagcacaaagcggtgtacttgatggctgttggcggcgcggcttacttagtgtcaaaagccattaaaaaatcccgtgtggtagcttttgccgatttaggtatggaagcgatttacgagtttgatgtgcaggatatgccagtcactgtagcggttgactcaaacggcgtgaatgcccatgaaacgggtcctgcgatttggaaagtgaatatcgctaacgcgaatgcaaaagcctaa

SEQ ID NO: 89818 - protein, 516 aa, Shewanella oneidensis MR-1
MSSHHETSENVVIKQADFIESVADALQYISYYHPKDFVDAMSEAYEREQSAAAKDAIAQILINSRMSAEGKRPLCQDTGIVTTFVKVGMGVKWDKTDMTIQQMVDEGVRRAYTNPDNPLRASIVADPAGSRKNTKDNTPSVVHIDMVPGNHVEVAIAAKGGGSENKAKMVMLNPSDDIAAWVEKTLPTMGAGWCPPGMLGIGIGGTAEKAAVLAKEALMESVDIHELMARGAQTTEEKLRLDIFERANNLGIGAQGLGGLTTVLDVKIKSAPTHAASKPVVMIPNCAATRHVHFHLDGTGPADLAPPSLSDWPEITREVGSDVRRVNLDTVTQADIEQWQSGETLLLSGKMLTGRDAAHKRIQSLIESGEGLPEGVDFTGKFIYYVGPVDPVGNEVVGPAGPTTATRMDKFTDLMLDKTGLMGMIGKAERGPATVESIKKHKAVYLMAVGGAAYLVSKAIKKSRVVAFADLGMEAIYEFDVQDMPVTVAVDSNGVNAHETGPAIWKVNIANANAKA

SEQ ID NO: 89819 - DNA, 1524 bp, Pseudomonas putida KT2440
  CDS (1)..(1524): transl_table=11
atgaccgtgatcaagcaagacgacctgattcagagcgtcgccgacgccctgcaattcatctcgtactaccaccccgtcgatttcatccaggccatgcacgaggcctatctgcgtgaggaatcgcctgctgcacgcgattccatcgcccagatcctgatcaactcgcgcatgtgcgccaccggccatcgtccaatctgccaggacaccggtatcgtcaccgtgttcatccgcgtgggcatggacgtgcgctgggatggcgccaccatgagcgtcgacgacatgatcaacgaaggtgtgcgtcgcgcctacaacctgcctgaaaacgtcctgcgcgcttcgatcctggccgacccggccggtgcccgcaagaacaccaaggacaacaccccggcagtgatccactactccatagtccccggcgacaaggtggaagtcgatgtcgcagccaagggcggcggctcggaaaacaagtcgaagatggccatgctcaacccgtccgactcgatcgtcgactgggtactgaagaccgtgccgaccatgggtgctggctggtgcccgcctggcatgctcggcatcggcatcggcggtaccgccgagaaggccgcggtcatggccaaggaagtgttgatggagtccatcgacattcacgaactgaaagcccgtggcccacagaaccgcctggaagaaatccgcctggagctgttcgacaaggtcaaccagctgggcatcggcgcccagggcctgggtggcctgaccaccgtgctcgacgtcaagatcatggactacccgacccacgccgcgtccttgccggtgtgcatgatccccaactgcgctgctacccgccacgcccacttcgtgctcgatggcaccggcccggcagaactggaagcgccgtcgctggacgcttacccggaaatcgtctgggaagccggcccgagcgcccgtcgcgtcaacctcgacgacatcaccccggaagaagtggccagctggaagccgggcgaaaccatcctgctcaacggcaagatgctgaccggccgtgatgccgcgcacaagcgcatggttgaaatgctcaaccgtggcgaagagttgccggtagacctgaaaggccgcttcatctactacgtcggcccggtcgacccggtgggtgacgaagtggtaggcccagccggcccgaccactgctacccgtatggacaagttcactcgccagatccttgagcagactggcctgctgggcatgattggcaagtccgagcgtggcccgaccgccatcgaggcgatcaaggacaacaaggccgtgtacctgatggccgttggcggcgctgcctacctggtcgcccaggccatccgcaagtcgaaggtactggccttcgccgagctgggcatggaagcgatctacgagttcgaagtcaaggacatgccggtgaccgtcgccgtggacagcaacggtgaatcggtacacatcactggccctgccctgtggcagagcaagattgccgaaagcctggccgtcgaagtgaagtaa

SEQ ID NO: 89820 - protein, 507 aa, Pseudomonas putida KT2440
MTVIKQDDLIQSVADALQFISYYHPVDFIQAMHEAYLREESPAARDSIAQILINSRMCATGHRPICQDTGIVTVFIRVGMDVRWDGATMSVDDMINEGVRRAYNLPENVLRASILADPAGARKNTKDNTPAVIHYSIVPGDKVEVDVAAKGGGSENKSKMAMLNPSDSIVDWVLKTVPTMGAGWCPPGMLGIGIGGTAEKAAVMAKEVLMESIDIHELKARGPQNRLEEIRLELFDKVNQLGIGAQGLGGLTTVLDVKIMDYPTHAASLPVCMIPNCAATRHAHFVLDGTGPAELEAPSLDAYPEIVWEAGPSARRVNLDDITPEEVASWKPGETILLNGKMLTGRDAAHKRMVEMLNRGEELPVDLKGRFIYYVGPVDPVGDEVVGPAGPTTATRMDKFTRQILEQTGLLGMIGKSERGPTAIEAIKDNKAVYLMAVGGAAYLVAQAIRKSKVLAFAELGMEAIYEFEVKDMPVTVAVDSNGESVHITGPALWQSKIAESLAVEVK

SEQ ID NO: 89821 - DNA, 1656 bp, Bradyrhizobium japonicum USDA 110
  CDS (1)..(1656)
atgaacgctcccaccgccttccccgaccccgcaaagcccgttccgccctacaagcacaccccgctgttcccgctgggcaaggacgagacgccctacaagaagatttcgtccgagggcgtccgggtcgagaaggtcctgggcaaggacatgctggtggtgtcgcgcgaggcgctgcgggcgctgtcggaggcggctttcggcgacatcaaccattacctgcgccccggccatttgaagcagctccgcgcgatcctggaagacggcgaggcgagcccgaacgacaagttcgtcgcgctcgacttcttgaagaacgccaacatcgcggccggcggcgtgctgccgatgtgccaggacaccggcaccgcgatcatcatgggcaagaagggctgcaacgtcatcaccgacggtgacgacgaggcggcgctgtcggaaggcgcgcgcgatgcgtacctgcgccgcaacctgcgctactcgcaggtcgcgccgctctcgatgtacgaggagaagaacaccgccaacaacatgccggcgcagtgcgagatctacgccgagggcgacgacgcctacaagttcatgttcatggcgaagggcggcggctccgccaacaagagcttcctgttccaggcgacgccttccgtcctgaccaaggaccgcctgctcgcgttcctgaaggaaaagatcctcacgctcggcaccgcggcgtgcccgccctatcacctcgccatcgtgatcggcggcacttcggccgagctctgcatgaagacggtgaagcttgcgtcggcccgctatctcgacgcgctgccgacccacggctcgcccgacggcaacgccttccgcgacgtcgagatggaaaaggaaatccacaagatgacgcagtcgctcggcgtcggcgcgcagttcggaggcaagtatttctgccacgacgtccgcgtgatccgcatgccgcgccatggcgcctcgctcccgatcgggcttggcgtgtcctgctcggccgatcgccaggtgctcggcaagatcaccagggacggcgtctatctcgaggagctcgagcacaacccggcgcaatatctgccgcaggtcgaagaggcgctgggcggcgaggtcgtcaagatcgacctcaaccagccgatgaaggacattttggcgacgttctcgaagcacccgatcaagacccgggtctcgatgaccggcaccatgatcgtcgcgcgcgattccgcccatgccaagctgcgcgagcggctggagaagggcgagccgctgccggactacttcaagaaccatccggtctactacgctggccccgccaagacgccggagggctatgcctccggtgcgttcggtccgaccaccgcgggccggatggattccttcgtcgaccagttccaggccgcgggcggctccatggtgatggtggccaagggcaaccgcgcgccggccgtgcgcgaggcctgcaagaagtatggcggcttctatctcggctcgatcggcggcgccgcggcgaacctcgccgagcactgcatcaagaaggtcgaggtgctcgaatatcccgagctcggcatggaagcgatctggcgcatcgaagtcgtggatttcccggcgttcatcatcatcgatgacaaggggaatgatttcttcaaggagttgaatttgggctag

SEQ ID NO: 89822 - protein, 551 aa, Bradyrhizobium japonicum USDA 110
MNAPTAFPDPAKPVPPYKHTPLFPLGKDETPYKKISSEGVRVEKVLGKDMLVVSREALRALSEAAFGDINHYLRPGHLKQLRAILEDGEASPNDKFVALDFLKNANIAAGGVLPMCQDTGTAIIMGKKGCNVITDGDDEAALSEGARDAYLRRNLRYSQVAPLSMYEEKNTANNMPAQCEIYAEGDDAYKFMFMAKGGGSANKSFLFQATPSVLTKDRLLAFLKEKILTLGTAACPPYHLAIVIGGTSAELCMKTVKLASARYLDALPTHGSPDGNAFRDVEMEKEIHKMTQSLGVGAQFGGKYFCHDVRVIRMPRHGASLPIGLGVSCSADRQVLGKITRDGVYLEELEHNPAQYLPQVEEALGGEVVKIDLNQPMKDILATFSKHPIKTRVSMTGTMIVARDSAHAKLRERLEKGEPLPDYFKNHPVYYAGPAKTPEGYASGAFGPTTAGRMDSFVDQFQAAGGSMVMVAKGNRAPAVREACKKYGGFYLGSIGGAAANLAEHCIKKVEVLEYPELGMEAIWRIEVVDFPAFIIIDDKGNDFFKELNLG

SEQ ID NO: 89823 - DNA, 1524 bp, Pseudomonas syringae pv. tomato str. DC3000
  CDS (1)..(1524): transl_table=11
atgaccgtgatcaagcaagacgacctgattcagagcgttgcagatgcactgcagttcatttcctattaccaccccgtggacttcatccaggccatgcacgaggcgtatctgcgtgaagaatcgcctgccgcccgcgactccatcgcccagatcctgatcaactcgcgcatgtgcgcgaccggtcatcgcccgatctgccaggacaccggcatcgtcacggtttttgtgcgcgtgggtatggatgttcgctgggacggcgccaccatgggcctggacgacatgatcaacgaaggcgtgcgtcgcgcttacaacctgcctgaaaacgtcttgcgtgcctcgatccttgccgacccggcaggcgctcgcaaaaacaccaaggacaacaccccggccgttatccactactccatcgtcccgggtaacaccgtggaagtggacgtcgcggcaaaaggcggcggttcggaaaacaaatcgaagatggcgatgctcaacccgtccgactcgatcgtcgactgggttctgaaaaccgttccgaccatgggcgcaggctggtgccccccgggcatgctcggcatcggcatcggcggcaccgcagaaaaggccgcggtcatggccaaggaagtgttgatggagtccatcgacattcacgaactgaaagcccgcggcccgcaaagccgtatcgaagagatgcgtctggagctgttcgagaaggtcaaccagctgggcattggcgctcagggcctgggcggcctgaccaccgtgctcgacgtcaagatcatggattacccgacccacgccgcgtcgctgccggtgtgcatgatccccaactgcgccgccacccgccacgcgcacttcgtgctcgacggcagcggccctgcctcgctggaggctccatcgctggacgcctatccggaaatcgtctgggaagccggcccatcggcccgccgcgtcaacctcgataccctgaccccggaagaagtacaaagctggaaaccgggcgaaaccgttttgctcaatggcaagatgctcaccggccgcgacgcagcgcacaagcgcatggtcgaaatgctcaacaggggtgaaaccctgccggtagacctcaagggtcgcttcatctactacgtcggcccggttgatccggtacgcgaagaagtcgtcggcccggccggcccgaccacggccacccggatggacaagttcacccggcagatcctcgatcagaccgggttgctgggcatgatcggcaagtccgaacgcggcccgaccgccatagaagcgatccgtgaccacaaggccgtgtacctgatggccgttggtggtgctgcctatctggtggctcaggcgatcaagaaatcccgcgtcgtggccttcgccgagctgggcatggaagcgatctacgagttcgaggttaaggacatgccggtgaccgttgccgtcgacagcaccggtgaatccgttcacatcaccggcccgcagatctggcagaagaagatcagcgacagtctggcggtggaagtgcagtaa

SEQ ID NO: 89824 - protein, 507 aa, Pseudomonas syringae pv. tomato str. DC3000
MTVIKQDDLIQSVADALQFISYYHPVDFIQAMHEAYLREESPAARDSIAQILINSRMCATGHRPICQDTGIVTVFVRVGMDVRWDGATMGLDDMINEGVRRAYNLPENVLRASILADPAGARKNTKDNTPAVIHYSIVPGNTVEVDVAAKGGGSENKSKMAMLNPSDSIVDWVLKTVPTMGAGWCPPGMLGIGIGGTAEKAAVMAKEVLMESIDIHELKARGPQSRIEEMRLELFEKVNQLGIGAQGLGGLTTVLDVKIMDYPTHAASLPVCMIPNCAATRHAHFVLDGSGPASLEAPSLDAYPEIVWEAGPSARRVNLDTLTPEEVQSWKPGETVLLNGKMLTGRDAAHKRMVEMLNRGETLPVDLKGRFIYYVGPVDPVREEVVGPAGPTTATRMDKFTRQILDQTGLLGMIGKSERGPTAIEAIRDHKAVYLMAVGGAAYLVAQAIKKSRVVAFAELGMEAIYEFEVKDMPVTVAVDSTGESVHITGPQIWQKKISDSLAVEVQ

SEQ ID NO: 89825 - DNA, 1518 bp, Vibrio parahaemolyticus RIMD 2210633
  CDS (1)..(1518): transl_table=11
atgacggtaatacgcaagcaggatgtaatcagcagtgtcgctgatgcgctacagtatatttcttactaccacccgctagactttgttcaagctcttgaaaaagcctatcaccgcgaagagagtcaagccgcgaaagacgcgattgctcagatcctaattaactcccgaatgtcagcagaaggtcaccgaccaatttgtcaggatactggcatcgtgacgtgtttcgtcaacatcggtatgggcgtgcaatgggactcaaccgacatgacggttcagcaaatggtagatgaaggtgtccgacaagcgtatacgaacccagacaacccgttgcgtgcgtcagtacttatggatcctgctggtaaacgtattaataccaaagacaacacacctgctgtcgtacacatcaacatggtaccgggcgataaagttgaaattcagatcgcagcgaagggcggcggtagtgaaaacaaaactaagatggtgatgctaaacccatctgacgatattgctgagtgggtagagaaaacactaccaacaatgggcgcgggctggtgtccaccaggtatgcttggcattggtattggcggtacggctgagaaagcagcggtattggcaaaagaatctctaatggaacacatcgatattcaagagcttatcgaccgtggtccacaaaacgcagaagaagagcttcgccttgatattttcaatcgcgtgaacaaacttggtatcggcgcgcaaggtcttggtggtttgacgactgttgtcgacgttaagatcaaaactgcgccaacgcacgcggcttctaagcctgtttgtttgatcccgaactgtgcggcgactcgtcacgtacacttcacgcttgatggcagcggcccagcagagctaacaccacctaaactagaagattggccagacattacttgggaagcgggcgaaaacacgcgtcgcgtaaacttagacactattactaaagaagaagtacaagagtggaagacaggcgaaaccgttcttctatcaggtaaaattctgactggtcgtgatgctgcgcataaacgtattcaaggcatgttagacaatggtgaaggtctaccagaaggcgtagatctaaacggtaagttcatttactacgtaggccctgtcgatgcggttggtgatgaggtcgttggtcctgccggcccaacaacatcaacgcgtatggataaattcaccgatatgatgttagaaaaaaccggcatcatgggcatgatcggtaaagctgagcgtggccctgcaacggttgaatctattaagaatcacaaagcggtttacctaatggctgttggtggcgcggcctaccttgtagcgaaagcgatcaagaaagctcgcgttgtcgcatttgaagatttaggtatggaagcgatttacgaatttgaagttgaagatatgccagtaacagtggctgtagactcaaatggtgttaacgcgcaccaaatcggtccagacacttggaaagtgaaaattcaagagatggaagcataa

SEQ ID NO: 89826 - protein, 505 aa, Vibrio parahaemolyticus RIMD 2210633
MTVIRKQDVISSVADALQYISYYHPLDFVQALEKAYHREESQAAKDAIAQILINSRMSAEGHRPICQDTGIVTCFVNIGMGVQWDSTDMTVQQMVDEGVRQAYTNPDNPLRASVLMDPAGKRINTKDNTPAVVHINMVPGDKVEIQIAAKGGGSENKTKMVMLNPSDDIAEWVEKTLPTMGAGWCPPGMLGIGIGGTAEKAAVLAKESLMEHIDIQELIDRGPQNAEEELRLDIFNRVNKLGIGAQGLGGLTTVVDVKIKTAPTHAASKPVCLIPNCAATRHVHFTLDGSGPAELTPPKLEDWPDITWEAGENTRRVNLDTITKEEVQEWKTGETVLLSGKILTGRDAAHKRIQGMLDNGEGLPEGVDLNGKFIYYVGPVDAVGDEVVGPAGPTTSTRMDKFTDMMLEKTGIMGMIGKAERGPATVESIKNHKAVYLMAVGGAAYLVAKAIKKARVVAFEDLGMEAIYEFEVEDMPVTVAVDSNGVNAHQIGPDTWKVKIQEMEA

SEQ ID NO: 89827 - DNA, 1647 bp, Salmonella enterica subsp. enterica serovar Typhi Ty2
  CDS (1)..(1647): transl_table=11
atgtcaaacaaacccttcttttatcaagacccttttcccctcaaaaaggacgataccgagtactacttgttgaccagcgaacatgtttccgtcgccgagttcgaaggacaagagatcctgaaagtcgcgccggaagcgctaacgttgttggcgcgtcaggccttccacgatgcgtcttttatgctacgtcccgcgcatcagcagcaggtggcggatattctgcgcgatccgcaggccagtgaaaacgacaaatatgtcgcgctgcaattcctgcgaaactccgatatcgcggccaagggcgtgttgcccacctgccaggataccggtacggccattattgtcggcaaaaaaggccaacgcgtctggactggtggaggtgatgaagcggcgctggctcgcggcgtatataacacctatatcgaagataacctgcgctattcgcagaacgcggcgctggatatgtacaaagaggtcaataccggtactaacctgccggcgcagatcgatctctacagcgtcgatggcgatgaatataaattcctctgtatcgctaaaggcggcggttcggcgaataaaacctacctctatcaggagacaaaagcgctactgacgccgggtaagctcaaaaattatctcgtcgataagatgcgtacgctgggcaccgccgcctgtccgccgtatcacattgcgtttgtcattggcggtacctcggcggaagcgaacctgaagaccgttaagctggcctcggcaaaatactatgatgcgctaccgaccgaaggcaatgaacacgggcaggccttccgcgatattgagctggaaaaagaattgttgcttgaggcgcaaaatcttggcttaggcgcgcagttcggcggcaaatatttcgctcacgatattcgtgtcatccgattgccgcgccatggggcatcgtgtccggtaggtatgggcgtgtcctgctccgcggatcgaaacattaaagcgaagatcaaccgggaagggttctggatcgagaagctggagcgcaatcccggtaaatatattccagaggcgctgcgccaggcgggagagggcgaggcggtgcgcgttgatcttaaccgtcccatgagcgagatactgcaacaactgtcgcagtatccggtatcaacgcgcttgtcgctgaacggcacgattattgtgggccgcgatatcgcgcacgctaaactgaaagaacggatggacagaggcgaaggtttgccgcagtacatcaaagatcatcctatctattatgcggggccggcaaaaacgccggaagggtacgcctccgggtcgcttgggccgactaccgcaggacggatggactcttatgttgatcagctccagtcgcagggcggcagtatgatcatgctggcgaaaggcaaccgcagccagcaggtgaccgatgcctgtaagaaacatggcggcttctacctgggcagtatcggcggcccggcagccgttctggcgcagggcagtatcaagcgcctggagtgtgtggaatatcctgaactgggtatggaggctatctggaaaattgaagtggaggattttccggcctttattctggtggatgataaaggtaacgatttcttccagcagattcagtcatcgcagtgcgcgcgctgcgttaagtaa

SEQ ID NO: 89828 - protein, 548 aa, Salmonella enterica subsp. enterica serovar Typhi Ty2
MSNKPFFYQDPFPLKKDDTEYYLLTSEHVSVAEFEGQEILKVAPEALTLLARQAFHDASFMLRPAHQQQVADILRDPQASENDKYVALQFLRNSDIAAKGVLPTCQDTGTAIIVGKKGQRVWTGGGDEAALARGVYNTYIEDNLRYSQNAALDMYKEVNTGTNLPAQIDLYSVDGDEYKFLCIAKGGGSANKTYLYQETKALLTPGKLKNYLVDKMRTLGTAACPPYHIAFVIGGTSAEANLKTVKLASAKYYDALPTEGNEHGQAFRDIELEKELLLEAQNLGLGAQFGGKYFAHDIRVIRLPRHGASCPVGMGVSCSADRNIKAKINREGFWIEKLERNPGKYIPEALRQAGEGEAVRVDLNRPMSEILQQLSQYPVSTRLSLNGTIIVGRDIAHAKLKERMDRGEGLPQYIKDHPIYYAGPAKTPEGYASGSLGPTTAGRMDSYVDQLQSQGGSMIMLAKGNRSQQVTDACKKHGGFYLGSIGGPAAVLAQGSIKRLECVEYPELGMEAIWKIEVEDFPAFILVDDKGNDFFQQIQSSQCARCVK

SEQ ID NO: 89829 - DNA, 1647 bp, Salmonella enterica subsp. enterica serovar Typhi Ty2
  CDS (1)..(1647): transl_table=11
atgtcgaaaaaagagtttatctatcaggcgcctttcccgatgggagaggacaaaacagagtattatctgctcacctccgattatgtcagcgtcagtgaattcaatggagaatctatcctcaacgttgagccgcaggcgttaacgttgctggctcagcaggctttccatgatgcgtcttttatgctccgtcctgaacaccagcagcaagtcgccgccattctccatgaccccgaagccagcgaaaacgacaaatatgtggcgttgcaattcctgagaaactccgagatcgccgccaaaggcattctgccgacctgccaggataccggcacggcgattatcatgggtaaaaaaggccaacgcgtctggacgggcggcggcgatgaagccgcgctctccaaaggcgtgtttaatacctatatcgaagataacctgcgctactcgcagaacgcgccgctggatatgtacaaagaggtcaataccggcagcaacctgccagcgcaaatcgatctctatgccgtcgatggcgacgagtacaagttcctttgcgtggcgaaaggcggcggttcagcaaacaaaacgtatctctatcaggagaccaaagcgctgctcaccccaggcaagctgaaaaacttcctcgttgagaaaatgcgcacgctgggcaccgcggcctgtccgccataccatatcgcctttgtcattggtggcacctcggcggaaagcacgctgaaaaccgttaaactcgccagcacccactattacgacgcgctgccgacggaaggtaacgagcacggccaggcattccgcgatctccacctggaacaggaactgctggaagaagcgcaaaaacttggcctcggcgcccagttcggcgggaaatatttcgcccacgatattcgcgtaattcgcctgccgcgtcacggcgcttcctgtccggtggggatgggcgtctcctgctcggcagaccgtaacatcaaagcgaaaatcaaccgcgaaggcatctggatcgaaaaactggaacacaatccgggccagtatattccgccagcgctgcgtcaggcgggcgaaggcgacgcggtgaaagtcgatcttaaccgtccgatgaaagagatcctcgcccagctatcgcagtacccggtctcgactcgcctgtcgctgacgggcaccattatcgtaggtcgcgatatcgcccacgcgaagctaaaagagcgtattgaatccggcgaagacctgccgcagtatattaaagaccaccccatctattacgcaggtccggccaaaaccccggcaggttatccatctggctcattaggccccaccaccgcaggccgaatggactcttatgtcgatctactgcaatcccacggcggcagtatgatcatgctggcgaaaggcaaccgtagtcagcaggtcacggatgcctgtaaaaaacacggcggcttttatttgggcagtatcggcggcccggcggcggtactggcacagcagagcattaagcatctggagtgcgtcgagtatccggaactcggcatggaagctatctggaaaattgaagtagaagatttcccggcctttattctggtggatgacaaaggcaacgatttcttccagcagattgtcagcaaacagtgcgctaactgcgcgaaataa

SEQ ID NO: 89830 - protein, 548 aa, Salmonella enterica subsp. enterica serovar Typhi Ty2
MSKKEFIYQAPFPMGEDKTEYYLLTSDYVSVSEFNGESILNVEPQALTLLAQQAFHDASFMLRPEHQQQVAAILHDPEASENDKYVALQFLRNSEIAAKGILPTCQDTGTAIIMGKKGQRVWTGGGDEAALSKGVFNTYIEDNLRYSQNAPLDMYKEVNTGSNLPAQIDLYAVDGDEYKFLCVAKGGGSANKTYLYQETKALLTPGKLKNFLVEKMRTLGTAACPPYHIAFVIGGTSAESTLKTVKLASTHYYDALPTEGNEHGQAFRDLHLEQELLEEAQKLGLGAQFGGKYFAHDIRVIRLPRHGASCPVGMGVSCSADRNIKAKINREGIWIEKLEHNPGQYIPPALRQAGEGDAVKVDLNRPMKEILAQLSQYPVSTRLSLTGTIIVGRDIAHAKLKERIESGEDLPQYIKDHPIYYAGPAKTPAGYPSGSLGPTTAGRMDSYVDLLQSHGGSMIMLAKGNRSQQVTDACKKHGGFYLGSIGGPAAVLAQQSIKHLECVEYPELGMEAIWKIEVEDFPAFILVDDKGNDFFQQIVSKQCANCAK

SEQ ID NO: 89831 - DNA, 1635 bp, Bacteroides thetaiotaomicron VPI-5482
  CDS (1)..(1635): transl_table=11
atggcaacacctccgtttaagtatcaacccatgtttgaaaagggaaaagataccactgagtattatctgcttacaaaagactatgtatcggtaagcgagtttgaaggaaatcctatcctgaaaattgagaaagaaggcttgactgcgatggcaaatgcagcttttcgtgatgtgtcattcatgcttcgccgttcgcacaatgaacaggttgctaagattctgagtgatccggaagccagcgagaacgataagtacgtagcactgactttcctgcgtaatgcggaagtggctgccaaaggtgtacttccattctgtcaggataccggtactgctattatccacggtgaaaagggacagcaagtgtggaccggctataccgacgaggaagctctgtcactgggtgtttacaaaacatataccgaagaaaacctgcgttactctcagaatgcgcctctgaatatgtatgatgaggtaaatacaaaatgtaacctgcctgcacagattgacatcgaagctaccgaagggatggaatatgaattcctctgcgtaacgaaaggtggtggttctgccaacaaaacatatctgtatcaggaaacaaaagcaattttgaaccccggtacactggttccgttcctggtggaaaaaatgaagactctgggaactgccgcttgtcctccttatcatatcgcttttgtgatcggcggtacttctgctgagaagaacctgctgacagtgaaactggcgtctactcacttctacgataatctgccgactacgggaaatgaatttggccgtgctttccgtgatatcgaactggaaaaacaagtactggaagaagctcacaagatcggtctgggtgcacaattcggcggtaaatatctggcacatgatgttcgtatcattcgtctgcctcgtcacggtgcttcttgtccggtaggtctgggcgtgtcttgttctgccgaccgtaacatcaaatgtaaaatcaataaagatggtatctggattgagaaactggattcaaatccgggtagcctgattccggcagaattgcgtcaggccggtgaaggtgatgtagtgaagattgatctgaaccgtccgatggctgagattctgaaagaactgaccaaatatcctgtatctactcgtctgtcactgaacggtactatcatcgttggccgtgatatcgctcacgctaaactgaaagaacgtctggatcgtggagaagatttgcctcagtatatcaaggatcatcctatttactatgctggtccggccaagactccggctggtatggcttgcggttcaatgggcccgacaactgccggacgtatggactcgtatgttgagctgttccagagccacggtggcagcatggttatgttggcgaaaggtaaccgtagccagcaggttacagatgcttgtcagaaatatggcggcttctatctgggttctatcggcggaccggctgcaatccttgctcagaacaacatcaagagcattgagtgcgtagaatatccggaactgggcatggaagcaatctggaaaattgaagtggaagatttcccggcatttattctggtagatgacaaaggaaatgacttcttcaaacagattaaaccacgttgtgccaaataa

SEQ ID NO: 89832 - protein, 544 aa, Bacteroides thetaiotaomicron VPI-5482
MATPPFKYQPMFEKGKDTTEYYLLTKDYVSVSEFEGNPILKIEKEGLTAMANAAFRDVSFMLRRSHNEQVAKILSDPEASENDKYVALTFLRNAEVAAKGVLPFCQDTGTAIIHGEKGQQVWTGYTDEEALSLGVYKTYTEENLRYSQNAPLNMYDEVNTKCNLPAQIDIEATEGMEYEFLCVTKGGGSANKTYLYQETKAILNPGTLVPFLVEKMKTLGTAACPPYHIAFVIGGTSAEKNLLTVKLASTHFYDNLPTTGNEFGRAFRDIELEKQVLEEAHKIGLGAQFGGKYLAHDVRIIRLPRHGASCPVGLGVSCSADRNIKCKINKDGIWIEKLDSNPGSLIPAELRQAGEGDVVKIDLNRPMAEILKELTKYPVSTRLSLNGTIIVGRDIAHAKLKERLDRGEDLPQYIKDHPIYYAGPAKTPAGMACGSMGPTTAGRMDSYVELFQSHGGSMVMLAKGNRSQQVTDACQKYGGFYLGSIGGPAAILAQNNIKSIECVEYPELGMEAIWKIEVEDFPAFILVDDKGNDFFKQIKPRCAK

SEQ ID NO: 89833 - DNA, 1524 bp, Bordetella bronchiseptica RB50
  CDS (1)..(1524)
atgaccgtcctcatcaaagaagaagacttcatccagtccatcgccgatggcatccagttcatcagctactaccacccggtggactatatccgtcacctggcgcgcgcctacgagcgtgaagaaagcccggctgcccgcgatgccatggcgcagatcctgaccaactcgcgcatgtgcgccgagggcaagcgcccgctgtgccaggacaccggcatcgtcaacgtgttcctcaaggtcggcatgaacgtgcgcttcgacacgcaacgcacgctgcaggaactctgtgacgaaggcgtgcgccgcggctacctcaaccccgacaacccgctgcgcgcgtcggtgctggacgatccgctgttcgcgcgcaagaacacccgcgacaacacgccctgtatcctgcacgtcgaactggtgccgggcgacaccgtcgacgtgcaagtggcctccaagggcggcggctcggaaaacaagtccaagttcgtcatgctcaatcccagcgattcgctggtcgactgggtgctcaaaaccgtgccgaccatgggcgccggctggtgcccgccgggcatgctcggcatcggcgtgggcggcacggccgagaaggccatgctgatggccaagcagtcgctgatggaagacatcgacatgtacgagctgctggcgcgcggcccgcagagcaagctggaagagctgcgcatcgagctgtacgagaaggtcaacgccctgggcatcggcgcgcagggcctgggcggcctgacgaccgtgctggacgtcaagatcagcaccttccccacgcacgccgcgtccaagccggtggcgatgatcccgaactgcgccgccacgcgccacgcgcatttcgtgctggacggctccggtccggcccgcctcgatccgccgtcgctgtccgaatggccggaagtgcactgggcgcccgattacaacaagtccaggcaggtcgacctcgataccctgaccaaggaagaagtcgccagctggaaaccgggccagaccttgctgctgtcgggcaagatgctgaccggccgcgacgcggcgcacaagcgcatccaggacatgctgtccaagggcgagagcctgccggtggacttcaccaaccgcgtcatctactacgtcggcccggtcgatccggtgcgcgacgaagtcgtcggcccggccggtcccaccacggcgacccgcatggacaagttcaccgacatgatgctggcgcagaccggcctgatttccatgatcggcaagtccgagcgcggcccggtcgccatcgagtcgatccgcaagcacggctcggcctacctgatggcggtgggcggcgcggcctacctggtgtccaaggccatccgcaacgccaaggttctggctttcgaggacctgggcatggaagccatctacgagttcgacgtcaaggacatgcccgtgaccgtcgcggtggactcgcagggcacctcggtgcacaccaccggcccgaaggagtggcaggcccgcatcggcaagattccggtcgcggtcgcctga

SEQ ID NO: 89834 - protein, 507 aa, Bordetella bronchiseptica RB50
MTVLIKEEDFIQSIADGIQFISYYHPVDYIRHLARAYEREESPAARDAMAQILTNSRMCAEGKRPLCQDTGIVNVFLKVGMNVRFDTQRTLQELCDEGVRRGYLNPDNPLRASVLDDPLFARKNTRDNTPCILHVELVPGDTVDVQVASKGGGSENKSKFVMLNPSDSLVDWVLKTVPTMGAGWCPPGMLGIGVGGTAEKAMLMAKQSLMEDIDMYELLARGPQSKLEELRIELYEKVNALGIGAQGLGGLTTVLDVKISTFPTHAASKPVAMIPNCAATRHAHFVLDGSGPARLDPPSLSEWPEVHWAPDYNKSRQVDLDTLTKEEVASWKPGQTLLLSGKMLTGRDAAHKRIQDMLSKGESLPVDFTNRVIYYVGPVDPVRDEVVGPAGPTTATRMDKFTDMMLAQTGLISMIGKSERGPVAIESIRKHGSAYLMAVGGAAYLVSKAIRNAKVLAFEDLGMEAIYEFDVKDMPVTVAVDSQGTSVHTTGPKEWQARIGKIPVAVA

SEQ ID NO: 89835 - DNA, 1527 bp, Chromobacterium violaceum ATCC 12472
  CDS (1)..(1527): transl_table=11
atgaccatcatccgccaggaagacttcatccagagcatcgccgatgccttccagtacatcagttgctaccaccctaaagactatatcgacgcgctgtaccaggcttacctgaacgaggagagcaccgccgccaaggacgcgatggcgcagatcctggtcaacagccgcatgtgcgccgaaggccgccggccgatctgccaggataccggcatcgccgtggtgttcctgaaagtgggcatgaaagtgcagtgggacgcccagctcagcgtgcaggagatggtcaacgaaggcgtgcgccgcgcctacaaccacccggacaacaagctgcgcgcctccgtgctgctggacccggccggcaagcgccagaactccaaggacaataccccggccgtggtgcacttcgagatcgtcgaaggcgaccaggtggaggtgatctgcgcggccaagggcggcggctcggaaaacaagtccaagatggtgatgctgaacccgtccgattccatcgtcgactgggtgctgaagaccgtgccgaccatgggcgccggctggtgtccgcctggcattctcggcatcggcatcggcggcacgccggagaaggcgatgctgctggcgaaagagtcgctgatggaccacgtcgacatccacgagctgaaggccaaggccgcggccggcgccgagctgtcccgcgtcgaggcgctgcggctggagctgttcgacaaggtcaacgcgctgggcatcggcgcccagggcctgggcggcctgaccacggtgctggacgtgaagatcctggattacccgacccacgcggcgtcgctgccggtggcgatgatccccaactgcgccgccacccgccacatccatttccacctggacggcagcggcccggcccacctggaaacgcctagcctggaagactggccggacatcacctacgacgcctcgtccggcaagcgcgtggacctggacaagatcaccaaggaagaagtggccagctggcagccgggcgacgtgctgctgctgaacggcaagatcctgaccggccgcgacgccgcgcacaagcgcatgatcgatatgctgaacaagggcgagaagctgccggtggacttcaccaaccgcttcatctactacgtcggcccggtcgatccggtgcgagacgaagtcgtcggcccggccggcccgaccaccgccacgcggatggacaagttcacgcgccagatgctggagcagaccggcttgctgggcatgataggcaaggccgagcgcggtccggcggcgatagaggcgatcaaggacaacaaggcggtctacctgatggccgtcggcggttcggcttacctggtgtccaaggcgatcaaggcgtccaaggtggtgggcttcgccgacctgggcatggaggcgatctacgagttcgaggtcaaggacatgccggtgacggtggcggtggattcctgtggcacctcggtgcacaacaccggcccggcggagtggcgggtgaagattggcaagattccagtaagccaaatttaa

SEQ ID NO: 89836 - protein, 508 aa, Chromobacterium violaceum ATCC 12472
MTIIRQEDFIQSIADAFQYISCYHPKDYIDALYQAYLNEESTAAKDAMAQILVNSRMCAEGRRPICQDTGIAVVFLKVGMKVQWDAQLSVQEMVNEGVRRAYNHPDNKLRASVLLDPAGKRQNSKDNTPAVVHFEIVEGDQVEVICAAKGGGSENKSKMVMLNPSDSIVDWVLKTVPTMGAGWCPPGILGIGIGGTPEKAMLLAKESLMDHVDIHELKAKAAAGAELSRVEALRLELFDKVNALGIGAQGLGGLTTVLDVKILDYPTHAASLPVAMIPNCAATRHIHFHLDGSGPAHLETPSLEDWPDITYDASSGKRVDLDKITKEEVASWQPGDVLLLNGKILTGRDAAHKRMIDMLNKGEKLPVDFTNRFIYYVGPVDPVRDEVVGPAGPTTATRMDKFTRQMLEQTGLLGMIGKAERGPAAIEAIKDNKAVYLMAVGGSAYLVSKAIKASKVVGFADLGMEAIYEFEVKDMPVTVAVDSCGTSVHNTGPAEWRVKIGKIPVSQI

SEQ ID NO: 89837 - DNA, 1647 bp, Porphyromonas gingivalis W83
  CDS (1)..(1647): transl_table=11
atggcaactccagaatttaagtatcagaagcctttccctatgggggatgatacgacagagtattatttgctgacgaaggagtatgtgtccgtggacaagtttggcgatcatgatgtcctgaaagtggagccggaagctctgcgattacttgcgcggacggcttttcatgacatcgctttctatttgcgaccggagcatcagcagcaagtggctcggattctgtccgatccggaagccagcgaaaacgacaaattcgtggctttgactttcctgcgcaatgcggaggtttcagccaagggacagctccctttctgccaagatacgggcacggctatcatcctcggtaagaagggacagcaggtctggacgggcggtcatgacgaagagcagctctcgcatggtgtctatgatacctatacgcaggagaacctgcgctattcgcagaatgctcctttggatatgtataaggaggtgaatacggggtgcaacctgcccgcacagatcgacctgatggccgtggacggcatggagtacgactttctctgcatagccaaaggaggagggtcggccaataagacgtatctctatcaggaaacgaaagcactgctcaaccccaagacgctggtgaacttcctcgtggataagatgagttctctcggtacagctgcctgtcctccgtatcacattgcattcgtgataggcggaacttcggccgaaacgaacctcaagaccgtcaagctggcttcggccaagtactacgacaatctgcctacttcgggcaacgaaggcgggcgtgccttccgcgatgtcgaactggaaaaagaagtcttggaagctgcctatcatctgggactgggtgctcagtttggaggcaaatacttcgcacacgacgtgcgcatcatccgcctgccccgacatggagcaagctgtcccgtaggtatgggcgtcagttgttcggcagaccgcaatatcaaggcaaagatcaataaagacggtatctggatcgaaaagatggagaccaatcccacacgcctcatccctgaatccatgcgtgagggtacagagggtacggtggtcaaggtcgatctgaatcgtccgatgcctgagattctgagagagctgtcgcagtatcctgtttccacccgtttgtctctcagtggtacgattatcgtggggcgtgatattgctcacgccaaactaaaagaacgtatcgaccgtggcgagggtttgcccgactatatcaagaatcatcccatctactacgccggtccggccaagacaccgaaggggatgccgagcggttcgttcgggcctacgacagcgggccgtatggatagctatgtggatctcttccaatcgcatggaggcagtatggtgatgatagccaaaggcaaccgctctcagcaagtgacggatgcgtgtaagaagtacggcggattctacctcggcagtgttggaggcccagcagctattctggctcaggacagcattaagaaagtggagtgtctggaatatcccgagctgggtatggaggctatttggaagatcgaagtggaggacttcccggcctttattctggtagatgacaagggcaatgatttctttactcagataagagagaagtgtaagggttgtgccttgcattga

SEQ ID NO: 89838 - protein, 548 aa, Porphyromonas gingivalis W83
MATPEFKYQKPFPMGDDTTEYYLLTKEYVSVDKFGDHDVLKVEPEALRLLARTAFHDIAFYLRPEHQQQVARILSDPEASENDKFVALTFLRNAEVSAKGQLPFCQDTGTAIILGKKGQQVWTGGHDEEQLSHGVYDTYTQENLRYSQNAPLDMYKEVNTGCNLPAQIDLMAVDGMEYDFLCIAKGGGSANKTYLYQETKALLNPKTLVNFLVDKMSSLGTAACPPYHIAFVIGGTSAETNLKTVKLASAKYYDNLPTSGNEGGRAFRDVELEKEVLEAAYHLGLGAQFGGKYFAHDVRIIRLPRHGASCPVGMGVSCSADRNIKAKINKDGIWIEKMETNPTRLIPESMREGTEGTVVKVDLNRPMPEILRELSQYPVSTRLSLSGTIIVGRDIAHAKLKERIDRGEGLPDYIKNHPIYYAGPAKTPKGMPSGSFGPTTAGRMDSYVDLFQSHGGSMVMIAKGNRSQQVTDACKKYGGFYLGSVGGPAAILAQDSIKKVECLEYPELGMEAIWKIEVEDFPAFILVDDKGNDFFTQIREKCKGCALH

SEQ ID NO: 89839 - DNA, 1524 bp, Vibrio vulnificus YJ016
  CDS (1)..(1524): transl_table=11
atgactgtaattcgcacgcaagatgtcatcagcagcgtagctgatgcacttcagtacatctcttactaccacccactcgattttgttcaagccctagaaaaagcctaccatcgtgagcagagccaagcggccaaagatgccattgcgcagattttgatcaactcgcgtatgtcggcggaagggcatcgcccaatttgccaagataccggtatcgtgacgtgttttgtcaatatcggtatgggcgttcagtgggactcaacggatctcaccgtacaacagatgattgacgaaggcgtgcgtcaggcttacaccaatcctgacaacccattgcgtgcgtcggtattgatggaccctgcaggtaaacgtattaacaccaaagacaatacacctgcggttgttcacatcaatatggtgccgggcaataccgtagaaattcagatcgcggcaaaaggcggcggctctgaaaacaaaaccaagatggtgatgctcaacccttcagacgatattgctgagtgggtagaaaaaacattgcctttgatgggcgcgggctggtgtcctccgggcatgcttggcattggcattggtggcacagcagaaaaagcggcggtactggctaaagagtcgttgatggagcacatcgacatccacgaactgattgagcgtggcccgcaaaatgcggaagaagagctgcgtttggacatcttcaatcgtgtcaaccgtttaggtattggtgctcaagggctcggtggggtgacaacggtggtggatgtgaaaatcaaaaccgcccctacgcacgcagcgtccaagccagtgtgtatgatcccgaactgtgcggcgactcgtcacgttcatttcacacttgacggctctggcccagcagaactgacgccaccgaagctagaagattggccaaacatcacttgggatgcgggtgcaagcgcgcgccgtgttaacctcgataccgtgacaaaagaagacgttcagcaatggaaaaccggtgagacactcttgctttcaggtaagattttgaccggtcgcgatgccgcgcataaacgcattcaaaccatgttgcaaaatggcgaaggcctacctgaaggcgttgaccttaaagggaagtttatctactacgttggccctgtggatgcagtgggtgacgaagtggttggcccagcaggcccaaccacctcaacacgtatggataagttcaccgatatgatgctggatgaaacgggcattatgggcatgatcggcaaagcggagcgtggcccagccactgttgagtcaatcaagaaccataaagcggtgtatctgatggcggtcggtggtgcggcgtacttggtagcaaaagccatcaagaaagcacgtgttgttgcttttgaagatctcggtatggaagcgatttacgaatttgaagtcgaagatatgccagtgacggtcgcggtggattcgagcggtgccaatgctcaccaaattggtcctgatacttggaaagttaaaatccaagaaatggaatcacaaaaataa

SEQ ID NO: 89840 - protein, 507 aa, Vibrio vulnificus YJ016
MTVIRTQDVISSVADALQYISYYHPLDFVQALEKAYHREQSQAAKDAIAQILINSRMSAEGHRPICQDTGIVTCFVNIGMGVQWDSTDLTVQQMIDEGVRQAYTNPDNPLRASVLMDPAGKRINTKDNTPAVVHINMVPGNTVEIQIAAKGGGSENKTKMVMLNPSDDIAEWVEKTLPLMGAGWCPPGMLGIGIGGTAEKAAVLAKESLMEHIDIHELIERGPQNAEEELRLDIFNRVNRLGIGAQGLGGVTTVVDVKIKTAPTHAASKPVCMIPNCAATRHVHFTLDGSGPAELTPPKLEDWPNITWDAGASARRVNLDTVTKEDVQQWKTGETLLLSGKILTGRDAAHKRIQTMLQNGEGLPEGVDLKGKFIYYVGPVDAVGDEVVGPAGPTTSTRMDKFTDMMLDETGIMGMIGKAERGPATVESIKNHKAVYLMAVGGAAYLVAKAIKKARVVAFEDLGMEAIYEFEVEDMPVTVAVDSSGANAHQIGPDTWKVKIQEMESQK

SEQ ID NO: 89841 - DNA, 1656 bp, Rhodopseudomonas palustris CGA009
  CDS (1)..(1656): transl_table=11
atgaacgctcccacgccgattccgtccgccgctaccccggttccgccctataagcacaccccgctgttcccgctgggcaaggacgagaccgtctatcgcaagatcacgtcggacggcgtgcgggtcgagaaggtgctcgggcgcgacatgctggtggtggagcgcgaggcgctgcgggcgctgtcggaggcagcgttcggcgagatcaaccattatctgcggcccggccacctcaagcagctccgcgccatcctggacgatccggaggcgagcccgaacgacaagttcgtcgcgctggatttcctgaagaacgccaacatcgccgccggcggcgtgctgccgatgtgccaggacactggcaccgcgatcatcatgggcaagaagggctcgaacgtcatcaccgacggcgacgacgaggcggcgctgtcggaaggcgcgcgcgacgcttacttgcgccgcaacctgcgctactcgcaggtcgcgccgctgtcgatgttcgaagagaagaacaccgccaacaacatgccggcgcagtgcgagatctacgccgagggcgatgatgcctacaagttcatgttcatggccaagggcggcggctcggccaacaagagcttcctgttccaggcgacgccgtcgttgctgacccgcgaccggctgctggcgttcctgaaagagaagatcatgacgctcggcaccgcggcgtgcccgccctatcacctggcgatcgtgatcggcggcacttcggtcgagaccacgatgaagacggtgaagctcgcatccgcgcgctatctcgatgcgctgccgacccacggctccgaactcggcaacgccttccgcgacgtcgagatggagcaggaaatccacaagatgacgcagagcctcggcgtcggcgcgcagttcggcggcaagtatttctgccacgacgttcgcgtcatccggctgccgcgccacggcgcctcgttgccgatcgggcttggggtgtcgtgctcggccgaccgccagatggtgggcaagatcaccaaggacggcgtgtatctggaggagctggagcacaatccggcgcagtatctgccggaagtcgagcaggcgctcggcggcgaggtggtgaagatcgacctcaaccagccgatgaaagatatcctcgccacgctgagcaagcacccgatcaagacccggctgtcgctgaccggcaccatgatcgtggcgcgcgacgccgcccatgccaagctgcgcgaccggctggagaagggcgagccgctgccggactacttcaagaaccacccggtgtactacgccggtccagccaagaccccggacggctatgcttccggcgcgttcggcccgactaccgcggggcgcatggactcgttcgtcgatcagttccaggcggccggcggctcgatggtgatggtcgccaagggcaaccgcgcgccggcggtgcgcgaggcctgcaagaagtacggcggtttctacctcggctcgatcggcggcgctgcggccaacctcgctgagcactgcatcaagaaggtcgaggtgctggaatatcccgagctcggcatggaggcgatctggaagatcgacgtcgtcgacttcccggccttcatcatcgtcgacgacaagggcaacgacttcttcaaggaactgaatctgggctga

SEQ ID NO: 89842 - protein, 551 aa, Rhodopseudomonas palustris CGA009
MNAPTPIPSAATPVPPYKHTPLFPLGKDETVYRKITSDGVRVEKVLGRDMLVVEREALRALSEAAFGEINHYLRPGHLKQLRAILDDPEASPNDKFVALDFLKNANIAAGGVLPMCQDTGTAIIMGKKGSNVITDGDDEAALSEGARDAYLRRNLRYSQVAPLSMFEEKNTANNMPAQCEIYAEGDDAYKFMFMAKGGGSANKSFLFQATPSLLTRDRLLAFLKEKIMTLGTAACPPYHLAIVIGGTSVETTMKTVKLASARYLDALPTHGSELGNAFRDVEMEQEIHKMTQSLGVGAQFGGKYFCHDVRVIRLPRHGASLPIGLGVSCSADRQMVGKITKDGVYLEELEHNPAQYLPEVEQALGGEVVKIDLNQPMKDILATLSKHPIKTRLSLTGTMIVARDAAHAKLRDRLEKGEPLPDYFKNHPVYYAGPAKTPDGYASGAFGPTTAGRMDSFVDQFQAAGGSMVMVAKGNRAPAVREACKKYGGFYLGSIGGAAANLAEHCIKKVEVLEYPELGMEAIWKIDVVDFPAFIIVDDKGNDFFKELNLG

SEQ ID NO: 89843 - DNA, 1626 bp, Geobacter sulfurreducens PCA
  CDS (1)..(1626): transl_table=11
atgtccaccaagccgttcgtctaccaggaccctttccccctcggcaaagatgagacgaagtaccgcaagatcgagggatccgagaaacatgtcacggtcgagcagttcgccggcaaggaagtgctgcgggtctgccccgaggcgctttccatcctcgccaacgaggcgatgcgcgatgtatccttcctgctgcgccccgagcacaacgagtcggtggcgaagatcctgcgcgacccggaagcgtccatgaacgacaagggcgtggccctcgcattcctgcgcaacgccgagatctccgccaacttcgagcttcccatctgccaggataccggcaccgccaccgtcatcgccaagaagggccagcaggtctggaccggcggcaaggatgaagaatacctctccaagggggtctacaagacctacaccgaggagaacctccgttactcccagaccgttgccctcaacatgtacgacgagatcaacaccggcaccaatctcccggcccaggtcgagatccaggccgtggacggcgatgcctacaagtttctcttcatggccaaaggtgggggctccgccaacaagaccatgcttttccaggagaccaaggcgctgctcacccccgagaagcttgaaaagttcctcgtggacaagatgaagtacctgggcaccgccgcctgtccgccctaccacatcgccgtggtcgtgggcggctgctccgccgaccagtgcatgaagaccgtcaagcttgcctcggccaagtacctggacgcactccccacccaggggaacgagcacggccaggcgttccgcgatgtggagcttgaggagaaactcctccaggccgcctacaagctcggcatcggcgcccagttcggcggcaagtacttcgcccacgacgtccgggtcatccggcttccgcgtcacggcgcttcctgccccgtggggatggcggtctcctgttccgccgaccgcaacatcaaggcgaagatcaccagggacggcctcttcgtggaagagctcgaccgcaatccgggccgcctcatccccgagcagtaccgcggcaagcacgagcacggcgtcaagatcgacctgaaccgccccatgaaggaaatcctcgccgagctcagcaagtacccggttgcaacgccgctgctcctgaacggtaccatcgtggtcggccgcgacatcgcccacgccaagttcaaggagatcatcgacgccggcaagccggtgcccgagtacctgctcaaccacccgatctactacgcgggaccggccaagaccccggctggcaagccctccggctccttcggccccaccaccgccggccggatggactcctacgtggatctcctccagtccaagggcgcatccatgatcatgatcgccaaggggaaccgcagccagcaggtgaccgatgcctgccagaagtacggcgggttctacctgggctccatcggcggcccggccgcggttcttgccgaggagaacatcaagaaggtcgagtgcatcgacttccccgaactggggatggaagcggtctggaagatcgaagtggaaaacttcccggccttcatccttgtggacgacaaggggaacgacttcttcaagcaactgggtctgtaa

SEQ ID NO: 89844 - protein, 541 aa, Geobacter sulfurreducens PCA
MSTKPFVYQDPFPLGKDETKYRKIEGSEKHVTVEQFAGKEVLRVCPEALSILANEAMRDVSFLLRPEHNESVAKILRDPEASMNDKGVALAFLRNAEISANFELPICQDTGTATVIAKKGQQVWTGGKDEEYLSKGVYKTYTEENLRYSQTVALNMYDEINTGTNLPAQVEIQAVDGDAYKFLFMAKGGGSANKTMLFQETKALLTPEKLEKFLVDKMKYLGTAACPPYHIAVVVGGCSADQCMKTVKLASAKYLDALPTQGNEHGQAFRDVELEEKLLQAAYKLGIGAQFGGKYFAHDVRVIRLPRHGASCPVGMAVSCSADRNIKAKITRDGLFVEELDRNPGRLIPEQYRGKHEHGVKIDLNRPMKEILAELSKYPVATPLLLNGTIVVGRDIAHAKFKEIIDAGKPVPEYLLNHPIYYAGPAKTPAGKPSGSFGPTTAGRMDSYVDLLQSKGASMIMIAKGNRSQQVTDACQKYGGFYLGSIGGPAAVLAEENIKKVECIDFPELGMEAVWKIEVENFPAFILVDDKGNDFFKQLGL

SEQ ID NO: 89845 - DNA, 1836 bp, Bdellovibrio bacteriovorus HD100
  CDS (1)..(1836): transl_table=11
gtgcttataggtccagggcgatatgttgtgtttcagaaggagacgtcacaaacgaagccttctaacctcggtaggttcctgaccactctccagcgaagagagacccggtcccaagaaaaccgccgcaatcgcggctcacaaagtcccacccaaatagcccacctaacacagcctaccgagggttgcgcgcgaacacgacgcaatgctactttcagttgcatgtcatttaaatacttccccctctatgaaaagcaaaaagatacgactcaatataaaaagatctcttccgatcacgtgcgcgtggaaaaaatcggcgagcgcgaggttctgattgttgaacctgaagcattggaactgctcgctcaagaggccttgagcgatgtttcgcacctgttgcgcccaaagcacctggaaaaactggaaagaatccttcaggaccctgaagcttcaccaaatgaccgctttgtggcggtggatctgctgcgcaatgcggtgatcgcggcgcagatggagttcccttcctgtcaggacacgggaactgcaattgttgtcggcaaaaaaggggagcgcgtgttcaccggggctgatgacaaggaattcctgtccaaagggatttacaacacctatcaaaaacgcaatctgcgcttttctcagatggcgccgatttctttctttgaagaaaaaaataccggcagcaatctgccagcccagatcgacatctattccgagcagggcgaagagtacaacttcctgttcctggctaaaggtggcggcagtgcgaataaatcctatctgtatcaaaaaaccaaagcggttctgaatccggaaggttttgaaaagtttgtgcgcgaaacgctgaactctttgggcacggcggcttgtcctccttatcacctggctttttgcgtgggtggaacgtcggcggaagaaacgctgaagatcgtgaaatacgcatctgcaggttatctggatggtctgccgacgacaggcagcgaaggcggacgggcctatcgtgatcttgaaatggaaaaacaagtcgagcagtgggctcgtgaaacgggcatcggtgctcagttcggtggcaagtacttcgtgcacgacgtgcgtgtgatccgactgcctcgccacggagcaagttgcccgattggtgtgggcgtcagctgttctgcggatcgtaacatcaaaggcaagatcacccgcgacggtatcttcctggaacaattggagcttcatccagagcagtacctgccaaatcacctgaaggatgccagcgccgaagcaattgaaattgatctgaacaaaccgatggcggaaacgctgaaggttctttcccagcaaaaagtggcgacccgggtgatgttaagcggtcccatgatcgtggctcgcgacatcgctcatgcgaaactgaaagaaaaagtcgatcgcggcgaaggtgtgcctcagtactttaaggattatgcagtctattacgcgggcccggctaagacgccaaaaggctacgcttccggctccttcgggccgacgaccagtgaacgaatggacccgtatgtggggacgttccaggcgctgggaggctccatgatcatgttgggtaaggggaaccgcagcccgcaggtcacagaagcctgcaaacagtacggtggcttctatctgggctctattggcggcccggcggcccgtttgggcaaagagtgcatcacaaaagttgaagtgctggatttcccggaactgggtatggagtctgtgtggaagatcgaagtcaaagacttcccggcctttatcatcgtcgatgacaaaggaaatgacttcttcaagtccgttatccgaaaactttaa

SEQ ID NO: 89846 - protein, 611 aa, Bdellovibrio bacteriovorus HD100
MLIGPGRYVVFQKETSQTKPSNLGRFLTTLQRRETRSQENRRNRGSQSPTQIAHLTQPTEGCARTRRNATFSCMSFKYFPLYEKQKDTTQYKKISSDHVRVEKIGEREVLIVEPEALELLAQEALSDVSHLLRPKHLEKLERILQDPEASPNDRFVAVDLLRNAVIAAQMEFPSCQDTGTAIVVGKKGERVFTGADDKEFLSKGIYNTYQKRNLRFSQMAPISFFEEKNTGSNLPAQIDIYSEQGEEYNFLFLAKGGGSANKSYLYQKTKAVLNPEGFEKFVRETLNSLGTAACPPYHLAFCVGGTSAEETLKIVKYASAGYLDGLPTTGSEGGRAYRDLEMEKQVEQWARETGIGAQFGGKYFVHDVRVIRLPRHGASCPIGVGVSCSADRNIKGKITRDGIFLEQLELHPEQYLPNHLKDASAEAIEIDLNKPMAETLKVLSQQKVATRVMLSGPMIVARDIAHAKLKEKVDRGEGVPQYFKDYAVYYAGPAKTPKGYASGSFGPTTSERMDPYVGTFQALGGSMIMLGKGNRSPQVTEACKQYGGFYLGSIGGPAARLGKECITKVEVLDFPELGMESVWKIEVKDFPAFIIVDDKGNDFFKSVIRKL

SEQ ID NO: 89847 - DNA, 1527 bp, Acinetobacter sp. ADP1
  CDS (1)..(1527): transl_table=11
atgaccacaattatcaaacaagaagacttgatcacttcggtcaaggatgcccttcagttcatttcctactatcatccgcaagattttattcaggccatgagccgtgcgtacgatcgtgaagcgaaccaagctgcaaaggatgcaatcgcacaaattctcatcaactctcgtatgtgtgcagaaggtcatcgcccaatctgtcaagatacaggtatcgtcaacgtatttgttgatgtcggtctagatgttaagttcgatcttagcatgagcctagatgatgcgattaatgaaggtgtacgccaaggttatcttgaaaataccaacgtactccgtgcttctgtgcttgcagatccagcctttggccgtaaaaataccaaagacaacacccccgctgtaatccattataaacttgttccaggtaacaaagttgatattacagtagccgctaaaggcggtggttctgaaaataaatctaaacttgccatgttgaatccgtctgattcaattgtggactgggtactgaaaactgttccaactatgggcgctggctggtgtcctccaggtatgctgggtatcgggattggtggtactgctgaaaaagccatgatgcttgccaaagaagcattgatggaagaaatcaacatggacgaattacttcgtcgcgggccagaaaacaaaattgaagaacttcgtatcgaaatcttcgagaaagtgaatgcgcttggtattggtgcacaaggtcttggcggtttgactacagttctcgatatcaaaattaaagattatccatgtcatgcggcaggcaaaccagtgggcatgattccaaactgtgctgcgactcgtcatgctcattttcagttagatggttcaggccctgcacatattcaagcacctaaacttgaagattacccagaagtgacgtgggattcatctaaatcaaaacgcgtaaaccttgataccatcactcaagaagaaatgaactcttggcagccaggtgataccttgttgctcagtggcaccatgtacactggtcgtgatgcagcgcataaacgtctggtagaaatgatcgataatggtgaagagcttcctgtcgatcttaaaggtaagtttatttactacgtgggtccagtcgatcctgtaggtgatgaagtggttggacctgctggcccaacaacagcaacgcgtatggacaaattcacacgtaaagtgcttgagcatacgggtctgtttggcatgattggtaaagcagatcgtggcccaaccgcgattgaagcgattaaagataatcaagcaacgtatctcatggcagtcggtggtgcagcataccttgtatctaaggcagtgcgtgaagccgaagtggttgcatttgctgatctaggtatggaagctatctacaaatttgtagtcgaagacatgccagtatccgttgcagttgatgttaacggtacatcggtacatgcaattgcacccaaaatctggcaagaaaagattggtaaaattccagtgattgatgccactgcagtttaa

SEQ ID NO: 89848 - protein, 508 aa, Acinetobacter sp. ADP1
MTTIIKQEDLITSVKDALQFISYYHPQDFIQAMSRAYDREANQAAKDAIAQILINSRMCAEGHRPICQDTGIVNVFVDVGLDVKFDLSMSLDDAINEGVRQGYLENTNVLRASVLADPAFGRKNTKDNTPAVIHYKLVPGNKVDITVAAKGGGSENKSKLAMLNPSDSIVDWVLKTVPTMGAGWCPPGMLGIGIGGTAEKAMMLAKEALMEEINMDELLRRGPENKIEELRIEIFEKVNALGIGAQGLGGLTTVLDIKIKDYPCHAAGKPVGMIPNCAATRHAHFQLDGSGPAHIQAPKLEDYPEVTWDSSKSKRVNLDTITQEEMNSWQPGDTLLLSGTMYTGRDAAHKRLVEMIDNGEELPVDLKGKFIYYVGPVDPVGDEVVGPAGPTTATRMDKFTRKVLEHTGLFGMIGKADRGPTAIEAIKDNQATYLMAVGGAAYLVSKAVREAEVVAFADLGMEAIYKFVVEDMPVSVAVDVNGTSVHAIAPKIWQEKIGKIPVIDATAV

SEQ ID NO: 89849 - DNA, 1644 bp, Erwinia carotovora subsp. atroseptica SCRI1043
  CDS (1)..(1644)
atgtcgaataaacccttctattaccaagatccttttccactcagtaaagatgacactgaatatcgcctgctgagcagcgactttgtctctgtcgcgcaatttgaaggtcaggacatcctgaaagtcgagccagcggcgttgacccttctggcccagcaagccttccacgatgcttctttcatgctccgccccgctcatcagcagcaagttgccgatattctccatgacccagaagccagcgaaaacgataaatacgttgctctgcaattcctgcgcaactcagaaatttccgccaagggaattctgccgacctgtcaggataccggtaccgcgattatcgtcggtaaaaaaggccaaaacgtgtggactggcggtaacgatgccgaagcgctgtctcagggcgtgtacaacacgttcattgaagacaacttgcgttactcgcagaacgctgcgctggatatgtaccaagaggtcaacactggcaccaacctgcctgcgcagattgatctctacagtaccgagggcgaagattataaattcctgttcgtcaccaaaggcggcggttctgctaacaagacctacttgtatcaggaaaccaaagcgctgctgacgccgggtaaactgaagagcttcctgatcgagaaaatgcgttcattgggcacggcggcctgcccgccataccacatcgcgtttgctattggcggtacctcggcagaaaccacgctgaaaaccgttaaactggcttcgaccaagtactatgacgaactgccgaccgaaggcaacgagcacggtcaggcgttccgcgatgtcgcactggagcaggaaattctggaagccgcacgcgatttgggtctgggggcgcagttcggcggtaaatatttcgcgcacgacgtgcggattatccgcttgccgcgccacggcgcatcttgtccggtcgggatgggcgtatcctgttccgctgaccgcaacatcaaaggcaagatcaaccgcaagggcgtctggctggagcagttagagcagaatccgggcaaatatatccctgagcacctgcgtgaaacgggcgaaggcgatgcggttaaaatcgacctgaaccgcccaatgaccgagatcctgaagacgctgtcgcagtatccggtgtccacccgcctttccctgactggcactatcatcgtgggtcgtgatattgctcacgccaagctgaaagagcgtctggataacggtgaaggtctgccgcagtacattaaagatcacccgatctactacgcaggcccagcgaaaacaccggaaggttatccatcaggttcattaggcccaaccacagctggccgcatggattcctatgtcgatttactgcaagccaacggcggcagcatggtcatgctggcaaaaggcaaccgtagccaacaagtcaccgacgcatgccataaacatggcggtttctacctcggcagcatcggcggcccggcagcgattctggcgcaaaacagcatcaaaagcctgacctgtgtggaatacccagaactgggtatggaagccatctggaaaatcgaagtagaagatttccctgcctttattctggtcgatgataaaggcaacgatttcttccaggtgattcagagcgccaaatgcgtgaaatgcggttaa

SEQ ID NO: 89850 - protein, 547 aa, Erwinia carotovora subsp. atroseptica SCRI1043
MSNKPFYYQDPFPLSKDDTEYRLLSSDFVSVAQFEGQDILKVEPAALTLLAQQAFHDASFMLRPAHQQQVADILHDPEASENDKYVALQFLRNSEISAKGILPTCQDTGTAIIVGKKGQNVWTGGNDAEALSQGVYNTFIEDNLRYSQNAALDMYQEVNTGTNLPAQIDLYSTEGEDYKFLFVTKGGGSANKTYLYQETKALLTPGKLKSFLIEKMRSLGTAACPPYHIAFAIGGTSAETTLKTVKLASTKYYDELPTEGNEHGQAFRDVALEQEILEAARDLGLGAQFGGKYFAHDVRIIRLPRHGASCPVGMGVSCSADRNIKGKINRKGVWLEQLEQNPGKYIPEHLRETGEGDAVKIDLNRPMTEILKTLSQYPVSTRLSLTGTIIVGRDIAHAKLKERLDNGEGLPQYIKDHPIYYAGPAKTPEGYPSGSLGPTTAGRMDSYVDLLQANGGSMVMLAKGNRSQQVTDACHKHGGFYLGSIGGPAAILAQNSIKSLTCVEYPELGMEAIWKIEVEDFPAFILVDDKGNDFFQVIQSAKCVKCG

SEQ ID NO: 89851 - DNA, 1545 bp, Desulfotalea psychrophila LSv54
  CDS (1)..(1545): transl_table=11
ttgatattattaaacaaaaaaggaatagccatgaccaccatcaagaaaaaagactttgtcgattctattgctgaaagtttacagcatatctcctactaccaccccctcgactttgtaaaggcgatgcacgcagcctatctgcgtgaggaaaaccccgcggccaaggacgccataggccaaattctgatcaactccaagatggctgctgtcggaaaaaggcctatctgccaagatacgggcatcgtcaatgtcttcttaaaggttggaaaaaactgtcaatttgactgctcagaaagcctgcaagaactggtagatgagggggtacgtcttgcctacgggcatccagaaaaccccctacgcgcctccgttgtcaaaagtcctgcaaccaaccgtctcaataccaaggataacagcccggccattgtctatacagagattgttgaaggtaacgggatcgatataagtatagcagccaagggcggtggttcagaaaataagaccaaattggccatgctcaaccccaacgactcaatcgttgactgggtcaagaaagttgtccccaccatgggcgcgggctggtgtcctccggggataatcagccttggggtcggtggtactgctgacaaggctatggtccttgccaaggagggactcatggcagccgttgatatgccagagattctcgcacgcggaccaaaggacaaggtcgaagagttgcgagtggccctctaccatgccataaatgatctgggcattggcgcccagggtctcggcggactcaccaccgtagtcgacgtcaaattagcagaatatccgacccacgcggcatctctgcccgtggcccttattccaaactgcgcagcaacccgtcatacccactttcatcttgacggcagcggccccgccgaatttccacgtcctgatataacccagtggccggacatctctcttgctgcgggcgacaaggttaaacgtgtccaccttaacaatataaccaaggaagagattgccacctggcaaaccggtgagaccctccttctcaacggtaaaatcctcaccggtcgtgatgccgcccataaacgcatcaagggactgctcgatgcgggagagccactacctgcgggggttgatttcaacggacgatttatctattacgtaggccccgttgatccagtcggcaccgaggtggttggacccgccggccccacaacatctacccgcatggacaagtttaccgacatgatgctagaagaggcgggcctctttggtatgattggcaaatcagaacgtggcgatgaaaccattgagtccatcaagaaaaacaaagctgtctacctgatggccgtaggcggagccgcctaccttgtctccaaggcaatcaaaaaatcccgggtggtggcctttgccgatctcggaatggaggccatctacgaatttgaggtggaggatatgccagtgaccgtggccgtcgacgcccgaggagaggcaatccacaaaacagggcccaccttttggcaggaacatatcaggcagatgaagagatag

SEQ ID NO: 89852 - protein, 514 aa, Desulfotalea psychrophila LSv54
MILLNKKGIAMTTIKKKDFVDSIAESLQHISYYHPLDFVKAMHAAYLREENPAAKDAIGQILINSKMAAVGKRPICQDTGIVNVFLKVGKNCQFDCSESLQELVDEGVRLAYGHPENPLRASVVKSPATNRLNTKDNSPAIVYTEIVEGNGIDISIAAKGGGSENKTKLAMLNPNDSIVDWVKKVVPTMGAGWCPPGIISLGVGGTADKAMVLAKEGLMAAVDMPEILARGPKDKVEELRVALYHAINDLGIGAQGLGGLTTVVDVKLAEYPTHAASLPVALIPNCAATRHTHFHLDGSGPAEFPRPDITQWPDISLAAGDKVKRVHLNNITKEEIATWQTGETLLLNGKILTGRDAAHKRIKGLLDAGEPLPAGVDFNGRFIYYVGPVDPVGTEVVGPAGPTTSTRMDKFTDMMLEEAGLFGMIGKSERGDETIESIKKNKAVYLMAVGGAAYLVSKAIKKSRVVAFADLGMEAIYEFEVEDMPVTVAVDARGEAIHKTGPTFWQEHIRQMKR

SEQ ID NO: 89853 - DNA, 1521 bp, Bacillus cereus ZK
  CDS (1)..(1521): transl_table=11
atggaaaagcttcaagaaagcatgtatcaactaattgttgaaacgtcaacgaacttaccgaaagatgttcgtcgtgcgattcaacaagcgaaagagcgagaaaatgcagggactcgctctgcgatggcacttggcacaattacgaataatattaaaatggctgatgataacatctcaccaatttgccaagatacagggatgccaacgtttaaaatttatacaccagttggtgtgaatcaattaaagttgaaggaagctatctataatgcgcttgagcgggcgacaaaagatggtaaacttcgtccaaattctgttgattctctttttggagacaatagtggaaataatttaggaccaggtactccggtgattaagtttgaacaatgggaaaaagattatattgatgcacgtttaattctaaagggtggtggctgtgagaataaaaatattcagtatagcttaccatgtgaattagaaggacttggacgtgcaggccgtgatttagaaggaattcgtaaatgccttcttcacgcagtatatcaagcacaagggcaaggatgtagtgcaggtgtaattggtgttggtatcgggggagaccgcacatcaggttacgaattagcaaaaaatcaattattccgtacattagatgatgttaatccaatcccagaattacaacaacttgaagaatatgtattagaaaatgcgaataagcttggcattggtacgatgggatttggcggagaaacaactttacttggctgtaaaattggcgtgtataatcgtctgccagctagcttctatgtatctgtggcgtataattgctgggcatatcgccgtcttggcgtaataattcaccctgaaacaggtgaaattatggattggttatatcaagaaggtgacgatacacttcagcaagaggcgcaaaaaaaaacagagcaacgtgagattgtattacaagcaccgattacagaagagcaaattcgtgaacttcgcgttggtgatgttgtaacaattaatggcatgatgtatacaggtcgtgacgcaatccataagcatttaatggataatgattgtccagtagatttaaatggacaagttatttatcactgtggtccagttgtcgtgaaagatgaaaaggacaattggcaaattaaagcggcaggtccaacgacaagtattcgtgaagaaccgtaccaaggtgatattatgaagaaattcggtattcgcgctgtcattggaaaaggcggtatgggtgcgaaaacattagcggctttagaagaacacggcggtgtatatttaaacgcaatcggtggtgcagcgcaatattatgctgaatgtattaaagaagtgaaagatgttgatttcttacaatttggtattccagaggcaatgtggcatttacgtattgaagggtttaaagcagttgtaacgatggattctcatggtaatagcttacatgcagatgttgataaaacatcacttgaaaaattagcgagctttaaagagccagtatttaagtaa

SEQ ID NO: 89854 - protein, 506 aa, Bacillus cereus ZK
MEKLQESMYQLIVETSTNLPKDVRRAIQQAKERENAGTRSAMALGTITNNIKMADDNISPICQDTGMPTFKIYTPVGVNQLKLKEAIYNALERATKDGKLRPNSVDSLFGDNSGNNLGPGTPVIKFEQWEKDYIDARLILKGGGCENKNIQYSLPCELEGLGRAGRDLEGIRKCLLHAVYQAQGQGCSAGVIGVGIGGDRTSGYELAKNQLFRTLDDVNPIPELQQLEEYVLENANKLGIGTMGFGGETTLLGCKIGVYNRLPASFYVSVAYNCWAYRRLGVIIHPETGEIMDWLYQEGDDTLQQEAQKKTEQREIVLQAPITEEQIRELRVGDVVTINGMMYTGRDAIHKHLMDNDCPVDLNGQVIYHCGPVVVKDEKDNWQIKAAGPTTSIREEPYQGDIMKKFGIRAVIGKGGMGAKTLAALEEHGGVYLNAIGGAAQYYAECIKEVKDVDFLQFGIPEAMWHLRIEGFKAVVTMDSHGNSLHADVDKTSLEKLASFKEPVFK

SEQ ID NO: 89855 - DNA, 1647 bp, Bacteroides fragilis YCH46
  CDS (1)..(1647): transl_table=11
atggcaacacctccgtttaagtatcaacctatgttcgaacatggggaagataaaaccgagtattatctgcttaccaaagactatgtgtcagtaagcgagttcgaaggaacacctgtgctgaaagtacagaaagaaggtctgacagcgatggctaatactgctttccgcgacgtatctttcatgcttcgccgtgcgcacaacgagcaggtagcgaagattctgagcgacccggaagcaagtgaaaacgacaaatacgtggcattgactttcctgcgcaacgctgaagtggctgccaaaggtatacttcctttctgccaggataccggtacggctatcatccacggtgaaaaaggacagcaggtatggacaggctattgcgatgaagaagctttgtcattgggtgtttacaagacatatacggaagaaaacctgcgttattcacagaatgctccgctcaacatgtacgacgaggtgaacacgaagtgcaatctgccggcccagatcgatatcgaggctacggaaggcatggagtacaaattcctgtgtgtgaccaagggtggtggttctgccaataagacttatctgtatcaggagacaaaagcgatcctgaatccgggcactctggttccgttcctggttgagaagatgaagacactgggtacagcggcttgtcctccttatcatattgcattcgttatcggcggtacttcggctgagaagaatctgctgactgtgaaactggcttctacccactattacgacgagttgccgactaccggtaatgagtatggtcgtgctttccgcgacgtagaactggagaaagaggtacttgccgaagcccaaaagatcggtttgggagcacagtttggcggtaaatatctggcacacgatgtacgtatcatccgtctgccccgtcacggagcttcttgtccggtgggcttgggtgtatcttgttctgccgaccgtaacatcaaatgtaagatcaataaagacggtatctggattgaaaaactcgattctaatccgggcagtctgattcccgcagaactgcgtggcgcaggtgaaggcgatgtagtgaaaatcgacctgaaccagccgatggcggatatcctgaaggaactgactaaatatccggtagctacacgtctgtcactcaacggtacgatcatcgtaggccgtgatatcgctcacgctaaactgaaagaacgtctggatcgcggcgaagatctgcctcaatatatcaaagaccatccgatttattatgccggtccggctaaaactcctgccggcatggcttgcggttcgatgggaccgactactgccggacgtatggatccctatgtggacttgttccagagccatggcggcagcatgattatgttggcaaaaggtaaccgtagccagcaggtgaccgatgcttgtaagaagtatggcggtttctaccttggttcaatcggtggtccggctgctatccttgcccagaacaatatcaagagcatcgaatgcgtagaatatccggaattgggtatggaagctatctggaagatcgaagtagaggacttccccgcatttattcttgtagatgacaagggtaacgacttctttaagcagataaaaccccgttgcggttcttgcagcaacaaataa

SEQ ID NO: 89856 - protein, 548 aa, Bacteroides fragilis YCH46
MATPPFKYQPMFEHGEDKTEYYLLTKDYVSVSEFEGTPVLKVQKEGLTAMANTAFRDVSFMLRRAHNEQVAKILSDPEASENDKYVALTFLRNAEVAAKGILPFCQDTGTAIIHGEKGQQVWTGYCDEEALSLGVYKTYTEENLRYSQNAPLNMYDEVNTKCNLPAQIDIEATEGMEYKFLCVTKGGGSANKTYLYQETKAILNPGTLVPFLVEKMKTLGTAACPPYHIAFVIGGTSAEKNLLTVKLASTHYYDELPTTGNEYGRAFRDVELEKEVLAEAQKIGLGAQFGGKYLAHDVRIIRLPRHGASCPVGLGVSCSADRNIKCKINKDGIWIEKLDSNPGSLIPAELRGAGEGDVVKIDLNQPMADILKELTKYPVATRLSLNGTIIVGRDIAHAKLKERLDRGEDLPQYIKDHPIYYAGPAKTPAGMACGSMGPTTAGRMDPYVDLFQSHGGSMIMLAKGNRSQQVTDACKKYGGFYLGSIGGPAAILAQNNIKSIECVEYPELGMEAIWKIEVEDFPAFILVDDKGNDFFKQIKPRCGSCSNK

SEQ ID NO: 89857 - DNA, 1536 bp, Burkholderia mallei ATCC 23344
  CDS (1)..(1536): transl_table=11
atgaccgtcatcaaacaggaagacctgatccagagcatcgcggattcgctgcagtacatcagctactaccatccgctcgattacatccaggcgctcggccgcgcatacgagctcgagcagagcccggccgcgaaggatgcgatcgcgcagatcctgacgaacagccgcatgtgcgcggaaggcaagcgcccgatctgccaggacacgggcatcgtcacgatcttcgtgaaggtcggcatggacgtgcgctgggcaagcgagaacggcgccgcgacgatgagcgtcaccgacatgatcaacgaaggcgtgcgccgcggctacacgcatccggacaacgtgctgcgcgcatcgatcgtcaacccgcccgaaggcgcgcgcaagaacacgaaggacaacacgccggccgtgatccattacgagatcgtgccgggcgacaaggtcgacgtgcaagtcgcggcgaagggcggcggctccgagaacaaatcgaagttcgtgatgctgaacccgtcggattcgatcgtcgactgggtactgaagaccgtgccgacgatgggcgcgggctggtgcccgccgggcatgctcggcatcggcatcggcggcaccgccgagaaggcgatgctgatggcgaaggaatcgctgatggagccgatcgacatccaggaaatcatcgcgcgcggcccgaaggactgggtcgaggaactgcgcgtcgagctgcacgagaaggtcaacgcgctcggcatcggcgcgcagggtctcggcggcctcgcgaccgtgctcgacgtgaagatcctggccgcgccgacgcacgcggcgtcgaagcccgtcgcgatgatcccgaactgcgcggccacgcgccatgcgcacttcgtgctcgacggctcgggcgcggcgaagctcgaggcgccgtcgctcgacgcatggccgaaggttcaatgggaaccgaacaccgagacgagcaagcgcgtcgacctgaacacgctgacgccggaagaagtcgcatcgtggaagccgggccagacgctgctgctgtcgggcaagatgctcacgggccgcgacgccgcgcacaagcgcatcgccgacatgctcgccaagggcgagccgttgcccgtcgacttcaagaaccgcgtgatctactacgtcgggccggtcgatccggtgcgcgacgaagtggtcggtccggcgggcccgacgacggccacgcgcatggacaagttcaccgagacgatgctcgcgcagacgggcctcatctcgatggtcggcaaggccgagcgcggcccggtcgcgatcgacgcgatcaagaagcacaaggccgcttatctgatggcggtcggcggcgccgcgtacctcgtgtcgaaggcgattcgcggcgcgaaggtgctcgcgttcgaagacctcggcatggaagcgatctacgagttcgacgtacaggacatgccggtgacggtcgcggtcgattcgcagggcacgtcggtccatcaaacggggccgaaggagtggcaggcgaagatcggcaagatccctgtcgcgagcgcgtaa

SEQ ID NO: 89858 - protein, 511 aa, Burkholderia mallei ATCC 23344
MTVIKQEDLIQSIADSLQYISYYHPLDYIQALGRAYELEQSPAAKDAIAQILTNSRMCAEGKRPICQDTGIVTIFVKVGMDVRWASENGAATMSVTDMINEGVRRGYTHPDNVLRASIVNPPEGARKNTKDNTPAVIHYEIVPGDKVDVQVAAKGGGSENKSKFVMLNPSDSIVDWVLKTVPTMGAGWCPPGMLGIGIGGTAEKAMLMAKESLMEPIDIQEIIARGPKDWVEELRVELHEKVNALGIGAQGLGGLATVLDVKILAAPTHAASKPVAMIPNCAATRHAHFVLDGSGAAKLEAPSLDAWPKVQWEPNTETSKRVDLNTLTPEEVASWKPGQTLLLSGKMLTGRDAAHKRIADMLAKGEPLPVDFKNRVIYYVGPVDPVRDEVVGPAGPTTATRMDKFTETMLAQTGLISMVGKAERGPVAIDAIKKHKAAYLMAVGGAAYLVSKAIRGAKVLAFEDLGMEAIYEFDVQDMPVTVAVDSQGTSVHQTGPKEWQAKIGKIPVASA

SEQ ID NO: 89859 - DNA, 1677 bp, Nocardia farcinica IFM 10152
  CDS (1)..(1677): transl_table=11
gtgaccgccccggagttccgctattcagatctgctgccgatcggcgccgacgacacgccgtaccggctgctgaccaccgagggcgtcagcaccttcgagcacaacggtcgcaccttcctgcaggtcgaccccgaggtgctgcggatgctcaccgccgaggcgatgcacgacatcagccactacctgcggcccgcgcacctggcgcagctgcgcaagatcatcgacgacccggagtcctccggcaacgaccgcttcgtcgcgctggacctgctcaaaaacgtcaacatctccgcgggcggcatcctgccgatgtgccaggacaccggcaccgcgatcgtgatgggcaagaagtccgagggcgtgctcaccggggtcgacgacgccgagtggatcagccgcggcgtcttcgacgcctacaccaagctgaacctgcgctactcccagctggccccgttgaccatgtgggaggagaagaacaccggcaccaacctgcccgcgcaggtcgagttgtactccacccagggcgatcccgcgcacccgtcctacaagttcctgttcatggccaagggcggcggctcggccaacaagtcgttcctgtaccaggagaccaaggccatcctgaaccccgagcggatgctggagttcctggacgagaagatccgttcgctgggcaccgcggcctgcccgccctaccacctggccgtggtgatcggcggcaccagcgccgaattcgcgctcaagaccgccaaatacgcctccgcgcactacctggacaatctgcccaccgagggctcgatgaccgcgcacgccttccgcgacctggcgctggaggaggaggtcttcaagctgacccagtccttcggcatcggcgcgcagttcggcggcaagtacttctgccacgacgtgcgcgtggtgcgcctgccccggcacggcgccagctgcccggtcgccatcgcggtgtcctgctcggccgaccgccaggcgttggccaagatcacccccgagggcgtgttcctcgagcagctcgagcgcgagcccgcccagtacctgcccgagcagaccgacgagatcctcggcggcgacgtggtgaagatcgacctgaaccggccgatgtcggagatccgcgccgaactgtcgaaatacccggtgaagacccgcctctcgctcaccggcccgctggtggtggcccgcgacatcgcgcacgccaagatcaaggaacgcctcgacgccggcgagccgatgccgcagtacatgcgcgacatggccgtctactacgcgggcccggccaagacgcccgagggctacgcctccggctcgttcggccccaccaccgccggacgcatggactcctacgtcgaccagttccaggcggcgggcggctcctacgtcatgctcgccaagggcaaccgctcggcgcaggtcaccaaggcgtgcaaggagcacggtggtttctacctcggctcgatcggcggcccggccgcgcggctggcgctggactgcatcaagaacgtcgaggtgctcgaataccccgagctcggcatggaggcggtctggaagatcgaggtcgaggacttcccggccttcatcgtcgtcgacgacaagggcaacgatttcttcgccgagacccagaagccgatcgcgctgcgcgtgcgcacccggtccaaggaacgggtctag

SEQ ID NO: 89860 - protein, 558 aa, Nocardia farcinica IFM 10152
MTAPEFRYSDLLPIGADDTPYRLLTTEGVSTFEHNGRTFLQVDPEVLRMLTAEAMHDISHYLRPAHLAQLRKIIDDPESSGNDRFVALDLLKNVNISAGGILPMCQDTGTAIVMGKKSEGVLTGVDDAEWISRGVFDAYTKLNLRYSQLAPLTMWEEKNTGTNLPAQVELYSTQGDPAHPSYKFLFMAKGGGSANKSFLYQETKAILNPERMLEFLDEKIRSLGTAACPPYHLAVVIGGTSAEFALKTAKYASAHYLDNLPTEGSMTAHAFRDLALEEEVFKLTQSFGIGAQFGGKYFCHDVRVVRLPRHGASCPVAIAVSCSADRQALAKITPEGVFLEQLEREPAQYLPEQTDEILGGDVVKIDLNRPMSEIRAELSKYPVKTRLSLTGPLVVARDIAHAKIKERLDAGEPMPQYMRDMAVYYAGPAKTPEGYASGSFGPTTAGRMDSYVDQFQAAGGSYVMLAKGNRSAQVTKACKEHGGFYLGSIGGPAARLALDCIKNVEVLEYPELGMEAVWKIEVEDFPAFIVVDDKGNDFFAETQKPIALRVRTRSKERV

SEQ ID NO: 89861 - DNA, 1509 bp, Photobacterium profundum SS9
  CDS (1)..(1509): transl_table=11
atgaccgtcatccgtaaagaagatgtgattagtagtgttgctgatgcattacagtacatatcttactaccatccacttgattttgttcaagcattggaaaaagcttataacaaagaacagagtcaagctgcgaaagatgctatcgcacagattttgatcaattcgcgtatgtctgcagaaggtaagcgtcctatctgtcaagatacgggtattgtgacctgtttcgttaaaatcggtatgaatgtgcagtgggagggtgatcttactgttcagcaaatggtcgatgaaggtgtccgtcaagcttataacaacccagacaaccccctacgagcgtctgttgttgccgatcctgctggcacgcgtaccaatacgaaagataatacgccagcagttgttcatattgatatggtgccaggtaataaagttgatattcaaattgcagctaaaggcggcggttctgaaaataaaaccaaaatggtgatgctaaacccttctgatgatgtagctgagtgggttgaaaaaacagtgccactaatgggcgcgggttggtgcccaccaggtatgttaggcataggcatcggtggtacggctgaaaaagcggcagtattagcaaaagagtcgttgatggactctattgatatccatgagctgcaagagcgtggcgcgcaaaatgctgaagaagaattacgtttagatatttataaccgtgtgaacaagttgggtattggtgcacaagggctgggtgggttaacaaccgttgttgatgtgaaaattaaaacagcaccaacacacgctgcgtctaagcctgtttgcatgatccctaactgtgcggctacgcgtcatgtgcattttacacttgacggtacaggccctgctgaattaaccccaccgaagctagaagactggccagaagtgacatgggaagtcggcgagagtgttcgccgtgttaacgttgatgaaattactaaagctgatgttcaggaatggaaatcaggcgaaacggttttattgtcaggtaaaatcttaacaggtcgtgatgctgcgcataaacgtattcaagatatgttggctcgcggcgaagatttccctgtagatttcaataaccgctttatttattacgtgggtccagtcgatgccgtccgtgatgaggtagtgggtcctgctggtccaacaacgtcaacgcgtatggataagtttaccgatatgatgttaggtcaagctggcttaatgggcatgattggtaaagctgaacgtggacctaaggcaattgagtcgattaaagcacacaacgcggtttatctaatggctgttggtggtgctgcttacttggttgcgaaggcgattaagaaagcacgtatagttgcatttgaagatctcggtatggaagctatctacgaatttgaagtcgaagatatgccagtgactgttgcggttgattctgcaggcactaacgcccatgagacaggtccagatacttggaaagtcaaaatagctgaaatggatgcttaa

SEQ ID NO: 89862 - protein, 502 aa, Photobacterium profundum SS9
MTVIRKEDVISSVADALQYISYYHPLDFVQALEKAYNKEQSQAAKDAIAQILINSRMSAEGKRPICQDTGIVTCFVKIGMNVQWEGDLTVQQMVDEGVRQAYNNPDNPLRASVVADPAGTRTNTKDNTPAVVHIDMVPGNKVDIQIAAKGGGSENKTKMVMLNPSDDVAEWVEKTVPLMGAGWCPPGMLGIGIGGTAEKAAVLAKESLMDSIDIHELQERGAQNAEEELRLDIYNRVNKLGIGAQGLGGLTTVVDVKIKTAPTHAASKPVCMIPNCAATRHVHFTLDGTGPAELTPPKLEDWPEVTWEVGESVRRVNVDEITKADVQEWKSGETVLLSGKILTGRDAAHKRIQDMLARGEDFPVDFNNRFIYYVGPVDAVRDEVVGPAGPTTSTRMDKFTDMMLGQAGLMGMIGKAERGPKAIESIKAHNAVYLMAVGGAAYLVAKAIKKARIVAFEDLGMEAIYEFEVEDMPVTVAVDSAGTNAHETGPDTWKVKIAEMDA

SEQ ID NO: 89863 - DNA, 1548 bp, Geobacillus kaustophilus HTA426
  CDS (1)..(1548): transl_table=11
atggaaaaattccagcaaagcatgtatgacttgatcgttgagacatcaacgaagctgccgaaggacgttcgccgagcgatcgctcgagcgaaagtgcgcgaaaacgccggcacgcgggcggccatggcgctcgatacgatcgtcgagaacattcaaatggcggacgaaaacgtgtcgccgatctgtcaggacaccggcttgccgacgtttaaaatcaaagtgccggtcggcgtgaatcaaatcgaaatgaaaaaagcgatccgcgccgccattgtcgaagcgacgaaaaacggcaagctgcgtccgaactcggtcgactcgctcaccggcaaaaacagcggcgacaacttaggggaaggcgtgccggtcatcaaatttgaacaatgggaaaacgattacattgacgttcgccttattttaaaaggcggcggttgtgaaaacaaaaacattcaatacagccttccgtgtgaactcgaggggctcggccgcgccggccgcgaccttgacggcatccgcaaatgcattttgcatgcggtgtaccaagcgcaagggcaaggatgcagcgccggctttatcggcgtcggcatcggcggcgaccgctcatcgggctatgagttggcgaaagagcagctgttccgtccggtcgatgatgtcaatccgattgaagaattgcgccaactcgaagaatacattatggaaaacgccaacaaacttggcatcggcacgatgggctttggcggcgaatcgacgctgcttggctgtaaaatcggcgttatgcaccgcatcccggcgagcttcttcgtttcggtcgcctacaactgctgggcgtttcggcgcatgggcgtgaaaatcgacccggcgaccggtgagatcatcgaatggctgtaccaagacggcgaagacgtcgattttgcaaaagagttggaaaaagcggaagcagccgcggcgcttgaacaaggcgacacacgcgtcatcgaccttgttccgccgctgtcggaagaacaagtgcgccagcttcgcgtcggcgacgtcgtccgcatcagcggcgtcatttacaccggccgcgatgccattcataaatatttgatggaccatgacgcgccggtcgacttgaacgggcaaatcatttatcattgcggcccggtcatgttaaaagatgaagaaggccgctggcacgccaaagctgccggcccgacgacaagcatccgtgaagagccgtaccaaggcgacatcatgaaaaaattcggtgtccgcgctgtcatcggcaaaggcggcatgggcgcgaagacgctgcaagcgttaaaagaacacggcggcgtgtatttgaacgccatcggcggcgcggcgcaatattacgccgattgcatcaaatccgtggaaggcgttgatttgctggagtttggcatccccgaagcgatgtggcatttgcgcgtcgaaaacttcactgctgttgtcacgatggattcgcacggcaacagcttgcatgaagatgtggaaaaatcgtcgcttgaaaagctggctcagttcaaagagccggtgttcaagtaa

SEQ ID NO: 89864 - protein, 515 aa, Geobacillus kaustophilus HTA426
MEKFQQSMYDLIVETSTKLPKDVRRAIARAKVRENAGTRAAMALDTIVENIQMADENVSPICQDTGLPTFKIKVPVGVNQIEMKKAIRAAIVEATKNGKLRPNSVDSLTGKNSGDNLGEGVPVIKFEQWENDYIDVRLILKGGGCENKNIQYSLPCELEGLGRAGRDLDGIRKCILHAVYQAQGQGCSAGFIGVGIGGDRSSGYELAKEQLFRPVDDVNPIEELRQLEEYIMENANKLGIGTMGFGGESTLLGCKIGVMHRIPASFFVSVAYNCWAFRRMGVKIDPATGEIIEWLYQDGEDVDFAKELEKAEAAAALEQGDTRVIDLVPPLSEEQVRQLRVGDVVRISGVIYTGRDAIHKYLMDHDAPVDLNGQIIYHCGPVMLKDEEGRWHAKAAGPTTSIREEPYQGDIMKKFGVRAVIGKGGMGAKTLQALKEHGGVYLNAIGGAAQYYADCIKSVEGVDLLEFGIPEAMWHLRVENFTAVVTMDSHGNSLHEDVEKSSLEKLAQFKEPVFK

SEQ ID NO: 89865 - DNA, 1524 bp, Idiomarina loihiensis L2TR
  CDS (1)..(1524): transl_table=11
atgaccaccattcgtcaggccgattttattgacagtattgccgatgcgttgcagtacatttcttattatcacccactggactttattaaagcactggacgaggcataccagcgtgaagagaacgaagcggcgaaaaacgccattgctcaggtgctgactaactcgcgtatgtctgcgcaagggcaccgtccaatttgccaggacaccggtattgtcacctgctttgtgaaagtgggcatgggcgtgcaatgggataaaaccgacctgaccgttcagcaaatggtggatgaaggtactcgtcgagcctacaacaacccggacaacccactgcgtgcttctattgtggctgacccggcgggcgctcgtaaaaacactggcgataacacgccagctgtggtgcatattgatatggtggcgggcaatgaaattgaagtgatgattgccgctaaaggtggtggttctgagaataaatcgaaaatggccatgttaaaccccagcgattcgattgccgattgggttgttgaaaccttgccgaagatgggcgctggctggtgtccgccgggtatgctgggtataggtattggtggtacagcggaaaagtctgcggtattggcaaaagaatctttaatggagtctgtcgatatccatgagcttattgagcgcggcccgcagaatgccgaagaagagctgcgtttagaaattttgaaccgcgttaacgcattaggtattggtgctcagggtttgggaggtttaacaacggtgctggatgtgaagattaagtcactaccaacccacgcagcctctaagcctgtcactttaattccgaactgtgcagccacccgtcacgttcactttacgttagacggcagcggagcagcagatttaaccccgccgaaactggaagattggccggatgtgacttttgaactgggtgatgatgcccgccgtgtgaacctggatgaagtgaccaaagaagacattcaggactggaaaatgggtgaaaccgtgctcttgtccggtaagttgctgaccggtcgtgatgcggcgcacaaacgcattaaaggtatgctggataacggtgaagagctgccagttgatttcaacaaccgctttatttactacgtagggccggtagatcctgtgggtgatgaagttgttggtccggcaggtcctacaacctctacgcgtatggataaattcactgatcagatgctcgaagaagccggtattattggtatggtaggcaaagcagagcgtggccctgaagctgtggaaagtattcgtaagcacaaagcggtttacctgatggccgtgggtggtgccgcgtatttggtcgctaaagccattaaaaaatcccgggttgttgcctttgaagacttaggtatggaagccatttatgagtttgaagtggaagacatgccggtcactgttgctgtggatagcgacggtcaaaacgcgcatacccaagggcctgctatctggaaagcgaaaattgctgacctcaatgaaaaattaggagcttaa

SEQ ID NO: 89866 - protein, 507 aa, Idiomarina loihiensis L2TR
MTTIRQADFIDSIADALQYISYYHPLDFIKALDEAYQREENEAAKNAIAQVLTNSRMSAQGHRPICQDTGIVTCFVKVGMGVQWDKTDLTVQQMVDEGTRRAYNNPDNPLRASIVADPAGARKNTGDNTPAVVHIDMVAGNEIEVMIAAKGGGSENKSKMAMLNPSDSIADWVVETLPKMGAGWCPPGMLGIGIGGTAEKSAVLAKESLMESVDIHELIERGPQNAEEELRLEILNRVNALGIGAQGLGGLTTVLDVKIKSLPTHAASKPVTLIPNCAATRHVHFTLDGSGAADLTPPKLEDWPDVTFELGDDARRVNLDEVTKEDIQDWKMGETVLLSGKLLTGRDAAHKRIKGMLDNGEELPVDFNNRFIYYVGPVDPVGDEVVGPAGPTTSTRMDKFTDQMLEEAGIIGMVGKAERGPEAVESIRKHKAVYLMAVGGAAYLVAKAIKKSRVVAFEDLGMEAIYEFEVEDMPVTVAVDSDGQNAHTQGPAIWKAKIADLNEKLGA

SEQ ID NO: 89867 - DNA, 1533 bp, Azoarcus sp. EbN1
  CDS (1)..(1533): transl_table=11
atgaccgtgattcgcgaagaagacctcattcagtccgtcgcggatgcctttcagttcatcagctattaccaccccctcgacttcatcgaggcgctcggtgaggcctggaagcacgaggagaacccggcggcgaaggacgccatcgcgcagatcctgaccaactcgcgcatgtgcgccgaaggccaccgcccgatctgccaggacactggcatcgcggtcgtcttcctcaaggtcggcatgaacgtgcagtgggacgcgaagatgagcgtccaggagatggtcaatgaaggcgtgcgccgcgcgtacaccaacgtcgacaacaagctgcgcgcctcggtgctgctcgacccggccggcaagcgtcagaattcgaaggacaacacgcccgctgtcgtgcattacgagatcgtccccggcgaccacgtcgaagtcacctgtgcggcgaagggcggcggctcggagaacaagtcgaagttctacgcgctgaacccgtccgactcgatcgtcgactgggtactgaagacgctgccgacgatgggtgccggctggtgcccgccgggcatcctcggcatcggcatcggcggcacgcccgagaaggcgatgctgctcgcgaaggaatcgctgatggcgccggtcgacatccacgaactacgcgcaaaagctgcttcgggggcgacgctcacgcgcgtcgaggaattgcgcctcgagctgatggacaaggtcaacgcactgggtatcggcgcgcagggtctcggcggcctcacgaccgtgctcgacgtcaagatcctcgactacccgacgcacgctgcgagcctgccggtcgcgatgattccgaactgcgcggcgacgcgccacgtgcatttcgagctcgacggctccgggccggcgaaactcgaggcgccgaagctcgaggactggccggacgtcacgtggcaggccgacaccaaggtcgccacgcgcgtcaatctcgacaccctgacgaaggaagaagtcgcgtcgtggaagcccggccaggtgctgctgctgaacggcaagatgctgaccggccgcgacgccgcacacaagcgcatcgccgacatgctcgcaaaaggcgagaagctgcccgtcgacttcacgaaccgcgtcatctactacgtcggcccggtcgacccggtgcgcgacgaagtcgtcggtccggccggcccgaccaccgcgacgcgcatggacaagttcacccgcatgatgctcgaacagaccggcctgatctcgatggtcggcaaggccgagcgcggcccggcggcgatcgacgcgatccgcgacaacaagtcggcctatctgatggcagtcggcggcgcagcctacctcgtcgcgaaagcgatcaagaccgccaaggtcgtcggcttcgccgatctgggcatggaagcgatctacgagttcgacgtgcaggacatgcccgtgaccgtcgccgtcgattcgaccggcaccagcgtccatgaaaccggcccgaagacgtggcaggcgaagatcggaaagatcccggtcgcgaccgcctga

SEQ ID NO: 89868 - protein, 510 aa, Azoarcus sp. EbN1
MTVIREEDLIQSVADAFQFISYYHPLDFIEALGEAWKHEENPAAKDAIAQILTNSRMCAEGHRPICQDTGIAVVFLKVGMNVQWDAKMSVQEMVNEGVRRAYTNVDNKLRASVLLDPAGKRQNSKDNTPAVVHYEIVPGDHVEVTCAAKGGGSENKSKFYALNPSDSIVDWVLKTLPTMGAGWCPPGILGIGIGGTPEKAMLLAKESLMAPVDIHELRAKAASGATLTRVEELRLELMDKVNALGIGAQGLGGLTTVLDVKILDYPTHAASLPVAMIPNCAATRHVHFELDGSGPAKLEAPKLEDWPDVTWQADTKVATRVNLDTLTKEEVASWKPGQVLLLNGKMLTGRDAAHKRIADMLAKGEKLPVDFTNRVIYYVGPVDPVRDEVVGPAGPTTATRMDKFTRMMLEQTGLISMVGKAERGPAAIDAIRDNKSAYLMAVGGAAYLVAKAIKTAKVVGFADLGMEAIYEFDVQDMPVTVAVDSTGTSVHETGPKTWQAKIGKIPVATA

SEQ ID NO: 89869 - DNA, 1524 bp, Zymomonas mobilis subsp. mobilis ZM4
  CDS (1)..(1524): transl_table=11
atgaccgttattcgccaaaatgacctgattgatagtgttgccgatgctttacagtttatcgcttgctatcatcctcgtgattttatccagtcgctttatgaagcctatcagcgcgaggaaaatccggcagcaaaagaggctctggcgcaaatccttatcaattcccgcctgtctgctatcggcaagcgccccatgtgtcaggataccggcattgtcaccgtttttgctgaaatcggtatgggagtgcgttttgaaggcgaaatgacgctggacgagatgatcaatgaaggcgtgagacgagcttatacctgcccttccaatcgtcttcgatattcagtggtggccgatcccgatggcagccggaagaataccggtgacaataccccagccattattcatcatcatttagtcgcaggcgatcaggtaaaattgcggctggcagcgaaaggcggaggcagcgaggcaaagacccgttttgcgatgctgaacccgtctgatagcgttgtggattgggtgttagaacaaattccccatttaggtgccggatggtgtccgcccggtattatcgggatcgggattgggggtaatcccgaaaaggctatggaaatggccaaatcccaagcgatggaatctattgatattcatcaattgcagggaagaggcgcacaaaatcacgaagaagccttgagattagaattatatcgtaagatcaatgaattggggattggtgcgcagggattgggcggattgaccacggttttggatgtcaaaattgaaagctatccaacccatgccgcgaataagcccattgccttggtaccgaattgtgccgcgacccgtcatattgaaatcactttggatgggcatggcgcagcgattatgccggaaattcatttagatgattggccagaaatcgccaagaaaagcgatggcgtggttagacgggtcaatattgatgacattaccaaagaagaaatggctgattggaaggccggtgacagcctattactgtccggtaaaatcctgaccggacgagatgctgcccataaaaggctggttgatttgttagaccaagggcaagccttgcctgtcgatcttgaaaatcgttttatctattatgtgggtcccgttgatccggttaaaggcgaagtgatgggccctgcgggcccgacgacggccacccgtatggataaattcaccccccgtttattagccgaaactggattaatcggcatgattggcaaagccgaaagaggtgaagccacgatcaaggccattcgtgacaataaggccgcttatttaattgcggtcgggggtgcggcttatctcatttcaaaagcaatcaaatccgcgagaattttggcttttgaagatttgggtatggaagctatttatgaatttgaggttgaggatatgcccgttacggtagcggtcgatagtgacggccaaaatatccataaaatagccccgaaaaaatggcaggcctatattcaagagaaagcttgttccgcctgtttaagctag

SEQ ID NO: 89870 - protein, 507 aa, Zymomonas mobilis subsp. mobilis ZM4
MTVIRQNDLIDSVADALQFIACYHPRDFIQSLYEAYQREENPAAKEALAQILINSRLSAIGKRPMCQDTGIVTVFAEIGMGVRFEGEMTLDEMINEGVRRAYTCPSNRLRYSVVADPDGSRKNTGDNTPAIIHHHLVAGDQVKLRLAAKGGGSEAKTRFAMLNPSDSVVDWVLEQIPHLGAGWCPPGIIGIGIGGNPEKAMEMAKSQAMESIDIHQLQGRGAQNHEEALRLELYRKINELGIGAQGLGGLTTVLDVKIESYPTHAANKPIALVPNCAATRHIEITLDGHGAAIMPEIHLDDWPEIAKKSDGVVRRVNIDDITKEEMADWKAGDSLLLSGKILTGRDAAHKRLVDLLDQGQALPVDLENRFIYYVGPVDPVKGEVMGPAGPTTATRMDKFTPRLLAETGLIGMIGKAERGEATIKAIRDNKAAYLIAVGGAAYLISKAIKSARILAFEDLGMEAIYEFEVEDMPVTVAVDSDGQNIHKIAPKKWQAYIQEKACSACLS

SEQ ID NO: 89871 - DNA, 1509 bp, Silicibacter pomeroyi DSS-3
  CDS (1)..(1509): transl_table=11
atgggcgtgatccgcgaaagcgacatgatcgaaagcatcgccgaggcgctgcaatatatctcgtattaccacccggccgatttcatcggcaccatgaccagcgcctgggagcgcgaggagaaccccggcgccaaggccgcgatggcgcagatcctggtcaattcgcgcatgtgcgccatgggccgccgcccgatctgtcaggacaccggcgccgccaatatccacgtcaaggtcggggtgcaggccaagaccgacttctcccgctcgctgcaggagatctgtgacgagggcacccgccaaggctatcagcgcgacaccaacccgctgcgcgccagcgtggtggtcgacccgttcggcgcccgcaagaactcgggcgacaacacgccctgcatgctgacggtcgagatggtcgccggcgacacgatcgaggtcgaggtcgcggccaagggcggcggatccgagaacaagtcgaaattcaccacgctcaacccctcgggcaatgtggccgactgggtggtgcagacggtcgagacgctgggcgcgggctggtgcccgccgggcgtgctgggcatcggcgtgggcggcaatgcggacaaggcgatggcgctggccaaacaggcgctgagcgaaccgctcgacatgtccgacctgctgcgtcgcggcccctcggacaagaccgaggagctgcggctggaaatctatgaccgcgtcaacgcgctgggcatcggcgcacagggcctgggtggcgtgaccaccgtgcttgacgtcaagatcaagagctttccgacccatgcggcctcgctgcccgtggggctgatccccaactgcgccgccacaaggcatgtgcatttcaccctcgacgggtcgggggctgcggaattcaccccgccctcgatggacctttatcccgacatcctgctggatgcggccggggcgcaggcgacgcggctggacctcgacgatctgaacgacacggtgctggcgtcgctggagccggggcagacactgctgctctcgggcacgctctatacgggccgtgacgccgcgcataagcggatggtcgacatgctcgacaagggtgagccgctgcccgtcgacctgaagggcaaggcgatctattacgtcggtcccgtcgatgcggtgggcgacgaggtgatcggcccggcgggcccgaccacctcgacccggatggacaagttcaccgaccgtatcctgggcgataccgggctcaaggtgatggtcggcaaggccgagcgcggcccggtcgccatcgaggccattgccaagcacaaggcggcctatctgatcgcggtgggcggtgcggcctatctggtgtccaaggcgatcaaggcggccaggccggtggcgttccaggacctggggatggaagccatctatgagctgagggtcgaggatatgccggtgagtgtcgcggtcgacacccagggcaactcgatccaccagaccggcccggccaagtggcgccgcgccactgccgcaggcagctga

SEQ ID NO: 89872 - protein, 502 aa, Silicibacter pomeroyi DSS-3
MGVIRESDMIESIAEALQYISYYHPADFIGTMTSAWEREENPGAKAAMAQILVNSRMCAMGRRPICQDTGAANIHVKVGVQAKTDFSRSLQEICDEGTRQGYQRDTNPLRASVVVDPFGARKNSGDNTPCMLTVEMVAGDTIEVEVAAKGGGSENKSKFTTLNPSGNVADWVVQTVETLGAGWCPPGVLGIGVGGNADKAMALAKQALSEPLDMSDLLRRGPSDKTEELRLEIYDRVNALGIGAQGLGGVTTVLDVKIKSFPTHAASLPVGLIPNCAATRHVHFTLDGSGAAEFTPPSMDLYPDILLDAAGAQATRLDLDDLNDTVLASLEPGQTLLLSGTLYTGRDAAHKRMVDMLDKGEPLPVDLKGKAIYYVGPVDAVGDEVIGPAGPTTSTRMDKFTDRILGDTGLKVMVGKAERGPVAIEAIAKHKAAYLIAVGGAAYLVSKAIKAARPVAFQDLGMEAIYELRVEDMPVSVAVDTQGNSIHQTGPAKWRRATAAGS

SEQ ID NO: 89873 - DNA, 1515 bp, Francisella tularensis subsp. tularensis Schu 4
  CDS (1)..(1515): transl_table=11
atggctgttatcaaagcagaagatctagtaaatagtgttgcagaagcattgcaatatatatcttattatcatccaaaagattttattgatgcaatgtatgaagcatatcagcgtgaagagtcaaaaccagctaaagatgcaatggtgcaaattctaataaactcgagaatgtctgctattggtaagcgtccgatctgccaagatacagggatggtatgcgcttttgtcaaagttggcatggatgcaaaacttgacaagactgatagaacaattacagaacttattaatgagggtgtgcgtcgtggctataatgatccgcataaccctttgagagcatctatggtttttccgccacatggatctagaaaaaacactaaagataatactccagcaattgttcatattgatttagttcatggtgataaaattgaggttgatattgctgcaaaaggtggtggatctgaatttaaatcaaaatttaaggtgttaaatcctagtgatagcataattgattgggttgaagagatgttgccaactatgggggctggctggtgtccacctggaattattggtataggtattggaggcactgcagaaaaagcgatacttttggctaaggaatctcttagtgaagagattaatatccaagatattatcaaaaatggcccacaaaatgaaacagagcaactaagattagatatctataatcgtgtcaatgctctgggtataggtgcacaaggcttaggtggtttgacaacagttttagatgtcaaaataaatgaatatccaacacatgctgcgtgtaagccagttgctttgattcctaactgtgcagctactcgccatgttcattttgttttagatggttctggtgccgttgatttaccagctcctaagatagaagactggccagtaattgagcaagcacaaaatgatgatgttaagagaataaatcttgatacagttactagagaagagattgaggcattaaggtcgggagataacgttttgattagcggtaaaatcttaactggtcgagatgctgcacataagcgtctacaagatatgtataatgctggagaagattttcctgttgatcttaacggtagatttatctactacgtaggtcctgttgatccagtaggtgatgaggtggttggtccagctggtccaactactgctacgcgtatggataagtttacgccatttatgttagagaaagctggtatcatgggaatgataggtaaatcagagcgtggtcaggcaacgattgattctatcaagaaaaataaagctatttacttcatgggtgtaggtggtgctgcttatctcatatctaaatctatcaaaaaagcagaagttgttgcatttgaagatcttggtatggaggcaatttatgagtttgaggttgaggatatgccagtaactgtggctgttgactctttaggtgtttctgctcatcagcaaggtcctaaactttggaaacaaaaaatagctgaaattaataaggtctaa

SEQ ID NO: 89874 - protein, 504 aa, Francisella tularensis subsp. tularensis Schu 4
MAVIKAEDLVNSVAEALQYISYYHPKDFIDAMYEAYQREESKPAKDAMVQILINSRMSAIGKRPICQDTGMVCAFVKVGMDAKLDKTDRTITELINEGVRRGYNDPHNPLRASMVFPPHGSRKNTKDNTPAIVHIDLVHGDKIEVDIAAKGGGSEFKSKFKVLNPSDSIIDWVEEMLPTMGAGWCPPGIIGIGIGGTAEKAILLAKESLSEEINIQDIIKNGPQNETEQLRLDIYNRVNALGIGAQGLGGLTTVLDVKINEYPTHAACKPVALIPNCAATRHVHFVLDGSGAVDLPAPKIEDWPVIEQAQNDDVKRINLDTVTREEIEALRSGDNVLISGKILTGRDAAHKRLQDMYNAGEDFPVDLNGRFIYYVGPVDPVGDEVVGPAGPTTATRMDKFTPFMLEKAGIMGMIGKSERGQATIDSIKKNKAIYFMGVGGAAYLISKSIKKAEVVAFEDLGMEAIYEFEVEDMPVTVAVDSLGVSAHQQGPKLWKQKIAEINKV

SEQ ID NO: 89875 - DNA, 1518 bp, Xanthomonas oryzae pv. oryzae KACC10331
  CDS (1)..(1518): transl_table=11
gtgacctcgatcaagcaggaagacctcatccagtccgtcgccgacgcgctgcagtacatcagctactaccacccggtcgactacatcaagaatttgtccgccgcgtatgagcgcgaggaatcgccggccgccaaggacgccatcgcgcagatcctgatcaattcgcgcatgtgcgccgaaggccaccgcccgatctgccaggacaccggcatcgtcaccgtgttcctggaaatcggcatgaacgtgcgctgggacgacgccacgatgggcgtggaagacatggtcaacgaaggcgtgcgccgcgcctacaaccaccccgacaacaagctgcgcgccagcgttctggccgacccggcgggaaagcgcgccaacaccaaggacaacacgccggcggtggtcaacaccaagatcgtgcccggcgaccatgtcgaggtgatcgtcgcagccaagggcggcggctcggaggccaagagcaagttcgccatgctcaatccctccgactccatcgtcgattgggtgctcaagaccgtgccgaccatgggcgccggctggtgcccgccgggcatgctcggcatcggcatcggcggcaccgccgaaaaggcgatgctgctggccaaggaagccttgatggagccgatcgacatcgtcgacctgcaggcgcgcggcgcgtccaaccgtgccgaagagctgcggcttgagctgtacgaaaaggtcaatgcactgggcatcggcgcgcaaggcctgggcggcctgaccaccgtgctggacatcaaggtcaaggattacccgacccacgcggcgaacctgccggtggcgttgattcccaactgcgcggcgactcgccacgcccacttcaccctggacggcagcggcccggtgatgctggatccgccgtcgctggaagactggcccacgctcacctacaacccgaccaatgcgcgccgggtcaatctggataccatcagcaaggaagaagtggccagcttcaagccgggcgaggtgattctgcttaacggcaagctgctgaccggccgcgatgccgcgcacaagcgcatgatcgacatgctcaaccgtggccaaacgctgccggtggatttcaccaatcgcttcatctactacgtcggtccggtcgacccggtgcgcgatgaagtggtcggcccggcgggcccgacgaccgccacgcgcatggacaagttcacccgccagatgctggagcagaccggcctgctgggcatggtcggtaagtccgagcgtggcgatgcggccatcgatgcgatccgcgacaacaaggccgtgtacctgatggcggtcggcggttcggcctacctggtgtccaaggcgatcaaggcggcccgcgtgcttgcgttcgaagatctcggcatggaggcgatctacgaattcgaggtcaaggacatgccagtcaccgtagcggtggattccactggcgaatcggtgcacaagactggcccacggctgtggcagtcgcgcatcggcaagatcccggtggtggtggaataa

SEQ ID NO: 89876 - protein, 505 aa, Xanthomonas oryzae pv. oryzae KACC10331
MTSIKQEDLIQSVADALQYISYYHPVDYIKNLSAAYEREESPAAKDAIAQILINSRMCAEGHRPICQDTGIVTVFLEIGMNVRWDDATMGVEDMVNEGVRRAYNHPDNKLRASVLADPAGKRANTKDNTPAVVNTKIVPGDHVEVIVAAKGGGSEAKSKFAMLNPSDSIVDWVLKTVPTMGAGWCPPGMLGIGIGGTAEKAMLLAKEALMEPIDIVDLQARGASNRAEELRLELYEKVNALGIGAQGLGGLTTVLDIKVKDYPTHAANLPVALIPNCAATRHAHFTLDGSGPVMLDPPSLEDWPTLTYNPTNARRVNLDTISKEEVASFKPGEVILLNGKLLTGRDAAHKRMIDMLNRGQTLPVDFTNRFIYYVGPVDPVRDEVVGPAGPTTATRMDKFTRQMLEQTGLLGMVGKSERGDAAIDAIRDNKAVYLMAVGGSAYLVSKAIKAARVLAFEDLGMEAIYEFEVKDMPVTVAVDSTGESVHKTGPRLWQSRIGKIPVVVE

SEQ ID NO: 89877 - DNA, 1530 bp, Vibrio fischeri ES114
  CDS (1)..(1530): transl_table=11
atgattaacgttcaccaagaaacattgattcgtaatgaagatgtgatcagttctgtagccgatgctctgcaatatatatcttattatcatccgctagattttgttcaagcacttgaaaaagcgtatcaccgagaagaaagccaagctgcaaaagatgcgcttgcacaaatcctaattaattcacgtatgtcagcagaggggcgtcgtcctatctgtcaagatacgggaattgtaacttgttttgttaatattggtatgaacgttaggtgggaaggagacttaacggttcaacaaatgattgatgaaggtactcgtcaagcttataccaatcctgacaatccattaagggcatccgtattgtctgatccggctggtaaacgtataaacacaaaagataatacgccagcagtggttcatattaatatggttccgggaaacaaagttgagattcaaattgctgcaaaaggtggcggctctgagaataaaactaaaatggtaatgttaaacccatcagatgatattgctgagtgggtagaaaagacgcttccaacaatgggtgcgggttggtgtcctccaggtatgcttggtataggtgttggcggtacggctgagaaagcagctgtattagcaaaagaagcactgatggaacacattgatattcaagaccttattgaacgaggtcctcagaatgcagaagaagaacttcgtcttgatatttttaaccgtgttaataaattaggtatcggagctcaaggtcttggcggacttactactgttgttgatgtaaaaatcaaatcagcaccaacgcacgcagcctctaaacctgtgtgtttaattcctaactgtgctgctactcgtcacgtacattttacccttgatggtacaggtcctgctgatcttcagccgccaaagttagaggaatggcctgatattacgtgggaagcgggagcaaatacacgccgagttaatcttgatgagataacaaaagaagacgttcaagagtggaaaacgggcgaaacgatcttgcttaatggtaaaattctaacaggacgtgacgcggcacataaacgtcttcaaggaatgatcgaaagcggtgaaggtttacctgatggtgttgattttaatggtaaattcatttactacgtaggccctgttgatgctgtaggtgatgaagcggtaggtcctgccggcccaacgacctctactcgcatggataaatttaccgatatgatgttagctacaggcttaacgggcatgataggtaaagcggaacgtggtccagcaaccgtggcatctattaaagaaaataaagcggtatatttaatggctgttggtggcgctgcttacttggttgctaaagcgattaaaaaagcacgtgttgttgcctttgaagatcttggaatggaagctatttatgagtttgaggttgaagatatgccagttactgtggccgttgattcaacaggtgtaaatgcgcatcaaattggtcctgatacatggaaggtaaaaattgctgaaatgagcaattaa

SEQ ID NO: 89878 - protein, 509 aa, Vibrio fischeri ES114
MINVHQETLIRNEDVISSVADALQYISYYHPLDFVQALEKAYHREESQAAKDALAQILINSRMSAEGRRPICQDTGIVTCFVNIGMNVRWEGDLTVQQMIDEGTRQAYTNPDNPLRASVLSDPAGKRINTKDNTPAVVHINMVPGNKVEIQIAAKGGGSENKTKMVMLNPSDDIAEWVEKTLPTMGAGWCPPGMLGIGVGGTAEKAAVLAKEALMEHIDIQDLIERGPQNAEEELRLDIFNRVNKLGIGAQGLGGLTTVVDVKIKSAPTHAASKPVCLIPNCAATRHVHFTLDGTGPADLQPPKLEEWPDITWEAGANTRRVNLDEITKEDVQEWKTGETILLNGKILTGRDAAHKRLQGMIESGEGLPDGVDFNGKFIYYVGPVDAVGDEAVGPAGPTTSTRMDKFTDMMLATGLTGMIGKAERGPATVASIKENKAVYLMAVGGAAYLVAKAIKKARVVAFEDLGMEAIYEFEVEDMPVTVAVDSTGVNAHQIGPDTWKVKIAEMSN

SEQ ID NO: 89879 - DNA, 1593 bp, Xylella fastidiosa Ann-1
  CDS (1)..(1593)
atgtttatcctatggctgatgtattcagggggattacaatggcaacgttttttagtcagccataagggccagccggtgtcattgatcaaacaagaagactttatccagtctatcgctgatgcgctgcaatacatcagttactaccatccggtcgattacatcaagaatctggctttggcgtatgagtgcgagaaatcgcccgccgctaaagatgcaatggcgcagattttgattaactcacgtatgtgtgctgaggggcgccgcccgatttgccaagatacagggattgtcacggtgttccttagcatcgggatggatgtacgttgggatgacgtcacgatggatgtggaagagatggtgaatgagggggttcgccgtgcctatcgtcatccggataacacgctacgtgcgtctgtgcttgctgatcctgccggcaagcgctgcaatacgagggacaatacgccagcagtcgttaacgtcaaggttgtttctgggggccatgttgaagtgattgttgctgccaagggagggggatcggaggccaagagcaaatttgcaatgctaaatccatcggattccatcgttgattgggttctggacactgtgcccaccatgggggctggctggtgcccaccagggatgcttgggattggtatcggtggtacggctgagaaagcgatgctgctcgctaaggaagcgttgatggaaccgattgacatccaggatttgatggtacgcggcccttccaatcgtgctgaagaattacgcttggagctgtacgagaaggtcaatgctttagggatcggtgctcagggggtgggcgggatgacgacggtattagacattaaagtcaaagattatccgacgcatgctgccaatttgccggtagcgatgatccctaattgtgcgtccacacgccatgcgcatttcacattggacggtagcggtcctgttgttctggaaccgccgtcattagaggattggcctaagttgagctatctcccggagtctgcacggcaggtggatttgaatacgatcaccagggatgaggtggcgcagttcaagccaggtgaggtgttgctactcagcggcaaattgttgacgggacgagatgctgcgcataagcgcatcgttgagatgctcaacaagggggagacattaccagttgatttcacgaatcgctttatctactacgtgggtccagtggatcctgtgcgtgatgaagtcgtcggtcctgcgggtccaaccacagcaacgcgtatggataagtttacgcgtcagatgctggagcagggcgggttgctcggtatggtgggcaaggccgagcgtggtcctactgccatcgctgcaatccgtgacaacaaagccgtgtatctgatggcggtgggaggggcggcttatcttgtctccaaggcgatcaaaacgagccggatactggcttttgaagaccttggcatggaggcaatttatgagtttgaagtcaaggagatgcctgtaacagtggcggttgattgcaacggtgagtcgatacatacaactgggccgcgtgagtggcgaagccggatcgggaaaattccggttgttgtggagtag

SEQ ID NO: 89880 - protein, 530 aa, Xylella fastidiosa Ann-1
MFILWLMYSGGLQWQRFLVSHKGQPVSLIKQEDFIQSIADALQYISYYHPVDYIKNLALAYECEKSPAAKDAMAQILINSRMCAEGRRPICQDTGIVTVFLSIGMDVRWDDVTMDVEEMVNEGVRRAYRHPDNTLRASVLADPAGKRCNTRDNTPAVVNVKVVSGGHVEVIVAAKGGGSEAKSKFAMLNPSDSIVDWVLDTVPTMGAGWCPPGMLGIGIGGTAEKAMLLAKEALMEPIDIQDLMVRGPSNRAEELRLELYEKVNALGIGAQGVGGMTTVLDIKVKDYPTHAANLPVAMIPNCASTRHAHFTLDGSGPVVLEPPSLEDWPKLSYLPESARQVDLNTITRDEVAQFKPGEVLLLSGKLLTGRDAAHKRIVEMLNKGETLPVDFTNRFIYYVGPVDPVRDEVVGPAGPTTATRMDKFTRQMLEQGGLLGMVGKAERGPTAIAAIRDNKAVYLMAVGGAAYLVSKAIKTSRILAFEDLGMEAIYEFEVKEMPVTVAVDCNGESIHTTGPREWRSRIGKIPVVVE

SEQ ID NO: 89881 - DNA, 1524 bp, Pseudomonas syringae pv. syringae B728a
  CDS (1)..(1524)
atgaccgtgatcaagcaagacgacctgattcagagcgttgcagacgcactgcagttcatttcctattaccaccccgtggacttcatccaggccatgcacgaggcgtatctgcgtgaagagtcgcctgccgctcgtgactccatcgcccagatcctgatcaactcgcgcatgtgcgcgaccggtcatcgcccgatctgccaggacaccggcatcgtcacggttttcgtgcgcgtggggatggatgttcgctgggacggcgccaccatgggcctggacgacatgatcaacgaaggcgtgcgtcgcgcgtacaacctgcctgaaaacgtgctgcgtgcctcgatccttgccgatccggcaggcgctcgcaaaaacaccaaggacaacaccccggccgtcattcactactccatcgtcccgggtaacaccgtggaagtggacgtcgcggcgaaaggcggcggttcggaaaacaaatcgaagatggcgatgctcaacccgtccgattcgatcgtcgactgggttctgaaaaccgtaccgaccatgggcgcaggctggtgcccgccgggcatgctcggcatcggcatcggcggtacggctgaaaaagccgccgttatggccaaggaagtgttgatggagtccatcgacattcatgaacttaaagcccgcggcccgcagaatcgtatcgaagagatgcgtctggagctgttcgagaaggtcaaccagctgggcattggcgctcagggcctgggcggtctgaccaccgtgctcgacgtcaagatcatggattacccgacccacgccgcgtcgctgccggtgtgcatgatccccaattgcgccgccacccgccacgcgcacttcgtgctcgacggcagcggccctgcttcgctggaggcgccatcgctggacgcctacccggaaatcgtctgggaagccggcccatcggcccgccgcgtcaacctcgatacgctgaccccggaagaagtacaaagctggaaaccgggcgaaaccgttttgctcaatggcaagatgctcaccggccgcgacgcggcgcacaagcgcatggtcgaaatgctcaaccggggtgaaaccctgccggtagacctcaagggtcgcttcatctactacgtcggcccggttgatccggtgcgcgaagaagtcgtcggcccggccggcccgaccacggccacccggatggacaagttcacccggcagatcctcgaccagaccggcctgctgggcatgatcggcaaatccgaacgcggcccgaccgccatcgaagcgatccgtgaccacaaggccgtgtacctgatggccgtcggtggtgctgcctatttggtggctcaggcgatcaagaaatcccgcgtcgtggccttcgccgagctgggcatggaagcgatctacgagttcgaggtcaaggacatgccggtgaccgtggccgtagacagcaacggtgagtccgtacacatcaccggcccgcagatctggcagaagaagatcagcgacagtctggcggtggaagtgcagtaa

SEQ ID NO: 89882 - protein, 507 aa, Pseudomonas syringae pv. syringae B728a
MTVIKQDDLIQSVADALQFISYYHPVDFIQAMHEAYLREESPAARDSIAQILINSRMCATGHRPICQDTGIVTVFVRVGMDVRWDGATMGLDDMINEGVRRAYNLPENVLRASILADPAGARKNTKDNTPAVIHYSIVPGNTVEVDVAAKGGGSENKSKMAMLNPSDSIVDWVLKTVPTMGAGWCPPGMLGIGIGGTAEKAAVMAKEVLMESIDIHELKARGPQNRIEEMRLELFEKVNQLGIGAQGLGGLTTVLDVKIMDYPTHAASLPVCMIPNCAATRHAHFVLDGSGPASLEAPSLDAYPEIVWEAGPSARRVNLDTLTPEEVQSWKPGETVLLNGKMLTGRDAAHKRMVEMLNRGETLPVDLKGRFIYYVGPVDPVREEVVGPAGPTTATRMDKFTRQILDQTGLLGMIGKSERGPTAIEAIRDHKAVYLMAVGGAAYLVAQAIKKSRVVAFAELGMEAIYEFEVKDMPVTVAVDSNGESVHITGPQIWQKKISDSLAVEVQ

SEQ ID NO: 89883 - DNA, 1533 bp, Dechloromonas aromatica RCB
  CDS (1)..(1533)
atgaccgccatcaaacaggaagacctgatccagtccgtcgccgatgccttccagtacatcagctactatcacccgctcgattacatcaaggcgctgggtgaagcctatgatcgcgaggaaagccccgctgcaaaggacgccatcgcccagatcctgaccaattcgcggatgtccgccgaaggccatcgcccgatctgtcaggacactggtatcggcatggttttcatcaaggtcggcatgcaggttacctggccggatgccaccatgagcatccagcagatgatcgacgaaggcgtgcgtcgcgcctacggcaacccggacaatccgctgcgcgcctcggtgctggccgacccggccggtgcccgcaagaacaccaaggacaacaccccggccgtcgtgcatttcgagatcgtccccggccaccatgttgaagtcatctgcgccgccaagggcggcggctcggaagccaagtccaaattcgccatgctcaacccttccgacgacctggtcgactgggtgctcaagaagatcccggaaatgggcgccggttggtgcccgcccggcatcatcggtatcgggatcggcggcacgccggaaaaggccatgctgctggccaaggaatcgatcatggcgccggtcgacatccatgaactgaaggccaaggcggccaccggcaccaagctgacccgtccggaagaattgcgcctcgaactgatggaaaagatcaacgcgctgggcgttggcgcccaaggcctcggcggcctgaccaccgtgctcgacgtcaaggtgctggattacccctgccacgctgccaacctgccggtcgccctggtcccgaactgtgctgcaacccgccactgccatttccacctcgacggctccggcccggccaagctggaagtgccgaagctcgaagactggccggccgtcacgtggacgccggatctcaagtcagccacgcaggtcaacctgaacaccctgaccaaggacgaagtcgcttcctggaagccgggccagaaactgctgctcaacggcaagatgctgactggccgcgatgccgcccacaagcgcattcaggacatgctggccaagggcgagaagctgccggtagatttcaccaaccgcgtcatctactacgtcggcccggtcgatccggtgcgtgacgaagtcgtcggcccggccggcccgaccaccggcacccgcatggacaagttcacccgcatgatgctggaacagaccggcctgatctcgatgatcggcaagtccgaacgcggtccggtcgccatcgaggcgatcaaggacaacaagtcggcctacctgatggctgtcggcggcgctgcctacctggttgccaaggcgatcaagtcggccaaggtcgtcggctttgccgatctgggcatggaagccatctacgagttcgatgtcgagaacatgccggtcacagtggccgtcgattcatcaggcatcagcgtgcacgaaaccggcccgaaggaatggcaggtcaagatcggcaagattccgctcaaggcctga

SEQ ID NO: 89884 - protein, 510 aa, Dechloromonas aromatica RCB
MTAIKQEDLIQSVADAFQYISYYHPLDYIKALGEAYDREESPAAKDAIAQILTNSRMSAEGHRPICQDTGIGMVFIKVGMQVTWPDATMSIQQMIDEGVRRAYGNPDNPLRASVLADPAGARKNTKDNTPAVVHFEIVPGHHVEVICAAKGGGSEAKSKFAMLNPSDDLVDWVLKKIPEMGAGWCPPGIIGIGIGGTPEKAMLLAKESIMAPVDIHELKAKAATGTKLTRPEELRLELMEKINALGVGAQGLGGLTTVLDVKVLDYPCHAANLPVALVPNCAATRHCHFHLDGSGPAKLEVPKLEDWPAVTWTPDLKSATQVNLNTLTKDEVASWKPGQKLLLNGKMLTGRDAAHKRIQDMLAKGEKLPVDFTNRVIYYVGPVDPVRDEVVGPAGPTTGTRMDKFTRMMLEQTGLISMIGKSERGPVAIEAIKDNKSAYLMAVGGAAYLVAKAIKSAKVVGFADLGMEAIYEFDVENMPVTVAVDSSGISVHETGPKEWQVKIGKIPLKA

SEQ ID NO: 89885 - DNA, 1524 bp, Methylobacillus flagellatus KT
  CDS (1)..(1524)
atggccttcatccgccaagaagattttatcgacagcatccaccaggcattgcaatacattgcctgctaccattcgccggacttcctcgctgccatgcacgatgcatggcagcgtgagccgtctccggcagcgcgggatgcgatcggtcaaatcctcatcaactcttatctctgcgcacaaggacaacgcccgctctgccaagacaccgggattgtcgtggccttcgtttccgtcggcatgaacgtgcagtggcaggccagcatgagcctgcaggagatggtggacgaaggtgtacgccgcgcctacctcgacccggacaaccgcctgcgcgcctccatcgtgcgcgaccccgcgggcaagcgcctcaatacccgcgacaacacgccgtctgtcgtacatgtggacatggtgcccggcgatacggtggaaatccatatcgccgccaaaggtggtggatcggaaaacaaatccaaactcgccatgctggaaccttccgacgacctcatcgaatgggtgctgaaaacagtaccggaaatgggtgccggctggtgcccacctggggtactcggcatcggcatcggcggcacggcggaaaaagccgtactgctcgccaagcaatccttgtttgctcccatcgacatccaggcattgagagccaggggacctcagacacgggcagaggagctacgcctggaaatctacgagaaagtcaaccggctcggcatcggcgctcaaggcctgggcggactcacaacggtactggatgtgaagatcctggaggccccgacccatgcgacttcgctaccagtcgccatcattcccaattgcgcagccacacgccatgtgcatttcacattggatggcactgggccagcacgcctgcctgcgccccggctggaagattggccacgagttgcgctggatgccagcacccccatgcgccgggtcgatctcggcaaggtaacacgagaagacgtgatcagctggcagccaggagaaaaactgctgctctcgggcaaactgctcaccgggcgcgatgccgcccataagcgcatcgtcgacctgatcgcccgcggtgagccgatgccggagggcctggacttcaccaaccgcttcatctattacgtcgggccggtcgacccggtaggcgatgaaatcattggcccagcgggccccaccaccgccacacgtatggaccgcttcacggagaccatgctgacccaaaccggcctgctcggcatgataggcaaggccgagcgcggcgaagccaccgtacagtccatcaagcggcatcaatcggtctacctgatcgcgatcggcggcgcagcctacctgatctcgcaggccatcaaggcatctcgtatcgtggcatttgccgacctgggcatggaagccatctacgaattcacggtggaggatatgcccgtgacggtggccgtggatagccgaggccacgctgtgcatgataccggcccggccgagtggcgtcccagaattgctaacatccccattttcagcgaatag

SEQ ID NO: 89886 - protein, 507 aa, Methylobacillus flagellatus KT
MAFIRQEDFIDSIHQALQYIACYHSPDFLAAMHDAWQREPSPAARDAIGQILINSYLCAQGQRPLCQDTGIVVAFVSVGMNVQWQASMSLQEMVDEGVRRAYLDPDNRLRASIVRDPAGKRLNTRDNTPSVVHVDMVPGDTVEIHIAAKGGGSENKSKLAMLEPSDDLIEWVLKTVPEMGAGWCPPGVLGIGIGGTAEKAVLLAKQSLFAPIDIQALRARGPQTRAEELRLEIYEKVNRLGIGAQGLGGLTTVLDVKILEAPTHATSLPVAIIPNCAATRHVHFTLDGTGPARLPAPRLEDWPRVALDASTPMRRVDLGKVTREDVISWQPGEKLLLSGKLLTGRDAAHKRIVDLIARGEPMPEGLDFTNRFIYYVGPVDPVGDEIIGPAGPTTATRMDRFTETMLTQTGLLGMIGKAERGEATVQSIKRHQSVYLIAIGGAAYLISQAIKASRIVAFADLGMEAIYEFTVEDMPVTVAVDSRGHAVHDTGPAEWRPRIANIPIFSE

SEQ ID NO: 89887 - DNA, 1509 bp, Mesorhizobium sp. BNC1
  CDS (1)..(1509)
atgacccgtatttccaacgcagcgatcgtcactaacatcgccgccgcgctgcagtacatctcggtcttccatccgcccgagtacatccgccaccttgcggctgcccacgcacaagaggagagcttgcccgcccgcgccgcaatcgagcagatcctgatcagttcgcgcatggccgcgctcgggcaacgtgccatttgtcaggacaccggcactgtcaacgcgcatatgaaagtgggcatgggggtgcggcttgatggtgattccagccttcagaacctgctcgacgaagcgatccggctagcctgggccgatgaccgcaacccgctgagggcctccatcgtcgccgacccgctgttcgcgcgccgcaatacccgcgacaacaccccgggcatgctgaccgtggaaatcgtgcccggagacggtatcgaaattgccctcatgtcgaagggcggcggctcggagaacaagagccgcttcaccacactcaggccttcagacagcgtcgaggactgggtaatcgatcagcttcccggcttgggcgccggctggtgccctccgggcatgctgggcatcggggtcggcggcagcgccgacatggccatgcggcttgccaaggagagcctttacgatgcgcccaacatggcatggttacgacagaaggcgaaccacaccgaagaggaggccttccgcgtccgcgtctgtgaccgggccaacgcactcggcattggtgcccaggggttgggtgggctgaccgcggtgctcgacgtaaagctacggaccgcgccaacgcatgcctctgcgctgccggtcgcgctgatcccgcaatgcgtggcaacgcgaatggtccgcttccgcatctcggcaaccgagggcttcgatctctcgccgcccgatcctgcgctttggccggagatcaccgcccccgccgttgacggagtccagcggatcaatctcgacaccttgaccgagtccgcgaagcagagttggaaagcaggcgacaccctgcttctgtcgggccgcatcctgactggccgtgatgcagcccacaagcgcctcgacgaaatgctggatcgcggcgatcccctgcccgtcgatttgcgcggccgcgcgatctattatgtcggtccggtcgatcccgctccgggcgagatcatcggcccggcgggacccaccacttccacccgaatggacaaattcactccccgtcttcttgcccaaaccggtctcggactgatgattgggaaggccgagcgtggaccagacgttattgaagcgatcgctcgccacaaggccccgtacctcatcgccgtcggcggcgcagccgttctcatctcccgcgcgatccgcaacgcccgcgtcgtcgccttcgaggacctcggcatggaagccatccacgaattcgaagtccaggacctgcccgtcatcgtcgcagtcgacaccgcgggtacatcgatacacgacacaggacccgcgcagtggcgtagaacgtcaaccagccggtcttcttaa

SEQ ID NO: 89888 - protein, 502 aa, Mesorhizobium sp. BNC1
MTRISNAAIVTNIAAALQYISVFHPPEYIRHLAAAHAQEESLPARAAIEQILISSRMAALGQRAICQDTGTVNAHMKVGMGVRLDGDSSLQNLLDEAIRLAWADDRNPLRASIVADPLFARRNTRDNTPGMLTVEIVPGDGIEIALMSKGGGSENKSRFTTLRPSDSVEDWVIDQLPGLGAGWCPPGMLGIGVGGSADMAMRLAKESLYDAPNMAWLRQKANHTEEEAFRVRVCDRANALGIGAQGLGGLTAVLDVKLRTAPTHASALPVALIPQCVATRMVRFRISATEGFDLSPPDPALWPEITAPAVDGVQRINLDTLTESAKQSWKAGDTLLLSGRILTGRDAAHKRLDEMLDRGDPLPVDLRGRAIYYVGPVDPAPGEIIGPAGPTTSTRMDKFTPRLLAQTGLGLMIGKAERGPDVIEAIARHKAPYLIAVGGAAVLISRAIRNARVVAFEDLGMEAIHEFEVQDLPVIVAVDTAGTSIHDTGPAQWRRTSTSRSS

SEQ ID NO: 89889 - DNA, 1524 bp, Burkholderia cepacia R18194
  CDS (1)..(1524)
atgaccgtcatcaaacaggaagacctgatccagagcatcgcggattcgctgcagtacatcagctactaccatccgctcgactacatccaggccctcggccgcgcgtacgagctggaagaaagcccggccgcgaaggatgcgatcgcgcagatcctcacgaacagccgcatgtgcgcggaaggcaagcgcccgatctgccaggacaccggcatcgtcacgatcttcgtgaaggtcggcatggacgtgcgctgggacggcgcgacgatgggcctgaccgacatgatcaacgaaggcgtgcgccgcggttacacgcacccggacaacgtactgcgcgcgtcgatcgtcaatccgccggaaggcgcccgcaagaacacgaaggacaacacgccggccgtgatccactacgagatcgtgccgggcgacaaggtcgacgtgcaggttgcggcgaagggcggcggctcggagaacaagtcgaagttcgtgatgctgaacccgtccgactcgatcgtcgactgggtgctgaagacggtcccgacgatgggtgcgggctggtgcccgcccggcatgctcgggatcggcatcggcggcaccgctgaaaaggcgatgctgatggcgaaggaatcgctgatggagccgatcgacatccaggaaatcatcgcacgcggtccgaaggactgggtcgaggaactgcgcgtcgaactgcacgagaaggtcaacgcgctcggcatcggcgcacagggcctcggcggcctggcaaccgtgctcgacgtgaagatcatggccgcaccgacgcacgcggcgtcgaagccggtcgcgctgatcccgaactgcgcagcaacgcgccacgcgcacttcgtgctcgacggctcgggcccggccaagcttgaagcaccgtcgctcgacgcgtggccgaaggtcaactgggaaccgaataccgaaaccagcaagcgcgtcgacctgaacacgctgacgccggaggaagttgcaagctgggcgccgggccagacgctgctgctgtcgggcaagatgctcaccggccgcgacgccgcgcacaagcgtatcgccgacatgctcgcgaagggcgagaagctgccggtcgacttcacgaaccgcgtgatctactacgtcggcccggtcgatccggtccgcgacgaagtggtcggcccggcaggcccgacgacggccacgcgcatggacaagttcaccgagacgatgctcgcgcaaaccggcctgatctcgatggtcggcaaggccgagcgcggcccggtcgcgatcgaagcgatcaagaagcacaaggcggcctacctgatggcggtcggcggggcggcttacctcgtgtcgaaggcgatccgcggcgcgaaggtgctcgcattcgaagacctcggcatggaagcgatctacgagttcgacgtgcaggacatgccggtgacggtggctgtcgattcgtcgggcacgtcggtgcaccagaccggtccgaaggagtggcaggcgaagatcggcaagatcccggtcgcagccgcttaa

SEQ ID NO: 89890 - protein, 507 aa, Burkholderia cepacia R18194
MTVIKQEDLIQSIADSLQYISYYHPLDYIQALGRAYELEESPAAKDAIAQILTNSRMCAEGKRPICQDTGIVTIFVKVGMDVRWDGATMGLTDMINEGVRRGYTHPDNVLRASIVNPPEGARKNTKDNTPAVIHYEIVPGDKVDVQVAAKGGGSENKSKFVMLNPSDSIVDWVLKTVPTMGAGWCPPGMLGIGIGGTAEKAMLMAKESLMEPIDIQEIIARGPKDWVEELRVELHEKVNALGIGAQGLGGLATVLDVKIMAAPTHAASKPVALIPNCAATRHAHFVLDGSGPAKLEAPSLDAWPKVNWEPNTETSKRVDLNTLTPEEVASWAPGQTLLLSGKMLTGRDAAHKRIADMLAKGEKLPVDFTNRVIYYVGPVDPVRDEVVGPAGPTTATRMDKFTETMLAQTGLISMVGKAERGPVAIEAIKKHKAAYLMAVGGAAYLVSKAIRGAKVLAFEDLGMEAIYEFDVQDMPVTVAVDSSGTSVHQTGPKEWQAKIGKIPVAAA

SEQ ID NO: 89891 - DNA, 1524 bp, Burkholderia cepacia R1808
  CDS (1)..(1524)
atgaccgtcatcaaacaggaagacctgatccagagcatcgcggattcgctgcagtacatcagctactaccacccgctcgactacatccaggcgctcggccgcgcgtacgagctcgagcagagcccggccgcgaaggacgcgatcgcgcagatcctcacgaacagccgcatgtgcgcggaaggcaagcgcccgatctgccaggacaccggcatcgtgacggtcttcgtgaaggtcggcatggacgtgcgctgggacggcgcgacgatgagcgtcaccgacatgatcaacgaaggcgtgcgccgcggttacacgcacccggacaacgtcctgcgcgcgtcgatcgtcaatccgccggaaggcgcccgcaagaacaccaaggacaacacgccggccgtgatccactacgagatcgtgccgggcgacaaggtcgacgtgcaggtggcggcgaagggcggcggctcggagaacaagtcgaagttcgtgatgctgaacccgtccgattcgatcgtcgactgggtgctgaagacggtcccgacgatgggcgcgggctggtgcccgccgggcatgctcgggatcggcatcggcggcaccgccgaaaaggcgatgctgatggcgaaggaatcgctgatggagccgatcgacatccaggaaatcatcgcgcgcggcccgaaggactggatcgaggaactgcgtgtcgagctgcacgagaaggtcaacgcgctcggcatcggcgcacagggcctcggcggcctggcgaccgtgctcgacgtgaagatcatggccgcgccgacgcacgcggcgtcgaagccggtcgccctgatcccgaactgcgcggcgacgcgccacgcgcacttcgtgctcgacggctcgggcgcggcgaagctcgaagcgccgtcgctcgacgcatggccgaaggtccagtgggaaccgaacaccgagacgagcaagcgcgtcgacctgaacacgctgacgccggaagaagtcgcgagctggacgccgggccagacgctgctgctgtcgggcaagatgctcacgggccgcgacgctgcgcacaagcgcatcgccgacatgctcgcgaagggcgagaagctgccggtcgacttcaccaaccgcgtgatctattacgtcggtccggtcgatccggtgcgtgacgaagtggtcggcccggccggcccgacgacggccacgcggatggacaagttcaccgagatgatgctcgcgcagacgggcctgatctcgatggtcggcaaggcggaacgcggcccggtcgcgatcgacgcgatcaagaagcacaaggccgcgtacctgatggcggtcggcggcgcggcatacctggtgtcgaaggcgatccgcggcgcgaaggtgctcgcattcgaagacctcggcatggaagcgatctacgagttcgacgtgcaggacatgccggtgacggtggcggtcgattcgtcgggcacgtcggtgcaccagaccggtccgaaggaatggcaggcgaagatcggcaagatcccggtcgcaaccgcttaa

SEQ ID NO: 89892 - protein, 507 aa, Burkholderia cepacia R1808
MTVIKQEDLIQSIADSLQYISYYHPLDYIQALGRAYELEQSPAAKDAIAQILTNSRMCAEGKRPICQDTGIVTVFVKVGMDVRWDGATMSVTDMINEGVRRGYTHPDNVLRASIVNPPEGARKNTKDNTPAVIHYEIVPGDKVDVQVAAKGGGSENKSKFVMLNPSDSIVDWVLKTVPTMGAGWCPPGMLGIGIGGTAEKAMLMAKESLMEPIDIQEIIARGPKDWIEELRVELHEKVNALGIGAQGLGGLATVLDVKIMAAPTHAASKPVALIPNCAATRHAHFVLDGSGAAKLEAPSLDAWPKVQWEPNTETSKRVDLNTLTPEEVASWTPGQTLLLSGKMLTGRDAAHKRIADMLAKGEKLPVDFTNRVIYYVGPVDPVRDEVVGPAGPTTATRMDKFTEMMLAQTGLISMVGKAERGPVAIDAIKKHKAAYLMAVGGAAYLVSKAIRGAKVLAFEDLGMEAIYEFDVQDMPVTVAVDSSGTSVHQTGPKEWQAKIGKIPVATA

SEQ ID NO: 89893 - DNA, 1521 bp, Bacillus cereus G9241
  CDS (1)..(1521): transl_table=11
atggaaaagcttcaagaaagcatgtatcaactaattgttgaaacgtcaacgaacttaccgaaagatgttcgtcgtgcgattcaacaagcgaaagagcgagaaaatgcagggactcgttctgcgatggcacttggcacaattacaaataatattaaaatggctgatgataacatctcaccaatttgccaagatacagggatgccaacgtttaaaatttatacaccagttggtgtgaatcaattaaagctgaaggaagctatctatcatgcgcttgagcgggcgacaaaagatggtaaacttcgtccaaattctgttgattctctttttggagacaatagtggaaataatttaggaccaggtacaccggttataaagtttgaacaatgggaaaaagattatattgatgcacgtttaatcttaaaaggtggtggctgtgagaataaaaatattcagtatagcttaccatgcgaattagaaggacttggacgagctggccgtgatttagaagggattcgtaaatgccttcttcatgccgtatatcaagcacaaggtcaaggatgtagtgcaggtgtaattggtgttggtatcgggggagaccgcacatcaggttacgaattagcaaaaaatcaattattccgtacattagatgatgtcaatccaatcccagagttacaacaacttgaagagtacgtattagaaaatgcaaataagcttggcattggtacgatgggatttggcggagaaacaactttacttggctgtaaaattggcgtgtataaccgtctgccagctagcttctacgtatctgtggcgtataactgctgggcatatcgccgccttggtgtaacaatccatcctgaaacaggtgaaattatggattggctatatcaagaaggtgacgatacactgaagcaagaagcacaagaaaaaacagagcaacgtgagattgtattacaagcgccaattacagaagagcaaattcgtgaacttcgcgttggtgatgttgtaacaattaatggcatgatgtatacaggtcgtgacgcaatccataagcatttaatggataacgattgtccagtagatctaaatgggcaaattatttaccactgtggtccagttgttgtgaaagatgaaaatgacaattggcaaattaaagcggcaggtccaacgacaagtattcgtgaagaaccgtaccaaggcgatattatgaagaaattcggcattcgcgctgttattggaaaaggcggtatgggtgcgaaaacattagcagctttagaagaacacggcggtgtatatttaaatgcaattggtggtgcagcacaatattatgctgaatgtattaaagaagtgaaagatgttgatttcttacaatttggtattccagaggcaatgtggcatttacgtatcgatggatttaaagcagttgtaacaatggattctcacggtaatagcttacatgcagatgttgataaaacatcacttgaaaaattagctagctttaaagagccagtatttaagtaa

SEQ ID NO: 89894 - protein, 506 aa, Bacillus cereus G9241
MEKLQESMYQLIVETSTNLPKDVRRAIQQAKERENAGTRSAMALGTITNNIKMADDNISPICQDTGMPTFKIYTPVGVNQLKLKEAIYHALERATKDGKLRPNSVDSLFGDNSGNNLGPGTPVIKFEQWEKDYIDARLILKGGGCENKNIQYSLPCELEGLGRAGRDLEGIRKCLLHAVYQAQGQGCSAGVIGVGIGGDRTSGYELAKNQLFRTLDDVNPIPELQQLEEYVLENANKLGIGTMGFGGETTLLGCKIGVYNRLPASFYVSVAYNCWAYRRLGVTIHPETGEIMDWLYQEGDDTLKQEAQEKTEQREIVLQAPITEEQIRELRVGDVVTINGMMYTGRDAIHKHLMDNDCPVDLNGQIIYHCGPVVVKDENDNWQIKAAGPTTSIREEPYQGDIMKKFGIRAVIGKGGMGAKTLAALEEHGGVYLNAIGGAAQYYAECIKEVKDVDFLQFGIPEAMWHLRIDGFKAVVTMDSHGNSLHADVDKTSLEKLASFKEPVFK

SEQ ID NO: 89895 - DNA, 1524 bp, Rubrivivax gelatinosus PM1
  CDS (1)..(1524)
atgaccacgatccgacacgccgatctcgttgacagcatcgctgccgcgctgcagtacatcagctactaccacccggcagactacatcacgcacctggcgcgtgcctacgaacaggagcagagcccggccgccaaggacgcgatcgcgcagatcctcaccaactccaagatgtgcgccgaaggacgccggccgatctgccaggacaccggcatcgtcaacgtgttcctgaagatcggcatggacgtgcgcttcgagggcttcgccggctcgatcgaggatgccgtcaacgagggcgtgcgtcgcggctacctgaaccccgagaacaccctgcgcgccagcatcgtggccgatccccacttcgagcgcaagaacaccaaggacaacaccccggccgtcgtgcacatgacggtcgtgccgggcaacacggtcgacgtgcaggtggccgccaagggcggcggctccgagaacaagagcaagttcgtgatgctcaaccccagcgacagcctggtcgactgggtattgaaaacggtgccgacgatgggcgccggctggtgcccgccgggcatgctgggcatcggcatcggcggctcggcggagaaggccatgctgatggccaaggagtcgctgatgggcgacatcgacatgtacgagctcaagcagcgcggcccgcagaacaagctggaggagctgcgcatcgagctgtgcgacaagatcaacgccctcggcatcggcgcccagggcctgggcggcctgaccacggtgctcgacgtgaagatctcgaccttcccgacgcacgcggccagcaaacccgtggcaatgatcccgaactgcgccgccacgcgccacgcacacttcgtgctcgacggctccggcccgtcctacctcgagccgccgagcctggacctctggcccgacgtgaaatgggctcccgattacaacaagagcaagtcggtcaatctcgacacgctgacgcgcgaggaggtggcgagctggaagccgggcgacacgctgctgctcaacggcaagatgctcaccggccgcgacgccgcgcacaagcgcatccaggacatgctggccaagggcgagaagctgccggtggacttcaccaaccgcgtcatctactacgtcggcccggtcgatccggtgcgcgacgaggtggtcggcccggctggcccgaccaccgccacgcgcatggacaagttcaccgagatgatgctggcccagaccggcctgatcggcatgatcggcaaggccgagcgcggcccggccggcatcgaggcgatccgcaagcacaagagcgcctacctgatggccgtcggcggcgccgcctacctggtggccaaggcgatcaagcaggccaaggtgctgggcttcgccgaccttggcatggaggcgatctacgagttcgacgtcaaggacatgccggtgacggtggccgtcgactcgaccggcagctcggtgcaccagacgggaccggccgaatggcaggcgaagatcggcaagattccggtcgccatcgcctga

SEQ ID NO: 89896 - protein, 507 aa, Rubrivivax gelatinosus PM1
MTTIRHADLVDSIAAALQYISYYHPADYITHLARAYEQEQSPAAKDAIAQILTNSKMCAEGRRPICQDTGIVNVFLKIGMDVRFEGFAGSIEDAVNEGVRRGYLNPENTLRASIVADPHFERKNTKDNTPAVVHMTVVPGNTVDVQVAAKGGGSENKSKFVMLNPSDSLVDWVLKTVPTMGAGWCPPGMLGIGIGGSAEKAMLMAKESLMGDIDMYELKQRGPQNKLEELRIELCDKINALGIGAQGLGGLTTVLDVKISTFPTHAASKPVAMIPNCAATRHAHFVLDGSGPSYLEPPSLDLWPDVKWAPDYNKSKSVNLDTLTREEVASWKPGDTLLLNGKMLTGRDAAHKRIQDMLAKGEKLPVDFTNRVIYYVGPVDPVRDEVVGPAGPTTATRMDKFTEMMLAQTGLIGMIGKAERGPAGIEAIRKHKSAYLMAVGGAAYLVAKAIKQAKVLGFADLGMEAIYEFDVKDMPVTVAVDSTGSSVHQTGPAEWQAKIGKIPVAIA

SEQ ID NO: 89897 - DNA, 1524 bp, Pseudomonas fluorescens PfO-1
  CDS (1)..(1524)
atgaccgtgatcaagcaagacgacctgattcagagcgttgccgacgccctgcagttcatttcctactaccaccccgtggacttcatccaggcgatgcacgaagcctacctgcgcgaagaatcgccagcggcccgtgactcgatggcgcagatcctgatcaactcgcgcatgtgcgccacgggccaccggccgatctgccaggacaccggcatcgtgaccgtgttcgtgcgtgtgggcatggacgtgcgttgggatggcgcgaccatgagcctggacgacatgatcaacgaaggcgtgcgccgcgcctacaacctgccggaaaacgtcctgcgtgcctcgatcctcgccgacccggcgggcgctcgtaaaaacaccaaggacaacaccccggcggtcatccactactccatcgttccgggtaacaccgtggaagtggacgtagcggccaagggcggcggttccgagaacaagtcgaagatggccatgctcaacccgtccgactcgatcgtcgactgggtactcaagaccgttccgaccatgggcgccggctggtgcccgccgggcatgctgggcatcggcatcggcggtaccgccgagaaagccgctgtcatggccaaggaagtgttgatggaatccatcgacattcacgagctcaaggcccgtggcccgcagaaccgcatcgaagaaatgcgtctggagctgttcgagaaggtcaaccagctgggcatcggcgcccagggcctcggtggcctgaccaccgtcctcgacgtgaagatcatggactacccgacccacgccgcttccttgccggtgtgcatgatcccgaactgcgccgccacccgtcacgcgcacttcgtattggacggctccggcccggcctcgctggaagcgccaccgctggacgcctacccggaaatcgtctgggaagccggcccgtcggcccgtcgcgtcaacctcgacaccctgaccccggaagacgtgcagagctggaagccgggcgaaaccgtcctgctcaatggcaagatgctcaccggtcgcgacgctgcgcacaaacgcatggtcgagatgctgaacaagggtgaaaccctgccggttgatctgaagggccgcttcatctactacgtcggcccggttgatccggtcggtgacgaagtggttggcccggcgggtccgaccaccgccacgcggatggacaagttcacccgtcagatccttgagcagaccggcctgttgggcatgatcggcaagtccgagcgcggcccgaccgccatcgacgcgatcaaggacaacaaggctgtgtacctgatggccgtcggcggtgccgcttacctggtggcgcaagcgatcaagaagtccaaggttctggcgttctccgaactgggcatggaagcgatctacgagttcgaggtcaaggacatgccggtcaccgttgcggtggacagcaaaggtgaatcggtgcacatcaccggtcctgcgatctggcaacagaagatcagcgaaagcctggcggtggaagtgcagtaa

SEQ ID NO: 89898 - protein, 507 aa, Pseudomonas fluorescens PfO-1
MTVIKQDDLIQSVADALQFISYYHPVDFIQAMHEAYLREESPAARDSMAQILINSRMCATGHRPICQDTGIVTVFVRVGMDVRWDGATMSLDDMINEGVRRAYNLPENVLRASILADPAGARKNTKDNTPAVIHYSIVPGNTVEVDVAAKGGGSENKSKMAMLNPSDSIVDWVLKTVPTMGAGWCPPGMLGIGIGGTAEKAAVMAKEVLMESIDIHELKARGPQNRIEEMRLELFEKVNQLGIGAQGLGGLTTVLDVKIMDYPTHAASLPVCMIPNCAATRHAHFVLDGSGPASLEAPPLDAYPEIVWEAGPSARRVNLDTLTPEDVQSWKPGETVLLNGKMLTGRDAAHKRMVEMLNKGETLPVDLKGRFIYYVGPVDPVGDEVVGPAGPTTATRMDKFTRQILEQTGLLGMIGKSERGPTAIDAIKDNKAVYLMAVGGAAYLVAQAIKKSKVLAFSELGMEAIYEFEVKDMPVTVAVDSKGESVHITGPAIWQQKISESLAVEVQ

SEQ ID NO: 89899 - DNA, 1617 bp, Rhodospirillum rubrum
  CDS (1)..(1617)
atgatcgatcgcgctttcgcggacgtctttcccttggcggaggataaaaccctctaccgcgctctcgaagggacggaggggttggtttcggtggagcggttccgcggcgaggagatgctggtcgtcgcccccgaggccctgacccgtctggcgcaagaggccttccgcgacatcgcccatctgctgcgcccggcccatctttcccagctgcgcgccatcatggacgatcccgaggcttcggccaacgaccgcttcgtcgccctggaactgctgaaaaacgccaatatctcggccggcatggtcttgccgatgtgccaggacaccggcacggcgatcattcagggcaagaagggccagcgggtgttttcgggcgacgacgacgccctcgccctgtcggaaggcgtggcccggacctatcagaccctgaacctgcgctattcgcagatggcggcgctgtcggttttcgacgaggtcaataccggcaacaacctgcccgcccagatcgacctctacgccacgccgggcgacgcctataaattcctcttcatggccaaaggcggcggctcggccaataaggtcttcctttaccagcagaccaaggccctgctcaatcccgagagcctcgcccgcttccttgacgcccaggtgcgcacgctgggcaccgccgcctgcccgccctatcacctgtcgatcgccatcggcggcaccagcgccgaggcctgcctgaaggcggtgaaactggccagcgccaagtatctcgatggcctgccgaccaccgggggcaaggatggccacgccttccgcgatctggcgctcgaggccgaggttctggcgatgacccgggccatgggcatcggcgcccagttcggcggcaagtatttctgccacgacgtgcgcgttgtccgcctgccccgccacggcgcgagctgcccggtgggcatcggcgtctcctgctcggccgaccgccagatgctgggcaagatcaccgccgaagggctgttcctcgaacagcttgaaaccaatcccgcccattacctgcccgacgtgcgcaccgagaagctgtcggccgaggtggtcaagatcgacctgtcgcggccgatggcggaaatccgcgcgacgctcagcggctatccgatcaagacccgggtctcgctgtcggggccgatgatcgtcgcccgcgacatcgcccacgccaagctcaaggaacggctggatcgcggcgagggcctgcccgagtacttcaagaacggcgcggtctattacgccggcccggccaagaccccggccaattacgcctcgggctcctttggcccgaccaccgccggccgcatggacgcctatgtcgatctattccaagagaacggcggctcgatggtgatgatcgccaagggcaaccgttccaaggcggtgaccgaggcctgcaagaagcacggcgggttctatctgggctcgatcggcggcgccgccgcccaactggccctcaacagcatccgcaaggtcgaggttctggaatacccggaactgggcatggaagccatctggcgcatcgaggtcgaggattttccggccttcatcatcgtcgatgacaagggcaacgacttcttccagcagctttga

SEQ ID NO: 89900 - protein, 538 aa, Rhodospirillum rubrum
MIDRAFADVFPLAEDKTLYRALEGTEGLVSVERFRGEEMLVVAPEALTRLAQEAFRDIAHLLRPAHLSQLRAIMDDPEASANDRFVALELLKNANISAGMVLPMCQDTGTAIIQGKKGQRVFSGDDDALALSEGVARTYQTLNLRYSQMAALSVFDEVNTGNNLPAQIDLYATPGDAYKFLFMAKGGGSANKVFLYQQTKALLNPESLARFLDAQVRTLGTAACPPYHLSIAIGGTSAEACLKAVKLASAKYLDGLPTTGGKDGHAFRDLALEAEVLAMTRAMGIGAQFGGKYFCHDVRVVRLPRHGASCPVGIGVSCSADRQMLGKITAEGLFLEQLETNPAHYLPDVRTEKLSAEVVKIDLSRPMAEIRATLSGYPIKTRVSLSGPMIVARDIAHAKLKERLDRGEGLPEYFKNGAVYYAGPAKTPANYASGSFGPTTAGRMDAYVDLFQENGGSMVMIAKGNRSKAVTEACKKHGGFYLGSIGGAAAQLALNSIRKVEVLEYPELGMEAIWRIEVEDFPAFIIVDDKGNDFFQQL

SEQ ID NO: 89901 - DNA, 1524 bp, Ralstonia metallidurans CH34
  CDS (1)..(1524)
atgacagtcatcaagcaagaagacctcatccagagcgtcgccgattccctgcagtacatcagctactaccatccgatggactacatcaccagcctgggccgcgcctatgagctggaaaagagtccggccgccaaggatgcgatcgcgcagatcctgaccaacagccgcatgtgcgccgaaggcaagcgcccgctgtgccaggacaccggcatcgtgacggtcttcctgaaggtgggcatgaacgtgcgctgggatggcgccacgatgagcctggaagacatggtcaacgaaggcgtgcgccgcgcgtacaacgacgtggacaacaagctgcgcgccagcgtgctggccgatccggccggcaagcgcaccaatacgaaggacaacaccccggcggtgatcaacatgtcgatcgttccgggcgatacggtggacgtgatcgtcgcagccaagggcggcggttccgaagccaagtcgaagttcgtgatgctcaacccgtctgactcgatcgtcgactgggtgctcaagactgtcccgaccatgggcgccggctggtgcccgccgggcatgctgggcatcggcattggcggcacggctgaaaaggccatgctgctggccaaggaagccctgatggagccgatcgacattcaggacctgctcgcccgcggcccgagcaaccgcgccgaagaactgcgcatcgagctgtacgagaaggtcaacgcactgggcatcggcgcgcagggcctgggcggcctggctaccgtgctcgacgtgaaggtgctggactacccgacccacgcggccaacctgcctgtggccatgatcccgaactgcgcggccacccgccacgcgcacttcacgctggacggcagcggcgtcgccaagctggaagcgccggacctgtcgcaatggccgaaggtcgagtgggcaccgaacaccgaaacgtcgaaaagcgttgacctgaacacgctgacgccggaagaagtcgcctcgtggaagcccggccagacgctgctgctgaacggcaagatgctgaccggccgtgatgccgcgcacaagcgcatcgccgacatgctggccaagggcgagaagctgccgatcgacttcacgaaccgcgtgatctactacgtaggccccgtggatccggtacgtgacgaagtggttggcccggctggccccaccaccgccacccgcatggacaagttcaccgagacgatgctgtcgcagactggcctgatcgcgatgatcggcaaggccgagcgtggccccaccgcaatcgaatcgatccagaagcacaagtcggcctacctgatggccgtgggtggcgctgcctacctcgtgtcgaaggcgatccgtggcgccaaggtcctcgccttcgaagacctcggcatggaagccatctacgagttcgacgtcaaggacatgccggtgacggtggccgtggatagctcgggcacgtccgtccacaagaccggccccgccgagtggcaggccaagatcggcaagattccggtcgcgacggcctaa

SEQ ID NO: 89902 - protein, 507 aa, Ralstonia metallidurans CH34
MTVIKQEDLIQSVADSLQYISYYHPMDYITSLGRAYELEKSPAAKDAIAQILTNSRMCAEGKRPLCQDTGIVTVFLKVGMNVRWDGATMSLEDMVNEGVRRAYNDVDNKLRASVLADPAGKRTNTKDNTPAVINMSIVPGDTVDVIVAAKGGGSEAKSKFVMLNPSDSIVDWVLKTVPTMGAGWCPPGMLGIGIGGTAEKAMLLAKEALMEPIDIQDLLARGPSNRAEELRIELYEKVNALGIGAQGLGGLATVLDVKVLDYPTHAANLPVAMIPNCAATRHAHFTLDGSGVAKLEAPDLSQWPKVEWAPNTETSKSVDLNTLTPEEVASWKPGQTLLLNGKMLTGRDAAHKRIADMLAKGEKLPIDFTNRVIYYVGPVDPVRDEVVGPAGPTTATRMDKFTETMLSQTGLIAMIGKAERGPTAIESIQKHKSAYLMAVGGAAYLVSKAIRGAKVLAFEDLGMEAIYEFDVKDMPVTVAVDSSGTSVHKTGPAEWQAKIGKIPVATA

SEQ ID NO: 89903 - DNA, 1524 bp, Burkholderia fungorum LB400
  CDS (1)..(1524)
atgaccgtcatcaaacaggaagatctgattcagagcattgctgattcgcttcagtacatcagctattaccatccgctcgactacatccaggccttgggccgcgcgtacgaactcgaacagagcccggccgcgaaagacgccatcgcgcagattctcaccaacagccgcatgtgcgccgaaggcaagcgcccgatctgccaggataccggcatcgtcacggtgttcgtgaaagtcggcatggacgtgcgttgggacggcgcgacgatgggtgtcaccgacatgatcaacgaaggtgtgcgccgcggttatctgaacccggacaacgtgctgcgcgcgtcgatcgtgagcccgcccgaaggcggccgcaagaacacgaaggacaacacgccggccgtgatccactacgagatcgtgccgggcaatacggtcgacgtgcaggtcgcggccaagggcggcggctcggaaaacaagtcgaagttcgcgatgctgaacccgtcggattcgatcgtcgactggatcctgaagaccgtgccgaccatgggcgcgggctggtgcccgccgggcatgctcggcatcggcattggcggcaccgccgagaaagcgatggtgatggcgaaggaatcgctgatggatccgatcgacattcaggacgtgatcgcgcgcggcccgaaggactggatcgaagaactgcgcgtggaactgcacgagaaggtcaacgcgctcgggatcggcgcgcagggtctcggcggtctcgccaccgtgctcgacgtgaagatcatggccgcgccgactcacgccgcgtccaagccggttgcgatcatcccgaactgcgcggccacgcgccacgcgcacttcacgctggacggctcgggcgccgccagactcgaggcgccttcgctcgacgcatggccgaaggtgcattggcagccggacacggagaagagcaagcgggtcgatctgaacacgctcacgccggaagaagtcgcggcgtggacgccgggccagacgctgctgctgtcgggcaagatgctgacgggccgcgacgccgctcacaagcgcattgccgacatgctggcaaagggcgaaaagctgccggtcgacttcacgaaccgcgtgatctactacgtcggcccggtcgatccggtgcgcgatgaagccgtcggtcccgcaggcccgaccacggcaacccgcatggacaagttcaccgagatgatgctggcgcaaaccggcctgatttcgatgatcggcaaagccgagcgcggccctgtcgcgatcgaggcgatcaggaagcacaaggccgcttatctgatggccgtgggcggcgcggcgtatctcgtgtcgaaggcgattcgcagcgccaaggttctcgcattcgaagacctcggcatggaagcgatctacgagttcgacgtgcaggacatgccggtcaccgtggccgtcgattcgaacggcacctccgttcaccagaccggcccgaaggaatggcaggccagaatcggcaagattccggtcgcgaccgtttga

SEQ ID NO: 89904 - protein, 507 aa, Burkholderia fungorum LB400
MTVIKQEDLIQSIADSLQYISYYHPLDYIQALGRAYELEQSPAAKDAIAQILTNSRMCAEGKRPICQDTGIVTVFVKVGMDVRWDGATMGVTDMINEGVRRGYLNPDNVLRASIVSPPEGGRKNTKDNTPAVIHYEIVPGNTVDVQVAAKGGGSENKSKFAMLNPSDSIVDWILKTVPTMGAGWCPPGMLGIGIGGTAEKAMVMAKESLMDPIDIQDVIARGPKDWIEELRVELHEKVNALGIGAQGLGGLATVLDVKIMAAPTHAASKPVAIIPNCAATRHAHFTLDGSGAARLEAPSLDAWPKVHWQPDTEKSKRVDLNTLTPEEVAAWTPGQTLLLSGKMLTGRDAAHKRIADMLAKGEKLPVDFTNRVIYYVGPVDPVRDEAVGPAGPTTATRMDKFTEMMLAQTGLISMIGKAERGPVAIEAIRKHKAAYLMAVGGAAYLVSKAIRSAKVLAFEDLGMEAIYEFDVQDMPVTVAVDSNGTSVHQTGPKEWQARIGKIPVATV

SEQ ID NO: 89905 - DNA, 1608 bp, Magnetococcus sp. MC-1
  CDS (1)..(1608)
atggctgaatttcgccacgtagaagtgctcaaccccggtaaagataccacaacttaccgcctgctgagcaaagcttatgtgcagctggaaaaggtgggtgagcgtaatctgctacgggttgatccccaggcgttgaccttgttggctcaagaggccatccgagacgtttcgcacctttttcgcaccagccatttgcagcagctcgcccaaattttaaaggatcctgaggcgtcagacaatgatcgctatgtggccaccgagatgctaaaaaatgccagtgtctcagcgggcatggtgttgccaagctgtcaagatactggaacggccaccatccttgccaaaaaaggggagcaggtttggaccgggggcggtgatcgcgaagcgctctcccgtggggtgttccgtatctaccatgacaccaatttacgttattcgcaggtggccccgatcacgctgtttgacgaaaaaaataccggtaccaatctgcccgcccagattgatattgaggcggtggatggcgagagctacaagtttatgtttgtggtcaagggtgggggtagcgccaataagaccttcctctatcaagagaccaaggcgctgcttaacccagaacgtttccgcagctttattaccgaaaaggtcaaaagtttgggtacctccgcctgcccgccctatcatttggccattgtggtgggggggagctcgccggagatgaacctgaaaacggttaagttggccagtacccgctatctggatggattgcccactcgtggctcgggtttgggtgaagggattcgtgatctggagtgggagcaggaggtccataaaattacccaacagctaggcattggcgcccaatttggcggtaaatattttgcccatgatgtgcggattatccgcctgccccggcatggggcttcgtgtccggtggggattggggtgagctgttcggcggatcggcagatcttgggcaaaattgataaagagggcgtttggcttgaggatctggatcgggatcccgcccgttttctgcccgaaataagcggtacagagctaaccgaagaggtggtgcatctggatcttaaccgctcgatggctgagatccgcgccgagttaacacgctacccgatcaagacccgctttatgcttaccggccccattgtggtggcgcgggacatcgcccatgctaaaatcaatgaacgtctggatgccggtgagggtatgccagagtacctgaaaaatcatattgtttattatgcgggtcctgctaaaacccccgagggctacgcatctggcagctttggccccaccaccgctggccgcatggatagctatgtagaccgattccaaaaagaggggggctcgttggttatgctcgccaagggcaaccgcagcccgcaggtgaccgaggcctgtcgtagcaatgggggcttttacctgggttctattggtggcgttgctgcccagttggcgaaagagtcgatccgcaaggtcgagattatcgactatcccgaactgggtatggaagcggtctaccgcattgaagtcgagaacttccccgcctttattatcgtggatgataaaggcaatgacttttttacgccatga

SEQ ID NO: 89906 - protein, 535 aa, Magnetococcus sp. MC-1
MAEFRHVEVLNPGKDTTTYRLLSKAYVQLEKVGERNLLRVDPQALTLLAQEAIRDVSHLFRTSHLQQLAQILKDPEASDNDRYVATEMLKNASVSAGMVLPSCQDTGTATILAKKGEQVWTGGGDREALSRGVFRIYHDTNLRYSQVAPITLFDEKNTGTNLPAQIDIEAVDGESYKFMFVVKGGGSANKTFLYQETKALLNPERFRSFITEKVKSLGTSACPPYHLAIVVGGSSPEMNLKTVKLASTRYLDGLPTRGSGLGEGIRDLEWEQEVHKITQQLGIGAQFGGKYFAHDVRIIRLPRHGASCPVGIGVSCSADRQILGKIDKEGVWLEDLDRDPARFLPEISGTELTEEVVHLDLNRSMAEIRAELTRYPIKTRFMLTGPIVVARDIAHAKINERLDAGEGMPEYLKNHIVYYAGPAKTPEGYASGSFGPTTAGRMDSYVDRFQKEGGSLVMLAKGNRSPQVTEACRSNGGFYLGSIGGVAAQLAKESIRKVEIIDYPELGMEAVYRIEVENFPAFIIVDDKGNDFFTP

SEQ ID NO: 89907 - DNA, 1626 bp, Geobacter metallireducens GS-15
  CDS (1)..(1626)
atgtccaccaagccgttcgtttaccaggaacccttccccctcgagaaagatgagacgtcgtactacaagattcccgactcggagaagtatgtcagcgtcgcaactttcgaagggaaagaggtcctcaaggtcgatcccgaggcactcaccgtcctggccaacacggccatgagggacgtctccttcctgctccgccccgagcacaacgagtcggtggccaagatcctccgggatccggaagcctcccagaacgacaagggggttgccctggcattcctgcggaacgccgagatcgccgccaacttcgagctccccctctgccaggacaccggcaccgccaccgtcgtggccaagaaagggcagcaggtttggaccggcggaaaggacgaggagtttctctccaagggggtctacaagacctacaccgaggaaaatctccgctactcccagaccgtggccctggacatgtacaaggaagtcaacaccggcaccaacctgccggcccagatcgacatccaggctgtggacggcgattactacaagttcctcttcatggccaaaggggggggctccgccaacaagaccatgctctaccaggagaccaaggcactccttaccccggacagcctgctcaagttcctggtgggcaagatgaagtacctgggaaccgccgcctgcccgccgtaccacatcgccgtcgtggtcggcggtacctcggccgacgcctgcatgaaggcggtcaagctcgcctccgccaagtaccttgacgccctccccaccacggggaacgagcacggccgggccttccgcgacgtggaactggaggagaagcttctccaagaggcctacaagctcggcatcggcgcccagttcggcggcaagtacttcgcccatgacgtacgggtcatccggcttccccgccacggcgcctcctgccccgtggggatggcggtctcctgttccgccgaccgcaacatcaaggccaagatcacccaaaacggcctcttcgtcgaggaactggaccgcaatccgagccgactcattcccgagcagtaccgcggcaagcatgagcacggggtcaagatcgacctgaaccgccccatgaaggagatcctggccgaactgagcaagcacccggtttccacgccgctgctgctgaatggcaccatcgtggtggggcgcgacatcgcccacgccaagttcaaagagattctcgacagcggcaaaccgctccccgactatctcaagaatcatccgatctactacgccggaccggccaagaccccggctggcaagccttccggctccttcggccccaccactgccggccgcatggactcctacgtggatcttctccaggcgaacggcggctccatgatcatgatcgccaaggggaaccggagccagcaggtgaccgatgcctgcaagaagcacggcggcttctacctgggctccatcggcggccctgccgcggtcctggccgaggagaacatcaagaaggtcgagtgcatcgacttccccgaactggggatggaagcggtctggaagatcgaggtcgagaacttcccggccttcatcctggtggatgacaaggggaatgacttcttcaagcagttgggtctgtag

SEQ ID NO: 89908 - protein, 541 aa, Geobacter metallireducens GS-15
MSTKPFVYQEPFPLEKDETSYYKIPDSEKYVSVATFEGKEVLKVDPEALTVLANTAMRDVSFLLRPEHNESVAKILRDPEASQNDKGVALAFLRNAEIAANFELPLCQDTGTATVVAKKGQQVWTGGKDEEFLSKGVYKTYTEENLRYSQTVALDMYKEVNTGTNLPAQIDIQAVDGDYYKFLFMAKGGGSANKTMLYQETKALLTPDSLLKFLVGKMKYLGTAACPPYHIAVVVGGTSADACMKAVKLASAKYLDALPTTGNEHGRAFRDVELEEKLLQEAYKLGIGAQFGGKYFAHDVRVIRLPRHGASCPVGMAVSCSADRNIKAKITQNGLFVEELDRNPSRLIPEQYRGKHEHGVKIDLNRPMKEILAELSKHPVSTPLLLNGTIVVGRDIAHAKFKEILDSGKPLPDYLKNHPIYYAGPAKTPAGKPSGSFGPTTAGRMDSYVDLLQANGGSMIMIAKGNRSQQVTDACKKHGGFYLGSIGGPAAVLAEENIKKVECIDFPELGMEAVWKIEVENFPAFILVDDKGNDFFKQLGL

SEQ ID NO: 89909 - DNA, 1524 bp, Novosphingobium aromaticivorans DSM 12444
  CDS (1)..(1524)
atggcggaaatggtgacgatcaaggaagcggacctgatcgaaagcgttgcggatgcgcttcaatacatcagctatttccacccgatggactacatccgcgcgctgggtgaggcctacaaggccgagcaggggccagcggccaaggacgccatcgcccagatcctcaccaacagccgcatgtgcgccgaagggcatcgcccgatctgccaggacaccggcatcgtcaacgtcttcatcgagtggggccaggactgccgcctcgaaagcgacctttcgttgcaggatgtggtcgatgagggcgtgcgccgtgcctacaacaatcccgacaacaagctgcgcgcgtcggttcttgccgatcccgcattcacccgccgcaacacccgcgacaacacgccctgtgtgctgcacgtggaaatggtcaagggcaacaaggtgacggtcgatgttgccgccaagggaggcgggtcggagaacaagtcgaagttcaagatgatgaaccccagcgattcgatcgtcgactgggtgatcgagatgctgccccagatgggcgccggctggtgcccgccgggcatgctcggcattggcatcggcggcaccgcggaacactgcgtgctgctcgccaagaaggcgctgatggagccgatcgatatggcccagctcaagcagcgcgggccgcagaccgacatcgaacgcctgcgcatcgagatcttcgacaaggtcaacgcgcttggcatcggcgcgcaggggctgggcgggctttccaccatcctcgacgtcaagatcatggacgcgccgtgccatgccgccggcaagccggtggcgatgatccccaattgcgcggcaacccgccatgcgcacttcacgctcgacgggtcggggccgaccttcctcgagcgacccaagctcgatgaatggccggaagtgcactgggcgccggactcggcggcaaggcgcgtcgatctcgatacgctgacgcaggaagaggtgcagagctggaaggcgggcgaccgcctgctcctgaacggcaagatgctgacgggccgcgatgccgcgcacaagcggatcaaggacatgctcgccaagggcgaggaactgcccgtcgatttcaagggccgcgtgatctactacgtcggcccggtcgatccggtgcgcgacgaagtcgtcggcccggccggccccaccacggccacccgcatggacagcttctccgacaccatgctcgacctcggcctgctcgccagcgtcggcaaggccgagcgtggccctgccgcgacccagtccatcgccaaccacaagagcgcctatctgatggcggtgggcggagcggcctatcttgtcgcccgcgcgatcaaggaggcgaaggtcgtcggcttcgaggacctcggcatggaggcgatctacgaattcaccgtcgaggacatgccggtgaccgtggccgtcgattccgggggccagaacgttcaccagctcgcgccgctggtgtggaagaagaagatcgccgaggaacacctccttccggcctga

SEQ ID NO: 89910 - protein, 507 aa, Novosphingobium aromaticivorans DSM 12444
MAEMVTIKEADLIESVADALQYISYFHPMDYIRALGEAYKAEQGPAAKDAIAQILTNSRMCAEGHRPICQDTGIVNVFIEWGQDCRLESDLSLQDVVDEGVRRAYNNPDNKLRASVLADPAFTRRNTRDNTPCVLHVEMVKGNKVTVDVAAKGGGSENKSKFKMMNPSDSIVDWVIEMLPQMGAGWCPPGMLGIGIGGTAEHCVLLAKKALMEPIDMAQLKQRGPQTDIERLRIEIFDKVNALGIGAQGLGGLSTILDVKIMDAPCHAAGKPVAMIPNCAATRHAHFTLDGSGPTFLERPKLDEWPEVHWAPDSAARRVDLDTLTQEEVQSWKAGDRLLLNGKMLTGRDAAHKRIKDMLAKGEELPVDFKGRVIYYVGPVDPVRDEVVGPAGPTTATRMDSFSDTMLDLGLLASVGKAERGPAATQSIANHKSAYLMAVGGAAYLVARAIKEAKVVGFEDLGMEAIYEFTVEDMPVTVAVDSGGQNVHQLAPLVWKKKIAEEHLLPA

SEQ ID NO: 89911 - DNA, 1605 bp, Cytophaga hutchinsonii
  CDS (1)..(1605)
atgcctgaatttaattatcaaaaagcgtttcctctaaagaaagaccctacgccgtataaattgatcagtacggattatgtttcaaccattgaagttgatggccgtaaaattcttaaaattgatcccaaagcactggaattagtggcggagaaagcattggctgatgtatcattttatctgcgctcctcgcatttagaaaaacttgcaaaaattattaaagatccggaagcaacggataacgatcgtttcgtagcatataccttattgcagaatgcatctactgccggtgaaggtaagctcccttcctgccaggatacaggtactgccattgtaatggggaaaaaaggtgaaaacgtttggacaggtgctaatgatgaagaagctttgtcaaaaggaatttacaatacatatcaggaaaaaaatctgcgttactctcaggtagtgccgatcacgatgttcgaagaaaaaaattccggcacaaacctgcctgctcagattgacatttatgccgaacagggaaacgaatataagtttttgtttatggcaaagggcggaggctctgcaaacaaaacatatttgtatcagcaaacgaaagcgttactgaatgaaaacagtttagccgagtttgttaaaaataaaatcaaagacctgggtacgtctgcctgccctccatatcacctggcattagtgattggcggtacatcggccgaagcgaacctgaaagctgttaaattggcatcagcaggttattacgatgaacttccaacagaaggtaacatgggcggacaggcattccgtgatcttgaatgggaagagaaagtacaattgatctgccaggagagtttgatcggtgcgcagtttggcggtaaatattttacacacgatgtaaaagtgatccgtttaccacgtcacgcggcgtcttgtccggttggtattggtgtaagctgttctgctgatcgaaacatcaaagcaaaaattacggaagaaggtattttcatcgaagcattggagaccaatccggagaaatttttaccggcacaggcgccacatctggaaaaggctgtagaagttgatctgaatcagccgatggcagatgtattgaaactgctttctcagtatccgattaaaacccgtttgaaattaaaaggcacattaatcgttgcgcgtgatattgcacacgcgaagatcaaagaattgcttgatgcaggaaaaccaatgccggagtatttcaaaaatcatccggtatattatgccggcccggcgaaaacaccggaaggtatgccatccggaagctttggtccgacaacagccggccgtatggattcctatgtgaatttattccagagccagggcggctccatgatcatgcttgcaaaaggaaaccgttctaaagcagtaacagatgcatgcaaagaattcggtgggttctatctgggctctatcggcggaccagcagcgatattagcaaaagaaaatattaaatcggttgaagtagttgacttcgaagagttgggtatggaagccgtacgtaagattgaagtcgttgattttccggctttcattatttgcgatgataagggaaatgacttcttcgcgaatctgtaa

SEQ ID NO: 89912 - protein, 534 aa, Cytophaga hutchinsonii
MPEFNYQKAFPLKKDPTPYKLISTDYVSTIEVDGRKILKIDPKALELVAEKALADVSFYLRSSHLEKLAKIIKDPEATDNDRFVAYTLLQNASTAGEGKLPSCQDTGTAIVMGKKGENVWTGANDEEALSKGIYNTYQEKNLRYSQVVPITMFEEKNSGTNLPAQIDIYAEQGNEYKFLFMAKGGGSANKTYLYQQTKALLNENSLAEFVKNKIKDLGTSACPPYHLALVIGGTSAEANLKAVKLASAGYYDELPTEGNMGGQAFRDLEWEEKVQLICQESLIGAQFGGKYFTHDVKVIRLPRHAASCPVGIGVSCSADRNIKAKITEEGIFIEALETNPEKFLPAQAPHLEKAVEVDLNQPMADVLKLLSQYPIKTRLKLKGTLIVARDIAHAKIKELLDAGKPMPEYFKNHPVYYAGPAKTPEGMPSGSFGPTTAGRMDSYVNLFQSQGGSMIMLAKGNRSKAVTDACKEFGGFYLGSIGGPAAILAKENIKSVEVVDFEELGMEAVRKIEVVDFPAFIICDDKGNDFFANL

SEQ ID NO: 89913 - DNA, 1554 bp, Polaromonas sp. JS666
  CDS (1)..(1554)
atgacgaccatcatcaaacaagccgacctgattgaatccgttgccgccgccctgcagtacatcagctactaccaccccaccgactacatcgcccatctggcccgtgcctacgagcgcgagcaaagcccggcggccaaggatgccattgcgcaaatcctgaccaacagcaagatgagcgccacgggccagcggccaatctgccaggacaccggcatcgtcaacgtgtttttgaaggtcggcatggacgtgcgctgggaaggctttaccggcagcatcgacgacgccatcaacgaaggcgtgcgccgcggctacaaccaccccgacaacacgctgcgcgcctccgtggtggccgatccgcagttcgaccgcaagaacaccaaggacaatacgcccgccgtgatctttacagagctggtgaccggcaacacggttgaagtcacggtggcagccaaaggcggcggcagtgaaaacaagagcaagatggtgatgctcaaccccggcgactcggtggtcgactgggtgctcaaaaccgtgcccaccatgggcgccggctggtgcccgcccggcatgctgggcatcggcattggcggcaccgctgaaaaagccgtgctgatggccaaggaaagcctgatggacgacctggacatgtacgagctgcaggccaagtcgtctgcgggtgccaaactgaccaaaaccgaagagctgcgcctcgaactgttcgagaaagtcaacgcgctcggcattggcgcgcagggcctgggtggtctcaccaccgtgctcgacatcaagatcaagatgtacccgacgcacgcggccagcaagcctgtcgccatgatcccgaactgcgcggccacgcgccatgcacactttgtgctcgacggcaacggcccggtctacctggacccgccttcgctggacctctggcccaatgtgaactgggagcccgactacaacaagagcaaaaaggtcaacctcaacaccctgaccaaggcagaagtcgccagctggaagcccggcgacaccctgctgctcaatggcaagatgctgaccggtcgcgacgccgcgcacaaacgcattgccgacatgctgctcaagggtgaaaagctgccggtcgacttcaccaaccgcgtgatctactacgtcggcccggtggacccggtcaagggcgaggccgttggcccggccggcccaaccaccgcgacccgcatggacggcttcaccgaaatgatgctggcgcaaaccggcttgatctcgatggtgggcaaggccgagcgcggccccgtcgcgattgaggccatcaagaagcaccagagcgcttacctgatggccgtgggcggcgccgcctacctggtatccaaagccatcaagcacgccgaagtggtgggctttgccgacctgggcatggaagccatttacgagttcgacgtggtggacatgccggtgacggtggcggtggatgccggcggcaccagcgcgcacatcaccggcccggccgagtggcagaaaaaaattgccacgggcgagttcaagcaaatcccggtcaccagcgcttga

SEQ ID NO: 89914 - protein, 517 aa, Polaromonas sp. JS666
MTTIIKQADLIESVAAALQYISYYHPTDYIAHLARAYEREQSPAAKDAIAQILTNSKMSATGQRPICQDTGIVNVFLKVGMDVRWEGFTGSIDDAINEGVRRGYNHPDNTLRASVVADPQFDRKNTKDNTPAVIFTELVTGNTVEVTVAAKGGGSENKSKMVMLNPGDSVVDWVLKTVPTMGAGWCPPGMLGIGIGGTAEKAVLMAKESLMDDLDMYELQAKSSAGAKLTKTEELRLELFEKVNALGIGAQGLGGLTTVLDIKIKMYPTHAASKPVAMIPNCAATRHAHFVLDGNGPVYLDPPSLDLWPNVNWEPDYNKSKKVNLNTLTKAEVASWKPGDTLLLNGKMLTGRDAAHKRIADMLLKGEKLPVDFTNRVIYYVGPVDPVKGEAVGPAGPTTATRMDGFTEMMLAQTGLISMVGKAERGPVAIEAIKKHQSAYLMAVGGAAYLVSKAIKHAEVVGFADLGMEAIYEFDVVDMPVTVAVDAGGTSAHITGPAEWQKKIATGEFKQIPVTSA

SEQ ID NO: 89915 - DNA, 1698 bp, Schistosoma japonicum
  CDS (1)..(1698)
atgttggctcaaggtatatttgcgcacatctgctgtcggcttttacggcggaatttgggatcacaggcggtgaaaccttttttttatcaagatatattgcagttggataaacctccgtatgcagagacaccatttcgaaagctaacgggtgatttcgtttctctcaaaaaaattgatgacaaagaaattttgaaaattgattctaaggcactgattttgttgagtcagcaagccatgatagatgtcgctcatcttttaagacctgcacacctacaatctctttctaacatcctgagggatcctgaagcatctaacaacgataagtttgttgcacttgagcttttgaaaaatgcaaatgtggctgctggaatggttctacctggttgtcaggatactggcaccgctatatgcatggcgaaaaagggccagtttgtctggacagatgggaatgacgctgaagctatctcgcaaggtatatataacacatatacttctagttatcttcgttactcccaagttgcggcacttgatatgtttacggaaaaaaatactggtactaacctgccagcacaaattgaaatatattcaactggtggtaacgaatatagctttttgtttattgctaagggtggagggtcagcgaataaaactttcctgtatcaacagacaaaagctcttctcaatcccactagtctatattcatttgttaatgaaaaaattaaaaccttaggaactgcagcttgtcccccttatcacttggctgttgtcgttggtgggacgtcagctgaatttactctgaaaactgtgaagcttgcatcatgcaagtatttggatcaccttccatcgactggtaatgaacatggaagagcttttcgtgaccgggaagctgaagaaaaaatattacatttaactcagaaggttgggatcggagcacagttcggaggaaaatacttctgtcatgatgtacgagtaatccgcttgcctaggcatggtgcatcatgtcctgttggtattggtgtctcttgttctgcagacagacagattctggggagaataactaacgatggagtttttcttgaacagttagagactgatccatctcaatatttacctgacccttctttaaatcaactcccaacagatgttgtcaaagtgaatctcaatcttccaatgaaagaaattctagctgaactttctaagtatccaatcaaaactcgtttgtcactgactggaactttagtcgttgcacgtgatatcgcacatgcaaagattaaggaacgtcttgattctggtcaaccaatgcctgactatttttgtaatcacccggtatattacgctggcccagctaaaacacctatgaattatgctagtggatcttttggacctaccacggctggtcgcatggattcttatgttggtcaattccagcaggctgggggtagtttgattatgctagctaaaggtaacagatcaaaagctgtaacaaatgcttgcagaaaacatggtggattctatctaggttcgatcggcggtccagctgcaatccttgctcagaattgtataaagaaagttgaagtactcgagtatccggaattaggaatggaggctatctggcgtgttgaagttgaggattttcctgcttttatagttgtcgatgataaaggcaatgacttctttaaggaatggcaagtagaataa

SEQ ID NO: 89916 - protein, 565 aa, Schistosoma japonicum
MLAQGIFAHICCRLLRRNLGSQAVKPFFYQDILQLDKPPYAETPFRKLTGDFVSLKKIDDKEILKIDSKALILLSQQAMIDVAHLLRPAHLQSLSNILRDPEASNNDKFVALELLKNANVAAGMVLPGCQDTGTAICMAKKGQFVWTDGNDAEAISQGIYNTYTSSYLRYSQVAALDMFTEKNTGTNLPAQIEIYSTGGNEYSFLFIAKGGGSANKTFLYQQTKALLNPTSLYSFVNEKIKTLGTAACPPYHLAVVVGGTSAEFTLKTVKLASCKYLDHLPSTGNEHGRAFRDREAEEKILHLTQKVGIGAQFGGKYFCHDVRVIRLPRHGASCPVGIGVSCSADRQILGRITNDGVFLEQLETDPSQYLPDPSLNQLPTDVVKVNLNLPMKEILAELSKYPIKTRLSLTGTLVVARDIAHAKIKERLDSGQPMPDYFCNHPVYYAGPAKTPMNYASGSFGPTTAGRMDSYVGQFQQAGGSLIMLAKGNRSKAVTNACRKHGGFYLGSIGGPAAILAQNCIKKVEVLEYPELGMEAIWRVEVEDFPAFIVVDDKGNDFFKEWQVE

SEQ ID NO: 89917 - DNA, 1545 bp, Rhizobium loti
  CDS (1)..(1545): transl_table=11
gtgggcagtagaacacggaccatcgccggcaaggacatcataaggagcgtggccgacgcccttcagtacatctcgtactaccatcctccagattacatccgctctctttcgcaagcgtacgcgcgcgaacagagcccagcggcaaaaaacgcaatagggcagattctgctgaactcccgcatggcggccttcgggcggcggccgatctgccaggacaccggccttgtggtggtcttcgcaaaagtcggcatggacgcccggatcaaatcaacggccagtttcgcagagctcgtgaatgaaggcgtccgtcaggcctatctcgacccggacaacccccttcgggcatcgatcgttgccgatccgctcgccggacgagtcaatactcgtgacaacacgccggcggtcgtccacgtcgaccttgtactaggtaaccagattgacatcaccattgccgcaaaaggcggcgggtcagagaacaaggcacgttttaccaccttgaaccccagcgcctccgtttccgactgggtggttgacacagtcgcgacgcttggcagtgggtggtgtccacccggcctgatctcgattggcatcggtggcagcgctgaaaaggcgatgctgctggccaaggaggccatgaaccagcccatcgatatggcggaattgattgccaggcggccttcaagcgcggaagaggcactgcggattgaactttatgaccggattaacgcactgggcatcggcgcccaaggccttggtggcctgacgacagtcgtcgacgtcaaggttgcgacctatcctactcatgccgcgtccaagcccgtggcgctcattccgcaatgcgccgccaaccggcacctgaagtttaccttggatggctctggaccaatcatgctggagccgcccgatttgcgcgaatggcccgacattggaacggacgaattgagtccagccggcgtacgaagagtgaacctcgatgcgctgaccaaggaacagacggcgtcgtggcgttgcggggaaacgctccttttgtccggaaaaatgctgacgggccgtgacgccgcccacaagcgaatggtcgagttgatcgacgccggcaagccgcttccgttcgatctgcaggggcgcgtaatctactacgttggacccgtccgcgccgtgagagatgaggtcgtcggaccggccggcccaacaacgtccagccgcttggacgattttacggacaaggtgctcgccgaaaccgggcttttcgcgatggtaggcaaagcggagagaggacgggcggccatcgagtcgattgtaaggcacaaaacgccgtatctcatcgcagtgggtggggctgcctacctgatatcaaaatcaatcaagtcagcgcggctcattgccttcgaagacctgggcatggaagcagtctatgaattcgaggtgcaggatatgcctgtcatcatggctgtcgatgttgagggaaactcaattcacaattctgggcctcttgagtggcgcaagcgcatggcggcggacagcatcgcacgcaacatcggcgtttga

SEQ ID NO: 89918 - protein, 514 aa, Rhizobium loti
MGSRTRTIAGKDIIRSVADALQYISYYHPPDYIRSLSQAYAREQSPAAKNAIGQILLNSRMAAFGRRPICQDTGLVVVFAKVGMDARIKSTASFAELVNEGVRQAYLDPDNPLRASIVADPLAGRVNTRDNTPAVVHVDLVLGNQIDITIAAKGGGSENKARFTTLNPSASVSDWVVDTVATLGSGWCPPGLISIGIGGSAEKAMLLAKEAMNQPIDMAELIARRPSSAEEALRIELYDRINALGIGAQGLGGLTTVVDVKVATYPTHAASKPVALIPQCAANRHLKFTLDGSGPIMLEPPDLREWPDIGTDELSPAGVRRVNLDALTKEQTASWRCGETLLLSGKMLTGRDAAHKRMVELIDAGKPLPFDLQGRVIYYVGPVRAVRDEVVGPAGPTTSSRLDDFTDKVLAETGLFAMVGKAERGRAAIESIVRHKTPYLIAVGGAAYLISKSIKSARLIAFEDLGMEAVYEFEVQDMPVIMAVDVEGNSIHNSGPLEWRKRMAADSIARNIGV

SEQ ID NO: 89919 - DNA, 1545 bp, Bacillus stearothermophilus
  CDS (1)..(1545): transl_table=11
atggaaaaattatatgagagtatgtatcaattaattgtggaaacgtctacaaaattgccgaaggatgtccgccgcgctattttgaaggcgaagcagcgtgaaaatgctggtacaagagctgcgatgtcgcttgccacgataaccgaaaatattaaaatggcagatgaaaatgtatcgccgatctgccaagataccggattgccgacatttaaaattaaagtgccagtcggtatcaatcaaattcaaataaaggaaacaataaaaaaagcgatcgctcaagcgacgaaggacgggaagcttcgcccgaactcggtcgattcactcactggagaaaattccggcgataacttgggcgaagggcttccagtcgtaaaatttgaacaatgggaaaaagattatatggatgttcgcttaatattaaaaggcggcggctgcgaaaacaaaaatattcaatacagcctgccgtgcgaactagaaggattgggaagagccggcagagatttggatggaatccgcaaatgtattttgcatgcggtatatcaagcacagggccaaggatgcagcgcaggattcattggagttggaatcggtggagaccgttcagcggggtacgatttagcgaaagaacaattattccgcgaagtcgatgacgtaaatccgaacgaagaattgcggcaattggaagaatatattatggaaaatgcaaacaagcttggcattggaacgatgggatttggcggggaaaccactttattaggctgcaaagtcggcgcaatgcacagaattcctgcgagcttttttgtttctgtcgcatacaactgctgggcattccgccgtttaggtgtgcatatcgatccaaatacgggtgaaatcataaaatggctttatcaagatggagaagatgttgattttcaagaaaatgctgcacaagaagaacatttagcatcaacggactctgaaagacgtgtcatcacgctgcaagcgccaattacagaagaacaaatccgcgagctgaaagtcggcgacgttgttcgcatcaacggaatcatttacacaggaagggatgccatccataaatatttaatggatcatgatgcgccggttgatttaaacggtcaaattatttaccactgcggacctgtcatgttaaaagatgaaaacggcaattgggaagtgaaagcggccgggccgaccacttccattcgcgaagagccttatcaaggggatattatgaaaaaatttggcatccgtgcggtaatgggcaaaggcggcatggggcaaaaaacgctgcaagctttaaaagagcatggcggagtatacttgaatgcgattggcggtgctgctcaatattatgcggattgcatcgaagcggttgaaggtgttgacttgctggagtttggaattccagaagctatgtggcatttgcgcgtaaaagacttcacggccgttgtcacaatggattcacacggcaacagcctgcatgaagacattgaaaaatcgtcattagaaaagctttctcaatttaaagagccggtatttagctaa

SEQ ID NO: 89920 - protein, 514 aa, Bacillus stearothermophilus
MEKLYESMYQLIVETSTKLPKDVRRAILKAKQRENAGTRAAMSLATITENIKMADENVSPICQDTGLPTFKIKVPVGINQIQIKETIKKAIAQATKDGKLRPNSVDSLTGENSGDNLGEGLPVVKFEQWEKDYMDVRLILKGGGCENKNIQYSLPCELEGLGRAGRDLDGIRKCILHAVYQAQGQGCSAGFIGVGIGGDRSAGYDLAKEQLFREVDDVNPNEELRQLEEYIMENANKLGIGTMGFGGETTLLGCKVGAMHRIPASFFVSVAYNCWAFRRLGVHIDPNTGEIIKWLYQDGEDVDFQENAAQEEHLASTDSERRVITLQAPITEEQIRELKVGDVVRINGIIYTGRDAIHKYLMDHDAPVDLNGQIIYHCGPVMLKDENGNWEVKAAGPTTSIREEPYQGDIMKKFGIRAVMGKGGMGQKTLQALKEHGGVYLNAIGGAAQYYADCIEAVEGVDLLEFGIPEAMWHLRVKDFTAVVTMDSHGNSLHEDIEKSSLEKLSQFKEPVFS

SEQ ID NO: 89921 - DNA, 25 bp, Primer
atgtcaaacaaaccctttatctacc

SEQ ID NO: 89922 - DNA, 22 bp, Primer
ttacttagtgcagttcgcgcac

SEQ ID NO: 89923 - protein, 520 aa, consensus
  MISC_FEATURE (1)..(520): consensus for the disclosure of xaa see table XV
LXXXXXXXXXDXXXXXXXAXXXXXXXXXXXXXXXXXXXXXXXXXLXNXXXXAXXXXPXCQDTGXXXXXXXXGXXVXXXXXXXXXXXXXXXXXXXGXXXXYXXXXXXXXXXXXXXXXXXXXNTXXNXPAXXXXXXXXGXXXXXXXXXXXXAKGGGSXNKXXXXXXXXXXXXXXXXXXXXXXXXXXXXXXXXXXGXXXCPPXXXXXXIGGXXXXXXXXXXXXXXXXXXXXXXXXXXXXXXXXXXXXXLXXXXXXXXXXLGIGAQXXGGXXXXXDXXXXXXPXHXASXPVXXXXXCXAXRXXXXXXXXXGXXXXXXXLXXXXXXXXPXXXXXXXXXXXXXXXXXXXXXLXXXXXXXXXXXXXXXXXXXXXLXGXXXXGRDXAHXXXXXXXXXXXXXXXXXXXXXXXIYYXGPXXXXXXXXXXXXGXXGPTTXXRMDXXXXXXXXXXGXXXMXXKXXRXXXXXXXXXXXXXXYLXXXGGXAAXLXXXXIXXXXXXXXXXLGMXEAXXXXXVXDXPXXXXVDXXG

SEQ ID NO: 89924 - protein, 109 aa, consensus
  MISC_FEATURE (1)..(109): consensus for the disclosure of xaa see table XV
XXXXXXXXXCQDTGXXXXXXXXXXXXXXXXXXXXXXXXXXXXXXXXXXXXXXXXXXXXXXXXXXXXXXXXXNXXXXXPXXXXXXXXXXXXXXXXXXXXXXXKGGGXXXK

SEQ ID NO: 89925 - protein, 28 aa, consensus
  MISC_FEATURE (1)..(28): consensus for the disclosure of xaa see table XV
XXXXXXXXXXXXGXXXCPPXXXXXXXGG

SEQ ID NO: 89926 - protein, 58 aa, consensus
  MISC_FEATURE (1)..(58): consensus for the disclosure of xaa see table XV
XXXXXXXXXXXXXXGXXXXXGXXXXXDXXXXXXPXHXXXXPXXXXXXCXXXRXXXXXX

SEQ ID NO: 89927 - protein, 89 aa, consensus
  MISC_FEATURE (1)..(89): consensus for the disclosure of xaa see table XV
XXXXGXXXXXRDXXHXXXXXXXXXXXXXXXXXXXXXXXXYXXGPXXXXXXXXXXXXXXXGPTTXXRXXXXXXXXXXXXXXXXXXXKXXX

SEQ ID NO: 89928 - protein, 60 aa, consensus
  MISC_FEATURE (1)..(60): consensus for the disclosure of xaa see table XV
XXXXXXXXYXXXXGGXXXXXXXXXXXXXXXXXXXXXGXXEXXXXXXXXXXXXXXXXDXXG

SEQ ID NO: 89929 - DNA, 1518 bp, Escherichia coli; identical to SEQ ID NO: 32416
  CDS (1)..(1518)

SEQ ID NO: 89930 - protein, 505 aa, Escherichia coli; identical to SEQ ID NO: 32417

SEQ ID NO: 89931 - DNA, 1536 bp, Streptococcus thermophilus CNRZ1066; identical to SEQ ID NO: 32418
  CDS (1)..(1536)

SEQ ID NO: 89932 - protein, 511 aa, Streptococcus thermophilus CNRZ1066; identical to SEQ ID NO: 32419

SEQ ID NO: 89933 - DNA, 1512 bp, Idiomarina loihiensis L2TR; identical to SEQ ID NO: 32420
  CDS (1)..(1512)

SEQ ID NO: 89934 - protein, 503 aa, Idiomarina loihiensis L2TR; identical to SEQ ID NO: 32421

SEQ ID NO: 89935 - DNA, 1731 bp, Francisella tularensis subsp. tularensis; identical to SEQ ID NO: 32422
  CDS (1)..(1731)

SEQ ID NO: 89936 - protein, 576 aa, Francisella tularensis subsp. tularensis; identical to SEQ ID NO: 32423

SEQ ID NO: 89937 - DNA, 1737 bp, Xenopus tropicalis; identical to SEQ ID NO: 32424
  CDS (1)..(1737)

SEQ ID NO: 89938 - protein, 578 aa, Xenopus tropicalis; identical to SEQ ID NO: 32425

SEQ ID NO: 89939 - DNA, 1809 bp, Danio rerio; identical to SEQ ID NO: 32426
  CDS (1)..(1809)

SEQ ID NO: 89940 - protein, 602 aa, Danio rerio; identical to SEQ ID NO: 32427

SEQ ID NO: 89941 - DNA, 1809 bp, Arabidopsis thaliana; identical to SEQ ID NO: 32428
  CDS (1)..(1809)

SEQ ID NO: 89942 - protein, 602 aa, Arabidopsis thaliana; identical to SEQ ID NO: 32429

SEQ ID NO: 89943 - DNA, 1539 bp, Vibrio cholerae O1 biovar eltor str. N16961; identical to SEQ ID NO: 32430
  CDS (1)..(1539): transl_table=11

SEQ ID NO: 89944 - protein, 512 aa, Vibrio cholerae O1 biovar eltor str. N16961; identical to SEQ ID NO: 32431

SEQ ID NO: 89945 - DNA, 1584 bp, Chlamydophila pneumoniae J138; identical to SEQ ID NO: 32432
  CDS (1)..(1584): transl_table=11

SEQ ID NO: 89946 - protein, 527 aa, Chlamydophila pneumoniae J138; identical to SEQ ID NO: 32433

SEQ ID NO: 89947 - DNA, 1335 bp, Sulfolobus tokodaii str. 7; identical to SEQ ID NO: 32434
  CDS (1)..(1335): transl_table=11

SEQ ID NO: 89948 - protein, 444 aa, Sulfolobus tokodaii str. 7; identical to SEQ ID NO: 32435

SEQ ID NO: 89949 - DNA, 1518 bp, Escherichia coli K12; identical to SEQ ID NO: 32436
  CDS (1)..(1518): transl_table=11

SEQ ID NO: 89950 - protein, 505 aa, Escherichia coli K12; identical to SEQ ID NO: 32437

SEQ ID NO: 89951 - DNA, 1518 bp, Salmonella typhimurium LT2; identical to SEQ ID NO: 32438
  CDS (1)..(1518): transl_table=11

SEQ ID NO: 89952 - protein, 505 aa, Salmonella typhimurium LT2; identical to SEQ ID NO: 32439

SEQ ID NO: 89953 - DNA, 1449 bp, Pyrobaculum aerophilum str. IM2; identical to SEQ ID NO: 32440
  CDS (1)..(1449): transl_table=11

SEQ ID NO: 89954 - protein, 482 aa, Pyrobaculum aerophilum str. IM2; identical to SEQ ID NO: 32441

SEQ ID NO: 89955 - DNA, 1725 bp, Drosophila melanogaster; identical to SEQ ID NO: 32442
  CDS (1)..(1725)

SEQ ID NO: 89956 - protein, 574 aa, Drosophila melanogaster; identical to SEQ ID NO: 32443

SEQ ID NO: 89957 - DNA, 1323 bp, Encephalitozoon cuniculi; identical to SEQ ID NO: 32444
  CDS (1)..(1323): transl_table=11

SEQ ID NO: 89958 - protein, 440 aa, Encephalitozoon cuniculi; identical to SEQ ID NO: 32445

SEQ ID NO: 89959 - DNA, 1596 bp, Schizosaccharomyces pombe; identical to SEQ ID NO: 32446
  CDS (1)..(1596)

SEQ ID NO: 89960 - protein, 531 aa, Schizosaccharomyces pombe; identical to SEQ ID NO: 32447

SEQ ID NO: 89961 - DNA, 1776 bp, Schizosaccharomyces pombe; identical to SEQ ID NO: 32448
  CDS (1)..(1776)

SEQ ID NO: 89962 - protein, 591 aa, Schizosaccharomyces pombe; identical to SEQ ID NO: 32449

SEQ ID NO: 89963 - DNA, 1581 bp, Corynebacterium glutamicum ATCC 13032; identical to SEQ ID NO: 32450
  CDS (1)..(1581): transl_table=11

SEQ ID NO: 89964 - protein, 526 aa, Corynebacterium glutamicum ATCC 13032; identical to SEQ ID NO: 32451

SEQ ID NO: 89965 - DNA, 1683 bp, Bifidobacterium longum NCC2705; identical to SEQ ID NO: 32452
  CDS (1)..(1683): transl_table=11

SEQ ID NO: 89966 - protein, 560 aa, Bifidobacterium longum NCC2705; identical to SEQ ID NO: 32453

SEQ ID NO: 89967 - DNA, 1752 bp, Plasmodium falciparum 3D7; identical to SEQ ID NO: 32454
  CDS (1)..(1752)

SEQ ID NO: 89968 - protein, 583 aa, Plasmodium falciparum 3D7; identical to SEQ ID NO: 32455

SEQ ID NO: 89969 - DNA, 1641 bp, Rhodopirellula baltica SH 1; identical to SEQ ID NO: 32456
  CDS (1)..(1641): transl_table=11

SEQ ID NO: 89970 - protein, 546 aa, Rhodopirellula baltica SH 1; identical to SEQ ID NO: 32457

SEQ ID NO: 89971 - DNA, 1563 bp, Corynebacterium diphtheriae NCTC 13129; identical to SEQ ID NO: 32458
  CDS (1)..(1563): transl_table=11

SEQ ID NO: 89972 - protein, 520 aa, Corynebacterium diphtheriae NCTC 13129; identical to SEQ ID NO: 32459

SEQ ID NO: 89973 - DNA, 1536 bp, Onion yellows phytoplasma OY-M; identical to SEQ ID NO: 32460
  CDS (1)..(1536): transl_table=11

SEQ ID NO: 89974 - protein, 511 aa, Onion yellows phytoplasma OY-M; identical to SEQ ID NO: 32461

SEQ ID NO: 89975 - DNA, 1542 bp, Lactobacillus johnsonii NCC 533; identical to SEQ ID NO: 32462
  CDS (1)..(1542): transl_table=11

SEQ ID NO: 89976 - protein, 513 aa, Lactobacillus johnsonii NCC 533; identical to SEQ ID NO: 32463

SEQ ID NO: 89977 - DNA, 1515 bp, Bdellovibrio bacteriovorus HD100; identical to SEQ ID NO: 32464
  CDS (1)..(1515): transl_table=11

SEQ ID NO: 89978 - protein, 504 aa, Bdellovibrio bacteriovorus HD100; identical to SEQ ID NO: 32465

SEQ ID NO: 89979 - DNA, 1503 bp, Mycoplasma mycoides subsp. mycoides SC str. PG1; identical to SEQ ID NO: 32466
  CDS (1)..(1503): transl_table=4

SEQ ID NO: 89980 - protein, 500 aa, Mycoplasma mycoides subsp. mycoides SC str. PG1; identical to SEQ ID NO: 32467

SEQ ID NO: 89981 - DNA, 1500 bp, Bacillus cereus ATCC 10987; identical to SEQ ID NO: 32468
  CDS (1)..(1500): transl_table=11

SEQ ID NO: 89982 - protein, 499 aa, Bacillus cereus ATCC 10987; identical to SEQ ID NO: 32469

SEQ ID NO: 89983 - DNA, 1578 bp, Eremothecium gossypii; identical to SEQ ID NO: 32470
  CDS (1)..(1578)

SEQ ID NO: 89984 - protein, 525 aa, Eremothecium gossypii; identical to SEQ ID NO: 32471

SEQ ID NO: 89985 - DNA, 1770 bp, Eremothecium gossypii; identical to SEQ ID NO: 32472
  CDS (1)..(1770)

SEQ ID NO: 89986 - protein, 589 aa, Eremothecium gossypii; identical to SEQ ID NO: 32473

SEQ ID NO: 89987 - DNA, 1917 bp, Magnaporthe grisea 70-15; identical to SEQ ID NO: 32474
  CDS (1)..(1917)

SEQ ID NO: 89988 - protein, 638 aa, Magnaporthe grisea 70-15; identical to SEQ ID NO: 32475

SEQ ID NO: 89989 - DNA, 1833 bp, Gibberella zeae PH-1; identical to SEQ ID NO: 32476
  CDS (1)..(1833)

SEQ ID NO: 89990 - protein, 610 aa, Gibberella zeae PH-1; identical to SEQ ID NO: 32477

SEQ ID NO: 89991 - DNA, 1821 bp, Aspergillus nidulans FGSC A4; identical to SEQ ID NO: 32478
  CDS (1)..(1821)

SEQ ID NO: 89992 - protein, 606 aa, Aspergillus nidulans FGSC A4; identical to SEQ ID NO: 32479

SEQ ID NO: 89993 - DNA, 1776 bp, Candida glabrata CBS138; identical to SEQ ID NO: 32480
  CDS (1)..(1776)

SEQ ID NO: 89994 - protein, 591 aa, Candida glabrata CBS138; identical to SEQ ID NO: 32481

SEQ ID NO: 89995 - DNA, 1782 bp, Debaryomyces hansenii CBS767; identical to SEQ ID NO: 32482
  CDS (1)..(1782)

SEQ ID NO: 89996 - protein, 593 aa, Debaryomyces hansenii CBS767; identical to SEQ ID NO: 32483

SEQ ID NO: 89997 - DNA, 1761 bp, Oryza sativa (japonica cultivar-group); identical to SEQ ID NO: 32484
  CDS (1)..(1761)

SEQ ID NO: 89998 - protein, 586 aa, Oryza sativa (japonica cultivar-group); identical to SEQ ID NO: 32485

SEQ ID NO: 89999 - DNA, 1749 bp, Yarrowia lipolytica CLIB99; identical to SEQ ID NO: 32486
  CDS (1)..(1749)

SEQ ID NO: 90000 - protein, 582 aa, Yarrowia lipolytica CLIB99; identical to SEQ ID NO: 32487

SEQ ID NO: 90001 - DNA, 1488 bp, Leptospira interrogans serovar Copenhageni str. Fiocruz L1-130; identical to SEQ ID NO: 32488
  CDS (1)..(1488): transl_table=11

SEQ ID NO: 90002 - protein, 495 aa, Leptospira interrogans serovar Copenhageni str. Fiocruz L1-130; identical to SEQ ID NO: 32489

SEQ ID NO: 90003 - DNA, 1590 bp, Parachlamydia sp. UWE25; identical to SEQ ID NO: 32490
  CDS (1)..(1590): transl_table=11

SEQ ID NO: 90004 - protein, 529 aa, Parachlamydia sp. UWE25; identical to SEQ ID NO: 32491

SEQ ID NO: 90005 - DNA, 1506 bp, Desulfovibrio vulgaris subsp. vulgaris str. Hildenborough; identical to SEQ ID NO: 32492
  CDS (1)..(1506): transl_table=11

SEQ ID NO: 90006 - protein, 501 aa, Desulfovibrio vulgaris subsp. vulgaris str. Hildenborough; identical to SEQ ID NO: 32493

SEQ ID NO: 90007 - DNA, 1518 bp, Erwinia carotovora subsp. atroseptica SCRI1043; identical to SEQ ID NO: 32494
  CDS (1)..(1518)

SEQ ID NO: 90008 - protein, 505 aa, Erwinia carotovora subsp. atroseptica SCRI1043; identical to SEQ ID NO: 32495

SEQ ID NO: 90009 - DNA, 1500 bp, Mesoplasma florum L1; identical to SEQ ID NO: 32496
  CDS (1)..(1500): transl_table=4

SEQ ID NO: 90010 - protein, 499 aa, Mesoplasma florum L1; identical to SEQ ID NO: 32497

SEQ ID NO: 90011 - DNA, 1533 bp, Propionibacterium acnes KPA171202; identical to SEQ ID NO: 32498
  CDS (1)..(1533): transl_table=11

SEQ ID NO: 90012 - protein, 510 aa, Propionibacterium acnes KPA171202; identical to SEQ ID NO: 32499

SEQ ID NO: 90013 - DNA, 1515 bp, Leifsonia xyli subsp. xyli str. CTCB07; identical to SEQ ID NO: 32500
  CDS (1)..(1515): transl_table=11

SEQ ID NO: 90014 - protein, 504 aa, Leifsonia xyli subsp. xyli str. CTCB07; identical to SEQ ID NO: 32501

SEQ ID NO: 90015 - DNA, 1512 bp, Desulfotalea psychrophila LSv54; identical to SEQ ID NO: 32502
  CDS (1)..(1512): transl_table=11

SEQ ID NO: 90016 - protein, 503 aa, Desulfotalea psychrophila LSv54; identical to SEQ ID NO: 32503

SEQ ID NO: 90017 - DNA, 1488 bp, Symbiobacterium thermophilum IAM 14863; identical to SEQ ID NO: 32504
  CDS (1)..(1488): transl_table=11

SEQ ID NO: 90018 - protein, 495 aa, Symbiobacterium thermophilum IAM 14863; identical to SEQ ID NO: 32505

SEQ ID NO: 90019 - DNA, 1512 bp, Mannheimia succiniciproducens MBEL55E; identical to SEQ ID NO: 32506
  CDS (1)..(1512): transl_table=11

SEQ ID NO: 90020 - protein, 503 aa, Mannheimia succiniciproducens MBEL55E; identical to SEQ ID NO: 32507

SEQ ID NO: 90021 - DNA, 1728 bp, Bacteroides fragilis YCH46; identical to SEQ ID NO: 32508
  CDS (1)..(1728): transl_table=11

SEQ ID NO: 90022 - protein, 575 aa, Bacteroides fragilis YCH46; identical to SEQ ID NO: 32509

SEQ ID NO: 90023 - DNA, 1491 bp, Methylococcus capsulatus str. Bath; identical to SEQ ID NO: 32510
  CDS (1)..(1491): transl_table=11

SEQ ID NO: 90024 - protein, 496 aa, Methylococcus capsulatus str. Bath; identical to SEQ ID NO: 32511

SEQ ID NO: 90025 - DNA, 1467 bp, Nocardia farcinica IFM 10152; identical to SEQ ID NO: 32512
  CDS (1)..(1467): transl_table=11

SEQ ID NO: 90026 - protein, 488 aa, Nocardia farcinica IFM 10152; identical to SEQ ID NO: 32513

SEQ ID NO: 90027 - DNA, 1491 bp, Legionella pneumophila str. Paris; identical to SEQ ID NO: 32514
  CDS (1)..(1491): transl_table=11

SEQ ID NO: 90028 - protein, 496 aa, Legionella pneumophila str. Paris; identical to SEQ ID NO: 32515

SEQ ID NO: 90029 - DNA, 1509 bp, Photobacterium profundum SS9; identical to SEQ ID NO: 32516
  CDS (1)..(1509): transl_table=11

SEQ ID NO: 90030 - protein, 502 aa, Photobacterium profundum SS9; identical to SEQ ID NO: 32517

SEQ ID NO: 90031 - DNA, 1488 bp, Leuconostoc mesenteroides subsp. mesenteroides ATCC 8293; identical to SEQ ID NO: 32518
  CDS (1)..(1488)

SEQ ID NO: 90032 - protein, 495 aa, Leuconostoc mesenteroides subsp. mesenteroides ATCC 8293; identical to SEQ ID NO: 32519

SEQ ID NO: 90033 - DNA, 1503 bp, Azotobacter vinelandii; identical to SEQ ID NO: 32520
  CDS (1)..(1503)

SEQ ID NO: 90034 - protein, 500 aa, Azotobacter vinelandii; identical to SEQ ID NO: 32521

SEQ ID NO: 90035 - DNA, 1686 bp, Nostoc punctiforme PCC 73102; identical to SEQ ID NO: 32522
  CDS (1)..(1686)

SEQ ID NO: 90036 - protein, 561 aa, Nostoc punctiforme PCC 73102; identical to SEQ ID NO: 32523

SEQ ID NO: 90037 - DNA, 1503 bp, Actinobacillus pleuropneumoniae serovar 1 str. 4074; identical to SEQ ID NO: 32524
  CDS (1)..(1503)

SEQ ID NO: 90038 - protein, 500 aa, Actinobacillus pleuropneumoniae serovar 1 str. 4074; identical to SEQ ID NO: 32525

SEQ ID NO: 90039 - DNA, 1482 bp, Fusobacterium nucleatum subsp. vincentii ATCC 49256; identical to SEQ ID NO: 32526
  CDS (1)..(1482): transl_table=11

SEQ ID NO: 90040 - protein, 493 aa, Fusobacterium nucleatum subsp. vincentii ATCC 49256; identical to SEQ ID NO: 32527

SEQ ID NO: 90041 - DNA, 1545 bp, Psychrobacter sp. 273-4; identical to SEQ ID NO: 32528
  CDS (1)..(1545)

SEQ ID NO: 90042 - protein, 514 aa, Psychrobacter sp. 273-4; identical to SEQ ID NO: 32529

SEQ ID NO: 90043 - DNA, 1506 bp, Dechloromonas aromatica RCB; identical to SEQ ID NO: 32530
  CDS (1)..(1506)

SEQ ID NO: 90044 - protein, 501 aa, Dechloromonas aromatica RCB; identical to SEQ ID NO: 32531

SEQ ID NO: 90045 - DNA, 1509 bp, Haemophilus influenzae R2866; identical to SEQ ID NO: 32532
  CDS (1)..(1509)

SEQ ID NO: 90046 - protein, 502 aa, Haemophilus influenzae R2866; identical to SEQ ID NO: 32533

SEQ ID NO: 90047 - DNA, 1686 bp, Anabaena variabilis ATCC 29413; identical to SEQ ID NO: 32534
  CDS (1)..(1686)

SEQ ID NO: 90048 - protein, 561 aa, Anabaena variabilis ATCC 29413; identical to SEQ ID NO: 32535

SEQ ID NO: 90049 - DNA, 1515 bp, Synechococcus elongatus PCC 7942; identical to SEQ ID NO: 32536
  CDS (1)..(1515)

SEQ ID NO: 90050 - protein, 504 aa, Synechococcus elongatus PCC 7942; identical to SEQ ID NO: 32537

SEQ ID NO: 90051 - DNA, 1551 bp, Ralstonia eutropha JMP134; identical to SEQ ID NO: 32538
  CDS (1)..(1551)

SEQ ID NO: 90052 - protein, 516 aa, Ralstonia eutropha JMP134; identical to SEQ ID NO: 32539

SEQ ID NO: 90053 - DNA, 1530 bp, Methylobacillus flagellatus KT; identical to SEQ ID NO: 32540
  CDS (1)..(1530)

SEQ ID NO: 90054 - protein, 509 aa, Methylobacillus flagellatus KT; identical to SEQ ID NO: 32541

SEQ ID NO: 90055 - DNA, 1722 bp, Crocosphaera watsonii WH 8501; identical to SEQ ID NO: 32542
  CDS (1)..(1722)

SEQ ID NO: 90056 - protein, 573 aa, Crocosphaera watsonii WH 8501; identical to SEQ ID NO: 32543

SEQ ID NO: 90057 - DNA, 1482 bp, Exiguobacterium sp. 255-15; identical to SEQ ID NO: 32544
  CDS (1)..(1482)

SEQ ID NO: 90058 - protein, 493 aa, Exiguobacterium sp. 255-15; identical to SEQ ID NO: 32545

SEQ ID NO: 90059 - DNA, 1527 bp, Burkholderia cepacia R1808; identical to SEQ ID NO: 32546
  CDS (1)..(1527)

SEQ ID NO: 90060 - protein, 508 aa, Burkholderia cepacia R1808; identical to SEQ ID NO: 32547

SEQ ID NO: 90061 - DNA, 1527 bp, Rubrivivax gelatinosus PM1; identical to SEQ ID NO: 32548
  CDS (1)..(1527)

SEQ ID NO: 90062 - protein, 508 aa, Rubrivivax gelatinosus PM1; identical to SEQ ID NO: 32549

SEQ ID NO: 90063 - DNA, 1506 bp, Magnetococcus sp. MC-1; identical to SEQ ID NO: 32550
  CDS (1)..(1506)

SEQ ID NO: 90064 - protein, 501 aa, Magnetococcus sp. MC-1; identical to SEQ ID NO: 32551

SEQ ID NO: 90065 - DNA, 1491 bp, Thermobifida fusca; identical to SEQ ID NO: 32552
  CDS (1)..(1491)

SEQ ID NO: 90066 - protein, 496 aa, Thermobifida fusca; identical to SEQ ID NO: 32553

SEQ ID NO: 90067 - DNA, 1548 bp, Methanosarcina barkeri str. fusaro; identical to SEQ ID NO: 32554
  CDS (1)..(1548)

SEQ ID NO: 90068 - protein, 515 aa, Methanosarcina barkeri str. fusaro; identical to SEQ ID NO: 32555

SEQ ID NO: 90069 - DNA, 1476 bp, Geobacter metallireducens GS-15; identical to SEQ ID NO: 32556
  CDS (1)..(1476)

SEQ ID NO: 90070 - protein, 491 aa, Geobacter metallireducens GS-15; identical to SEQ ID NO: 32557

SEQ ID NO: 90071 - DNA, 1755 bp, Cytophaga hutchinsonii; identical to SEQ ID NO: 32558
  CDS (1)..(1755)

SEQ ID NO: 90072 - protein, 584 aa, Cytophaga hutchinsonii; identical to SEQ ID NO: 32559

SEQ ID NO: 90073 - DNA, 1509 bp, Microbulbifer degradans 2-40; identical to SEQ ID NO: 32560
  CDS (1)..(1509)

SEQ ID NO: 90074 - protein, 502 aa, Microbulbifer degradans 2-40; identical to SEQ ID NO: 32561

SEQ ID NO: 90075 - DNA, 1497 bp, Pediococcus pentosaceus ATCC 25745; identical to SEQ ID NO: 32562
  CDS (1)..(1497)

SEQ ID NO: 90076 - protein, 498 aa, Pediococcus pentosaceus ATCC 25745; identical to SEQ ID NO: 32563

SEQ ID NO: 90077 - DNA, 1569 bp, Trichodesmium erythraeum IMS101; identical to SEQ ID NO: 32564
  CDS (1)..(1569)

SEQ ID NO: 90078 - protein, 522 aa, Trichodesmium erythraeum IMS101; identical to SEQ ID NO: 32565

SEQ ID NO: 90079 - DNA, 1491 bp, Streptococcus suis 89/1591; identical to SEQ ID NO: 32566
  CDS (1)..(1491)

SEQ ID NO: 90080 - protein, 496 aa, Streptococcus suis 89/1591; identical to SEQ ID NO: 32567

SEQ ID NO: 90081 - DNA, 1506 bp, Thiobacillus denitrificans ATCC 25259; identical to SEQ ID NO: 32568
  CDS (1)..(1506)

SEQ ID NO: 90082 - protein, 501 aa, Thiobacillus denitrificans ATCC 25259; identical to SEQ ID NO: 32569

SEQ ID NO: 90083 - DNA, 1551 bp, Polaromonas sp. JS666; identical to SEQ ID NO: 32570
  CDS (1)..(1551)

SEQ ID NO: 90084 - protein, 516 aa, Polaromonas sp. JS666; identical to SEQ ID NO: 32571

SEQ ID NO: 90085 - DNA, 1734 bp, Brachydanio rerio; identical to SEQ ID NO: 32572
  CDS (1)..(1734)

SEQ ID NO: 90086 - protein, 577 aa, Brachydanio rerio; identical to SEQ ID NO: 32573

SEQ ID NO: 90087 - DNA, 1506 bp, uncultured bacterium 577; identical to SEQ ID NO: 32574
  CDS (1)..(1506): transl_table=11

SEQ ID NO: 90088 - protein, 501 aa, uncultured bacterium 577; identical to SEQ ID NO: 32575

SEQ ID NO: 90089 - DNA, 1491 bp, Candidatus Portiera aleyrodidarum; identical to SEQ ID NO: 32576
  CDS (1)..(1491): transl_table=11

SEQ ID NO: 90090 - protein, 496 aa, Candidatus Portiera aleyrodidarum; identical to SEQ ID NO: 32577

SEQ ID NO: 90091 - DNA, 1518 bp, Citrobacter freundii; identical to SEQ ID NO: 32578
  CDS (1)..(1518): transl_table=11

SEQ ID NO: 90092 - protein, 505 aa, Citrobacter freundii; identical to SEQ ID NO: 32579

SEQ ID NO: 90093 - DNA, 1497 bp, Escherichia coli; identical to SEQ ID NO: 32580
  CDS (1)..(1497): transl_table=11

SEQ ID NO: 90094 - protein, 498 aa, Escherichia coli; identical to SEQ ID NO: 32581

SEQ ID NO: 90095 - DNA, 1788 bp, Mus musculus; identical to SEQ ID NO: 32582
  CDS (1)..(1788)

SEQ ID NO: 90096 - protein, 595 aa, Mus musculus; identical to SEQ ID NO: 32583

SEQ ID NO: 90097 - DNA, 1551 bp, Methanosarcina barkeri; identical to SEQ ID NO: 32584
  CDS (1)..(1551): transl_table=11

SEQ ID NO: 90098 - protein, 516 aa, Methanosarcina barkeri; identical to SEQ ID NO: 32585

SEQ ID NO: 90099 - DNA, 1878 bp, Homo sapiens; identical to SEQ ID NO: 32586
  CDS (1)..(1878)

SEQ ID NO: 90100 - protein, 625 aa, Homo sapiens [sequence omitted]

SEQ ID NO: 90101 - DNA, 1536 bp, Methanosarcina acetivorans; identical to SEQ ID NO: 32588
  CDS (1)..(1536): transl_table=11

SEQ ID NO: 90102 - protein, 511 aa, Methanosarcina acetivorans; identical to SEQ ID NO: 32589

SEQ ID NO: 90103 - DNA, 1536 bp, Methanosarcina mazei; identical to SEQ ID NO: 32590
  CDS (1)..(1536): transl_table=11

SEQ ID NO: 90104 - protein, 511 aa, Methanosarcina mazei; identical to SEQ ID NO: 32591

SEQ ID NO: 90105 - DNA, 1779 bp, Saccharomyces cerevisiae; identical to SEQ ID NO: 32592
  CDS (1)..(1779)

SEQ ID NO: 90106 - protein, 592 aa, Saccharomyces cerevisiae; identical to SEQ ID NO: 32593

SEQ ID NO: 90107 - DNA, 1731 bp, Saccharomyces cerevisiae; identical to SEQ ID NO: 32594
  CDS (1)..(1731)

SEQ ID NO: 90108 - protein, 576 aa, Saccharomyces cerevisiae; identical to SEQ ID NO: 32595

SEQ ID NO: 90109 - DNA, 1530 bp, Acinetobacter sp; identical to SEQ ID NO: 32596
  CDS (1)..(1530): transl_table=11

SEQ ID NO: 90110 - protein, 509 aa, Acinetobacter sp; identical to SEQ ID NO: 32597

SEQ ID NO: 90111 - DNA, 1500 bp, Agrobacterium tumefaciens; identical to SEQ ID NO: 32598
  CDS (1)..(1500): transl_table=11

SEQ ID NO: 90112 - protein, 499 aa, Agrobacterium tumefaciens; identical to SEQ ID NO: 32599

SEQ ID NO: 90113 - DNA, 1686 bp, Anabaena sp; identical to SEQ ID NO: 32600
  CDS (1)..(1686): transl_table=11

SEQ ID NO: 90114 - protein, 561 aa, Anabaena sp; identical to SEQ ID NO: 32601

SEQ ID NO: 90115 - DNA, 1794 bp, Aquifex aeolicus; identical to SEQ ID NO: 32602
  CDS (1)..(1794): transl_table=11

SEQ ID NO: 90116 - protein, 597 aa, Aquifex aeolicus; identical to SEQ ID NO: 32603

SEQ ID NO: 90117 - DNA, 1881 bp, Arabidopsis thaliana; identical to SEQ ID NO: 32604
  CDS (1)..(1881)

SEQ ID NO: 90118 - protein, 626 aa, Arabidopsis thaliana; identical to SEQ ID NO: 32605

SEQ ID NO: 90119 - DNA, 1485 bp, Bacillus stearothermophilus; identical to SEQ ID NO: 32606
  CDS (1)..(1485): transl_table=11

SEQ ID NO: 90120 - protein, 494 aa, Bacillus stearothermophilus; identical to SEQ ID NO: 32607

SEQ ID NO: 90121 - DNA, 1500 bp, Bacillus subtilis; identical to SEQ ID NO: 32608
  CDS (1)..(1500): transl_table=11

SEQ ID NO: 90122 - protein, 499 aa, Bacillus subtilis; identical to SEQ ID NO: 32609

SEQ ID NO: 90123 - DNA, 1731 bp, Bacteroides thetaiotaomicron; identical to SEQ ID NO: 32610
  CDS (1)..(1731): transl_table=11

SEQ ID NO: 90124 - protein, 576 aa, Bacteroides thetaiotaomicron; identical to SEQ ID NO: 32611

SEQ ID NO: 90125 - DNA, 1521 bp, Buchnera aphidicola; identical to SEQ ID NO: 32612
  CDS (1)..(1521): transl_table=11

SEQ ID NO: 90126 - protein, 506 aa, Buchnera aphidicola; identical to SEQ ID NO: 32613

SEQ ID NO: 90127 - DNA, 1512 bp, Buchnera aphidicola; identical to SEQ ID NO: 32614
  CDS (1)..(1512): transl_table=11

SEQ ID NO: 90128 - protein, 503 aa, Buchnera aphidicola; identical to SEQ ID NO: 32615

SEQ ID NO: 90129 - DNA, 1719 bp, Caenorhabditis elegans; identical to SEQ ID NO: 32616
  CDS (1)..(1719)

SEQ ID NO: 90130 - protein, 572 aa, Caenorhabditis elegans; identical to SEQ ID NO: 32617

SEQ ID NO: 90131 - DNA, 1506 bp, Campylobacter jejuni; identical to SEQ ID NO: 32618
  CDS (1)..(1506): transl_table=11

SEQ ID NO: 90132 - protein, 501 aa, Campylobacter jejuni; identical to SEQ ID NO: 32619

SEQ ID NO: 90133 - DNA, 1458 bp, Candidatus Blochmannia floridanus; identical to SEQ ID NO: 32620
  CDS (1)..(1458): transl_table=11

SEQ ID NO: 90134 - protein, 485 aa, Candidatus Blochmannia floridanus; identical to SEQ ID NO: 32621

SEQ ID NO: 90135 - DNA, 1578 bp, Chlamydophila caviae; identical to SEQ ID NO: 32622
  CDS (1)..(1578): transl_table=11

SEQ ID NO: 90136 - protein, 525 aa, Chlamydophila caviae; identical to SEQ ID NO: 32623

SEQ ID NO: 90137 - DNA, 1536 bp, Chlorobium tepidum; identical to SEQ ID NO: 32624
  CDS (1)..(1536): transl_table=11

SEQ ID NO: 90138 - protein, 511 aa, Chlorobium tepidum; identical to SEQ ID NO: 32625

SEQ ID NO: 90139 - DNA, 1581 bp, Chlamydia trachomatis; identical to SEQ ID NO: 32626
  CDS (1)..(1581): transl_table=11

SEQ ID NO: 90140 - protein, 526 aa, Chlamydia trachomatis; identical to SEQ ID NO: 32627

SEQ ID NO: 90141 - DNA, 1509 bp, Chromobacterium violaceum; identical to SEQ ID NO: 32628
  CDS (1)..(1509): transl_table=11

SEQ ID NO: 90142 - protein, 502 aa, Chromobacterium violaceum; identical to SEQ ID NO: 32629

SEQ ID NO: 90143 - DNA, 1506 bp, Clostridium perfringens; identical to SEQ ID NO: 32630
  CDS (1)..(1506): transl_table=11

SEQ ID NO: 90144 - protein, 501 aa, Clostridium perfringens; identical to SEQ ID NO: 32631

SEQ ID NO: 90145 - DNA, 1509 bp, Clostridium tetani; identical to SEQ ID NO: 32632
  CDS (1)..(1509): transl_table=11

SEQ ID NO: 90146 - protein, 502 aa, Clostridium tetani; identical to SEQ ID NO: 32633

SEQ ID NO: 90147 - DNA, 1497 bp, Coxiella burnetii; identical to SEQ ID NO: 32634
  CDS (1)..(1497): transl_table=11

SEQ ID NO: 90148 - protein, 498 aa, Coxiella burnetii; identical to SEQ ID NO: 32635

SEQ ID NO: 90149 - DNA, 1794 bp, Cricetulus longicaudatus; identical to SEQ ID NO: 32636
  CDS (1)..(1794)

SEQ ID NO: 90150 - protein, 597 aa, Cricetulus longicaudatus; identical to SEQ ID NO: 32637

SEQ ID NO: 90151 - DNA, 1578 bp, Deinococcus radiodurans; identical to SEQ ID NO: 32638
  CDS (1)..(1578): transl_table=11

SEQ ID NO: 90152 - protein, 525 aa, Deinococcus radiodurans; identical to SEQ ID NO: 32639

SEQ ID NO: 90153 - DNA, 1497 bp, Enterococcus faecalis; identical to SEQ ID NO: 32640
  CDS (1)..(1497): transl_table=11

SEQ ID NO: 90154 - protein, 498 aa, Enterococcus faecalis; identical to SEQ ID NO: 32641

SEQ ID NO: 90155 - DNA, 1482 bp, Fusobacterium nucleatum; identical to SEQ ID NO: 32642
  CDS (1)..(1482): transl_table=11

SEQ ID NO: 90156 - protein, 493 aa, Fusobacterium nucleatum; identical to SEQ ID NO: 32643

SEQ ID NO: 90157 - DNA, 1494 bp, Gloeobacter violaceus; identical to SEQ ID NO: 32644
  CDS (1)..(1494): transl_table=11

SEQ ID NO: 90158 - protein, 497 aa, Gloeobacter violaceus; identical to SEQ ID NO: 32645

SEQ ID NO: 90159 - DNA, 1497 bp, Haemophilus ducreyi; identical to SEQ ID NO: 32646
  CDS (1)..(1497): transl_table=11

SEQ ID NO: 90160 - protein, 498 aa, Haemophilus ducreyi; identical to SEQ ID NO: 32647

SEQ ID NO: 90161 - DNA, 1557 bp, Helicobacter hepaticus; identical to SEQ ID NO: 32648
  CDS (1)..(1557): transl_table=11

SEQ ID NO: 90162 - protein, 518 aa, Helicobacter hepaticus; identical to SEQ ID NO: 32649

SEQ ID NO: 90163 - DNA, 1485 bp, Lactococcus lactis; identical to SEQ ID NO: 32650
  CDS (1)..(1485): transl_table=11

SEQ ID NO: 90164 - protein, 494 aa, Lactococcus lactis; identical to SEQ ID NO: 32651

SEQ ID NO: 90165 - DNA, 1500 bp, Lactobacillus plantarum; identical to SEQ ID NO: 32652
  CDS (1)..(1500): transl_table=11

SEQ ID NO: 90166 - protein, 499 aa, Lactobacillus plantarum; identical to SEQ ID NO: 32653

SEQ ID NO: 90167 - DNA, 1497 bp, Listeria monocytogenes; identical to SEQ ID NO: 32654
  CDS (1)..(1497): transl_table=11

SEQ ID NO: 90168 - protein, 498 aa, Listeria monocytogenes; identical to SEQ ID NO: 32655

SEQ ID NO: 90169 - DNA, 1767 bp, Lycopersicon esculentum; identical to SEQ ID NO: 32656
  CDS (1)..(1767)

SEQ ID NO: 90170 - protein, 588 aa, Lycopersicon esculentum; identical to SEQ ID NO: 32657

SEQ ID NO: 90171 - DNA, 1512 bp, Neisseria meningitidis; identical to SEQ ID NO: 32658
  CDS (1)..(1512): transl_table=11

SEQ ID NO: 90172 - protein, 503 aa, Neisseria meningitidis; identical to SEQ ID NO: 32659

SEQ ID NO: 90173 - DNA, 1509 bp, Nitrosomonas europaea; identical to SEQ ID NO: 32660
  CDS (1)..(1509): transl_table=11

SEQ ID NO: 90174 - protein, 502 aa, Nitrosomonas europaea; identical to SEQ ID NO: 32661

SEQ ID NO: 90175 - DNA, 1482 bp, Oceanobacillus iheyensis; identical to SEQ ID NO: 32662
  CDS (1)..(1482): transl_table=11

SEQ ID NO: 90176 - protein, 493 aa, Oceanobacillus iheyensis; identical to SEQ ID NO: 32663

SEQ ID NO: 90177 - DNA, 1809 bp, Oryza sativa; identical to SEQ ID NO: 32664
  CDS (1)..(1809)

SEQ ID NO: 90178 - protein, 602 aa, Oryza sativa; identical to SEQ ID NO: 32665

SEQ ID NO: 90179 - DNA, 1506 bp, Pasteurella multocida; identical to SEQ ID NO: 32666
  CDS (1)..(1506): transl_table=11

SEQ ID NO: 90180 - protein, 501 aa, Pasteurella multocida; identical to SEQ ID NO: 32667

SEQ ID NO: 90181 - DNA, 1737 bp, Porphyromonas gingivalis; identical to SEQ ID NO: 32668
  CDS (1)..(1737): transl_table=11

SEQ ID NO: 90182 - protein, 578 aa, Porphyromonas gingivalis; identical to SEQ ID NO: 32669

SEQ ID NO: 90183 - DNA, 1506 bp, Pseudomonas aeruginosa; identical to SEQ ID NO: 32670
  CDS (1)..(1506): transl_table=11

SEQ ID NO: 90184 - protein, 501 aa, Pseudomonas aeruginosa; identical to SEQ ID NO: 32671

SEQ ID NO: 90185 - DNA, 1503 bp, Pseudomonas syringae; identical to SEQ ID NO: 32672
  CDS (1)..(1503): transl_table=11

SEQ ID NO: 90186 - protein, 500 aa, Pseudomonas syringae; identical to SEQ ID NO: 32673

SEQ ID NO: 90187 - DNA, 1533 bp, Ralstonia solanacearum; identical to SEQ ID NO: 32674
  CDS (1)..(1533): transl_table=11

SEQ ID NO: 90188 - protein, 510 aa, Ralstonia solanacearum; identical to SEQ ID NO: 32675

SEQ ID NO: 90189 - DNA, 1497 bp, Rhizobium meliloti; identical to SEQ ID NO: 32676
  CDS (1)..(1497): transl_table=11

SEQ ID NO: 90190 - protein, 498 aa, Rhizobium meliloti; identical to SEQ ID NO: 32677

SEQ ID NO: 90191 - DNA, 1503 bp, Shewanella oneidensis; identical to SEQ ID NO: 32678
  CDS (1)..(1503): transl_table=11

SEQ ID NO: 90192 - protein, 500 aa, Shewanella oneidensis; identical to SEQ ID NO: 32679

SEQ ID NO: 90193 - DNA, 1488 bp, Staphylococcus aureus; identical to SEQ ID NO: 32680
  CDS (1)..(1488): transl_table=11

SEQ ID NO: 90194 - protein, 495 aa, Staphylococcus aureus; identical to SEQ ID NO: 32681

SEQ ID NO: 90195 - DNA, 1485 bp, Sulfolobus solfataricus; identical to SEQ ID NO: 32682
  CDS (1)..(1485): transl_table=11

SEQ ID NO: 90196 - protein, 494 aa, Sulfolobus solfataricus; identical to SEQ ID NO: 32683

SEQ ID NO: 90197 - DNA, 1521 bp, Synechococcus elongatus; identical to SEQ ID NO: 32684
  CDS (1)..(1521): transl_table=11

SEQ ID NO: 90198 - protein, 506 aa, Synechococcus elongatus; identical to SEQ ID NO: 32685

SEQ ID NO: 90199 - DNA, 1509 bp, Synechococcus sp; identical to SEQ ID NO: 32686
  CDS (1)..(1509): transl_table=11

SEQ ID NO: 90200 - protein, 502 aa, Synechococcus sp; identical to SEQ ID NO: 32687

SEQ ID NO: 90201 - DNA, 1509 bp, Thermotoga maritima; identical to SEQ ID NO: 32688
  CDS (1)..(1509): transl_table=11

SEQ ID NO: 90202 - protein, 502 aa, Thermotoga maritima; identical to SEQ ID NO: 32689

SEQ ID NO: 90203 - DNA, 1479 bp, Thermus thermophilus; identical to SEQ ID NO: 32690
  CDS (1)..(1479): transl_table=11

SEQ ID NO: 90204 - protein, 492 aa, Thermus thermophilus; identical to SEQ ID NO: 32691

SEQ ID NO: 90205 - DNA, 1500 bp, Thermoanaerobacter tengcongensis; identical to SEQ ID NO: 32692
  CDS (1)..(1500): transl_table=11

SEQ ID NO: 90206 - protein, 499 aa, Thermoanaerobacter tengcongensis; identical to SEQ ID NO: 32693

SEQ ID NO: 90207 - DNA, 1482 bp, Ureaplasma parvum; identical to SEQ ID NO: 32694
  CDS (1)..(1482): transl_table=4

SEQ ID NO: 90208 - protein, 493 aa, Ureaplasma parvum; identical to SEQ ID NO: 32695

SEQ ID NO: 90209 - DNA, 1518 bp, Vibrio parahaemolyticus; identical to SEQ ID NO: 32696
  CDS (1)..(1518): transl_table=11

SEQ ID NO: 90210 - protein, 505 aa, Vibrio parahaemolyticus; identical to SEQ ID NO: 32697

SEQ ID NO: 90211 - DNA, 1533 bp, Vibrio vulnificus; identical to SEQ ID NO: 32698
  CDS (1)..(1533): transl_table=11

SEQ ID NO: 90212 - protein, 510 aa, Vibrio vulnificus; identical to SEQ ID NO: 32699

SEQ ID NO: 90213 - DNA, 1482 bp, Wigglesworthia glossinidia brevipalpis; identical to SEQ ID NO: 32700
  CDS (1)..(1482): transl_table=11

SEQ ID NO: 90214 - protein, 493 aa, Wigglesworthia glossinidia brevipalpis; identical to SEQ ID NO: 32701

SEQ ID NO: 90215 - DNA, 1524 bp, Wolinella succinogenes; identical to SEQ ID NO: 32702
  CDS (1)..(1524): transl_table=11

SEQ ID NO: 90216 - protein, 507 aa, Wolinella succinogenes; identical to SEQ ID NO: 32703

SEQ ID NO: 90217 - DNA, 1518 bp, Xanthomonas campestris; identical to SEQ ID NO: 32704
  CDS (1)..(1518): transl_table=11

SEQ ID NO: 90218 - protein, 505 aa, Xanthomonas campestris; identical to SEQ ID NO: 32705

SEQ ID NO: 90219 - DNA, 1521 bp, Xylella fastidiosa; identical to SEQ ID NO: 32706
  CDS (1)..(1521): transl_table=11

SEQ ID NO: 90220 - protein, 506 aa, Xylella fastidiosa; identical to SEQ ID NO: 32707

SEQ ID NO: 90221 - DNA, 1518 bp, Yersinia pestis; identical to SEQ ID NO: 32708
  CDS (1)..(1518): transl_table=11

SEQ ID NO: 90222 - protein, 505 aa, Yersinia pestis; identical to SEQ ID NO: 32709

SEQ ID NO: 90223 - DNA, 23 bp, Primer
atgtctgaacaagaaacacgggg

SEQ ID NO: 90224 - DNA, 22 bp, Primer
ttatttctgtgggcgcatcgcc

SEQ ID NO: 90225 - protein, 561 aa, consensus; identical to SEQ ID NO: 32712
  MISC_FEATURE (1)..(561): consensus for the disclosure of xaa see table XV

SEQ ID NO: 90226 - protein, 34 aa, consensus; identical to SEQ ID NO: 32713
  MISC_FEATURE (1)..(34): consensus for the disclosure of xaa see table XV

SEQ ID NO: 90227 - protein, 46 aa, consensus; identical to SEQ ID NO: 32714
  MISC_FEATURE (1)..(46): consensus for the disclosure of xaa see table XV

SEQ ID NO: 90228 - protein, 135 aa, consensus; identical to SEQ ID NO: 32715
  MISC_FEATURE (1)..(135): consensus for the disclosure of xaa see table XV

SEQ ID NO: 90229 - protein, 62 aa, consensus; identical to SEQ ID NO: 32716
  MISC_FEATURE (1)..(62): consensus for the disclosure of xaa see table XV

SEQ ID NO: 90230 - protein, 45 aa, consensus; identical to SEQ ID NO: 32717
  MISC_FEATURE (1)..(45): consensus for the disclosure of xaa see table XV

SEQ ID NO: 90231 - DNA, 1587 bp, Saccharomyces cerevisiae
  CDS (1)..(1587)
atgagctatggaactataaatgatatgaatgaatcggtaacgaactatcgaataaaaaaagcccaaaacaatatcaagggatggtacgcttactcattttctagcgaaccatttgtcgtttctgcggtttcaacgtatattcccttactactgcagcaatttgcgagtataaatggtgtaaaagttcacgatcactccataccctgcctgtcagaaacgggtagtgattcagataagtgtgttcttggtttgttcaacaatcggatcttcgtagatacttcaagttttgcattatatgtcttttcccttagcgttttattccaaactataatagtcatttccgtttcagggatagtagatctctgggggagcgttaaattcaaaggcagaattctggtttggtttggtattgtgggcgcattgtcgactgttgcgatttcaaaattgaatgatacccagatttattctctggctgggctttatatagtggccaatggttgttttggcgttatcaatgttgttgggaattctcttctgcccatttttgtcaaggattctttgaaatgtcaaagtcaaggagcttatgaacctgataaggtagactcgttaactactgttattagcggtagaggtgcatctttaggttattcaagtgccctcattgttcagattgtatctatgttcttagtcgcatctaaaaagggcagtaagcaggatgttcaagtggctgttcttttcgttgggatttggtggtttgtgtggcaactgcccatgatctggttgattgacgatgtgacaataccgataagagttgacgattctacattagcatccgcccgcagtccgtatcccggtgagcaagacgccttgggtcaactaaactggaagaattacctttcatatggttgggtttcgcttttcgaatcgtttaaacatgccagactattgaaagatgtgatgatttttcttattgcgtggtttattattagtgattccattacaactataaattctacagcggttttgttctccaaggcagaactgcacatgagtaccctcaatttaatcatgataagtgttttgaccgttgtaaatgcaatgctgggtgcctttatgattccacaatttcttgccacaaagtttcggtggacttctagtcaaactttgatgtacattatcatttgggcaagtttcataccattttatggtattcttggatttttcttcaatgcgttcggtttaaagcataagtttgaaatgttcttattggccatttggtatggattatcactaggtggcctgtccgcggtttcaagatcagttttcagtttgattgtacctccaggaaaagaatccacgttttttagtatgttcagtatcacagataaggggtcgtccatcctgggacccttccttgttggactgcttaccgataaaacgcataatattcgctattcgttttatttcttctttttgcttttgatgctatcattgcctgtgctaaactgtttggatgtcaagagaggtagaagagaggctgaagaactcagtcaagttttacctgaaagtgaaagaaggttggattag

SEQ ID NO: 90232 - protein, 528 aa, Saccharomyces cerevisiae
MSYGTINDMNESVTNYRIKKAQNNIKGWYAYSFSSEPFVVSAVSTYIPLLLQQFASINGVKVHDHSIPCLSETGSDSDKCVLGLFNNRIFVDTSSFALYVFSLSVLFQTIIVISVSGIVDLWGSVKFKGRILVWFGIVGALSTVAISKLNDTQIYSLAGLYIVANGCFGVINVVGNSLLPIFVKDSLKCQSQGAYEPDKVDSLTTVISGRGASLGYSSALIVQIVSMFLVASKKGSKQDVQVAVLFVGIWWFVWQLPMIWLIDDVTIPIRVDDSTLASARSPYPGEQDALGQLNWKNYLSYGWVSLFESFKHARLLKDVMIFLIAWFIISDSITTINSTAVLFSKAELHMSTLNLIMISVLTVVNAMLGAFMIPQFLATKFRWTSSQTLMYIIIWASFIPFYGILGFFFNAFGLKHKFEMFLLAIWYGLSLGGLSAVSRSVFSLIVPPGKESTFFSMFSITDKGSSILGPFLVGLLTDKTHNIRYSFYFFFLLLMLSLPVLNCLDVKRGRREAEELSQVLPESERRLD

SEQ ID NO: 90233 - DNA, 1284 bp, Bacillus halodurans C-125
  CDS (1)..(1284): transl_table=11
atgggtaaatataataaagcagagaaaagttggatgatatatgattgggcggattccgcctattttcttattattgtaacggccattttccctatttattataaagaggtagcaactaatggcggcgttgcccctgctgattcgacagcttatcttggctatacaatttccatcgcgacctttttattggcattgcttggccccattttagggaccgttgcggactatagagggatgaaagggaaatttttcggctcttttttttcaataggggtactatcgacaatcggcttgttttttgtccctgacaaccattggttgctactcttactggtttacaccctcacatctttaggagcccggggagcaaatgtattttacgatgcatatatagtcgacgtgacaacgaaacaacgaatggatgaactatcggcaagggggtacgctttaggttatgttggtagctccattccttttattatttgcatagcgctcatcattttagcccaaacaggcactatccgattgactgtgtctgaagccagtcgaagtgcctttctaattaccgcgggatggtggctcgtttttacgattccaatgcttaaaaacgtgaagcaacaatatggggttgaacgagaaccaaaaatggttgtcagtagctttaaacgcctcggacaaacctttaaagaaattagacaatatcggacagtgtttttgtttttaatcgcctatttcttttacattgatggcgtcggaaccattatttccatgtcaaccgcctatggtaccgacttaggcttaagcgcaaccgacctcattcttgcattattggcagtacaaattgtagctgctcccttttcaatactatacggaacgttagccaaccgattcggtgtaaaaaagatgctttatacagggattgtcatttatatgatcgtttgtgtatacgccatgttcttgagaactagtgtagacttttggataatggccatgctcgttgccacttcacaaggaggaattcaagcgctaagtcgctcctattttgcccagatggttccaaaagaaaagtcaaacgaattctttggcttctatacgatctttggtcgatttgccgctgtttcagggccatttcttgtcggtgtcatcacccaaataacaggaagctctgctttcggtgtatctagcttaatcgtattattcgccattggtttgattgtgttaacgtttgtccctgatgcagggaaggaagatgctgtcgaacctagagtaaaactcatgcagtag

SEQ ID NO: 90234 - protein, 427 aa, Bacillus halodurans C-125
MGKYNKAEKSWMIYDWADSAYFLIIVTAIFPIYYKEVATNGGVAPADSTAYLGYTISIATFLLALLGPILGTVADYRGMKGKFFGSFFSIGVLSTIGLFFVPDNHWLLLLLVYTLTSLGARGANVFYDAYIVDVTTKQRMDELSARGYALGYVGSSIPFIICIALIILAQTGTIRLTVSEASRSAFLITAGWWLVFTIPMLKNVKQQYGVEREPKMVVSSFKRLGQTFKEIRQYRTVFLFLIAYFFYIDGVGTIISMSTAYGTDLGLSATDLILALLAVQIVAAPFSILYGTLANRFGVKKMLYTGIVIYMIVCVYAMFLRTSVDFWIMAMLVATSQGGIQALSRSYFAQMVPKEKSNEFFGFYTIFGRFAAVSGPFLVGVITQITGSSAFGVSSLIVLFAIGLIVLTFVPDAGKEDAVEPRVKLMQ

SEQ ID NO: 90235 - DNA, 1278 bp, Clostridium acetobutylicum ATCC 824
  CDS (1)..(1278): transl_table=11
atgagaaatttaagtaaaggtgaaaaaagctggattatgtacgactgggcaaattctgcttatagtacagctataacagctactattcttcctttatattttaaatcaatagctttaaaaagtggtgtaagtgcggcttcttctacagcgtactggggatattccaattcaatagcaactcttttaatagctattttatctccaatattagggactatggcagattataaaggctataaaatgaagcttttcaatgttttctttattttaggaacaagctttacccttcttctctctgtagttccaactaattattggcttttaataattttattttatattctgacttccataggtttctctggaagctgcattttttatgatgcctttttagtagatgtcagtgacaatgacaatatggatagagtgtcttctttaggctttggaatgggttacataggtagcaacataccttttatattgtgtatattaataatagccttagctcaacttaagataattccaatatccttttttactgcttgtaaaatatcctttgcaataacagctttatggtgggcaatattcacaatacctatgataaaaaacgtaaaacagacatattcaatcaatatagaaaaaaatcctgcaagaaaaagtttcttaaggttaaaatcaactttaaaagatataaaaaagcataaacaattattcatatttttattatcctactttttttatattgatggtgtaaatacaataattactatggctacttcgtacggctcagatcttggaattaattctactacaatgttagtaattcttttagtaatgcaatttatagcttttccattttccattatttttggaatgctggcaaaaaagtttcaaggcaaaacaatgctttatgtagggatagtaatatattcaataatttgtgtatactcttactttttaagaagcaccttagacttctggatattagcaatacttgtaggaacttcccaaggcggaatacaagcattaagcagatcctacttgggaaagctggtacctaaaaataaagcaaatgagttttttggcttctataacatattcggtaagttttcagcaattctaggaccttttatggttgggatagtatctcaagttactggaaactccaacaaaggcgtgcttagcatacttgttctatttttaattggaggcatcatcctaaaaaaagtaccatcttatgaaaaaagtgaaaaagaatctaatgtctactctacgtag

SEQ ID NO: 90236 - protein, 425 aa, Clostridium acetobutylicum ATCC 824
MRNLSKGEKSWIMYDWANSAYSTAITATILPLYFKSIALKSGVSAASSTAYWGYSNSIATLLIAILSPILGTMADYKGYKMKLFNVFFILGTSFTLLLSVVPTNYWLLIILFYILTSIGFSGSCIFYDAFLVDVSDNDNMDRVSSLGFGMGYIGSNIPFILCILIIALAQLKIIPISFFTACKISFAITALWWAIFTIPMIKNVKQTYSINIEKNPARKSFLRLKSTLKDIKKHKQLFIFLLSYFFYIDGVNTIITMATSYGSDLGINSTTMLVILLVMQFIAFPFSIIFGMLAKKFQGKTMLYVGIVIYSIICVYSYFLRSTLDFWILAILVGTSQGGIQALSRSYLGKLVPKNKANEFFGFYNIFGKFSAILGPFMVGIVSQVTGNSNKGVLSILVLFLIGGIILKKVPSYEKSEKESNVYST

SEQ ID NO: 90237 - DNA, 1446 bp, Brucella melitensis 16M
  CDS (1)..(1446): transl_table=11
gtgtttccggtcggaggcgggttcgtgccttttcggaaagcgtccggcggacaggagcagggattgaccgaacaagtgatggcgccccgccgccatgccgcgcgtcgcggcgtatggggatggattttcttcgattgggcggcacagccctttttcacggttgtaaccacattcattttcggcccctatttcatttcccatgtcgccgccacgcctgaagaggggcagatggcgtggggatatggtttcgcggtggcggggttgctcatcgccattctctcgccaatcctcggctcggttgcggataaaaccggtgcgcgtaagccctggatcggcttctttgcagttttgaaaatcatttgcctgtcgcttttgtggtttgcggttccgggtgcaaacctgttctgggttctgtgcgctttcgccatcgccatggtggcggcagaattttccatcgtcttcaacgattccatgatgccgcgtctggtggcgcgtgaagatatcgggcgcgtgtcgaatatcgcctgggggcttggctatcttggcggcatgatcgtgctgattttcgtggtcttttgccttgccgcatcgccggaaacaggccggacgatcatcgggatgaagccgctcttcggccttgatccgcaactgggcgagggcgcgcgcatcaccgggcctctggccgcgctctggtatttcattttcatcctgccgatgtttttcttcacgcccgatgcggcaaagggtgagcccttgcgcacggcgcttcgctccggcttgagcgagttgaaggcgacattggcggaggtgcgccaccgttccggcattgtgcgctttcttgctgcgcggatgatctatcaggatggcgtcaatgcactgctggcgctgggaggcggttatgctgcggccatgttccactggacgattaccgagatcggacttttcggcatgatcctcaatgtcatggcgatcatcagttgcctcatcgccagcaggctcgatatgcgcttcggctccaagaaggtcgtgatcggcgcgctggtgcttctgttcttcgcttcacttggcattatttcgacagcaagggactatacgctttttggcctcctgcccttcacgctggaaggcgagggcaagctcttcggtaccgccgccgagcatagttatctgatctatgggctgatgatcggcgcggcctttgggccggtgcaggcttcctcgcggtcctggtttgcgcgcagtatcaagccggaggaatcgggccgctatttcggcctttatgcgctggctggccgcgcaaccagctttatggggccatttctggtggccagcattaccgccatcagtggttcagcggctcttggcatgtcggtactgctgttgttttttgtagcaggctttgcgctgacgctgattacgccctatccggcggaccgtctgatatga

SEQ ID NO: 90238 - protein, 481 aa, Brucella melitensis 16M
MFPVGGGFVPFRKASGGQEQGLTEQVMAPRRHAARRGVWGWIFFDWAAQPFFTVVTTFIFGPYFISHVAATPEEGQMAWGYGFAVAGLLIAILSPILGSVADKTGARKPWIGFFAVLKIICLSLLWFAVPGANLFWVLCAFAIAMVAAEFSIVFNDSMMPRLVAREDIGRVSNIAWGLGYLGGMIVLIFVVFCLAASPETGRTIIGMKPLFGLDPQLGEGARITGPLAALWYFIFILPMFFFTPDAAKGEPLRTALRSGLSELKATLAEVRHRSGIVRFLAARMIYQDGVNALLALGGGYAAAMFHWTITEIGLFGMILNVMAIISCLIASRLDMRFGSKKVVIGALVLLFFASLGIISTARDYTLFGLLPFTLEGEGKLFGTAAEHSYLIYGLMIGAAFGPVQASSRSWFARSIKPEESGRYFGLYALAGRATSFMGPFLVASITAISGSAALGMSVLLLFFVAGFALTLITPYPADRLI

SEQ ID NO: 90239 - DNA, 1461 bp, Streptomyces coelicolor A3(2)
  CDS (1)..(1461)
atgggcaccgacaccctgcggacggatgcggcggacggggccgacccggccgccgaacggcggcgcgagcagcgtggctggtacttctacgactgggcgtgctccgtctactcgacgagcgtgctcaccgtgttcctggggccctatctcacctcggtcgcggagtcggcggcggacgcggacgggtacgtccacccgctgggcataccggtgcgcgccggttcgttcttcgcgtactcggtgtcgctgtcggtgatcgtggcggtgctggtgatgcctctggtggccgcggcggccgaccgctcggggcgcaagaagccgctgctggccgccgccgcgtacaccggcgccgcggccacgaccgccatgttcttcctcgacggcgaccgctacctgctgggcggcctgctgttggtcgtcgccaacgccgcgcagtcggtcgccatgatgctctacaactcctacctgccccagatcgccccgcccgaggagcgcgacgcggtctcctcccgcggctgggccttcggctacgcggccggctccctggtcctggtcgtcaatctggtcctctacaccggccacgactccttcggactgagcgagagcgcggcggtccgcatctgtctggcgtcggcgggactgtggtggggcgccttcgcgctcattccgctccggcggctgcgcgaccggcgcgcggtggcacgggaggccgcgctgcccgggttccggcagctcgcggcgaccgtccgcgacatgcgccgccgcccgctgacgctggccttcctgctggcgtacctggtctacaacgacggcatccagacggtgatctcccaggcctcggtctacggttccgaggaactggacctcgggcagtccacgctcatcgtggcggtgctgctggtccaggtgctggcggtggcgggcgcgctggcgctcggccggctggcccggaggtacggggccaaacgcacgatcctcgggtcgctggtcgcctggacggtgaccctggcggccgggtacttcctgccggccggggcgccggcgtggttcttcgtgctggccgccgggatcgggctcgtcctgggcggcagccaggccctgtcccgctccctgttctcccacctggtccccccgggcaaggaggcggagtacttctcggcgtacgagctgagcgaccgcgggatgagctggctcgggccgctgctcttcgggctgacctaccagctgaccgggagctaccgggacgcgatcatctcgctggtggccttcttcgttatcgggttcgtgctgctcgcgcgggtcccggtacggcgggcgatcggcgacgcgggcaacccggtacccgaaaggtttagcactcggcgcgaaagggctgtagtgtacgcgtttggcctgccaggcgtaccgttactgcgcgtcaaaggtgccgaatcgctatgtcacatctgccagcagaggtga

SEQ ID NO: 90240 - protein, 486 aa, Streptomyces coelicolor A3(2)
MGTDTLRTDAADGADPAAERRREQRGWYFYDWACSVYSTSVLTVFLGPYLTSVAESAADADGYVHPLGIPVRAGSFFAYSVSLSVIVAVLVMPLVAAAADRSGRKKPLLAAAAYTGAAATTAMFFLDGDRYLLGGLLLVVANAAQSVAMMLYNSYLPQIAPPEERDAVSSRGWAFGYAAGSLVLVVNLVLYTGHDSFGLSESAAVRICLASAGLWWGAFALIPLRRLRDRRAVAREAALPGFRQLAATVRDMRRRPLTLAFLLAYLVYNDGIQTVISQASVYGSEELDLGQSTLIVAVLLVQVLAVAGALALGRLARRYGAKRTILGSLVAWTVTLAAGYFLPAGAPAWFFVLAAGIGLVLGGSQALSRSLFSHLVPPGKEAEYFSAYELSDRGMSWLGPLLFGLTYQLTGSYRDAIISLVAFFVIGFVLLARVPVRRAIGDAGNPVPERFSTRRERAVVYAFGLPGVPLLRVKGAESLCHICQQR

SEQ ID NO: 90241 - DNA, 1308 bp, Chlorobium tepidum TLS
  CDS (1)..(1308): transl_table=11
atgggcatgaacgacacatcgcagaaggcccggattttctcatggctgctgttcgatttcgcgaatacatcgttcagcgtcatgatggtgacgttcgcctttccgctctacttcaagaacataatctgcgagggagaacccaagggtgacgcgctctggggcgcgagcgtcagtatttcgatgctgcttgtggcgctcatctcgccggtgctcggcgcgcaggcggactactcgggccgccgcaaacgctttctcttcgctttcacgctgatatcggtacttgctacggcgctactctctttttccgggccgggtatggtgctgttcgccgcagtgctcttcattcttgccaacatcggctttgagggtggccttgtgttctacgatgcgtggcttccggagatcacctcgccgcgaagcaccggcagggtttccggctacggtttcgcgatgggttacctcggtgcgttcgccatcctcctgatcaatctgccgctgctctcaaaggggattgtgccagccaacattcccaacctgaagctcagtttcctcatcgtcgcgctctttttcgccgtgttctccgcgccgattttcgtgatgctgcgcgacaccaaaggctcggtgggcgattcatccagcggtgagcggcggcgcgagcgcggctcgtcgtttatgcactcgatcaaagaggtcggctacacgatccggcatatcatgagctatcccgatctcgcgcgcttcctgctcgcctactttttctacaacgacgcgatcctgaccgttatcgccttctcctcgatctacgcgcagaacacgcttggattcacgacgggcgaactcatcacctttttcatgaccgtgcagaccaccgccattcttggttcggtggtgtttggctttgtcaccgacaagatcggcccgaagcgtaccatcgttatcacgctctttatctggttcgcggtgattctgctggcgattctttccggaagcaaggagacctttatcatgactggccttcttgccggcatgtcgatggggtcgtcgcaggcagcttcgcgctcgctgatggcgaggctgacgccgaaggagcacgttacggaatttttcggcttctacgacggtagttttggaaaggcgtcggcgatcatcggtcctttggtgttcggtgtcgtttccgcccaagtcggcagccagaaggtcgcgctcgcttcgctgctggtgtttttctgccttggtctcctgattattaccggcgtgaggacgcgagccaccgccgaagcctcaccggaagcctcccggatcgagtga

SEQ ID NO: 90242 - protein, 435 aa, Chlorobium tepidum TLS
MGMNDTSQKARIFSWLLFDFANTSFSVMMVTFAFPLYFKNIICEGEPKGDALWGASVSISMLLVALISPVLGAQADYSGRRKRFLFAFTLISVLATALLSFSGPGMVLFAAVLFILANIGFEGGLVFYDAWLPEITSPRSTGRVSGYGFAMGYLGAFAILLINLPLLSKGIVPANIPNLKLSFLIVALFFAVFSAPIFVMLRDTKGSVGDSSSGERRRERGSSFMHSIKEVGYTIRHIMSYPDLARFLLAYFFYNDAILTVIAFSSIYAQNTLGFTTGELITFFMTVQTTAILGSVVFGFVTDKIGPKRTIVITLFIWFAVILLAILSGSKETFIMTGLLAGMSMGSSQAASRSLMARLTPKEHVTEFFGFYDGSFGKASAIIGPLVFGVVSAQVGSQKVALASLLVFFCLGLLIITGVRTRATAEASPEASRIE

SEQ ID NO: 90243 - DNA, 1311 bp, Oceanobacillus iheyensis HTE831
  CDS (1)..(1311): transl_table=11
atggatgtaaagagtaggaaaaagattcaacgaagctggatgatgtatgattttggaaattcagcatttgccacaaccattatggcagcagtcctaccggtatattattcaaccgttgccgcgtctggattagatgacaatttagcgactagttattggggatattcacaatcaatttccgtgttaatcgtagcaattctagcaccaattcttggtgcaattagtgatttctcggcagcaaagaaaaagtttcttcgtttctttgcttttatgggaattatagctagcttattaatgatgtttgttggagaaggagattatattcttgcatccctactattcatcgttggttccataggcttttcaggtgctaatgttttctatgatggatttttaccagaaattgctgaaaaagatgaaatggataaagtctcctctggtggatttgcttttggttacatcggtggaggaattttacttgccatcaatgttgttatgatactaaaacccgacttattcggtctaccgaatacagagtgggctacaagattagctttagcttctgtaggggtctggtggtttatatttgctataccattattaaaaaatattaaagaagaaaagaagcaacaagttagcagaacgaaatcgtatgtagcaattggattcaacagagtaggtaatacatttcgcgaaataaaacaatacaaacaattagcgatttttctaattgcgttttggttatataacgacggtatttcaacgatcattcgtatggcaacagtatatggaagtgagattggaattgctcaaaatgatttaattatcgcgttattaattacacaatttgtcggcataccatttactttcttctttgggtggttagcgacaaaaattaatcctaaaaatgctctatatattaccttgtttacttaccttggaattgtaattatcggttattttatgaattctgcacttcatttttacttattggcaattattgtaggtatggtacaaggaggagctcaatcccttagcagatcaatctttggaagaatggtaccagccggaaaacatgctgagttttttggtttctatggcatctcgtcaaaatttgccgcagtcgttggaccatttatgttcgctaccattggacatttaaccggcaatagtagacttggtatattatcactgattttcttttttgtagcaggtatcattttattacgatttgtggatatcaataaaggtattttagaagcaaaagaagcatctgaccccaaagatgatgtgattattaaaacgaagtaa

SEQ ID NO: 90244 - protein, 436 aa, Oceanobacillus iheyensis HTE831
MDVKSRKKIQRSWMMYDFGNSAFATTIMAAVLPVYYSTVAASGLDDNLATSYWGYSQSISVLIVAILAPILGAISDFSAAKKKFLRFFAFMGIIASLLMMFVGEGDYILASLLFIVGSIGFSGANVFYDGFLPEIAEKDEMDKVSSGGFAFGYIGGGILLAINVVMILKPDLFGLPNTEWATRLALASVGVWWFIFAIPLLKNIKEEKKQQVSRTKSYVAIGFNRVGNTFREIKQYKQLAIFLIAFWLYNDGISTIIRMATVYGSEIGIAQNDLIIALLITQFVGIPFTFFFGWLATKINPKNALYITLFTYLGIVIIGYFMNSALHFYLLAIIVGMVQGGAQSLSRSIFGRMVPAGKHAEFFGFYGISSKFAAVVGPFMFATIGHLTGNSRLGILSLIFFFVAGIILLRFVDINKGILEAKEASDPKDDVIIKTK

SEQ ID NO: 90245 - DNA, 1374 bp, Corynebacterium efficiens YS-314
  CDS (1)..(1374): transl_table=11
ttgtcgacgaaaaacccgatggcccattctgtccccgagacaggagttacccgctggcttagagtcgtggacatgactgttgccaaacgtccccccgttatctcctgggccttctgggactggggctccgccgccttcaacgcggtcctggtgaccttcatcttctcggtctacctcaccgactcggtgggatcgaccctgccctcgggcaatgccacccccctgtactccatggcggtggccctggccggtgtggtggtggcggtggtcgccccggtgatgggacgacgctccgatatctggggcacccgccgggcatccctgcgtatctggacactggtcaccatcatcctgatgttcagcctctttgccgtgaagaacaccgatccggcgtattactggatcggtgtggccatcatggcggtggccaatgtgaccttcgaattcgcggaggtccagtactatgcccaactctcgcaggtctcgacgccccacaccgtgggccgggtctccggcttcgggtggtcgatgggttatttcggcgggatcttcctcctgctgatctgttatttcgggttcgtggcgggcgagggggacacccgtggtttcctcaacatcccgacagaagagggactgaatatccgcctggtggccgtgttcgccgccgtgtggttcctggtctccgcgctgcccgccctgtttcgcatcccggagatcaccccgcaggccgttgacggccaccaaccccgcggcatcgtggccgcctacgccgacctgttccggcagatcgggaaactgtggcggagcaaccgcaacgcggtgttcttcctcatcgcctcagcggtgttccgtgatggcctggccggggtgttcaccttcggtgccatcctggcggtcaccgtctacgagctctccgcaggtgatgttctgttgttcggggtggcagccaatgtggtctccgcactgggtgccctgctcgggggctttctcgacgaccggatcggccccaaacccatcatcatcgtctccctgctgatcatggtggtggatgtggtgattctctacttcgtggatggaccgcagaacttctggatcttcggcctgatcctgtgtgcgttcgtggggccggcacaatcggcgtcgagaagctttttgacccggctgtccccggaccgccaggagggccagctcttcggcctctacgcgaccaccgggcgcgccgtgagctggatggccccgacgctgttcggactgttcgtggccatcaccggtgaggaccgcgcgggcatctggggtatcggtctgttgctgctgctgggtgcgggcctgttgatggcggtgaaacccccggccagggaagataaccgcaggtag

SEQ ID NO: 90246 - protein, 457 aa, Corynebacterium efficiens YS-314
MSTKNPMAHSVPETGVTRWLRVVDMTVAKRPPVISWAFWDWGSAAFNAVLVTFIFSVYLTDSVGSTLPSGNATPLYSMAVALAGVVVAVVAPVMGRRSDIWGTRRASLRIWTLVTIILMFSLFAVKNTDPAYYWIGVAIMAVANVTFEFAEVQYYAQLSQVSTPHTVGRVSGFGWSMGYFGGIFLLLICYFGFVAGEGDTRGFLNIPTEEGLNIRLVAVFAAVWFLVSALPALFRIPEITPQAVDGHQPRGIVAAYADLFRQIGKLWRSNRNAVFFLIASAVFRDGLAGVFTFGAILAVTVYELSAGDVLLFGVAANVVSALGALLGGFLDDRIGPKPIIIVSLLIMVVDVVILYFVDGPQNFWIFGLILCAFVGPAQSASRSFLTRLSPDRQEGQLFGLYATTGRAVSWMAPTLFGLFVAITGEDRAGIWGIGLLLLLGAGLLMAVKPPAREDNRR

SEQ ID NO: 90247 - DNA, 1251 bp, Lactobacillus plantarum WCFS1
  CDS (1)..(1251): transl_table=11
atgaaatttaataaacagcagtggggttggatcttttacgattgggccaactcgggctatggcattattgtcacaacggcggtgctacccgtttactttaaggcagttgcccaaagtagcggtgtgacaccggctaatgcaacggcttactggggttatgccaatagtattgggaccttactagtttcgattttggcgcccgtcctaggtgcactagcagactatccccatgccaagaaacgaatgctcaacatcttttcgatacttggaatggtgatgacgctagggctgagtgttgccccgactagtgcctggaagtggctattaggtatttatattttatcaattatcggttattccggtggtaatctgttttatgacagttttctgactgacgtggcgccaaacgatcagatggatcgattatcgtcatatggttatgggtttggctatctcggtggtgtcttggcgtttatcttattcttggtcttacaattaaccagtggttttggtcaattatcaagctatggggtcgcgcggtggagttttgtcttagccgctgcgtggtggattatcttttacattcctttgttgaaaaacgttcaccaaaagtacgcgttagcacccagtgcacatccggtgcgttcaagttttcaacgggtatggtcgactttgaaacacatccggaattatcgcgctgcggcgtggttcttggtggcgtacttcttctacattgatggagtcgacacgatctttacaatggcaacttcgattgggatggatatgggaattacgacgaccacgttgatgatcgtcttgctggttgttcagctagtcgcgtttccgttttcactgctttacgggtggttagcgaataaaacgtcgacccggacgggcatcttgcttggcattattatttatttaggtatctgcttgtacgcgttgcggttgaatagtacgacggatttttggattttagccatactagttggaaccagtcagggtgggattcaagcgctcagtcgttcgtacttcggtcgtttgattcctaagactagtgggagtgagtttttcggcttttacaatattctcggtaagttctcagccgtgatgggccccgtcctagttggaatcgtgacccaaatgacggggaagtcaacgattggtgctgcttctttaagtattttatttgttgttggattagtgattttcttggctctaccgcatttgaaccagacaaagtcggtttaa

SEQ ID NO: 90248 - protein, 416 aa, Lactobacillus plantarum WCFS1
MKFNKQQWGWIFYDWANSGYGIIVTTAVLPVYFKAVAQSSGVTPANATAYWGYANSIGTLLVSILAPVLGALADYPHAKKRMLNIFSILGMVMTLGLSVAPTSAWKWLLGIYILSIIGYSGGNLFYDSFLTDVAPNDQMDRLSSYGYGFGYLGGVLAFILFLVLQLTSGFGQLSSYGVARWSFVLAAAWWIIFYIPLLKNVHQKYALAPSAHPVRSSFQRVWSTLKHIRNYRAAAWFLVAYFFYIDGVDTIFTMATSIGMDMGITTTTLMIVLLVVQLVAFPFSLLYGWLANKTSTRTGILLGIIIYLGICLYALRLNSTTDFWILAILVGTSQGGIQALSRSYFGRLIPKTSGSEFFGFYNILGKFSAVMGPVLVGIVTQMTGKSTIGAASLSILFVVGLVIFLALPHLNQTKSV

SEQ ID NO: 90249 - DNA, 1347 bp, Streptomyces avermitilis MA-4680
  CDS (1)..(1347)
atgggcaccgacaccgcgcaggcacggccgaccgacgaggccgccgagcgacggcgcgaacaacgcggctggtacttctacgactgggcctgctccgtctactcgacgagcgtgctgaccgtgttcctcggcccctatctgacgtcggtcgcgaagtcggcggcggacgcggacggctatgtgcatccgctgggcgtcccggtgcgcgccgggtcgttcttcgcgtactccgtgtccctgtccgtgatcgtcgccgtcgtggtgatgcccctggtgggcgcggccgccgaccgcacgggccgtaagaagccgctgctcgcggtgacggcctacgtgggcgctgcggcgacggcgggcatgttcttcctggacggcgaccgctatctgctgggcggcgtgctcctgttggtcgccaacgccgcgcaggccgtctcgatgatgctctacaactcctatctgccacagatcgccccgcccgaggagcgcgacgccgtctcgtcccgcggctgggcgttcgggtacgcggcgggagccctcgtcctcatcgcgaacctggtgctgttcctcgcccacgactccttcggtgtctcggagagcaccgcggtccggatctgtctggcctcggcgggtctgtggtggggcgccttcaccctcataccgctgaagcggctgcgcgaccgcgggtcgcccgtcaaggagatcaccgcccccggaccgcgccggctcgcggcgaccgtccgcgacatgcgccgccacccgctcacgctctcgttcctgctcgcctacctgatctacaacgacggcatccagacggtgatctcccaggcgtcggtgtacggctccgaggaactgggcctgagccagtccacgctcatcgtcgccgtgctgctcgtccaggtgctcgcggtgggcggcgccctgggcatggggcggctggcccggacgtacggcgcccggcgcacgatcctcggctcactggtggcctggacggtcacgctgggcgccggctacttcctgccggccggcgcgcccttctggttcttcgtcctggcgtccgggatcggtctcgtcctcggcggcagccaggccctgtcccgctccctcttctcgcatctggtgcccgccggcaaggaggccgagtacttctcggcgtacgagatgagcgaccgcggcatgagctggctgggcccgctcctgttcggcctgacctaccagctgaccggaagctaccgggacgcgatcatctcgctggtggccttcttcgtggtcggattcgtgctgctcgccagggttccggtacggcaggcggtgcgcgacgcggggaactccgttcccgaaaggatttag

SEQ ID NO: 90250 - protein, 448 aa, Streptomyces avermitilis MA-4680
MGTDTAQARPTDEAAERRREQRGWYFYDWACSVYSTSVLTVFLGPYLTSVAKSAADADGYVHPLGVPVRAGSFFAYSVSLSVIVAVVVMPLVGAAADRTGRKKPLLAVTAYVGAAATAGMFFLDGDRYLLGGVLLLVANAAQAVSMMLYNSYLPQIAPPEERDAVSSRGWAFGYAAGALVLIANLVLFLAHDSFGVSESTAVRICLASAGLWWGAFTLIPLKRLRDRGSPVKEITAPGPRRLAATVRDMRRHPLTLSFLLAYLIYNDGIQTVISQASVYGSEELGLSQSTLIVAVLLVQVLAVGGALGMGRLARTYGARRTILGSLVAWTVTLGAGYFLPAGAPFWFFVLASGIGLVLGGSQALSRSLFSHLVPAGKEAEYFSAYEMSDRGMSWLGPLLFGLTYQLTGSYRDAIISLVAFFVVGFVLLARVPVRQAVRDAGNSVPERI

SEQ ID NO: 90251 - DNA, 1284 bp, Bacillus anthracis str. Ames
  CDS (1)..(1284): transl_table=11
atgaaaaaaatgtccagacaagaaaaaagctggatattatacgattgggcgaactcggtatattcgctcgtcattacaactgcattattcccaatttactttaaagcagctgcaaaagaagctggactatctggtgcaacgtcaacagcatattggggatatgcaaactcattcgctacacttttaatttctatacttgcccctattctcggcacagttgctgattataaaggatttaaaaaacgatttttcacattcttctttggactcggcattgtatttacaagtatgttagcagtcgtcccaacatctcagtggtacttattgctaggatgctatatgctcgcattagtcggttttgctggagcaaacattttttatgacgcatttttagtagatgtcacttctgaagatagaatggatcgaatttctacgagaggtttcgctttaggctatattgggagtactattccatttatcggttgtatcgctcttatcattcttgctcaaaaaggaactatccctttatcagtcggcattgctagtcaaatttcattcgcgataaccgctctttggtggggactattcacaattccaatgctgaagaacgtagagcaaacacattatattgaacgtcacccaaaaccaattgcaatgagcttcaaacgccttgctgatacttttaaaaatattaaagaatataaaacggtctttatgtttctaatcgcttactttttctatattgatggggtcgatacaattattactatgtctaccgcttatggaacagatctcggcattagtgcaacgaatctattaatcatcttattcgtcacacaaattgtagcttgtccatttgctttattatacggaaaattatcaacaacatttacaggtaaaaaaatgctatatgtcggtattattatttacatcattatctgcatatatgcttatttcttaaaaacgacactcgatttctggattttagcaatgctagttgctacttctcaaggtggtattcaagcacttagtcgttcctattttgcaaaactagtacctaaagaatctgcaaatgaattttttggattttataatatatttggcaaattcgccgcgattatgggtccagtattagtcggtgttacaacgcaattaacaggaaaaacaaacgctggtgttcttagtattattgtattgtttattatcggtggatttttattaactagggtccctgaaaataatacatccgttacaccacctaatccgaaaactaaaacgctataa

SEQ ID NO: 90252 - protein, 427 aa, Bacillus anthracis str. Ames
MKKMSRQEKSWILYDWANSVYSLVITTALFPIYFKAAAKEAGLSGATSTAYWGYANSFATLLISILAPILGTVADYKGFKKRFFTFFFGLGIVFTSMLAVVPTSQWYLLLGCYMLALVGFAGANIFYDAFLVDVTSEDRMDRISTRGFALGYIGSTIPFIGCIALIILAQKGTIPLSVGIASQISFAITALWWGLFTIPMLKNVEQTHYIERHPKPIAMSFKRLADTFKNIKEYKTVFMFLIAYFFYIDGVDTIITMSTAYGTDLGISATNLLIILFVTQIVACPFALLYGKLSTTFTGKKMLYVGIIIYIIICIYAYFLKTTLDFWILAMLVATSQGGIQALSRSYFAKLVPKESANEFFGFYNIFGKFAAIMGPVLVGVTTQLTGKTNAGVLSIIVLFIIGGFLLTRVPENNTSVTPPNPKTKTL

SEQ ID NO: 90253 - DNA, 1227 bp, Geobacter sulfurreducens PCA
  CDS (1)..(1227): transl_table=11
atgatccgccccgcctggctcacccgccccagtctctcctgggcactctacgacttcgccaacacaatcttctccatgagcgtggtgacgctctatttccccttgttcctcgtccagaccctgggctaccgcgagtactggctctccctggggctatcgctctccatgggacttgccgccgtggccagccccttcgtggggagcgcctccgatcggcgcatcggcaaaaacgtgatactggcggtcgccacatccctctgctgcatcgcaacccttctcattcccgcgtcggggcatctggcaggcgtccttgccgccttcgtggccgccaacttcctctaccaggtatccctcgtggcctacgattcactcctcccttcggccaccgacgaagggcactatggaccggtatccggattcggcgttgccctgggctacatcggaacgttcctggcgttgatcatcggcaaactcttggtgaccaccccggcggacaatggccgggtattcctgcccacggcgatctgctttctccttttcgccctgccctgcttcttcgtcaaagacctgaaacgcagccaaacctccccgatccgggttgccgacacggcccgggaaatcatccgcgaccgggacctgcgctggtacttcgccggccacctgctctacctggacgcggtgaacaccgtgattgccttcatggccgtctttctggtgaaagtgggagggttctcccaggaagcgggggaagtgaactatttcctcatgttctcgaccatcttcgcggtcatcggcggtctcttctgggggtggctcgtgcgacgccggggggcgcgggtggggctcctggcgacccttgccctctggatcgtcgccctcggcatggtctgcctgccactggccaaggaacactactggatactgggtcccctttccggcatcgccctgggaggggtctgggcgtgcgaccggccgctgctcctggacatggtcccccgggaacgggccgggagcttcttcggcttctactacctcaccggcaagttctcgtcggtggtgggaccattgctgttcggcgccatcctcgcgctccccctcggcaccgaggcgatccgctaccggctcgccttcttctcgctgcttatcatggtaatcgtcgccacggcctgtatcgcccgcatccgcccgaagcaggccgcgccgcagcttcaggccggcgacccgtga

SEQ ID NO: 90254 - protein, 408 aa, Geobacter sulfurreducens PCA
MIRPAWLTRPSLSWALYDFANTIFSMSVVTLYFPLFLVQTLGYREYWLSLGLSLSMGLAAVASPFVGSASDRRIGKNVILAVATSLCCIATLLIPASGHLAGVLAAFVAANFLYQVSLVAYDSLLPSATDEGHYGPVSGFGVALGYIGTFLALIIGKLLVTTPADNGRVFLPTAICFLLFALPCFFVKDLKRSQTSPIRVADTAREIIRDRDLRWYFAGHLLYLDAVNTVIAFMAVFLVKVGGFSQEAGEVNYFLMFSTIFAVIGGLFWGWLVRRRGARVGLLATLALWIVALGMVCLPLAKEHYWILGPLSGIALGGVWACDRPLLLDMVPRERAGSFFGFYYLTGKFSSVVGPLLFGAILALPLGTEAIRYRLAFFSLLIMVIVATACIARIRPKQAAPQLQAGDP

SEQ ID NO: 90255 - DNA, 1179 bp, Bdellovibrio bacteriovorus HD100
  CDS (1)..(1179): transl_table=11
atggctgcatttttcccggtctttctgaagcaatattggagcgtcggcactgacgctgtcgtgaccacggcccgcctgggcgtcactatttccgtttcaagtctggctattgccttgatgagccccactttgggcgttatcgcggacatgaagggctacaagaagctcttttgcatgctcttcactttgattggtgttgtgggctgtgcgtggatggggttcattccgcaaggggactgggtcagtgctctgtgggcttatggtatcacactggcggcgtttaatgcggccagtgttttttatgattcgcttcttccttacgtggcggaacacaagtacatggactttgcttcgtcgctgggatactcgctggggtatctgggcggcggggtgctgttgctgctgaatgtgctgatggcgctttatcctcttagttttgggatcccggatgcgactgtggccaccaaactttcgttcatgattgtttcggtgtggtggctggcgttttcccttccgctgatgaagaacgtgcctgaaccggaagcggaaagatccgtgaaaggccttggaaccttgacgctggaaagcctgcgcacactgaaaggcactctgaaagccctgatgaaggaacgcaacctgtttatgttcatggtggcttactggctttacatcgacggcgtctacaccgtgatgaccatggcggtggattacggaatttcgatcggttttgaatccaaggatttgattgctgcccttttgatcacgcagtttattggattcccttgtgcttatttcttcgggactttgaccaaacgctggggggcgaagatgcccattctggtttgtatcgtggtgtatggggtgaccgtgattgccgccacccagatgaagacggcgacgcatttctatttgctggcgacggtgataggactggtgcagggtggggtgcaatcgctcagccgttccatgtttggccgtatgatccccaaagaggccagtggagagtattttggtttgtttaaccttgtgggccgttttgcctcgatcctgggtccactgctggtggctgcgggggcgatgcttagcggaagttcacggtggggcatggtgggattgttgatcctattcgtttctggcggtattctgctggcgatggtgaaagagcctcgcgaagcctaa

SEQ ID NO: 90256 - protein, 392 aa, Bdellovibrio bacteriovorus HD100
MAAFFPVFLKQYWSVGTDAVVTTARLGVTISVSSLAIALMSPTLGVIADMKGYKKLFCMLFTLIGVVGCAWMGFIPQGDWVSALWAYGITLAAFNAASVFYDSLLPYVAEHKYMDFASSLGYSLGYLGGGVLLLLNVLMALYPLSFGIPDATVATKLSFMIVSVWWLAFSLPLMKNVPEPEAERSVKGLGTLTLESLRTLKGTLKALMKERNLFMFMVAYWLYIDGVYTVMTMAVDYGISIGFESKDLIAALLITQFIGFPCAYFFGTLTKRWGAKMPILVCIVVYGVTVIAATQMKTATHFYLLATVIGLVQGGVQSLSRSMFGRMIPKEASGEYFGLFNLVGRFASILGPLLVAAGAMLSGSSRWGMVGLLILFVSGGILLAMVKEPREA

SEQ ID NO: 90257 - DNA, 1716 bp, Eremothecium gossypii
  CDS (1)..(1716)
atggcgcgagaggatatggatcgcgggagcagctggatcaaggagacagagggcgggtcgcagacgtctgggccaagcaagggcgctgacatgcaggtgtcagtgacgctggacgagcagcagccgctagtgggcgggcagcgcgccgacgaggaggtgctggcgcggtggcggggccggtgggtatttcctgcatggctccttgtgtgcttttcgaccgggccgacctacgtgatgatgcgttcttttgtgcctgcgtcgttacagaccatcgcacacgagctcgggcaccccaaggggcaccccgccgcgcactgccgcccgcgcggcgatgactgctacatctacgtgggcggaagggacgtgcagttcacggcatatgtgctttatatgcgggcgttgtacacgtccatcgagggcctcattgcgattgtgctcatgggtttggcggacttttcaaactaccgcaagtggctcatgacgctgtcgattgtaatgtacggcgcacttgccacgccgtttgtcagccagggtagcaagacctacggcgcgctcattttgatgtcggtgctgtactgcttgatgctctgctgtaacactatatacaccatcacggagggctcgtacatcccggtcttcatggacatggcgcgcctcgccgcggcgcgcgacgccgccagtgccaagctgggcgatggcgtcgaggagcgcacggcgggggagcccgtcaacccgatgttgcgtcggggagccaaggtcagcgtgctcggcttgatcatgggcaatctcggctcgatcgtggccggtctcgtcgggatcatcatcacgtactcccgcggaaagccgcaggcggagggctactcggccttcctcctcacgatcaccatcgccggctgcgcgaccattgtgctcggctccgtcgcctcgctcggcatccccgccatacacggcagcaggtttcccttcgatccgcaggagaataagctcatcaccatctgcaagttcccgttccggcgcttcatgtacattctcagggacttgacgcactaccgcgaggcgttcaagtacgtcgtcgcgtgggtgctctggaacatcgcctactcgaacttcatgcaattgttccagctctcgttccgcgccacgttgggcagcaccgcggacaaggagtacttcgtgtggcagctaatgacctcggtcatcgcctgtgtcggctcgctcacgtggatggcggtgttccgccacttcagcgcgcgccgcacgttgcgcgcgcagacgcagctcctcaagacctgcttgtacgcgatgatggccgcgggcgtcgtagtcaacttctggggctcgctcggagcctcgtcccgcgtgcccatcggcttcaagcaccgctgggagttctggttcttccaggtcatctacgtcagcaccagcagcgccatccgttcgcttaaccgcgtcgcctactccgccatgttgcccgccggccgcgagaaccagtacttcggcctggagatcatgcttggcttggccacgggctggtcccagtcgctcctcgtcagcgtcatccaggaccgcaccggcaacgcccgcttcccctacatccccaacaccctgctcctgatcgtttcgctcggcttctactactggtccgacctcagccacggcatgctcgccgccggcaaggccgagctccaccgcgccgccccgcaggacgcatcgtga

SEQ ID NO: 90258 - protein, 571 aa, Eremothecium gossypii
MAREDMDRGSSWIKETEGGSQTSGPSKGADMQVSVTLDEQQPLVGGQRADEEVLARWRGRWVFPAWLLVCFSTGPTYVMMRSFVPASLQTIAHELGHPKGHPAAHCRPRGDDCYIYVGGRDVQFTAYVLYMRALYTSIEGLIAIVLMGLADFSNYRKWLMTLSIVMYGALATPFVSQGSKTYGALILMSVLYCLMLCCNTIYTITEGSYIPVFMDMARLAAARDAASAKLGDGVEERTAGEPVNPMLRRGAKVSVLGLIMGNLGSIVAGLVGIIITYSRGKPQAEGYSAFLLTITIAGCATIVLGSVASLGIPAIHGSRFPFDPQENKLITICKFPFRRFMYILRDLTHYREAFKYVVAWVLWNIAYSNFMQLFQLSFRATLGSTADKEYFVWQLMTSVIACVGSLTWMAVFRHFSARRTLRAQTQLLKTCLYAMMAAGVVVNFWGSLGASSRVPIGFKHRWEFWFFQVIYVSTSSAIRSLNRVAYSAMLPAGRENQYFGLEIMLGLATGWSQSLLVSVIQDRTGNARFPYIPNTLLLIVSLGFYYWSDLSHGMLAAGKAELHRAAPQDAS

SEQ ID NO: 90259 - DNA, 1524 bp, Eremothecium gossypii
  CDS (1)..(1524)
atgagttacgaaactatacccacgagcgatgagaactttgaccgagatgtctcggctacgaatcgcaatgtatttggatggtacctgtatgcgttctcgagcgagcccttcatagtgtcggcgatgtcgacatactttccgctgctactcgaggagtttgcacggaacaacggcgtacaggtcgacgatcacacagtggcgtgtggagcggaggacaagcactgtgtattgcccctttttgggcggagggtgtttgtagatacatcgagcttcgcgctgtacacgtttgcactcggggtgctgctgcagacggtgctggtgatcagtgtttccggtgtagtggacgtttgcaagacagtacgcttcaagcgcaatgtgctgctttctttcgggatggtcggtgggctggccacctgctcgaccgtgctgctgcggggaaaccagtactacatcttggcgctgctgacggtgatttcgaattgctgttacggggtgatcaacgtggtcggcaactcgcttttgccggatgtggtttctgacttgaagcgcgtgctgtatctatacagagtcatagattccgaccagttgacgacagtgatcagcgggcgcgggagtggcataggttacattgctgcatttgtggtacagctatgctcggtgtggttattgaggcagcccgagtatcgtgacgatatcagagtggcggtgctgcttgtgggcggctggtggatgctcttccaattgcctctgatttggatgttggatgatgttgtggtacgcgagaatagcacgcagttcaagtggagccggtcgcggcagtacttgaaagccggatggcagtcgcttggacatgctgctatgcatgctaacttgctgaaagatgtgctgatctttctcgttggatggtttatcatcagcgattccattacaaccatcaattccgcagcgattctattttccaagacagagcttcacatgagtactgttaacctagtcgtcattagcattctcacgatgataaatgctgtcatcggcgcatattttgtcccacaactcctctcagaacggttggagctaccgccacaccagtcgttgatatatctcatctgctgggcaggcgtcattccattttacggaaccttaggttttgtctttcaaagtattggactaaagcatccctttgaaatgtatatacttgctgtttggtatggcatttccatgggaggtttggcagctgtttcaagatccgtgttttctcttctcattcctaggggtaaggaatctacatttttcagtttattcagcattacagacaaggggtcttcggttgttggccccttactcattggcctaataactgacaagactcacaacatcagatactcattctacttcctgttcttgtttgttgtagcatcaattccagttttcaatgcgctaaatgtacaaagaggcaaagtggaagcagaagaactagcggggataaatgagagtaggctggagacaaatgatgggtttgcttaa

SEQ ID NO: 90260 - protein, 507 aa, Eremothecium gossypii
MSYETIPTSDENFDRDVSATNRNVFGWYLYAFSSEPFIVSAMSTYFPLLLEEFARNNGVQVDDHTVACGAEDKHCVLPLFGRRVFVDTSSFALYTFALGVLLQTVLVISVSGVVDVCKTVRFKRNVLLSFGMVGGLATCSTVLLRGNQYYILALLTVISNCCYGVINVVGNSLLPDVVSDLKRVLYLYRVIDSDQLTTVISGRGSGIGYIAAFVVQLCSVWLLRQPEYRDDIRVAVLLVGGWWMLFQLPLIWMLDDVVVRENSTQFKWSRSRQYLKAGWQSLGHAAMHANLLKDVLIFLVGWFIISDSITTINSAAILFSKTELHMSTVNLVVISILTMINAVIGAYFVPQLLSERLELPPHQSLIYLICWAGVIPFYGTLGFVFQSIGLKHPFEMYILAVWYGISMGGLAAVSRSVFSLLIPRGKESTFFSLFSITDKGSSVVGPLLIGLITDKTHNIRYSFYFLFLFVVASIPVFNALNVQRGKVEAEELAGINESRLETNDGFA

SEQ ID NO: 90261 - DNA, 2214 bp, Neurospora crassa
  CDS (1)..(2214)
atggccaaaatttcggggttgtgcgtttttaaatggtacccactgtacgcctatcaatgccctgcaacgggccctagcgtacaactaaagtacagcgcaatgacaccacggcacaacaacaacgtgaaccacgtctacaatggacctgacatccagtgggaggacgaatctctccgaccgccaccagctccgcgactcttttcccgttcatcctacgcatcctacgcgtccaaggcctccaagcgatccttctactcgtacacttcgtcgtgcttcgaagccgacgacgagcgatccgacactctctcgtttgccgactggatcaccaccaccatgtccggcaggatgagtcctgccaacgccggcgacaacagcgattcctacccatacggcgacgacactgacggcgacagcagcagcggcctgcctcccccacgataccccggtgacgacactcgccccaccagccaaaaggaactcgcgggatggtatgcctatgcctttgctgctgaggtctatgttatttgcggtatcggttccttcatcccaattctcctcgaaagtctagctcgcgaaaatggcgtcctcctctccgaccgatcgaaaccctgcggttccagctccgacaagcataccacctctgccgaaggacaatgtgtcgtctacgtactgggcatggaaatcaacacggccagcttcgccatgtacacgttcagcgtcagcgtcctgctgcaagccttgttggtcgtcagcatcagttgcgccgcggaccatggcaactttcgaaagaagctgctacttgccttcgcatggattggcagcgcgtgtgtgatggcctacatcttcattagcaagagcacttatctcattggtgctctgctggccatcatctcgaatacctcgttcggcgcctcctttgtgctgctgaactcgttcttgccgcttttggtcaggcatcaccccgagatcgatcaggttggcgactatggctcgccagggtatgcgactaccgaagagggcgatgatgaggacgatgagtaccaggaggatagcacgcgcaactcgacgactgccttgcttggaagccgaagatacgaggagggcgaaccgctttcccgagttcagacgaccgaggagttgacgtctcgcgaactggaactgtccacgcagatctcagccaagggcattggcatcggctacattgccggcttgttcctgcagtgcgtggccatcgccattctgatcacactgaagaacaccacttggtcgcagcggattgtactttgcgttatcggtgcatggtgggccatcttcaccattccagccgccatgtggttacgaccacgtccgggacctcccctacccaccaaatccaacaccggaggcattcgcgccttgttccactacaccatctacgcctggaagtccctgttccgcaccatccatctcgcccggcgcctcgtggacattgttctcttcctagctggctggttcttgctttcggatgccattgctacgacctcgtcgaccgccattctctttgccaaaacccaactccacatggaaccctgggctctgggcatgatcaacgtcatttccaccgcctcgggcatcttgggcgcattctcgtggtccttcatctcccgaaaattccgcctcaaagcccatcaaaccatcttggcatgcatcgccctctttgagctcatccctctctacgggcttatgggctatctcccctttgtccaagcatggggcgtcggtggcttgcagcagccatgggagatgtaccccctcgccgccatctacgggtttgtcctcggcggcttgtcaggctattgccgctctttgtacggagaactcatcccgcccggatccgaggccgctttctatgctctttatgctatcaccgataaagggtcgagcgtgtttggaccggcgattgtgggggcgattatcgatgcgagcggggagatcaggccggcgttttggttcttggctgcgattgtgggcacgccggcgctgtttatttggtttatcaatgtggagagggggaggacggagggagaggcgttggcagagattattgaggggttcaagatgaacggacagaatgggctcaacggaaatggggcggatggactggcggacgataggagagggagtgatgcgagtagggcgattttggggaggtatgatgatgaggatgaggagtga

SEQ ID NO: 90262 - protein, 737 aa, Neurospora crassa
MAKISGLCVFKWYPLYAYQCPATGPSVQLKYSAMTPRHNNNVNHVYNGPDIQWEDESLRPPPAPRLFSRSSYASYASKASKRSFYSYTSSCFEADDERSDTLSFADWITTTMSGRMSPANAGDNSDSYPYGDDTDGDSSSGLPPPRYPGDDTRPTSQKELAGWYAYAFAAEVYVICGIGSFIPILLESLARENGVLLSDRSKPCGSSSDKHTTSAEGQCVVYVLGMEINTASFAMYTFSVSVLLQALLVVSISCAADHGNFRKKLLLAFAWIGSACVMAYIFISKSTYLIGALLAIISNTSFGASFVLLNSFLPLLVRHHPEIDQVGDYGSPGYATTEEGDDEDDEYQEDSTRNSTTALLGSRRYEEGEPLSRVQTTEELTSRELELSTQISAKGIGIGYIAGLFLQCVAIAILITLKNTTWSQRIVLCVIGAWWAIFTIPAAMWLRPRPGPPLPTKSNTGGIRALFHYTIYAWKSLFRTIHLARRLVDIVLFLAGWFLLSDAIATTSSTAILFAKTQLHMEPWALGMINVISTASGILGAFSWSFISRKFRLKAHQTILACIALFELIPLYGLMGYLPFVQAWGVGGLQQPWEMYPLAAIYGFVLGGLSGYCRSLYGELIPPGSEAAFYALYAITDKGSSVFGPAIVGAIIDASGEIRPAFWFLAAIVGTPALFIWFINVERGRTEGEALAEIIEGFKMNGQNGLNGNGADGLADDRRGSDASRAILGRYDDEDEE

SEQ ID NO: 90263 - DNA, 2040 bp, Magnaporthe grisea 70-15
  CDS (1)..(2040)
atggcgcctcgcaaccctgaactgccgccgacgcccttgcgccatccacaaccgcagaggccgacaattccacgcctgttctccaggctatcccacgcctcaaagcggtctttccgctcgtattcttcatcgttcgaggccgacgacgaacgctcaggaagtgattcgcgatcccaatttgactccgactccgactccgacatggatacctcgacggaaaggggacagagccgcgagcgccgctgccggcgctcgtatggtggtgaacaatacgcagacgaggacaccagaccgacgagcgaaaaagagcttgccggctggtacatgtactcttttgcggcggagacgtatgtgatctgcgccatcagctccttcatcccaatcctactcgaaagtcttgcacgagaaaacggtgttctcctcaaggatagaacatcgccctgtaaagcaagctacgacaagactccagatggcgggaatgacgacaaccagtgcgtggtccacgtgttgggcatggaaatcaacaccgccagctttgccatgtatacctttagcgtcagtgtcttgttgcaggcactgttggtcgtgagcataagctgcgctgctgatcacggaaactatcgcaagaagctgctgctggcttttgcttggattggcagcttcagtgtcatggcctacatattcgtcagcaaggagatctatctactaggcgcaattcttgccattatctccaatacctcatttggcgcctcttttgtcctgctcaactcgtttctccccttgttggttaggcaccatccgaggattgagtacgcggagccggcgaccggcgacgacctcgacttcgagtcagaggatcaaatgcgaaactcagcctcgcacctactagcagatgagcacgacgatcactatgcgctgtctagggtccacaccaaggaagagctcacctcgatcgaattgcagctatcgaccgagatctcagccaagggcattggtatcggctactgtgctggtctatttgtccaatgcattgccattgccattgtgttcaagctcaagaactcgacttggtcccagagagttgtgttattatttgtcggagcctggtgggctatattcactattcctgccgcaatgtggctcaggccaagaccagggcctccgctacctgcggcgtcagaatcgagccgtggtggcgtggccgcttttgtttcttacactttatacgcatggaaggcactgtttcgtactgtttctctggcacggcgtctgatagacattgtgctgtttctcggcgcgtggttcctcctctctgatgccattgcgaccacatcgtccacggctatcttattcgccaagacacaactacgtatggaaccttgggcactcgccatgatcaacgtgatctcgacaacggctggtattgcaggtgcattttcttgggccttcatctcgcggcgactcggactcagaccccatcagacgatcctagcgtgcatagtactgttcgagcttattccactatatggactaatgggctacctcccgtttgtaaagaactggggtgttctgggtctgcaaaagccgtgggagatgttcccactcgcggcggtgtatggattcgtgctgggaggactgagtggatattgtagatccttgttcggtgagctgatcccgcctggatccgaggcggccttttacgcgctatacgccatcacggacaagggctcaagcattttcggacccgccatcgtcggagccatcatcgatgccacagaggagattcggccggctttctggttcctggccgtcatggtggggcttcctgcgccgctgatttactttatagatgtcgaccggggcaaggtcgaaggtgagaagcttgcggcggtcattgagggctatcgcaggcatcaggatgaatctttcgatgatggccgattcccaagcgatgacgacgatgatggtcgagggcccatccttggagggcgcgatgacgaggatgaacatgacacggagcgtgaagtcagggggagatag

SEQ ID NO: 90264 - protein, 679 aa, Magnaporthe grisea 70-15
MAPRNPELPPTPLRHPQPQRPTIPRLFSRLSHASKRSFRSYSSSFEADDERSGSDSRSQFDSDSDSDMDTSTERGQSRERRCRRSYGGEQYADEDTRPTSEKELAGWYMYSFAAETYVICAISSFIPILLESLARENGVLLKDRTSPCKASYDKTPDGGNDDNQCVVHVLGMEINTASFAMYTFSVSVLLQALLVVSISCAADHGNYRKKLLLAFAWIGSFSVMAYIFVSKEIYLLGAILAIISNTSFGASFVLLNSFLPLLVRHHPRIEYAEPATGDDLDFESEDQMRNSASHLLADEHDDHYALSRVHTKEELTSIELQLSTEISAKGIGIGYCAGLFVQCIAIAIVFKLKNSTWSQRVVLLFVGAWWAIFTIPAAMWLRPRPGPPLPAASESSRGGVAAFVSYTLYAWKALFRTVSLARRLIDIVLFLGAWFLLSDAIATTSSTAILFAKTQLRMEPWALAMINVISTTAGIAGAFSWAFISRRLGLRPHQTILACIVLFELIPLYGLMGYLPFVKNWGVLGLQKPWEMFPLAAVYGFVLGGLSGYCRSLFGELIPPGSEAAFYALYAITDKGSSIFGPAIVGAIIDATEEIRPAFWFLAVMVGLPAPLIYFIDVDRGKVEGEKLAAVIEGYRRHQDESFDDGRFPSDDDDDGRGPILGGRDDEDEHDTEREVRGR

SEQ ID NO: 90265 - DNA, 1974 bp, Gibberella zeae PH-1
  CDS (1)..(1974)
atggcgccaaaccttcaacctcaacctcagtctcaacttcagcgtccgcgtctgaaagatcacagaccgtggtcaggactctcaaatatctcaaaacggtcttttagatcttgcgcaacttctgctttcgaggccgacgacgagcgatcctccagcgacggcgatatgagccctcgcaatagtgaggctgacctgcgacggccagtcgtgccgcgtcactttggccatgatgctcgtccgacaagccggagagaacttctaggatggtatgcgtatgcgttcgccgccgaaacatacgtgatttgtggaattgcttcctttatccccatactgctcgaaacgctcgccagagagaacggtgtgcttgtttctgaccgaaaaacaccatgcgggtcgagtgatagtaaaaacgatggcgatggacaatgtattgtctgggtgttcggaatggagatcaacactgccagctttgccatgtacaccttctcagtgagcgtcttagtccaagccctgcttgttgtaagtatcagctgtgctgccgaccatggaaactaccgcaagaagcttctcctcacttttgcttggattggaagcttcgcggtcatgtcctacattttcatcaccaaagacaactacatcctcggtgctctcttgaccgtcatttccaacacctcctttggcgcatcgtttgtattactaaactccttcctcccattgcttgtgcgataccaccccgatgttattgaggccaatgttgccactaccccggatctcggcagctcggaatttgagtcacgtcctctggatcaatcagtaggtcaacttgagtcatcaccagttacagcaacgtcacctctgttacatcccgaggatggcggacgactaaagcccactgcaagccatgcagagataacatccaaagagctagagctatcaacgcgcatatcagcgattggaatcgggactggatatatcgcagcgctgtttctacaatgtatttgtattggcgtcctcatctcgctgcacaatacaacatggggccaaagagttgtgttgttcatggttggagtctggtggacagttttcactattcctgctgccatgtggttgcgaccccgtcctgggcctcccctagcagacaatggccggaaaggtatcatggcaggactcgcatacatcctctacgcctggaagagtctcttcaaaacaattcagcaggctagacgtctgttggatattgttttgttccttgctggatggtttctattgtctgatgcaatcgcaaccacgtcatccaccgccattttgttcgccaagacccaactccacatgaagccatgggcacttggtatgatcaatgtcatttcaacgactgcaggggtcttcggcgcgttcggatggtcgtgggtatcgcgactattcaatctcaaagcccatcagaccatcctcgtttgcatcgcgttatttgaactgatccctctgtacggtctactaggatatctcccatttgtcaaaaactggggagtttttggactccagcaaccatgggagatgtacccgttggctgctgtgtatggagtcgtccttggaggcttgagtggttactgtcgttctctatacggcgagctcattccacctggatccgaggcggccttctatgcgctttacgccatcacagacaagggctccagtgtttttgggccgacaattgtgggcgccattattgacaggaccggcacaatacgtcctgctttttggttcctcgcagttttagttggctttccggcgcccctgatatggttcattgacgttgaacgaggcagacgggaaggcgccaagcttgcaaagtccatcacagactctattgtacaagaagaggatgaaagtgacgatggagctgagcgccgtggaatgttgtcagattatgagagagaacatggacaaagcattgatgatgagcgtgcaggtcgctga

SEQ ID NO: 90266 - protein, 657 aa, Gibberella zeae PH-1
MAPNLQPQPQSQLQRPRLKDHRPWSGLSNISKRSFRSCATSAFEADDERSSSDGDMSPRNSEADLRRPVVPRHFGHDARPTSRRELLGWYAYAFAAETYVICGIASFIPILLETLARENGVLVSDRKTPCGSSDSKNDGDGQCIVWVFGMEINTASFAMYTFSVSVLVQALLVVSISCAADHGNYRKKLLLTFAWIGSFAVMSYIFITKDNYILGALLTVISNTSFGASFVLLNSFLPLLVRYHPDVIEANVATTPDLGSSEFESRPLDQSVGQLESSPVTATSPLLHPEDGGRLKPTASHAEITSKELELSTRISAIGIGTGYIAALFLQCICIGVLISLHNTTWGQRVVLFMVGVWWTVFTIPAAMWLRPRPGPPLADNGRKGIMAGLAYILYAWKSLFKTIQQARRLLDIVLFLAGWFLLSDAIATTSSTAILFAKTQLHMKPWALGMINVISTTAGVFGAFGWSWVSRLFNLKAHQTILVCIALFELIPLYGLLGYLPFVKNWGVFGLQQPWEMYPLAAVYGVVLGGLSGYCRSLYGELIPPGSEAAFYALYAITDKGSSVFGPTIVGAIIDRTGTIRPAFWFLAVLVGFPAPLIWFIDVERGRREGAKLAKSITDSIVQEEDESDDGAERRGMLSDYEREHGQSIDDERAGR

SEQ ID NO: 90267 - DNA, 1590 bp, Gibberella zeae PH-1
  CDS (1)..(1590)
atggcctcacattcagattcagtgacggcaaaccccaaagatgtgcatgatgatcctgtcaagcaggacgttggtacaggcgttatagtgcccaccttggcagaaggcgatatgcctacaacctccaagtgggaaatctggagttggtacgcctactacatcggtgccaatggactcgcccttttcaactttggtccaactgcttttcaaaacctgctttcacaggcggcgccaaaagataccggtcttttacctttcgctggccgtgaacgagatgtcaacagtatcgttctactcgccaatggcatatcattcgctctacaagccgttctcttcctcatcatcggagcatatgcagacttcggaagtggacgacgatggattttggtggtatggtcaattattgcctacggaatcgggtttgggtggctgggagttcacgaccccagtaaatggcagacagcgacaggcttgtacatcgtcggtctgatcgcgtaccagatgacgctcacatactggacggcagcattcccctctcttgcacgaaacacacctcaacttaaggaagcagcgctgcaattcgagtcgggtgacatcacgcaacaagacatggaccgaaaggacgaaatggaaaggagcagactcagcaacgtcgctttttacatccagtccgttggtgaagttgtcatcttggctatgatcgtgggtgtcatgttcggcgtcaaagttgacaagagtccagagaacaataactggggactttcagtactgatagcatttgcaactgcttgttggctcgtactctcaatcccttggtttctcatcgagaagaaacgtcccggcatgaaggtccccgatcacttgaacattgttacagtcgggttctggcagctttgggaggctctcacgcaaatctggcacttgaagcagagcttgatctaccttgttgggtatttcctcctgggagactccctcaacactactgtgacggtcatcggcacactacagaaccaggttgtcagttacgagactctgactctaacctaccttctcatcgtcggcattgttgctcaagctgtcggaattggtgctttctggatgatccagaagaaattcaatcttagcgtcaaagccatgttcaacgccgtcatggtcttcatcatccttttagatggatggggcatggttggaaactggaccgataagttcggtttcaagaatgtctgggagatttggctataccaagcattttacggactcttcgtttgtccatggtacagctactctcaaatcatgatcagctctgtcacgccccgaggccacgaattccttttcttctctctgttcaacattattggcaaatcctcaagcttcatcggaccatttatcagcagtgctattatcgatgctactccaggaggcaccaacaatagcgcccccttctatttcttgtttgctctgagcttggttagcgcagttggcatctggtcgtttttggatctggagaagagtgcaagggagcaagaggcatttattatagaagagaaaatccgcatgggcgaggactctgatgccagcaaaaccaattag

SEQ ID NO: 90268 - protein, 529 aa, Gibberella zeae PH-1
MASHSDSVTANPKDVHDDPVKQDVGTGVIVPTLAEGDMPTTSKWEIWSWYAYYIGANGLALFNFGPTAFQNLLSQAAPKDTGLLPFAGRERDVNSIVLLANGISFALQAVLFLIIGAYADFGSGRRWILVVWSIIAYGIGFGWLGVHDPSKWQTATGLYIVGLIAYQMTLTYWTAAFPSLARNTPQLKEAALQFESGDITQQDMDRKDEMERSRLSNVAFYIQSVGEVVILAMIVGVMFGVKVDKSPENNNWGLSVLIAFATACWLVLSIPWFLIEKKRPGMKVPDHLNIVTVGFWQLWEALTQIWHLKQSLIYLVGYFLLGDSLNTTVTVIGTLQNQVVSYETLTLTYLLIVGIVAQAVGIGAFWMIQKKFNLSVKAMFNAVMVFIILLDGWGMVGNWTDKFGFKNVWEIWLYQAFYGLFVCPWYSYSQIMISSVTPRGHEFLFFSLFNIIGKSSSFIGPFISSAIIDATPGGTNNSAPFYFLFALSLVSAVGIWSFLDLEKSAREQEAFIIEEKIRMGEDSDASKTN

SEQ ID NO: 90269 - DNA, 1692 bp, Aspergillus nidulans FGSC A4
  CDS (1)..(1692)
atggcctctgttacggagcaccctccaacgctggagcaaattgaagcagatcaagacgaatatgatcgcctattcacagcaaaagtggactctttcgatgttccaacgacaactcggcgggaactgtggtcctattacctttattataatggagacaacggagtaggccctctttcgtatacccaagcattgtttcaatggtcccttaacggcgccggctggcaaccagggaccacgccccggcaaccctgcaccgattcgtctccttgcgtagtcccttgggccggagggacacgaaccgtctcctcgattgtgttgatagcaaatggcctcagcttcaccttcatgacaataatctttgtctggctcgggagtgccgcagactacggctctttcgggcgctggttgctcctcgctcttacagtcgtttgctgggctttgcagtatgggacgcttgctatcagagagccgactcagtggcccgccgctatggggctgtatatcgtgacgtatgttgcgtatggcgcaacgctggtgttttatgccgcaatgttcccgaagcttgcgaggtatatgccgcatgtcaggaaggcgagggaggaggatttgagagaggggaggatcgatcaaagggattatgatgctgttgagtccttggagaggaatcatatttcgaatatatccacagcacatagtaatattggctatttggccgtgttgcttctcaacctaagtgttctattgcctatgcagggcaataactatgcgaataatttagccatctgtctgacgaactcgtcgtcagattgggttgtcttgggggtgtggtggttcatctttcagcagaaaagaccgggccctagagttccagaaggctcaaactacgcaaccatcgggtttaagcagatctggctagcaatgaggaagatccggtctctaccacagatcctcctctactatatcgcctactttctcctcgcggatgggctaaacacaaccggaacattggtatcaatcatccaaaatgacttcattgacttttcattcctacaactcacctacttgggcatatcgcaagctgtatgctccatcgcctccacattcggcttctggtatttccagagacatttcagagtccgcactaaacgtatgtttctcgtcaccaacttcttcaccgttctcataccattttggggcatgatcggtctttggacacatcgcatcggttatcataaccggtgggaattctacttttacaatgtcatatttggactctttcaagctccatactatgcatatgcccaaacaatgatcagtgagctaatgcctcctggctatgataacatgtttttcgcgctcttcggaatcacgaaccgtgcgtcatctataattggacccaacgtcattcaagcaatcatcaacgatacgcataataactggatggggttcccattcctatttgctatttgtaccatggcaatgatagcgattgcgctcgttaatgttgagaagggccgtgagaatgcaagcaagtttgcagaggcacataggcagaggactactgtacggggtagaactgacgcatcggattctagggctggcgggaagggagcttcaattggggcttctgaaaggattgaagaggttgataatgctgactgtcgctactcgggtgccgcaagaagtgattga

SEQ ID NO: 90270 - protein, 563 aa, Aspergillus nidulans FGSC A4
MASVTEHPPTLEQIEADQDEYDRLFTAKVDSFDVPTTTRRELWSYYLYYNGDNGVGPLSYTQALFQWSLNGAGWQPGTTPRQPCTDSSPCVVPWAGGTRTVSSIVLIANGLSFTFMTIIFVWLGSAADYGSFGRWLLLALTVVCWALQYGTLAIREPTQWPAAMGLYIVTYVAYGATLVFYAAMFPKLARYMPHVRKAREEDLREGRIDQRDYDAVESLERNHISNISTAHSNIGYLAVLLLNLSVLLPMQGNNYANNLAICLTNSSSDWVVLGVWWFIFQQKRPGPRVPEGSNYATIGFKQIWLAMRKIRSLPQILLYYIAYFLLADGLNTTGTLVSIIQNDFIDFSFLQLTYLGISQAVCSIASTFGFWYFQRHFRVRTKRMFLVTNFFTVLIPFWGMIGLWTHRIGYHNRWEFYFYNVIFGLFQAPYYAYAQTMISELMPPGYDNMFFALFGITNRASSIIGPNVIQAIINDTHNNWMGFPFLFAICTMAMIAIALVNVEKGRENASKFAEAHRQRTTVRGRTDASDSRAGGKGASIGASERIEEVDNADCRYSGAARSD

SEQ ID NO: 90271 - DNA, 1515 bp, Aspergillus nidulans FGSC A4
  CDS (1)..(1515)
atggctgtcgtcgcatctctagatatggagaaggtccagtatcccgccgtccaagaactcgatgccaaagcacatgcagcagcaaaacggcccacggctcccgaccagtttgacgagagctaccggacagcgcgactggagatatgggcttattatgcttactacataggaaataatggcctgtccctgttcaatttcgcacctacagcgttccagaatctgctgtcgcaagcgaccgacgagaatggacagttatttttcgccggcagattgcgctctattgaaagcatcgtccttctctgcaacggcatctcttttgccatccaggttctcgtctttctagtcatcggcagcttcgcagacttcggcacctggagaccaaatatcctcatcggtctatcaattgtcgcgtacgcaattggctttggctggctaggtgtccatgatgcagagaaatggcatgtcgcagtggggttatatattgtcggcttgatcgcctaccagacaaccctaacattctggacagctgcattcccgggccttgcacgtaatacagtcgaaatgaaatccaaggcggacgagtatcaatccggttctatatctcgtgatgagtatgatttcgcggatacaatgaagcgcagtcaactggcgaacatggcgttctacgtacaatctgtgggtgagatctttatccttgcagttattgtggggattatgtttgggttgagagttgatgatagccaagcaaataataactggggactgagtgtgctgattgcgtttgcgagtggtgtttggctgcttgtttcgctgccttggtttgtccttgagaaaagacgaccgggacaaggtactggggggcggagcatagttgttgctggcctcaagcagatctatgtagctacaaggcaaatatggaggttgaagcagagcctgctttatcttgttgtgatatcaacactccaaaacaacatcgttgcttacaacacccttcagctcgcataccttctgatcgtcggtattacagcacaggcgctcggcatatacgccttctggcgtatccagacccgtttcaacctttcccccttaacgctcttccacctcattgtagcagccataatagttctcgacatctggggcatgattggcatcttcactaaccgattcggcttccataacacttgggaggtctgggcatatcaagcatactacggcctccttgtgtgtccctggtacagctattctcagattatgatttcggaagtgacaccgcgcggacatgagttcttatttttctccctctttagcattgttggaaagacgagcagtttcattgggcccttggtatcaagtgcaattatcgatgcgagcgagagtgggaatgcgggtttgccgttttacttcctggtgggcattagcgtgctcgcggcgggggtcctgggcgtttggttggatatagggaagagtagaaaggagcaggaggctttcttggaggagaagaaattgagagaatga

SEQ ID NO: 90272 - protein, 504 aa, Aspergillus nidulans FGSC A4
MAVVASLDMEKVQYPAVQELDAKAHAAAKRPTAPDQFDESYRTARLEIWAYYAYYIGNNGLSLFNFAPTAFQNLLSQATDENGQLFFAGRLRSIESIVLLCNGISFAIQVLVFLVIGSFADFGTWRPNILIGLSIVAYAIGFGWLGVHDAEKWHVAVGLYIVGLIAYQTTLTFWTAAFPGLARNTVEMKSKADEYQSGSISRDEYDFADTMKRSQLANMAFYVQSVGEIFILAVIVGIMFGLRVDDSQANNNWGLSVLIAFASGVWLLVSLPWFVLEKRRPGQGTGGRSIVVAGLKQIYVATRQIWRLKQSLLYLVVISTLQNNIVAYNTLQLAYLLIVGITAQALGIYAFWRIQTRFNLSPLTLFHLIVAAIIVLDIWGMIGIFTNRFGFHNTWEVWAYQAYYGLLVCPWYSYSQIMISEVTPRGHEFLFFSLFSIVGKTSSFIGPLVSSAIIDASESGNAGLPFYFLVGISVLAAGVLGVWLDIGKSRKEQEAFLEEKKLRE

SEQ ID NO: 90273 - DNA, 1743 bp, Aspergillus nidulans FGSC A4
  CDS (1)..(1743)
atgcaggaagatggaattgctgagcctgggcttcttctcccacgatacccaggcgatgacacccggccaacaaacaagaaagagctgctggggtggtatagttatggttgggcagcagaggttttcacagtatgtgctatggagcagatggcccgagaacgtggggttctactctcggacaaaacgacaccgtgtactgcgatctggaaaactccagagtcatcaaacacaagctggcaaaattcaagtcccgccgctgcaggtcaatgtattgtttacatccttggggccgaaatcaacaccgcaagcttcgcaatgtacaccttctccgtgagtgtcctcatacaagcaatcctgataatatcaatgtcaggcgctgcagatcatggaagctaccgcaagacgctcttagtatcatttgcggctattggctccatttgtacgatgttaatccttgcggttactccgaaagtatacctacttggtgggttattcgctattgttgctaacacctgcctcggggcatcgttcgtgttattgaactctttcctacctttattggtccgatatcatccttcgttacttaaggaagagagtggatacatggtccgttctcctactgaaaacagtggtcaaccaattgccacggactgtttttcgaacgatgaccccagagcagcacttctacagggagatggaatgactccagaagatacaagggagtttatatcgtcatcaaacacgtcaaaagagctgacaatatccactcggatttcgtcatatgggattggcattggctacatcggtgctgttttcctacaaggtatatgcatccttgtcattgtccagacccgccagactaccttttcgctacgcctcgttcttttcttgataggtttatggtggtttatcttcactatacctgcggcattttggctcaggccgcgccctgggcccccgttgctgcgtgctcaagacgggaaggcctatcagtcatggctcggctacatggcgtacgcttggaagtcgctcggccgaacggcgatgcggacgcgacatttgaaggatattctgttattccttgcatcctggttcctgttgagcgatggaatcgccaccgtcagtggtacagccgttctcttcgctaaaacccagttgaatatggagcccgcagcgttggggatgatcaatgtgattacaatgatctcaggagtttttggtgccttttcttggagctacgtttcacgagtgctgaaccttcgcgcttcgcagaccatcatcgcttgcattttcctttttgagcttgtgccgctttatggtctgttgggctttattccagccatcaaaaacctcggcttcttgggtcttcaacagccgtgggaaatgttcccattaggggttatatatgggcttgtcatgggagggctttcgtcgtattgtcgaagtttcttcgggcagctgatccctcctggatatgaagcgtctttctattctctttacgctataacggacaaaggctcgagtgtatttggaccggcaattgttggatttatcacagatcattatggggagattcgtcctgcgttcttctttctcgcgatacttattcttctacctttgccgttaatgctcctcgtggacgccgatcgaggaaagcgagatgcgctggcattggcagaagtgctggaggcacgttcgagccttgaacagcgtgattacggaacgttttcgcaacaacagtaa

SEQ ID NO: 90274 - protein, 580 aa, Aspergillus nidulans FGSC A4
MQEDGIAEPGLLLPRYPGDDTRPTNKKELLGWYSYGWAAEVFTVCAMEQMARERGVLLSDKTTPCTAIWKTPESSNTSWQNSSPAAAGQCIVYILGAEINTASFAMYTFSVSVLIQAILIISMSGAADHGSYRKTLLVSFAAIGSICTMLILAVTPKVYLLGGLFAIVANTCLGASFVLLNSFLPLLVRYHPSLLKEESGYMVRSPTENSGQPIATDCFSNDDPRAALLQGDGMTPEDTREFISSSNTSKELTISTRISSYGIGIGYIGAVFLQGICILVIVQTRQTTFSLRLVLFLIGLWWFIFTIPAAFWLRPRPGPPLLRAQDGKAYQSWLGYMAYAWKSLGRTAMRTRHLKDILLFLASWFLLSDGIATVSGTAVLFAKTQLNMEPAALGMINVITMISGVFGAFSWSYVSRVLNLRASQTIIACIFLFELVPLYGLLGFIPAIKNLGFLGLQQPWEMFPLGVIYGLVMGGLSSYCRSFFGQLIPPGYEASFYSLYAITDKGSSVFGPAIVGFITDHYGEIRPAFFFLAILILLPLPLMLLVDADRGKRDALALAEVLEARSSLEQRDYGTFSQQQ

SEQ ID NO: 90275 - DNA, 1782 bp, Aspergillus nidulans FGSC A4
  CDS (1)..(1782)
atggcgtcgttctcccagctcgcctcctctcccgaagagccggactttgagcgtcgattcctgcggtaccgcggggaggatacctcccccacaggccgtcgcgagatttggggatggtatgcctacggagtcgctgccgaggtgtttgccgtatgcggtgtcggctcgttcctccccctcaccctagagcaactggcccgcgagcaggggttcttgtcttccagtcatctgccatgtgtcggtccagatgcgcctcccgctgccggtaacggaaccgcgccggccaacgaggcctgtgttgtcccgttgatgggcttggagatcaacacggcgagttttgctatgtacaccttctcgcttgccgtgctcatccaggccttgaccctcgtgtcctttagtgctcttgcggattatgaaaataaccgaaaggccctattactggcattcggctttatcggatccgcaacgtccatgctcttcatgctcatcgttccgccagtcttcgtactcggagcgctcctggttgtgatcggggtcacctgcctcggctcctcttttgttgtcctgaactcattcctgcctatcctcgtcgcaaatgatccctcggtacaaagagcctcgaacaagaataaggacgaccttcatgacctccatacggaaggagacgaattctcgctgcggtcttggacggacgaagaagataccggtgatcatgccggcccggcgggctcaaagaaggctgttgagcccgaaaaggcgtccagctctacgtcgcccgaactgcagctctctactcgcatctcgtcacggggtgtgggcttgggttactgtgcagctgtccttgtgcagattctaagcatattgttgctgttcacgctgtcgaagacgtccatgggcaaatcccacccaactctgccgctgcggtttgttttgcttctagtaggtatatggtgggctgccttcactgtcgtctgcagccggtggttacgaagccgtcctggccctccgttagagggtgtcacccctggcgctgggtatcgtcagaaatggcgtgtctggctacgcgttgttggttttgcgtggaagtctctctggaataccattaaggttgcactgcgattgcgtgaagttgtggtattcttggccgcgtggtttctgatttccgacgccatagcgacagtgtctggaactgcgattctttttgcgcggacagaactgcatctgagtaccgtctctgttggtctcttgtctatcacggcgacaatgtctggaatggcgggcgcgttcctgtggccgatcgtagcccgtcggtttgcgctggcgtccaaccatactattcttttatgcatagcactgtttgagatcatccccttgtacgggatgctggcttacatcccctttattcgaaactggggtgtgttggggctacagaagccatgggagattttccctttgggcattgttcatggggttgtctctggaggattggcatcgtactgtcgctctttgttcggcgagcttatcccgccaggcagcgaggctgcgttttacgcgctctacgcggccaccgacaaaggaagctcattcgtgggtccggctatagtcggcgccctgatcgatgcgaccgggtctgtccggtccggattcattttcattggcgtcttgatcctactaccgatgccgctagtgtggttggtgaatgcagagcgagggcgccaggatgcaatagccatggtgaaacatgcgcctaatagtgaagagggggaggggctgctgcgctaa

SEQ ID NO: 90276 - protein, 593 aa, Aspergillus nidulans FGSC A4
MASFSQLASSPEEPDFERRFLRYRGEDTSPTGRREIWGWYAYGVAAEVFAVCGVGSFLPLTLEQLAREQGFLSSSHLPCVGPDAPPAAGNGTAPANEACVVPLMGLEINTASFAMYTFSLAVLIQALTLVSFSALADYENNRKALLLAFGFIGSATSMLFMLIVPPVFVLGALLVVIGVTCLGSSFVVLNSFLPILVANDPSVQRASNKNKDDLHDLHTEGDEFSLRSWTDEEDTGDHAGPAGSKKAVEPEKASSSTSPELQLSTRISSRGVGLGYCAAVLVQILSILLLFTLSKTSMGKSHPTLPLRFVLLLVGIWWAAFTVVCSRWLRSRPGPPLEGVTPGAGYRQKWRVWLRVVGFAWKSLWNTIKVALRLREVVVFLAAWFLISDAIATVSGTAILFARTELHLSTVSVGLLSITATMSGMAGAFLWPIVARRFALASNHTILLCIALFEIIPLYGMLAYIPFIRNWGVLGLQKPWEIFPLGIVHGVVSGGLASYCRSLFGELIPPGSEAAFYALYAATDKGSSFVGPAIVGALIDATGSVRSGFIFIGVLILLPMPLVWLVNAERGRQDAIAMVKHAPNSEEGEGLLR

SEQ ID NO: 90277 - DNA, 1626 bp, Candida glabrata CBS138
  CDS (1)..(1626)
atggcttatgaatcattggcgtcagagccgaatgatggggttacggatcataatgatgatgctctgtatgtgggaatagacactcttaaagctgctagagataatatcaagggctggtacctgtattcattttccagtgagccatttgtggtttctgctgttgctacatacgttccgttattgctagagcaatttgctagaatcaatggtgtgcaattggatgatcataacgctccttgttctacatcatcatccgataaatgtgtcttaggtctgttcaataatcgagtctttgtcgattcttctagttttgcattatatgtcttctctctgagtgtcctgtttcaaacggtagtcgttatttcagtatcgggcatggtggataggtggaaaactatatcatttagaaaaaatgtgctggtaacctttggcatggtaggtgcattcgcaacagtcttaatttctttgctcaacgaaacccagtattattcattggtggtatattacattgtggctaactcttgttatggtgttatcaacgtagtaggaaattcattactacccttgtttgtggatgaccttgttaggttgcaacctgaccatacagtgcccgccgccgaagagctatctttggatactgatgacaaggatggtttgactacagtgatcagtggtcgtggtgctagtattgggtattcggcagcattggttgttcaattaatgtccatattgcttgtgcgtcttagcccttctaagcaggatattcaatacgcggtattttttgtaggactttggtgggcagtatggcagttccctatgtattggttgctttctgacagcataataccagatcaacaatccaatcaggcaattgcaaatggtagatattatgatatcgatggttccatattcacatttgtcaacctctcatcccttaagtatggttggaagttactgggtgaagctctgaaacatgcaacattgctaagagatgtggtgatatttttaataggttggttcatcttaagtgattcattgacaactatcaattctactgcaataatatttgcgaagactgaacttcacatgtcaacaatcaatctaatttcgctaagtataataaccatgatcagtgctatggttggtgctttcgctatccctcagatagtatcgacatctctacatgtacctcctcaacgcactatattactaataatatgttgggccagcattattccattatatggcatgctaggtttcatttttcaatcatttggattgaagcatcaattcgaaatgtttattttaggtgtatggtatgggatttctatgggaagtgttgctgccgtttccagatctctattcaccatcatcattccgaaaggtagagaatccacattcttcagccttttcagtattactgacaaaggttcctcaatagtcggaccatttattattggcatagtaacagacaaaacacataatataagatattcattttttattttgtttatattactagtcttctcgttgccaatatttaagatgcttaatgtggaaagaggtaaaagagaggctgaagaaatcagtaaattgcatgtaaacatcgatcccatccaagactaa

SEQ ID NO: 90278 - protein, 541 aa, Candida glabrata CBS138
MAYESLASEPNDGVTDHNDDALYVGIDTLKAARDNIKGWYLYSFSSEPFVVSAVATYVPLLLEQFARINGVQLDDHNAPCSTSSSDKCVLGLFNNRVFVDSSSFALYVFSLSVLFQTVVVISVSGMVDRWKTISFRKNVLVTFGMVGAFATVLISLLNETQYYSLVVYYIVANSCYGVINVVGNSLLPLFVDDLVRLQPDHTVPAAEELSLDTDDKDGLTTVISGRGASIGYSAALVVQLMSILLVRLSPSKQDIQYAVFFVGLWWAVWQFPMYWLLSDSIIPDQQSNQAIANGRYYDIDGSIFTFVNLSSLKYGWKLLGEALKHATLLRDVVIFLIGWFILSDSLTTINSTAIIFAKTELHMSTINLISLSIITMISAMVGAFAIPQIVSTSLHVPPQRTILLIICWASIIPLYGMLGFIFQSFGLKHQFEMFILGVWYGISMGSVAAVSRSLFTIIIPKGRESTFFSLFSITDKGSSIVGPFIIGIVTDKTHNIRYSFFILFILLVFSLPIFKMLNVERGKREAEEISKLHVNIDPIQD

SEQ ID NO: 90279 - DNA, 1479 bp, Kluyveromyces lactis NRRL Y-1140
  CDS (1)..(1479)
atgagttatgaggcagttcctgccgagaattcggcttttatacctgatcaagccaaacgtaatatcaagggatggtatttctattgcttctcaagtgaacccttcatagtcagcgctgtttccacgtatgtcccattattgttagaacagtttggtaggattaacggtgttaaattggatgatcatagtctcagatgcgaagtgaatgatgataagtgcgtactacctatgtttaatggaagatggttcattgatacatctagctttgcattatataccttttccctaagtgttctatttcagacgttactagtaatcagcgtcagtggtattgtcgacaaatgtcagagcatagcatttaagaagagagtcctattattttttggaacagttggggctttagcgacatggtttattggtacacttagatcagaccagtactacgtattacctttgcttgcaatagtcggaaattgtagctacggagtcattaatgttgtaggaaactcattgttaccagtgtttgtgggatttttggttggaaatgaagatcagctggaagttgatatcaaaacttctattataagcggtcgtggtgcttcttatggatatttcagtgcgcttatcgtacaattattttcaatattgttggtaaaacaaagcaaaaaccacgacaatcttcaaatagcgattctatttgtaggcttatggtggttactgtggcaaataccgatagcatttttgttacaggatatcccccgtgacacagatcaagaacagcatgagtttacatgggccaacaccggaaattatatggaatacggctggaactcattgtgggagtcattgaagcacgcaagattgttgaaagacgtggtaatctttctcattgggtggtttattatatctgattctttgacgacaattaactctactgccattttgtttgccaaaacggagttgaagatgacagctataaatctaattactctaagtatcataacgatggttatggcaatgcttggtgctgtctacataccccatttattaagcgaacgtttgagacttcccttgcagcaggttttgatcattataatcatttggtctagtgttattccattgtatgggatgacgggatttgtattccaaaacattggtttgaaacacaaatttgagatgtatatcttgggagtgtggtatggtgtgtccttgggaggcttagctgctgtgtcgcgttcgttattcagtttgcttgtaccacgtgggaaagaatctacatttttcagtctttttagtgtaactgataaaggctcctcaatactaggaccactgttgatcggcttaattacagataaaactcataatattaggtatgcattttacttgttattcctttttttggtggtttcactaccagtcttccacggtttggacgtggaaagaggaaaaagagaagctagacaattgtctactatgtag

SEQ ID NO: 90280 - protein, 492 aa, Kluyveromyces lactis NRRL Y-1140
MSYEAVPAENSAFIPDQAKRNIKGWYFYCFSSEPFIVSAVSTYVPLLLEQFGRINGVKLDDHSLRCEVNDDKCVLPMFNGRWFIDTSSFALYTFSLSVLFQTLLVISVSGIVDKCQSIAFKKRVLLFFGTVGALATWFIGTLRSDQYYVLPLLAIVGNCSYGVINVVGNSLLPVFVGFLVGNEDQLEVDIKTSIISGRGASYGYFSALIVQLFSILLVKQSKNHDNLQIAILFVGLWWLLWQIPIAFLLQDIPRDTDQEQHEFTWANTGNYMEYGWNSLWESLKHARLLKDVVIFLIGWFIISDSLTTINSTAILFAKTELKMTAINLITLSIITMVMAMLGAVYIPHLLSERLRLPLQQVLIIIIIWSSVIPLYGMTGFVFQNIGLKHKFEMYILGVWYGVSLGGLAAVSRSLFSLLVPRGKESTFFSLFSVTDKGSSILGPLLIGLITDKTHNIRYAFYLLFLFLVVSLPVFHGLDVERGKREARQLSTM

SEQ ID NO: 90281 - DNA, 1644 bp, Kluyveromyces lactis NRRL Y-1140
  CDS (1)..(1644)
atgaatgaaatgctggaaagtacacctctcaaaccgaatagcaccggctgttctactctgtcaggctccaaaaaactgacagctgatgcttcagtacaagagcttgtgtgtgaacatgatgagacattccaacaagaacagatttcgtctgcatcatgcaatttcaaagactctcaactatccaagtgggataccaggaagacttaccttgtttggctattaatctgcttttctacaggtcctacggctgcgatgatgagatcgtatgtccctgcaacgatacaaacaacagcacatgcgttaggtcatccaaaaggttcatctggtccctgtttagccacaggggacgactgttatgttacttttagttacggaacagttcaatacacgtctttttctctctacttaaaggccatttatacgtctttagaaggtgcgattgcaattttaatgatggccttcgctgattattcggactatagaaaatggctaatgattggcgcaacggcatcgtatggtatctttgctattccattctactggttatccgatactaaaaaatatcaaaccttagtccagcaatcagtgttgtattgtcttatgctttgctttggtacaatataccaaatcactgaaagctcatacattcctgtctttatgaatgcaagaaaacttgctttacaagatgagcacaattcaaaacaaggtggggtcatgttgcgaggtgttaacgtcagcacctggggtcttgttgttggaaatattgggggaattatcgcttctttagttggagttattattacccatgcatcttctcatccttcaaacaaggactttctattggcagtgactgttgcaggattcgtcactacatttatatcaattatatgtgcaaacctaataccgagcttgaaaggaaaagaattccagaataaaggtgtgagagatttgataataatgccattggttagattcaaagaaatttttatggatttattggattacagagaagcattcaaattctgtgttgcttgggtactttggaatattgcgtattcgaattttctctcggtattcggattactcttcagatcgaccatgggaatcggttcatcggatgctgagtttgccatttggcaatttatgaacctaatagttgcctgtttagggccattatgttggatggcattttactcgtacgcctgcagcaacaaaccaagcttctacagcatcacgtacatgaaacgatcattgtatgggatgttgttagtgggaacattcaccaatttttggggatgtctaggaactaacttcaatagtaaggttggctttaaatatcgatgggaattctggttatttcagattttgttcgttagcacaagttctggtatcagaacaatcaaccgcgttgcatatagtgcaatgttacctacaggtaaagaaaaccaatattttggctttgaagtaatgcttggtttatgtactggttggtctgaatctttgattgttgctttacttcaagataagacagggaactccaggatgccattcattccgaacacattattatatttggtggctctactactattcttcagtgtcgatgtagaaaaagggatgaagcaagccgggaaatgtggttaa

SEQ ID NO: 90282 - protein, 547 aa, Kluyveromyces lactis NRRL Y-1140
MNEMLESTPLKPNSTGCSTLSGSKKLTADASVQELVCEHDETFQQEQISSASCNFKDSQLSKWDTRKTYLVWLLICFSTGPTAAMMRSYVPATIQTTAHALGHPKGSSGPCLATGDDCYVTFSYGTVQYTSFSLYLKAIYTSLEGAIAILMMAFADYSDYRKWLMIGATASYGIFAIPFYWLSDTKKYQTLVQQSVLYCLMLCFGTIYQITESSYIPVFMNARKLALQDEHNSKQGGVMLRGVNVSTWGLVVGNIGGIIASLVGVIITHASSHPSNKDFLLAVTVAGFVTTFISIICANLIPSLKGKEFQNKGVRDLIIMPLVRFKEIFMDLLDYREAFKFCVAWVLWNIAYSNFLSVFGLLFRSTMGIGSSDAEFAIWQFMNLIVACLGPLCWMAFYSYACSNKPSFYSITYMKRSLYGMLLVGTFTNFWGCLGTNFNSKVGFKYRWEFWLFQILFVSTSSGIRTINRVAYSAMLPTGKENQYFGFEVMLGLCTGWSESLIVALLQDKTGNSRMPFIPNTLLYLVALLLFFSVDVEKGMKQAGKCG

SEQ ID NO: 90283 - DNA, 1770 bp, Yarrowia lipolytica CLIB99
  CDS (1)..(1770)
atggacattgttgcaacgacacaaaaggagctgtatggatggtacgcgtatgcatgggccgccgagccgttcatggttgtggctgtagcaacttacatcccccaattgttgcaatcatacgctcgtcagaatgcggttttagcagacgatcactctcagccctgcgattcgcctccagtgccatttccaggcgaccccggagttcctaccgaccctggtatccccccaaacaacagtctgtcctcatctgtgccctggtttctgcgcgcaaatgagattcagctgttggagtcccccgacaccgtgcataccatgaaagaccataaggcgaaacccacacagcccacgtgcgtcatcaaattttttggcatctacattgacactgcatcttttcctctctacacattctcgctttcagtgctgctgcaggtcgtcgtggtcatctccatgtctggagcagccgaccgcggccgtttccgaaaacaattgctcttgtttttcggcattgccggagctctaaccaccggcctgtttgtttttatcacccccaagcggtactaccttggttcgttcctcgctatcgtctctaatgctgcttttggtgccgctacagtgtgcggaaacgcatatttgccagtcctggcagcaggtatgaaggacggaaccacgtcagaggagcccagcgagcccagcactccttccgatacgtcgaaacccgcctccagaagcgagaacacaccgctgctatccgcctcaggtgttgactacgagactggagaatcatccaacacagccgaaatcgtcaaaatcgaccacagagcaaacgtgtcggccagaatctcgggaacaggtgtagccctgggctaccttgccggattcattgtccaaatcatctccatatatctggtcatcactacaggttctaccacctggtctctgcgtctggctctgctgattgttggtgtatggtggctcattttccagattcctgtgctaatgtggttaaaaccacgtcctggtcctcctcttcctatcaagacagacccccagaaccacccctggactgctactctggatcgtgtcactaacggaggatggtcgtatgttacctatggatggaagaccctcctggtgaccttcaaagaggctcgtcagatgaaggatgtggctcttttcttggtgggttggttcctagtgtccgatggaatcactaccatcaactccacagccgttctgtttgcccagggtgagctgcggatgtctcctgctaatctggcggtcatgggcatgctcgttgtgatcagtggcatttctggagccaaactgacacctctgattggaggaacaagggcgtctcctatcaaatccatcgttgtagtggtttctctggctgctgcagttcccgcttacggtattctaggtttcttcttcaccaacattggtctgaaaaacccgtgggagctttacgtgcttgctgtttggtatggctttgctctcggaggtctcaacactgtctgtcgatcgacgttcagtatgctgattccacgcggaaaggaggctgtcttcttttcgctcttttccgtcaccgacaagggctcctctgtgctcgggcccctacttgttggtctgattgttgacaagactcataacctgcgccacgccttctaccttctgttggtactgctgatcactcccattggactgttcctgatgattgatatggagcggggtagaaaggaggccgagtacttggagacggtggaggagtag

SEQ ID NO: 90284 - protein, 589 aa, Yarrowia lipolytica CLIB99
MDIVATTQKELYGWYAYAWAAEPFMVVAVATYIPQLLQSYARQNAVLADDHSQPCDSPPVPFPGDPGVPTDPGIPPNNSLSSSVPWFLRANEIQLLESPDTVHTMKDHKAKPTQPTCVIKFFGIYIDTASFPLYTFSLSVLLQVVVVISMSGAADRGRFRKQLLLFFGIAGALTTGLFVFITPKRYYLGSFLAIVSNAAFGAATVCGNAYLPVLAAGMKDGTTSEEPSEPSTPSDTSKPASRSENTPLLSASGVDYETGESSNTAEIVKIDHRANVSARISGTGVALGYLAGFIVQIISIYLVITTGSTTWSLRLALLIVGVWWLIFQIPVLMWLKPRPGPPLPIKTDPQNHPWTATLDRVTNGGWSYVTYGWKTLLVTFKEARQMKDVALFLVGWFLVSDGITTINSTAVLFAQGELRMSPANLAVMGMLVVISGISGAKLTPLIGGTRASPIKSIVVVVSLAAAVPAYGILGFFFTNIGLKNPWELYVLAVWYGFALGGLNTVCRSTFSMLIPRGKEAVFFSLFSVTDKGSSVLGPLLVGLIVDKTHNLRHAFYLLLVLLITPIGLFLMIDMERGRKEAEYLETVEE

SEQ ID NO: 90285 - DNA, 1275 bp, Legionella pneumophila str. Lens
  CDS (1)..(1275): transl_table=11
atgaaaggccaaaaggatttgaaaccaatagatgttaagcaagtgattgcctgggcattctacgattttgccaattcttcctattttgtggtgatatttacatttgtctttgcaacctatttcacaagtcacattgcccctaatcctatcctgggaacggaattgtggggttatacgatttcgctttctgcttttctcattgccctggtgagtcctattgttggggcaatagctgattttaatgggcatcataaatcctggctattcttttttacttatttggggattatttcaacagcttgtttgtggtttgcctatcctgacagtcattccattcctttggttttaacttgtattttgattagcaattttgccttggaagtgggaaccgtattttataattcttttttggcaaatttagccccggaaaactatctggggcggatttctggctgggcctggggttgtggttatctgggagggttgctgtgcctgattctatccttatttgtttttgtgaaaggggattttggtggattgtggtttgggacagagaattttgccaatattcgtgccgtcactgtatttgtggctttatggattagtttgtttagcttgcctttgttttttatagttcaacaaaaaacaggtgagcatttgacagtgggcactgcgattagcaaaggtttgcaagaattgtggctaacaataaaaagcctgcccaaacaacgtgatctgttcttgtttttaatagccagaattttttatatcgatgggttgaactctatattggcactaggcggtatttatgcggctggcaactttcacttgagtgttagcgatattatgctgtttgggatcattttaaatattactgcaggtcttggcgcgggattattcgcctggtttgatgattggattggatctaaaaaaactattctgattgctttagcgtgcctgacattcactttttgttttctgttaaccatccactcaagtgcgttattttgggtttttgcgccggtgtttggtatttttgttggtcctgttcaggctgccagtcgtactttcttggctcgtttggcaaaacccgaagaaatgacgcgaatgtatggtttttactctttttctggtaaggcaaccagttttttaggacctttcctggttagtaccaccactgctttagctgacagtcaacgtttggggatggccgttcttattcctttttttatcatcggaggcggactattattattggttcatgaaaatgaataa

SEQ ID NO: 90286 - protein, 424 aa, Legionella pneumophila str. Lens
MKGQKDLKPIDVKQVIAWAFYDFANSSYFVVIFTFVFATYFTSHIAPNPILGTELWGYTISLSAFLIALVSPIVGAIADFNGHHKSWLFFFTYLGIISTACLWFAYPDSHSIPLVLTCILISNFALEVGTVFYNSFLANLAPENYLGRISGWAWGCGYLGGLLCLILSLFVFVKGDFGGLWFGTENFANIRAVTVFVALWISLFSLPLFFIVQQKTGEHLTVGTAISKGLQELWLTIKSLPKQRDLFLFLIARIFYIDGLNSILALGGIYAAGNFHLSVSDIMLFGIILNITAGLGAGLFAWFDDWIGSKKTILIALACLTFTFCFLLTIHSSALFWVFAPVFGIFVGPVQAASRTFLARLAKPEEMTRMYGFYSFSGKATSFLGPFLVSTTTALADSQRLGMAVLIPFFIIGGGLLLLVHENE

SEQ ID NO: 90287 - DNA, 1278 bp, Bacillus clausii KSM-K16
  CDS (1)..(1278): transl_table=11
atgaaaacaagacggtttagtaaacaagaaaaaagctggatgctttacgactgggcgaactcggcctattcgattattgttacgacagcagtgtttccactcttttttaaagcggttgcaacagactcaggcttgagtgacgctacgtcaacggcgtatctcggctacacgattgcgattgccacattcattttggcgatgctaagtccgattttagggacgattgctgactacgaaggcttgaaaaaacgcttttttgttttctttttttcactcggcgctggttctaccgctttgctcgcgtttgtgcctggcgatcattggcttattctcctgatcctctatacagtgacggcagttggctttgctggcgccaatgtattttacgatgcttttttagtcgatgtaaccgaagaaaatcgaatgcatgatatttctacacggggctacgggctcggctatatcggcagctgcatcccctttctcattagcattgctttgattgtattggcacagttggaaatcatcccactctctttttatgccgcaagcaaaattgcatttttgattacggccttgtggtgggctgctttcacgattccgatgcttaagcatgtgacgcaacgttactacaaaaaacgggaagcgagaccgattgccaatagttttaaacagcttgggcaaacatttaaagaagtgcgccaatacaaaccgttgtttttatttttgttggcctatttcttttacattgacggggtaggcacgattattcgcatgtctactgcttatggcagtgatctcggaattagcgcaaccgatttgttaattgtcttatttgtcacgcaaatcgtcgctgccccttgttcaattctttacggcaggctgtcacagcgctttacaggcaaaaaaatgctttatgccggcatatgcgtctatattgttgtttgcgtgtatgcgtttttcttacggaccacacttgatttttggattttggcgatgctagttgccacttcacaagggggcatccaagcattaagccgatcgtattttgcgaagctcgttcctaaacagaaagcaaatgagttttttggcttttataacgtgttcggcaaattcgccgccgtgatgggccccctcttgctcggactcacgacgcaattgacaggcaataccaatgcaggtgtctttagcctgatcgcattgtttttaatcggctttgctttgctagcaaaagtgcctgaaccgaaagacgaacagcgccattcatacgctagttaa

SEQ ID NO: 90288 - protein, 425 aa, Bacillus clausii KSM-K16
MKTRRFSKQEKSWMLYDWANSAYSIIVTTAVFPLFFKAVATDSGLSDATSTAYLGYTIAIATFILAMLSPILGTIADYEGLKKRFFVFFFSLGAGSTALLAFVPGDHWLILLILYTVTAVGFAGANVFYDAFLVDVTEENRMHDISTRGYGLGYIGSCIPFLISIALIVLAQLEIIPLSFYAASKIAFLITALWWAAFTIPMLKHVTQRYYKKREARPIANSFKQLGQTFKEVRQYKPLFLFLLAYFFYIDGVGTIIRMSTAYGSDLGISATDLLIVLFVTQIVAAPCSILYGRLSQRFTGKKMLYAGICVYIVVCVYAFFLRTTLDFWILAMLVATSQGGIQALSRSYFAKLVPKQKANEFFGFYNVFGKFAAVMGPLLLGLTTQLTGNTNAGVFSLIALFLIGFALLAKVPEPKDEQRHSYAS

SEQ ID NO: 90289 - DNA, 1239 bp, Desulfitobacterium hafniense DCB-2
  CDS (1)..(1239)
atgagcaagctggagaggaattggatactttatgatgtggggaactcggcctttgtcttgctgacatccacaattattccgatctatttcaaaaatctagcagccgcagacgggatcagcaatgctgcgtctacagcgtattggggctatgcatccagcatctccaccatgatcattgctattctcggtcctatcctgggcactgtaggagatttgcgcggctacaagaaagcgctttttctgatctttatggcaatcggtgccgccggctgcctggctctggctttgccggtaggctggctggcttttctcggcttgtatatcattggcaagtccggattttccggcagcctgattttttatgacgcgatgctgccggatatcacttctgaagaaagggtggatcgtgtcagttctcatggctatgcctggggctatatcggcagctgtattccctttgtgatctgcctcgggctgattctgactgccgatggaacgggtttgggtgcggctgccgccacacagctggccttcctgatcacggctttatggtggattctctgcaccgtgccgctcatgggcagctaccggcaggtctacgctttggaaagcggcggccggcctgttcgtgaaagtttgtcccggttatggcatacccttacccatgtgcaaaagcataaaagtgtctttacctttctgatcgccttttttctctatatcgacggggtttataccattattgccatggcgacttcctatggaaaagatgtgggcatttctgatcataacctgctgctggctttactgcttactcaggtcgtggcctttccctttgccattctctttgcgcgcctgacgaaaaaatttgaggcgacaaaattaatttctgctgcgattatcggctatctggccatcaccttgtttgcctttcagctggataaagcctgggaattctggctgctggcagtctgtgttgctgtcttccaagggggaattcaggccctgtcccgttcttattttgcgcggatcgtacctaaggaaaaggccaatgagttttttggaatttttgatatctttggcaaaggcgctgcctttttcggtatgctcttgatgagtgtcatcacccaaatcaccggccattcccgttttggcgtgctggggctggcggttttgtttggagtggggctctgggcactgcgccatcatgtctgtgagagcaaaaaagcccaggcgttttag

SEQ ID NO: 90290 - protein, 412 aa, Desulfitobacterium hafniense DCB-2
MSKLERNWILYDVGNSAFVLLTSTIIPIYFKNLAAADGISNAASTAYWGYASSISTMIIAILGPILGTVGDLRGYKKALFLIFMAIGAAGCLALALPVGWLAFLGLYIIGKSGFSGSLIFYDAMLPDITSEERVDRVSSHGYAWGYIGSCIPFVICLGLILTADGTGLGAAAATQLAFLITALWWILCTVPLMGSYRQVYALESGGRPVRESLSRLWHTLTHVQKHKSVFTFLIAFFLYIDGVYTIIAMATSYGKDVGISDHNLLLALLLTQVVAFPFAILFARLTKKFEATKLISAAIIGYLAITLFAFQLDKAWEFWLLAVCVAVFQGGIQALSRSYFARIVPKEKANEFFGIFDIFGKGAAFFGMLLMSVITQITGHSRFGVLGLAVLFGVGLWALRHHVCESKKAQAF

SEQ ID NO: 90291 - DNA, 1305 bp, Rubrobacter xylanophilus DSM 9941
  CDS (1)..(1305)
atgtgggcgtgggcgctctacgacttctccaacaccatcttctcggtcagcatcctgagcttcttcttcccggtgtggctgggggacgagctcggggccggggcgggggccgtcaacgcggccgccgcgctctcggccgctctggtcctcctcaccgccccggcggtgggggccctcgccgacctgcggcagcgccgggtgccctacctcgcggcgctcacgctgctggcctgcgggctcacggccgcgctggacgccgccgggggggtcgtggtggcggtcgcgctctttgtggccgcggacctcgcctaccagtcggcgctcgtgttctacaacgcgcttttgccggtggtcgccgcggggaggggggcggggagggtcagcggctacgggaccgccgcgggatatgtgggctccatcttcgcgctgctcgtgctcaccctcttcgtcgcccgcggggaggaggcgcgggccctgctcgggcccctggggtggtggctcgagcccggggagaccggctccaacgccttcgtgcccaccgcggtcctctacctgctcttcagcctgcccgccttctttctggtgcccgacccccgggtgcgcgagccgcggcccggcgggctcgggcgggcttaccgggatgtgatctccacggtgcgaagcatccggcgctaccgggggatggcccccttcatcctcgccaccctcctctacaccgacgcggccaacaccgccatcgccaacatggcgctctacgggcgggaggtcttcgggatgcagagccaggacatccgcaacctcctgctcttctccaccctcttcgccgtcgccggctccttcggctgcgggctcctctccgaccgttggggcccgcgccgggcgctcatggccgtgctcgtgctctggctcgccgccatactgctcgccgccggggccctctcggcgtggatgctctacgtggccgggccgctcgtgggcgccgcgctcggcggcacctggaccgccgggcggcccatgctcgtcgccctctccccgccggagaagatcggggagttcttcgggctctactccttcgccggcaaggtctccgccgtggccgggcccgccctcacggcgctgcttctgttctggctcgaggagctcgggaccctggcctacaggctctccgtcggctcgctcgccctcgtcatggtcctggccatggcggtgctcgcccgcgtccccgacgtccgccccgccggggtggtggacaggtacgcccccgaggttctagtctctagggaaaacggagaggtggtgcgctga

SEQ ID NO: 90292 - protein, 434 aa, Rubrobacter xylanophilus DSM 9941
MWAWALYDFSNTIFSVSILSFFFPVWLGDELGAGAGAVNAAAALSAALVLLTAPAVGALADLRQRRVPYLAALTLLACGLTAALDAAGGVVVAVALFVAADLAYQSALVFYNALLPVVAAGRGAGRVSGYGTAAGYVGSIFALLVLTLFVARGEEARALLGPLGWWLEPGETGSNAFVPTAVLYLLFSLPAFFLVPDPRVREPRPGGLGRAYRDVISTVRSIRRYRGMAPFILATLLYTDAANTAIANMALYGREVFGMQSQDIRNLLLFSTLFAVAGSFGCGLLSDRWGPRRALMAVLVLWLAAILLAAGALSAWMLYVAGPLVGAALGGTWTAGRPMLVALSPPEKIGEFFGLYSFAGKVSAVAGPALTALLLFWLEELGTLAYRLSVGSLALVMVLAMAVLARVPDVRPAGVVDRYAPEVLVSRENGEVVR

SEQ ID NO: 90293 - DNA, 1245 bp, Listeria monocytogenes str. 1/2a F6854
  CDS (1)..(1245): transl_table=11
ttggcatatacaaaagaggagaaaagttggatttttcaagattgggcgaattccgcctactcaatcatgatcacaacagcgattttaccaatttattttaaaggggtagcagcgaatgctggaattgctgacactacgtcgaccgcgtactggggatatgcaaactcgattgggacgttacttatttcattacttgcaccgatacttggaacaattgcggattatcaatttttcaaaaaacggtttttcggtatttttacagccatcgggattggctttactttcttgttaattttcatacccacggatgcctggttattattactagggttttatgtgctctctttaattggtttttctggcgcaaatattttttatgatgcctttttaattgatgtaacaacgaacgaccggatggataaagtttcatctgccggatatgcgtatggttatttaggaagttgtattccttttattatctttattattttccaagcgacaggtatcttgccaatcagtgatgtggcactcgtcaatattggttttgtgatgacggcgctttggtggctatttttcacgattcccatgtggaaaaacgtgcatcaaatccattatattccagcagtgaaaagcccagttagaacaagttttaaacggctgtttcatacaattagccacattagtgaacataaaaatattgttatctttttaattgcttattttttctacatagacggggttgatacgattttccgcatggcgacttcatacgggattgatcttgggatttctcaaacaacattaattttaattcttttaatgacacaactcgttgcatttccatttacattgctatacgggtacttagccaaacgtttcagtgccaaaccgcttattttcacagctatttttgtttacattattatttgtgtttatgcggttttcatgaaatctgcgcttgatttttggatattagcaatgttagttggaacttcgcaaggtggtattcaagcattaagtagatcattcttcggaaaaattattcctaaaaagcgttcgaatgagttttacggattttataatattttcgggaaattttcagcaatcatgggaccggcccttatgggggtaatcacacaaattaccggaaaaacgcaatacggtgtggctagtttaattgtacttttcctcgttggtggtattttatttgtattcgtaaaagagaaaaacttagaaaatctttaa

SEQ ID NO: 90294 - protein, 414 aa, Listeria monocytogenes str. 1/2a F6854
MAYTKEEKSWIFQDWANSAYSIMITTAILPIYFKGVAANAGIADTTSTAYWGYANSIGTLLISLLAPILGTIADYQFFKKRFFGIFTAIGIGFTFLLIFIPTDAWLLLLGFYVLSLIGFSGANIFYDAFLIDVTTNDRMDKVSSAGYAYGYLGSCIPFIIFIIFQATGILPISDVALVNIGFVMTALWWLFFTIPMWKNVHQIHYIPAVKSPVRTSFKRLFHTISHISEHKNIVIFLIAYFFYIDGVDTIFRMATSYGIDLGISQTTLILILLMTQLVAFPFTLLYGYLAKRFSAKPLIFTAIFVYIIICVYAVFMKSALDFWILAMLVGTSQGGIQALSRSFFGKIIPKKRSNEFYGFYNIFGKFSAIMGPALMGVITQITGKTQYGVASLIVLFLVGGILFVFVKEKNLENL

SEQ ID NO: 90295 - DNA, 1281 bp, Rhodospirillum rubrum
  CDS (1)..(1281)
atgaccgggggcgccgccgctgcgccgcccggtcgcggcgcggctttttcgtggtgcctgttcgatttcgccaattcgggctatcccaccgtcgtcgccaccttcgttttttcggcctatgtgaccaaggcggtggcggcgacgcccgaagcgggaacggcggcctggggttatgccatgggcgcttcggggctgctgatcgccctgctcgccccgatcttcggcgccgtggccgaccacagcggccggcgcaagccttggcttggcctgttcagtctgctgtgcgtcgcctccaccgccttgatgtggacgatccgccccgacccggccttcctgttggccgccctggtgctggcggcgctgtcgaacgccgccttcgagatcggcggcgtcttctacaacgccatgttgcccgatgtgacgacgcccgagcgcatgggccgcctttcgggctgggcctgggggttgggctatgccggcgggctggcctgtctggtcatcgccctgctcgccctggttcaggccgatccgccgcccttcggcctggacaaggccgccgccgagccggtgcgcgccaccctggtgctggtcgccctgtggttcgtggttttcggctggccgctgttcgccttcgtgcccgagcggccgaccgggcgggttctggccttgggcgcggcggcgcgcggggcgattgacagcctgaagggcctgccggcgctgtttcgcggcgatccccggctgggctggtttctgctggcgcgcatgctctacaccgaagggctgaacaccctgttcgcctttggcggcatctatgccgccggcaccttcgacatgggctttgatcagatcatcgtgtttggcatcgggctgaacatcaccgccgggctgggggccttcgcctttggctggatcgacgactggctgggctcgccgcgcaccatcgttgtcggcctgatcggcctgatcggtttttgcgtcgccgttcttctggtcgaagacaccgcatggttcgtcggtctggctttgaccatggggattttcttcggcccggtgcaggcagccagccgcacccatatcgcccgcgtcgccccgcccgacaggcgcggcgaattattcgggcttttcgccctgaccggcaagatcagcgccttcgccggaccgctggccgtcggtctggcgaccgatctaagcggcagtcagcgcctcggcatggccaccgtggtggttttcctggtcgccggcctcggcctgctggtcaagacccgcgccccccggggctga

SEQ ID NO: 90296 - protein, 426 aa, Rhodospirillum rubrum
MTGGAAAAPPGRGAAFSWCLFDFANSGYPTVVATFVFSAYVTKAVAATPEAGTAAWGYAMGASGLLIALLAPIFGAVADHSGRRKPWLGLFSLLCVASTALMWTIRPDPAFLLAALVLAALSNAAFEIGGVFYNAMLPDVTTPERMGRLSGWAWGLGYAGGLACLVIALLALVQADPPPFGLDKAAAEPVRATLVLVALWFVVFGWPLFAFVPERPTGRVLALGAAARGAIDSLKGLPALFRGDPRLGWFLLARMLYTEGLNTLFAFGGIYAAGTFDMGFDQIIVFGIGLNITAGLGAFAFGWIDDWLGSPRTIVVGLIGLIGFCVAVLLVEDTAWFVGLALTMGIFFGPVQAASRTHIARVAPPDRRGELFGLFALTGKISAFAGPLAVGLATDLSGSQRLGMATVVVFLVAGLGLLVKTRAPRG

SEQ ID NO: 90297 - DNA, 1293 bp, Thermobifida fusca
  CDS (1)..(1293)
atgtacgactgggcgcagtcggtgttcaacaccactgtgatcacggtcttcctcggcccttacctgactgcgctcgcctccggggctgccggtcctgacggcaagatcagcgtgttcggctggatgatcacgcccgcttccctctacccctatgccacgtccctgtccgtgctgatccaactggtgctgctgcccgtgctcggcgcggtggtcgacaccagcggacgcaaacgggaactgctgggtgtgaccgcctacctcggtgcgttcgccaccatgggcctgtacttcgcggcggacgaccgctacctgctcggtgcagccctgttcgtcgtggccaatgtcgcgttcggggcttctatcgtggtcgccaactcgttcctgcccgacattgcctcggaagaggagcgcgacactgtctcctcccgaggctgggcgatgggctacctgggcggggccctgctgctcaccctgaacctggccctcttcctcagccatgagagcttcggcttggaagaaggccacgcggtgcggatctgcatgatgtcggcgggcgtatggtgggcgatcttcaccatcattccggtggcacggctccgcaaccggcgcgccgggtcgctggaggtcccggcacagcggatcgctgtgggccgcagcttcgcgcaactgtggcacaccatcaccagtctgcgcgcctacccccgcaccctgctgttcctggtcgcctacatcatgttcaacgacgggatccagaccgtcatcgccttctcggcgaccttcgccgaccaggcgttgaaactggaccagagcgtgcagatcggcaccattctcatggtgcagttcgtcgcattcggcggagcgctgctgctcggcgcgatcgcccgacgggtcggcacgaagaagaccatcctgggcagcctcgtggtgtggaccgcggtggtcgcggtggctcccctgctgcaggaaggcgcggccgtgcagttcttcgcgctgggcttcttcattgcgatcgtgctgggcggcacccaggcgctgtcgcggtccctgttctccctgctcattcccaagggcaaggaggcggagtacttcggcctctatgagatcagcgacaaaggctcggcgttcctgggggcgctcgtgctcggtgtggtgttggacaccacgggaggcgactaccggctggcgatcctgtcgctcatcgtgttcttcgcgctcggtttcgtgctgctgctggccgtcaaccttccccaggcgatccgtgccgtggggaaccgggtccccgaaaaactctga

SEQ ID NO: 90298 - protein, 430 aa, Thermobifida fusca
MYDWAQSVFNTTVITVFLGPYLTALASGAAGPDGKISVFGWMITPASLYPYATSLSVLIQLVLLPVLGAVVDTSGRKRELLGVTAYLGAFATMGLYFAADDRYLLGAALFVVANVAFGASIVVANSFLPDIASEEERDTVSSRGWAMGYLGGALLLTLNLALFLSHESFGLEEGHAVRICMMSAGVWWAIFTIIPVARLRNRRAGSLEVPAQRIAVGRSFAQLWHTITSLRAYPRTLLFLVAYIMFNDGIQTVIAFSATFADQALKLDQSVQIGTILMVQFVAFGGALLLGAIARRVGTKKTILGSLVVWTAVVAVAPLLQEGAAVQFFALGFFIAIVLGGTQALSRSLFSLLIPKGKEAEYFGLYEISDKGSAFLGALVLGVVLDTTGGDYRLAILSLIVFFALGFVLLLAVNLPQAIRAVGNRVPEKL

SEQ ID NO: 90299 - DNA, 1308 bp, Cytophaga hutchinsonii
  CDS (1)..(1308)
atgcaaccaacaataaaaaacgatcctaaaatcatcaatgcctggtgcacctatgattgggccaattcggtttattcattgacaataacaacggctatttttccggaatattttttaggaattacgacaaatgaaaccaacggcaacctggtagatttttttggttttcttattccgaatacggtattgtattcctggtcggtttccattgtgtttttagtagcggctatactcagtccgtttctgacatccattgctgattattccggcttgaaaaaaacattcatgaaaatatcgtgttataccggggcattggcttgtgcggccttatattttctgaatgcacagaccattgaattcggtgtactggcctttgtactggcaggtatcggttacagttccagtatagtattctataattcttatttacctgaaattgctaccgaagatcagtatgaccgtatcagtgccaaaggctatacctggggctatatcggaagtgtattgctgttgattataaacctggtgtgtttgatctttcatgaaaaaatagggattacagaaagttttgcggcacgtttatctttcttaacggttggtgtctggtggctgggattcggacagctttcctttgcgggcttaccgcgggcacagcagaaaaataataccggtcatatgctgacaaatggtttaagagagttgaataaggtatggaacaacattaaaaaattacctttactgcaacgtttcctggttggttttttcttttataatatgggtgtacaaacagttatgtatctggctccgttgtttgccaaagaagttattcatattgaaacagaatcattgattgcaacaatcctgctgattcagctcgtagctattgccggtgcatatgcgttaaataagttgtcaaacaaagtaggtaacacacatgcgttgattattggtgtggttatatggatcattatctgctgtatgggctatgtggtacagccaggcttaagcttctttatccttgcgggttccatcggttttgtaatgggcggggtgcaatccttgtcacgtgcaacctattctaaacttatgccggtgaatacaaaagatcatgcttcgtatttcagcttttttgatgtagtagataaaatgtcgatcgtacttggtaccttcagttatggcctgatccggcaaatcaccggcgacatgcgaaacagtttaattgcactcggaatttattttgtgatcagtatattcttccttcgcctcattccttccaggcaggtatatgatacacagatgccggagtag

SEQ ID NO: 90300 - protein, 435 aa, Cytophaga hutchinsonii
MQPTIKNDPKIINAWCTYDWANSVYSLTITTAIFPEYFLGITTNETNGNLVDFFGFLIPNTVLYSWSVSIVFLVAAILSPFLTSIADYSGLKKTFMKISCYTGALACAALYFLNAQTIEFGVLAFVLAGIGYSSSIVFYNSYLPEIATEDQYDRISAKGYTWGYIGSVLLLIINLVCLIFHEKIGITESFAARLSFLTVGVWWLGFGQLSFAGLPRAQQKNNTGHMLTNGLRELNKVWNNIKKLPLLQRFLVGFFFYNMGVQTVMYLAPLFAKEVIHIETESLIATILLIQLVAIAGAYALNKLSNKVGNTHALIIGVVIWIIICCMGYVVQPGLSFFILAGSIGFVMGGVQSLSRATYSKLMPVNTKDHASYFSFFDVVDKMSIVLGTFSYGLIRQITGDMRNSLIALGIYFVISIFFLRLIPSRQVYDTQMPE

SEQ ID NO: 90301 - DNA, 1293 bp, Thiobacillus denitrificans ATCC 25259
  CDS (1)..(1293)
atggcgcccccgctgctgcaagcgggcgtgcgccggcacgaagtcgccgcgtgggcgatgtacgacttcgcgaactcgggctacacgacggtcgtcatcaccgcggtgttcagcgcctatttcgtcggtgtcgtcgccgcggacgcgccgtgggcgaccttcgtctggacgctagcactctcggcgtcctacgcgctggtgatgctgagcgcgccgctcgtcggcgcctgggccgacgcccacgcgagcaagaagaagctgctctggctgacgaccctcggctgcgtcggcttcacggcgctgctgtacttcgcggcgccgggcgcgctcgtgctcgcagtcgccgcgctcgttatttcgaattacttcttcggcacaggcgagaacctgatcgcggccttcctgcccgaactcgcgcggccgcgggcgctcggccgggtgtcgggctggggctgggcgctcggctatttcggcggtctcgtcgcgctcggcgtctgcctcgcctacatcggctgggcgcgggcgcgcgggcagggcgccacggacttcgtgcccgtgacgatgctgctcacggcgggcctgttcgcgctggcgagcctgccgacgctgatcctgctgcgcgagcgcgcgacagcgcgcgccgagccgtcgcgaaaaagcgcttggtcgcagctgcgccacacgctgtcgcacctcgaccggctgcccgatctcaaggccttcctcgtctgtaccgtgctctaccaggcgggcatccaggccgtcatcacactggccgcgatctacgcgagccaggtgttccacttcgataccgaacggacgatccgcctcgtgttcgtggtcaacgtcacggccgccctcggggcgttcctcttcggccacgtgcaggaccggatcggccacgtgcgggcgatcgcactgaccctcgtaggctggatcgtgatggtcgccctcgcgtgggcggcgcccgacgaacgcatgttctgggtcgccgccaatctcgccggcctgtgcatgggcgcctcgcaatcggccggtcgcgcgatggtcggtctgctcgcaccgccggcgcagcaggccgaattcttcggcctctgggggctcgccgtgaagctcgcctcgatactcggcccgttgacctacggcgtggcgacctggcttacgcacggcgaccaccgccaggccttgctcgtcaccggcagctatttcgttgccggcctgtggacgctgcgacacgtgcgcgccgcacgcgggcgccgcgccgcacagcgtttcgcgcgcgcagcggcatga

SEQ ID NO: 90302 - protein, 430 aa, Thiobacillus denitrificans ATCC 25259
MAPPLLQAGVRRHEVAAWAMYDFANSGYTTVVITAVFSAYFVGVVAADAPWATFVWTLALSASYALVMLSAPLVGAWADAHASKKKLLWLTTLGCVGFTALLYFAAPGALVLAVAALVISNYFFGTGENLIAAFLPELARPRALGRVSGWGWALGYFGGLVALGVCLAYIGWARARGQGATDFVPVTMLLTAGLFALASLPTLILLRERATARAEPSRKSAWSQLRHTLSHLDRLPDLKAFLVCTVLYQAGIQAVITLAAIYASQVFHFDTERTIRLVFVVNVTAALGAFLFGHVQDRIGHVRAIALTLVGWIVMVALAWAAPDERMFWVAANLAGLCMGASQSAGRAMVGLLAPPAQQAEFFGLWGLAVKLASILGPLTYGVATWLTHGDHRQALLVTGSYFVAGLWTLRHVRAARGRRAAQRFARAAA

SEQ ID NO: 90303 - DNA, 1341 bp, Chloroflexus aurantiacus
  CDS (1)..(1341)
atgaccacgcttgctgcctcgaccgataatcgtcgcgaacaggttggctggtatttttacgactgggccaattcggcattttcgaccacagtagtgaccgttttcttagggccatacctcacctcaattacccgtaatgcggctgatgcgaatggatttgtctatccgtttgggataccggtggcagccggttctttttttccttacatggtttcgctctcggtcttgttacaggtcttctttttacccatccttggtgccattgccgattactccaacgctcgcaagcaaatgctggcgatctttgcgtatgtaggggcatttgccactatgggcctctacttacttgaaggcaccaactatctgctgggtggaatcctgttcctgatcgccaacctcacctttggcgcctcgatagtcttttacaacgctttcttgccggatattgccagtcctgatcggcgagacgccgtttcttcacagggatgggcgcttggatatctgggcggcggcttattactggcggccaacctggtcttctttttaaatgccggctcgttcggggttgagagtgggatggcggtgcgaatcagcctggtgtccgccggcatgtggtgggccatttttacgctcattccaatgtggacgctacggaaccgtggtgcagttcggcgcttaccgcctggcgagaactatttgacggtcggcttccgtcagttagcccacacatttcggcagatgcgcggttatccacaaaccctgctcttcctggcggcgtatctactctacaacgacggtattcaggcggtcattgcgctggctgcgcaattcggggccgaagagcttggcatcggcgagtcaacccggattgccactatcttgatggtacagttcgtcgctttcttcggcgccctgatcttcggtgctctggcaacacggttgggttcaaaacgagtgttgctgggtagtctggtcatttggacactggtcgtcagttatgcctacattatgccggccaacaacgatgtgcaattctttgcactcggtgcggcaattgccctggtgttgggggggagtcaggcaatcagtaggtcgctgttttcgctcatgatccctgatggtcaggaggcagagtactttagcctgtacgaagtgggtgagcgcggcacgagctggctggcgccactcttgttcggggttgcctaccagatgaccggtagctaccggatcgccattgtctcactgattatctttttcatcagtgggtttatcctgctcttgttcgtgaatgtacggcgggcggctgccgaagccggtaatcaggcaccggcgcatgtgtag

SEQ ID NO: 90304 - protein, 446 aa, Chloroflexus aurantiacus
MTTLAASTDNRREQVGWYFYDWANSAFSTTVVTVFLGPYLTSITRNAADANGFVYPFGIPVAAGSFFPYMVSLSVLLQVFFLPILGAIADYSNARKQMLAIFAYVGAFATMGLYLLEGTNYLLGGILFLIANLTFGASIVFYNAFLPDIASPDRRDAVSSQGWALGYLGGGLLLAANLVFFLNAGSFGVESGMAVRISLVSAGMWWAIFTLIPMWTLRNRGAVRRLPPGENYLTVGFRQLAHTFRQMRGYPQTLLFLAAYLLYNDGIQAVIALAAQFGAEELGIGESTRIATILMVQFVAFFGALIFGALATRLGSKRVLLGSLVIWTLVVSYAYIMPANNDVQFFALGAAIALVLGGSQAISRSLFSLMIPDGQEAEYFSLYEVGERGTSWLAPLLFGVAYQMTGSYRIAIVSLIIFFISGFILLLFVNVRRAAAEAGNQAPAHV

SEQ ID NO: 90305 - DNA, 1245 bp, Listeria monocytogenes
  CDS (1)..(1245): transl_table=11
ttggcatatacaaaagaggagaaaagctggatttttcaagattgggcgaattccgcctactcaatcatgatcacaacagcgattttaccaatttattttaaaggggtagcagcgaatgctggaattgctgacactacgtcgaccgcgtactggggatatgcaaactcgattgggacgttacttatttcattacttgcaccgatacttggaacaattgcggattatcaatttttcaaaaaacggtttttcggtatttttacagccatcgggattggctttactttcttgttaattttcatacccacgggtgcctggctattgttacttggattttatgtgctgtcattaataggcttttcaggtgcaaatattttttatgatgcgtttttaattgatgtaacaacgaacgaccggatggataaagtgtcatctgccggatatgcctatggttatttaggaagttgcatcccttttattatctttattattttccaagcgacaggtatcttgccaattagtgatgtcgcactcgtcaatatcggttttgttatgacagcgctttggtggctgtttttcacgattcccatgtggaagaacgtgcatcaaattcactatattccagcggtaaaacgtccagtcagaactagttttaaaagattatttcatactattagccacattagtgaacataaaaatattgttatctttttaattgcttatttcttctacatagatggggttgatacgattttccgcatggcgacatcgtacgggattgatcttggaatttctcagacaacattaattttaatacttttaatgacgcaactcgttgcatttccgttcactttattatatgggtatttagctaaacgtttcagtgcaaaaccacttatctttaccgcgatttttgtttatattattatatgtatttatgcggttttcatgaaatctgcgcttgatttttggatattagcaatgttagttggaacttcgcaaggtggtattcaagcattaagtagatcattcttcggaaaaattattcctaaaaagcgttcgaatgagttttacggattttataatattttcgggaaattttcagcaatcatgggaccggcccttatgggggtaatcacacaaattaccggaaaaacgcaatacggtgtggctagtttaattgtacttttcctcgttggtggtattttatttgtattcgtaaaagagaaaaacttagaaaatctttaa

SEQ ID NO: 90306 - protein, 414 aa, Listeria monocytogenes
MAYTKEEKSWIFQDWANSAYSIMITTAILPIYFKGVAANAGIADTTSTAYWGYANSIGTLLISLLAPILGTIADYQFFKKRFFGIFTAIGIGFTFLLIFIPTGAWLLLLGFYVLSLIGFSGANIFYDAFLIDVTTNDRMDKVSSAGYAYGYLGSCIPFIIFIIFQATGILPISDVALVNIGFVMTALWWLFFTIPMWKNVHQIHYIPAVKRPVRTSFKRLFHTISHISEHKNIVIFLIAYFFYIDGVDTIFRMATSYGIDLGISQTTLILILLMTQLVAFPFTLLYGYLAKRFSAKPLIFTAIFVYIIICIYAVFMKSALDFWILAMLVGTSQGGIQALSRSFFGKIIPKKRSNEFYGFYNIFGKFSAIMGPALMGVITQITGKTQYGVASLIVLFLVGGILFVFVKEKNLENL

SEQ ID NO: 90307 - DNA, 1590 bp, Schizosaccharomyces pombe
  CDS (1)..(1590)
atgaattctccaatacaacttcacaagaagttttccactacagtttggcatgttctgagctggattctttatgcagttggggcaggtcctactgcaattataagtatgggggtgtatgttcctttaattgttatgaaaaatgcccatgatcatggttttttaagaacagatcacacaattccttgttctttatatccagaagaaccttgctctttgaatatagttggtccgctatggattgatgttagttctattgtattcgctgcatcagctatttcaacttttttacagatggctatgatggttagcttgggtgttatttgcgattatggaaataacagaagatacatcttgttttcatgcgttatcataggttctattagtggtattatactttcgtggagtccctcgagttttcttttgggaaaaatagtgtttttgattctggtcgacttgaactttattatatctcaatcctgctatgacagctttctccctatttttttgagattctaccctatcacgagaggacctataacattggaatccgctcttcaggatgaaacagatgacctagatagctacataacaaataccaccattgattctagtgaagaagagccctatttgcttgaacacagcctaatacttaatgaatccgctcctcctgcagatgtggaagatgaacacaaggctaaaatcgctgctcgattatcaagcgttggcttcggtagcttcttcggcgctgctattctctttcagattatttttactcccattttgtacaaaactaataacaatccaataatcttgccaataactgttacagtgtgttcatgttggtggcttatactttcaacccccctttgtaccattgttacactacctgtggaaaatcactcaagtgatgctatcctgacactactttataatagtgtgaaagagtcgtatcattcattcaagcatgcaatgagtatttcttcgattaggctattcctattttcacgactcttcattaattgtggaattcaaacttctctttcttctgccgttatttttggaaaagcaaggttgaatctctctaactttcagctgactttgctaggaatgggaatatcttctttcgcattgttaggcaccgtaattataccctatcttactgagtattttcaactgaactcgttacaagtagtaatgattatttccatcctcttgccgatggctcctttatatggccttttgggttacattcctggatttgaaaatgctggaatacgaacatcagctgacgttttccgggctactttattctttggctttttcttaggaggtgcgcatagttattgtaggtccgtatacgctcaactagtgccatctggaaaagaaactagattctttgccctctacgctttgatatcacaaaccggtgtgttatttagccatatttctttaacacttatttcgaactacacatctgatttacgtgccgtctacatttttgtaattgttgttatgactttacctttgtcttctttatggataatgtatcaacacagcaaaacccccaacttgcataggtcctcctcttaa

SEQ ID NO: 90308 - protein, 529 aa, Schizosaccharomyces pombe
MNSPIQLHKKFSTTVWHVLSWILYAVGAGPTAIISMGVYVPLIVMKNAHDHGFLRTDHTIPCSLYPEEPCSLNIVGPLWIDVSSIVFAASAISTFLQMAMMVSLGVICDYGNNRRYILFSCVIIGSISGIILSWSPSSFLLGKIVFLILVDLNFIISQSCYDSFLPIFLRFYPITRGPITLESALQDETDDLDSYITNTTIDSSEEEPYLLEHSLILNESAPPADVEDEHKAKIAARLSSVGFGSFFGAAILFQIIFTPILYKTNNNPIILPITVTVCSCWWLILSTPLCTIVTLPVENHSSDAILTLLYNSVKESYHSFKHAMSISSIRLFLFSRLFINCGIQTSLSSAVIFGKARLNLSNFQLTLLGMGISSFALLGTVIIPYLTEYFQLNSLQVVMIISILLPMAPLYGLLGYIPGFENAGIRTSADVFRATLFFGFFLGGAHSYCRSVYAQLVPSGKETRFFALYALISQTGVLFSHISLTLISNYTSDLRAVYIFVIVVMTLPLSSLWIMYQHSKTPNLHRSSS

SEQ ID NO: 90309 - DNA, 1287 bp, Bacillus subtilis
  CDS (1)..(1287): transl_table=11
atgatgaaacgttttacgaaacaagaaaacagctgggtgttatatgactgggcaaattcagcttactcaattgtcgtgaccaccgcggtatttccgttattttataaatcagcagctgcggaaagcggtgtcagcgccgctcaatcgactgcctatctgggctataccattgcgatttcaacgtttattcttgcgatgctcggccctattttaggcacaatcgccgactatgaagggtgcaagaaaaagttcttcggtttctttgtgtcagccggtgtcgccagcaccgcgatgctcgcctttatccctagtgaacattggctgctattgttgctgttttatacggtatcggctatcggtttttccggcgccaatgtgttttatgatgcctttctcgtggacgtcacgcctgagaagcggatgaatctcgtctcggcacggggttttggcttaggatacattggaagcacgattccatttatcatcagtattgctgtcatcctgctcgcacaagcagagactattccagtgtctgtatcggccgcaagccagctgtccttcttcataacggctgcctggtgggggctgttcaccatcccaatgattaaacatgtccatcaacgctattacatcaaaaaagaacctcatattgtcatcaacagctttaagcggctcggccaaacgatgaaacggatcaggcaataccgggcacttttcctcttcttgctcgcttatttcttttatatcgacggagtcggcacgattattacgatgtcgacatcctatggatcagatttagggatcggctcctcaagccttctgatcatcctatttgtcacccaggtagtcgccgcgccgttttcgattatatacggaaaactggcagaacgcttcacggggaagaccatgctgtacgtcgggatcgtcatttatatgatcgtctgcgtgtatgcctattttatggagacaacgcttgatttctggatactggctatgcttgtcgccacctcgcaaggcggtattcaagccctaagccgttcctatttcgccaagcttgtgccaaagcgccacgccaatgaattctttggcttctacaacatttttggaaaattcgcctcaattatggggccgctgctcattgccgttaccgcccagctgaccggtaaatcctcgactgcggtgttcagcctgatcattttgtttgtgattggtattgtgattcttgcctttgttcccgaggaaaccagcacagatgtcagccagcagcaaaatgacctgcccctttaa

SEQ ID NO: 90310 - protein, 428 aa, Bacillus subtilis
MMKRFTKQENSWVLYDWANSAYSIVVTTAVFPLFYKSAAAESGVSAAQSTAYLGYTIAISTFILAMLGPILGTIADYEGCKKKFFGFFVSAGVASTAMLAFIPSEHWLLLLLFYTVSAIGFSGANVFYDAFLVDVTPEKRMNLVSARGFGLGYIGSTIPFIISIAVILLAQAETIPVSVSAASQLSFFITAAWWGLFTIPMIKHVHQRYYIKKEPHIVINSFKRLGQTMKRIRQYRALFLFLLAYFFYIDGVGTIITMSTSYGSDLGIGSSSLLIILFVTQVVAAPFSIIYGKLAERFTGKTMLYVGIVIYMIVCVYAYFMETTLDFWILAMLVATSQGGIQALSRSYFAKLVPKRHANEFFGFYNIFGKFASIMGPLLIAVTAQLTGKSSTAVFSLIILFVIGIVILAFVPEETSTDVSQQQNDLPL

SEQ ID NO: 90311 - DNA, 27 bp, Primer
atgagctatggaactataaatgatatg

SEQ ID NO: 90312 - DNA, 25 bp, Primer
ctaatccaaccttctttcactttca

SEQ ID NO: 90313 - protein, 591 aa, consensus
  MISC_FEATURE (1)..(591): consensus for the disclosure of xaa see table XV
WXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDXXXXXXXXXXXXXXXXXXXXXXXXXXXXXXXXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXSXXGXXXGYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFLXXXXXXXDXXXTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXRXXXXXXXPXXXXXXXXXXXXXXXXXXXXXXXGP

SEQ ID NO: 90314 - protein, 51 aa, consensus
  MISC_FEATURE (1)..(51): consensus for the disclosure of xaa see table XV
XXXXXXXXXXXXXXXXXXXXXXXXXXXXXXXXXXXXXXXXXXXXXXXXXXX

SEQ ID NO: 90315 - DNA, 1251 bp, Saccharomyces cerevisiae
  CDS (1)..(1251)
atgtctttatcttcaaagttgtctgtccaagatttggacttgaaggacaagcgtgtcttcatcagagttgacttcaacgtcccattggacggtaagaagatcacttctaaccaaagaattgttgctgctttgccaaccatcaagtacgttttggaacaccacccaagatacgttgtcttggcttctcacttgggtagaccaaacggtgaaagaaacgaaaaatactctttggctccagttgctaaggaattgcaatcattgttgggtaaggatgtcaccttcttgaacgactgtgtgcgtccagaagttgaagccgctgtcaaggcttctgccccaggttccgttattttgttggaaaacttgcgttaccacatcgaagaagaaggttccagaaaggtcgatggtcaaaaggtcaaggcttccaaggaagatgttcaaaagttcagacacgaattgagctctttggctgatgtttacatcaacgatgccttcggtaccgctcacagagctcactcttctatggtcggtttcgacttgccacaacgtgctgccggtttcttgttggaaaaggaattgaagtacttcggtaaggctttggagaacccaaccagaccattcttggccatcttaggtggtgccaaggttgctgacaagattcaattgattgacaacttgttggacaaggtcgactctatcatcattggtggtggtatggctttcaccttcaagaaggttttggaaaacactgaaatcggtgactccatcttcgacaaggctggtgctgaaatcgttccaaagttgatggaaaaggccaaggccaagggtgtcgaagtcgtcttgccagtcgacttcatcattgctgatgctttctctgctgatgccaacaccaagactgtcactgacaaggaaggtattccagctggctggcaagggttggacaatggtccagaatctagaaagttgtttgctgctactgttgcaaaggctaagaccattgtctggaacggtccaccaggtgttttcgaattcgaaaagttcgctgctggtactaaggctttgttagacgaagttgtcaagagctctgctgctggtaacaccgtcatcattggtggtggtgacactgccactgtcgctaagaagtacggtgtcactgacaagatctcccatgtctctactggtggtggtgcttctttggaattattggaaggtaaggaattgccaggtgttgctttcttatccgaaaagaaataa

SEQ ID NO: 90316 - protein, 416 aa, Saccharomyces cerevisiae
MSLSSKLSVQDLDLKDKRVFIRVDFNVPLDGKKITSNQRIVAALPTIKYVLEHHPRYVVLASHLGRPNGERNEKYSLAPVAKELQSLLGKDVTFLNDCVRPEVEAAVKASAPGSVILLENLRYHIEEEGSRKVDGQKVKASKEDVQKFRHELSSLADVYINDAFGTAHRAHSSMVGFDLPQRAAGFLLEKELKYFGKALENPTRPFLAILGGAKVADKIQLIDNLLDKVDSIIIGGGMAFTFKKVLENTEIGDSIFDKAGAEIVPKLMEKAKAKGVEVVLPVDFIIADAFSADANTKTVTDKEGIPAGWQGLDNGPESRKLFAATVAKAKTIVWNGPPGVFEFEKFAAGTKALLDEVVKSSAAGNTVIIGGGDTATVAKKYGVTDKISHVSTGGGASLELLEGKELPGVAFLSEKK

SEQ ID NO: 90317 - DNA, 1179 bp, Francisella tularensis subsp. tularensis
  CDS (1)..(1179)
atgagttttctaacattgaaagatgttgatttaaaagataaaaaagtcttggttcgtgttgacttcaacgtacctgttaaagatggtaaggtaacaagtaaagttagaattgaagcggctattccgactattcaatatattctagatcaaggtggagctgtgattctgatgtcacaccttggtcgtcctacagagggtgagtatgattctcagttctctctagagcctgttgctaaagctttatctgaaattatcaataagccggttaagtttgctaaagactggttagatggtgttgatgttaaagctggtgaaattgtcatgtgtgaaaatgtccgctttaatagtggtgagaaaaaatcaacagatgatttatctaaaaagattgcaagcttaggtgatgtgtttgttatggacgcttttgctacagcgcatagagctcaagcttcgacctacggtgtggctaaatatattcctgtagcatgtgcagggatattgttaactaatgaaattcaagcattagaaaaagctttaaaatcgccaaaaaaaccaatggcagcaatagttggagggtctaaggtctctactaaactatcggtgctaaataaccttcttgataaggttgaaattcttattgttggtggtggtattgctaatactttcataaaagcagaaggttttgatgttggtaattcattgtatgaacaagatcttgtcgctgaagcaacagagattttagctaaagctaaggctttaggggttaatattcctgtgccagttgatgtaagagttgctaaagagtttagcgaaaatgcccaagcaatcattaaaaaggtttccgatgttgttgcggatgagatgattctagatataggtccagaatctcaaaagataattgctgagctgttaaaatcagcaaatactatcttatggaatggacctgttggagtatttgagtttgataactttgcagagggtacaaaagctttatctttagctatagcacaatcgcacgctttttcagtagctggtggtggtgatactattgctgcgatagaaaaatttggcattaaagaccaagtttcttatatatcaacagctggtggagcattcttagagtttcttgaaggcaagaaattaccagctatagagatacttaaagaaaaagcaatcaggtag

SEQ ID NO: 90318 - protein, 392 aa, Francisella tularensis subsp. tularensis
MSFLTLKDVDLKDKKVLVRVDFNVPVKDGKVTSKVRIEAAIPTIQYILDQGGAVILMSHLGRPTEGEYDSQFSLEPVAKALSEIINKPVKFAKDWLDGVDVKAGEIVMCENVRFNSGEKKSTDDLSKKIASLGDVFVMDAFATAHRAQASTYGVAKYIPVACAGILLTNEIQALEKALKSPKKPMAAIVGGSKVSTKLSVLNNLLDKVEILIVGGGIANTFIKAEGFDVGNSLYEQDLVAEATEILAKAKALGVNIPVPVDVRVAKEFSENAQAIIKKVSDVVADEMILDIGPESQKIIAELLKSANTILWNGPVGVFEFDNFAEGTKALSLAIAQSHAFSVAGGGDTIAAIEKFGIKDQVSYISTAGGAFLEFLEGKKLPAIEILKEKAIR

SEQ ID NO: 90319 - DNA, 1254 bp, Homo sapiens
  CDS (1)..(1254)
atgtcgctttctaacaagctgacgctggacaagctggacgttaaagggaagcgggtcgttatgagagtcgacttcaatgttcctatgaagaacaaccagataacaaacaaccagaggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaaggatgttctgttcttgaaggactgtgtaggcccagaagtggagaaagcctgtgccaacccagctgctgggtctgtcatcctgctggagaacctccgctttcatgtggaggaagaagggaagggaaaagatgcttctgggaacaaggttaaagccgagccagccaaaatagaagctttccgagcttcactttccaagctaggggatgtctatgtcaatgatgcttttggcactgctcacagagcccacagctccatggtaggagtcaatctgccacagaaggctggtgggtttttgatgaagaaggagctgaactactttgcaaaggccttggagagcccagagcgacccttcctggccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctggaaggtaaagtccttcctggggtggatgctctcagcaatatttag

SEQ ID NO: 90320 - protein, 417 aa, Homo sapiens
MSLSNKLTLDKLDVKGKRVVMRVDFNVPMKNNQITNNQRIKAAVPSIKFCLDNGAKSVVLMSHLGRPDGVPMPDKYSLEPVAVELKSLLGKDVLFLKDCVGPEVEKACANPAAGSVILLENLRFHVEEEGKGKDASGNKVKAEPAKIEAFRASLSKLGDVYVNDAFGTAHRAHSSMVGVNLPQKAGGFLMKKELNYFAKALESPERPFLAILGGAKVADKIQLINNMLDKVNEMIIGGGMAFTFLKVLNNMEIGTSLFDEEGAKIVKDLMSKAEKNGVKITLPVDFVTADKFDENAKTGQATVASGIPAGWMGLDCGPESSKKYAEAVTRAKQIVWNGPVGVFEWEAFARGTKALMDEVVKATSRGCITIIGGGDTATCCAKWNTEDKVSHVSTGGGASLELLEGKVLPGVDALSNI

SEQ ID NO: 90321 - DNA, 1254 bp, Mus musculus
  CDS (1)..(1254)
atgtcgctttccaacaagctgactttggacaagctggacgtgaaggggaagcgggtcgtgatgagggtggacttcaacgttcctatgaagaacaaccagataacaaacaaccaaaggatcaaggctgctgttccaagcatcaaattctgcttggacaatggagccaactccgttgtccttatgagccacctgggccggcctgatggtgttcccatgcctgacaagtactccttagagccagttgctgctgaactcaaatctctgctgggcaaggatgttctgttcttgaaggattgtgtgggcccagaagtcgagaatgcctgtgccaacccagcggctgggactgtcatcctgctggaaaacctccgctttcatgtagaggaagaagggaagggaaaagatgcttctgggaacaaggttaaagctgagccggccaaaattgatgctttccgagcctcactgtccaaactaggagatgtctatgtcaatgatgcttttgggactgcacaccgagcccatagctccatggtgggtgtgaatctgccacagaaggctggtggatttttgatgaagaaggagctgaactactttgccaaggctttggagagtcctgagcgacccttcctggctatcttgggaggcgctaaagttgcagacaagatccagctgatcaataatatgctagacaaagtcaatgagatgatcattggtggtggaatggcctttaccttccttaaggtcctcaacaacatggagattggcacatctctgtatgatgaagaaggagccaagattgtcaaagatctcatgtccaaagctgagaaaaatggtgtgaagattaccttgcctgttgactttgtcactgctgacaaatttgatgagaatgccaagactggccaagctactgtggcctctggtatacctgctggctggatgggcttggactgtggtactgagagcagcaagaaatatgccgaggctgtgggtcgagctaagcagattgtttggaatggtcctgttggggtatttgaatgggaagcctttgccaggggaaccaagtcactcatggatgaggtggtgaaagccacttctaggggttgcatcactatcataggtggtggagacactgccacttgctgtgccaaatggaacacagaggataaagtcagccatgtgagcactgggggcggtgccagtctagagctcctggaaggtaaagtccttcctggggtggatgctctcagcaatgtttag

SEQ ID NO: 90322 - protein, 417 aa, Mus musculus
MSLSNKLTLDKLDVKGKRVVMRVDFNVPMKNNQITNNQRIKAAVPSIKFCLDNGANSVVLMSHLGRPDGVPMPDKYSLEPVAAELKSLLGKDVLFLKDCVGPEVENACANPAAGTVILLENLRFHVEEEGKGKDASGNKVKAEPAKIDAFRASLSKLGDVYVNDAFGTAHRAHSSMVGVNLPQKAGGFLMKKELNYFAKALESPERPFLAILGGAKVADKIQLINNMLDKVNEMIIGGGMAFTFLKVLNNMEIGTSLYDEEGAKIVKDLMSKAEKNGVKITLPVDFVTADKFDENAKTGQATVASGIPAGWMGLDCGTESSKKYAEAVGRAKQIVWNGPVGVFEWEAFARGTKSLMDEVVKATSRGCITIIGGGDTATCCAKWNTEDKVSHVSTGGGASLELLEGKVLPGVDALSNV

SEQ ID NO: 90323 - DNA, 1212 bp, Neisseria meningitidis MC58
  CDS (1)..(1212): transl_table=11
atggcatttttaaaactgaccgaacaaaacgtgcagggcaaaaccgtcctcatccgcgccgatatgaacgtaccgttcaaagacggcaaaatcagcgacgacacccgtatccgcgcctcgctcgcgtccattaaatactgcgtggacaacggtgcgtccgttatcgtgatgacccatctcggccgcccgaccgaaggcgagttccaccccgaagacgatgtcgcccccgttgccgcgcacttgggcagcctgttgggcaaagacgtgaaagtattgaacgactggcgtgaaaacaaacccgccctgaacgcgggcgatgtcgtcatgctgcaaaacgtgcgcatcaacaaaggcgagaagaaaaacgatttggaactgggtaaagcctacgcttctttgtgcgacgtgttcgtcaatgacgcgttcggaaccgcccaccgcgcccaagcctcgaccgaagccgtcgcccaagccgcgcccgttgcctgcgccggcgtattgatggcgggcgaactcgacgctttgggcaaagccttgaaacagcccgcgcgcccgatggttgccatcgttgccggcagcaaagtgtccaccaagctgaccatcctcgaatcgctggcggacaaagtcgaccaactcatcgtcggcggcggtatcgcaaacaccttcctgttggcggaaggcaaagccatcggcaaatctttggcggaacacgatttggtggaagaatccaaaaaaattatggcgaaaatggcggcaaaaggcggttctgtgccgctgccgaccgatgtcgtcgttgccaaagcctttgccgccgatgcggaagctgtggtgaaagacattgccgccgatgcggaagctgtggtgaaagacattgccgacgttgccgaagacgagatgattttggacatcggtccgaaatccgctgccgcgcttgccgatttgcttaaagccgccggtacggtcgtttggaacgggccggtcggcgtgttcgagtttgaccaattcgcaggcggtacgaaagcccttgccgaagccattgcccaaagcaaagcgttctcgattgcgggcggcggcgacacgctggcggcgattgccaaattcggcgttaccgaacaaatcggctacatctccaccggcggcggcgcgttccttgagttcttggaaggcaaagagctgcctgccgtagccgctttggaaaaacgcggcgcgtaa

SEQ ID NO: 90324 - protein, 403 aa, Neisseria meningitidis MC58
MAFLKLTEQNVQGKTVLIRADMNVPFKDGKISDDTRIRASLASIKYCVDNGASVIVMTHLGRPTEGEFHPEDDVAPVAAHLGSLLGKDVKVLNDWRENKPALNAGDVVMLQNVRINKGEKKNDLELGKAYASLCDVFVNDAFGTAHRAQASTEAVAQAAPVACAGVLMAGELDALGKALKQPARPMVAIVAGSKVSTKLTILESLADKVDQLIVGGGIANTFLLAEGKAIGKSLAEHDLVEESKKIMAKMAAKGGSVPLPTDVVVAKAFAADAEAVVKDIAADAEAVVKDIADVAEDEMILDIGPKSAAALADLLKAAGTVVWNGPVGVFEFDQFAGGTKALAEAIAQSKAFSIAGGGDTLAAIAKFGVTEQIGYISTGGGAFLEFLEGKELPAVAALEKRGA

SEQ ID NO: 90325 - DNA, 1248 bp, Sulfolobus solfataricus P2
  CDS (1)..(1248): transl_table=11
gtggggatctttctgattaaagtgggagacttaactatacccacaatggatgatatagatatccaatcaaaaaaagttctgttacgaatagacataaattcccccgtagatgagaacggcaaaataattgatgattctagaataaaggcacatattggaacaattaaggaattgattaataagggcaattctgttgtgttaatttcacatcaaggtaggcctggagacaaggatttcacaagtttagaggaacatgctaaattaatttcaaagtatttagatcgagaagtaattttcgtagatgatgtaataggcccatatgcaagggaaatgattaaaaaattagaaaataatgggattttactcttagataatataagattaatttcagaggagttaatagaggctccaccacaacaacacgtaaaaagctttttagtaaagaaattagctccgcttttcgacatttatatcaatgatgcgttcgctactgcacacagaagtcagcctagtatcgtaggctttcctttagctttaccatcagcagctggaagagtaatggaaagggaagtttcagcgttagccaagatttttaatgccgaagacacaccaaagatatttacgttaggtggtggtaaggttcacgatactattaggataattgaaaatctagtgagaaaaaggatagctgacagaatacttactgggggtttagttgcagaattattttctgtcgctaaaggaatgaatttaaatccaaagaatatggaaattctggaaaaattaggtatactgagtctaattcctagagctagaaaactacttctaagtggagctcctatcgaaataccagttgactataaggtagaaataaacggaaacgtaatcgaggaaccagctagtaaggtcactggcattataaaggatatcggatccactactgcagaaatatactcatcatttataaaagatgctaaagtagtagttttaaggggaccaatgggagtaatcgaagatgaaagatttaagagtggaagtaaaagcgtcttaaaagcatcattagagggacaaggttacgttataataggaggtggacacatgataagtgctttagatgaggatatgaagatagatagtagtaaagttcatatctctactggtggaggagctctcctcttattcttatctggagaacgattaccagcattagaggcattatcaatgtcggtggtgaatagcggtgattaa

SEQ ID NO: 90326 - protein, 415 aa, Sulfolobus solfataricus P2
MGIFLIKVGDLTIPTMDDIDIQSKKVLLRIDINSPVDENGKIIDDSRIKAHIGTIKELINKGNSVVLISHQGRPGDKDFTSLEEHAKLISKYLDREVIFVDDVIGPYAREMIKKLENNGILLLDNIRLISEELIEAPPQQHVKSFLVKKLAPLFDIYINDAFATAHRSQPSIVGFPLALPSAAGRVMEREVSALAKIFNAEDTPKIFTLGGGKVHDTIRIIENLVRKRIADRILTGGLVAELFSVAKGMNLNPKNMEILEKLGILSLIPRARKLLLSGAPIEIPVDYKVEINGNVIEEPASKVTGIIKDIGSTTAEIYSSFIKDAKVVVLRGPMGVIEDERFKSGSKSVLKASLEGQGYVIIGGGHMISALDEDMKIDSSKVHISTGGGALLLFLSGERLPALEALSMSVVNSGD

SEQ ID NO: 90327 - DNA, 1281 bp, Agrobacterium tumefaciens str. C58
  CDS (1)..(1281): transl_table=11
atgaggcctgaccggcttgcgtcggcaatcaggcatagtatggtccgtcccgaactcgcaacaaatcaggatcgacccatgcccgctttcaagaccatcgacgaccttaacgacattgccggaaagcgcgttctcgtccgcgttgatctcaacgtgccggtcgcggatggcaaggtgacggacgcaacccgtatcgaacgcgttgcgccgaccattctggaactctcttcaaagggcgcaaaagtcattctgctcgcccatttcggccgcccaaagggtgaacccgtcgctgagatgtcgctttcccagattgtccccacggtcgaggacgtgctggatcacgccatttccttcgcaacggactgcatcggtgcccctgcagcggatgcggtcgcaaaaatgaatgatggcgatattctgctgctggaaaacacccgcttccacaagggcgaggaaaagaacgatcccgccttcgtcgaagaactggccgcgaatggcgatatctatgtgaacgacgccttctccgccgctcaccgtgcccacgcctccaccgagggcctggcgcggcatctgcccgcttatgccggccgcaccatgcaggccgagcttgaggcgctggaaaaaggcctcggccagcccgttcgcccggtcgtcgccatcgtcggcggtgccaaggtttcgagcaagatcgatctcttgatgaacctcgtcaagaaggtcgatgccctcgtcattggcggcggcatggccaacaccttcctcgccgcccgcggcaccaatgtcggcaagtcgctctgcgagcacgatctggcagagaccgcaaagcagatcatgatcgaggcagcgacatccggttgcgctatcgtcctgccggaagacggcgtcgtcgcccgcgaattcacggccggcgcggccaatgaaattgtcgatatcaacgccattcccgccgacgccatggttctcgatgtcggtccgaaatcggttgaaagcatcaaggcctggatttcgcgggcggaaacgctggtctggaacggcccgctcggcgccttcgaaatcgaacccttcgatgcggcaaccgtggcggcggcaaaacacgctgcggaatgcaccaaggccggcaagctcgtttccgttgccggtggcggcgacaccgtcgctgcactcaaccatgccggtgtttcggacgatttcacctatatttcgacggcgggcggcgccttccttgaatggatggaaggcaaggaattgccaggcgttgccatcctgaccactgccaagtaa

SEQ ID NO: 90328 - protein, 426 aa, Agrobacterium tumefaciens str. C58
MRPDRLASAIRHSMVRPELATNQDRPMPAFKTIDDLNDIAGKRVLVRVDLNVPVADGKVTDATRIERVAPTILELSSKGAKVILLAHFGRPKGEPVAEMSLSQIVPTVEDVLDHAISFATDCIGAPAADAVAKMNDGDILLLENTRFHKGEEKNDPAFVEELAANGDIYVNDAFSAAHRAHASTEGLARHLPAYAGRTMQAELEALEKGLGQPVRPVVAIVGGAKVSSKIDLLMNLVKKVDALVIGGGMANTFLAARGTNVGKSLCEHDLAETAKQIMIEAATSGCAIVLPEDGVVAREFTAGAANEIVDINAIPADAMVLDVGPKSVESIKAWISRAETLVWNGPLGAFEIEPFDAATVAAAKHAAECTKAGKLVSVAGGGDTVAALNHAGVSDDFTYISTAGGAFLEWMEGKELPGVAILTTAK

SEQ ID NO: 90329 - DNA, 1164 bp, Escherichia coli K12
  CDS (1)..(1164): transl_table=11
atgtctgtaattaagatgaccgatctggatcttgctgggaaacgtgtatttatccgtgcggatctgaacgtaccagtaaaagacgggaaagtaaccagcgacgcgcgtatccgtgcttctctgccgaccatcgaactggccctgaaacaaggcgcaaaagtgatggtaacttcccacctgggtcgtcctaccgaaggcgagtacaacgaagaattctctctgctgccggttgttaactacctgaaagacaaactgtctaacccggttcgtctggttaaagattacctcgacggcgttgacgttgctgaaggtgaactggttgttctggaaaacgttcgcttcaacaaaggcgagaagaaagacgacgaaaccctgtccaaaaaatacgctgcactgtgtgacgtgttcgtaatggacgcattcggtactgctcaccgcgcgcaggcttctactcacggtatcggtaaattcgctgacgttgcgtgcgcaggcccgctgctggcagctgaactggacgcgctgggtaaagcactgaaagaacctgctcgcccgatggtggctatcgttggtggttctaaagtatctaccaaactgaccgttctggactccctgtctaaaatcgctgaccagctgattgttggtggtggtatcgctaacacctttatcgcggcacaaggccacgatgtgggtaaatccctgtacgaagctgacctggttgacgaagctaaacgtctgctgaccacctgcaacatcccggttccgtctgatgttcgcgtagcaaccgagttctctgaaactgcaccggctaccctgaaatctgttaacgatgtgaaagctgacgagcagatcctggatatcggtgatgcttccgctcaggaactggctgaaatcctgaagaatgcgaaaaccattctgtggaacggtccggttggcgtgttcgaattcccgaacttccgcaaaggtactgaaatcgtggctaacgctatcgcagacagcgaagcgttctccatcgctggcggcggcgacactctggcagcaatcgacctgttcggcattgctgacaaaatctcctacatctccactggcggcggcgcattcctcgaattcgtggaaggtaaagtactgcctgcagtagcgatgctcgaagagcgcgctaagaagtaa

SEQ ID NO: 90330 - protein, 387 aa, Escherichia coli K12
MSVIKMTDLDLAGKRVFIRADLNVPVKDGKVTSDARIRASLPTIELALKQGAKVMVTSHLGRPTEGEYNEEFSLLPVVNYLKDKLSNPVRLVKDYLDGVDVAEGELVVLENVRFNKGEKKDDETLSKKYAALCDVFVMDAFGTAHRAQASTHGIGKFADVACAGPLLAAELDALGKALKEPARPMVAIVGGSKVSTKLTVLDSLSKIADQLIVGGGIANTFIAAQGHDVGKSLYEADLVDEAKRLLTTCNIPVPSDVRVATEFSETAPATLKSVNDVKADEQILDIGDASAQELAEILKNAKTILWNGPVGVFEFPNFRKGTEIVANAIADSEAFSIAGGGDTLAAIDLFGIADKISYISTGGGAFLEFVEGKVLPAVAMLEERAKK

SEQ ID NO: 90331 - DNA, 1161 bp, Haemophilus influenzae Rd KW20
  CDS (1)..(1161): transl_table=11
atgtcagtaatcaaaatgaccgatttagatttagccggtaaacgtgtatttatccgtgcagatcttaatgtgccagtaaaagatggcaaagtgacctcagatgcgcgtattcgtgcgaccattcctactttaaaattagccttagaaaaaggtgcgaaagtgatggtaacttctcacttaggtcgtccaactgaaggagaattcaaaccagaagattctttacaaccagttgttgattacttaaaaaacgcaggctttaatgtgcgtttagaacaagattatttaaatggtgtggatgttaaagatggcgaaatcgttgttttagaaaacgtacgcgtaaacaaaggcgaaaagaaaaatgatccagaattaggtaaaaaatatgccgcactttgcgacgtatttgtaatggatgcctttggtacagcgcaccgcgcgcaagcatcaacttatggcgttgcagaatttgcgccgatcgcttgtgcaggcccattattagccgctgagttagatgcattaggtaaagcattaaaagaacctgctcgtccaatggtggctattgttggtggttctaaagtttccactaaattagaagtattaaattctctttcaaaaatcgctgaccaaattattgtgggcggtggcattgcgaatactttcatcgcggcagctggtcacaatgtaggtaaatctttatatgaagctgatttaattccagttgcgaaagaattagccgcaaatacagatattccagttccagttgatgtgcgtgtaggtttagagttctctgaaacggcagctgcaacagaaaaagtggtaaatgaagtgaaagatgatgaatctatttttgatattggcgataaatcagcagaacaattggctgaaattatcaaaaatgcaaaaaccgttttatggaatggcccagttggcgtgtttgagttccctcacttccgtaaagggactgaaatcatttctcacgccattgcaaacagcgatgcattctctatcgctggtggcggcgataccttagcggctatcgatttatttggtattgctgataagatttcttacatttcaacgggtggtggtgcattcttagagtttgtagaaggcaaagtattacctgcagtagaaattcttgaaaaacgtgcgaaaaactaa

SEQ ID NO: 90332 - protein, 386 aa, Haemophilus influenzae Rd KW20
MSVIKMTDLDLAGKRVFIRADLNVPVKDGKVTSDARIRATIPTLKLALEKGAKVMVTSHLGRPTEGEFKPEDSLQPVVDYLKNAGFNVRLEQDYLNGVDVKDGEIVVLENVRVNKGEKKNDPELGKKYAALCDVFVMDAFGTAHRAQASTYGVAEFAPIACAGPLLAAELDALGKALKEPARPMVAIVGGSKVSTKLEVLNSLSKIADQIIVGGGIANTFIAAAGHNVGKSLYEADLIPVAKELAANTDIPVPVDVRVGLEFSETAAATEKVVNEVKDDESIFDIGDKSAEQLAEIIKNAKTVLWNGPVGVFEFPHFRKGTEIISHAIANSDAFSIAGGGDTLAAIDLFGIADKISYISTGGGAFLEFVEGKVLPAVEILEKRAKN

SEQ ID NO: 90333 - DNA, 1164 bp, Salmonella typhimurium LT2
  CDS (1)..(1164): transl_table=11
atgtctgtaattaagatgaccgatctggatctggccgggaaacgcgtttttatccgtgcggatctgaacgtacctgttaaagaagggaaagtgaccagcgacgcgcgtatccgcgcttctctgccgaccatcgaactggctctgaaacagggcgcgaaagtgatggtaacttcccacctgggtcgtcctaccgaaggcgagtacaacgaagaattctctctgctgccggttgttaactacctgaaagacaaactgtctaacccggttcgcctggtcaaagattacctggacggcgttgacgtggccgaaggtgagctggtggttctggaaaacgttcgctttaacaaaggcgaaaagaaagacgacgaagcgctgtctaaaaaatacgccgccctgtgtgacgtattcgtgatggacgcctttggtactgcgcaccgcgcgcaggcttctacccacggtatcggcaaatttgctgatgttgcgtgcgcaggcccgctgctggccgctgaactggatgcgctgggtaaagcgctgaaagaaccggctcgtccgatggtggctatcgttggtggttctaaagtatctaccaaactgaccgttctggattccctgtctaaaatcgctgaccagctgattgtcggcggcggtatcgccaacaccttcgttgccgctcagggccacagcgtcggtaaatccctgtacgaagctgacctggttgacgaagcaaaacgtctgctgaccacttgcgatatcccggttccgaccgatgttcgcgttgccaccgagttctccgaaaccgcaccggcgactctgaaatccgttaacgacgtgaaagaagacgagcagatcctggatatcggcgatgcttccgctcagcagctggctgaaatcctcaagaatgccaaaaccattctgtggaacggcccggttggcgtgtttgagttcccgaacttccgtaaagggactgaaatcgtggcgaatgccatcgctgatagcgaagcgttttccatcgctggcggcggcgacaccctggcggcaatcgacctgttcggcattgctgacaaaatttcctacatttctactggcggcggcgcattcctcgaattcgtggaaggtaaagttctgccagccgtagcgatgctcgaagagcgcgctaagaagtaa

SEQ ID NO: 90334 - protein, 387 aa, Salmonella typhimurium LT2
MSVIKMTDLDLAGKRVFIRADLNVPVKEGKVTSDARIRASLPTIELALKQGAKVMVTSHLGRPTEGEYNEEFSLLPVVNYLKDKLSNPVRLVKDYLDGVDVAEGELVVLENVRFNKGEKKDDEALSKKYAALCDVFVMDAFGTAHRAQASTHGIGKFADVACAGPLLAAELDALGKALKEPARPMVAIVGGSKVSTKLTVLDSLSKIADQLIVGGGIANTFVAAQGHSVGKSLYEADLVDEAKRLLTTCDIPVPTDVRVATEFSETAPATLKSVNDVKEDEQILDIGDASAQQLAEILKNAKTILWNGPVGVFEFPNFRKGTEIVANAIADSEAFSIAGGGDTLAAIDLFGIADKISYISTGGGAFLEFVEGKVLPAVAMLEERAKK

SEQ ID NO: 90335 - DNA, 1215 bp, Brucella melitensis 16M
  CDS (1)..(1215): transl_table=11
ttgataaggaccgagagaagaaacatgatgttccgcacccttgacgatgccaatgtccaatccaagcgcgtgctggtccgtgttgacctcaacgtgccgatggcaaacggcgaagtcaccgaccttacccgcatcgaacgcatcgttccgaccatcgcggaactgtcaaggaagggcgcgaaggtcatcctgctcgcccatttcggtcgcccgaagggggttgcctcggatgaaaattcgctgaagcatgtcgtgaagccgctctccaaggttctggatcacagtgttcattttgccgaagactgcatcggcgacaaggcgaaagcggccgtcgatgcgctgaaggacggcgacgtcctgcttctggaaaatacccgtttccacaagggcgaggaaaagaacgatcctgaattcgtgcaggcgctggccgccaatggcgatctctatgtgaacgatgccttttccgccgctcaccgcgcccatgcctcgactgaaggtctggcccatgtcctgcctgccttcgcgggccgcgccatgcaggctgagcttgaagcacttgaaaagggcctcggcaatccggcccgcccggtggtcgccatcgtcggcggtgcaaaggtttcgaccaagctcgacctcctgtccaacctgatcgaaaaggtcgatgcgcttgtcatcggcggcggcatggccaacacgttccttgcagccaagggtcttgatgtcggcaaatcgctctgcgagcatgagctggcctcgaccgcacgcgaaatcatggccaaggccgaaaccaccaaatgcgccatcatcctgccggtggacgcgatcgtgggctggcacttcgccgccgatacgccacaccagacctatggcgtggattcggttccgggcgacgccatgatccttgacgcaggcgagctttcgaccgacctcattgcttcggccatcgatgatgccgcaacattggtctggaacggcccgcttggggctttcgagttgcgcccctttgacacagcaacggtgaaggtcgcaaggcatgtcgcaaagcgcacaaaggaaggcaagcttgtttcggtcggcggcggcggcgatacggtggcagccctcaaccatgcgggcgtggccgacgacttcacctatatctcaaccgctggcggcgctttcctcgaatggatggaaggcaaaccgcttccgggcgtcgatgtattgaagaagtga

SEQ ID NO: 90336 - protein, 404 aa, Brucella melitensis 16M
MIRTERRNMMFRTLDDANVQSKRVLVRVDLNVPMANGEVTDLTRIERIVPTIAELSRKGAKVILLAHFGRPKGVASDENSLKHVVKPLSKVLDHSVHFAEDCIGDKAKAAVDALKDGDVLLLENTRFHKGEEKNDPEFVQALAANGDLYVNDAFSAAHRAHASTEGLAHVLPAFAGRAMQAELEALEKGLGNPARPVVAIVGGAKVSTKLDLLSNLIEKVDALVIGGGMANTFLAAKGLDVGKSLCEHELASTAREIMAKAETTKCAIILPVDAIVGWHFAADTPHQTYGVDSVPGDAMILDAGELSTDLIASAIDDAATLVWNGPLGAFELRPFDTATVKVARHVAKRTKEGKLVSVGGGGDTVAALNHAGVADDFTYISTAGGAFLEWMEGKPLPGVDVLKK

SEQ ID NO: 90337 - DNA, 1167 bp, Encephalitozoon cuniculi
  CDS (1)..(1167)
atgaaaacaattagcaatgcggagattgagggaaaacgggtatttctccgggtggacttcaatgtgccgatattggactctgtggttctgaacgacttcaaaataacttctgtgcttccaacaatcagacttcttcattctaggaatcccaggagagtgattattggaagtcaccttggaagacccaaggggaagtattccaaggagctttccctgaggcctgtctactcagtactaaaggcgcgcctctgggaggaacttggcgtagagttggatttctgcgacctgtgggatgttgggaatgtgcaaagtccatggatactcctggagaacctcaggttttattccgcagaggaagacgccggcgacaaggatgctgttgatcagtacagaaatgtattcgtagacaatatggatgttgctgttatagatgcattcggatgtctgcatagagaatgcgggtctatacagagaaccgggcttccttcattctctgggcttctggtccagaaagagttgaactttactaaggaaatcatggaggaaagggtggatcttatgatactgggaggaaagaaagtgtccgacaagatcaagctgctggaatctcttggacagaaaacaggaagcttatttgttaccggaggactggcatttccattcattagatacatattgggaaaggaggttggaaagagcataggagaaagtgtttctgaagaggaagtaaagaggatacataagatctgtgaggagcacaaaacaaggattatccttccatctgacttcacggttgtttgcaacgacagcgtacaaacaactagcaacatcccccctgaggggagtgcaatggacataggcccggaaactatagaaatgctaaggagagaagtttctaaggcaaaggccgtgttttggaatggccctcccggaatgtatgaagaacaaagtttctcgaggggaacggaggctttggtgagtgccttggagagtcttaaaggagaagggaagaagtctttctgcggaggaggggagactgcaggcgcaatcagattgtttggtagctatgatgcctttacttatgtatctaccggaggaggggtgctgatgaagctgctgggtggaaaaaggcttcctgggctagacttcctctccatgcagccctga

SEQ ID NO: 90338 - protein, 388 aa, Encephalitozoon cuniculi
MKTISNAEIEGKRVFLRVDFNVPILDSVVLNDFKITSVLPTIRLLHSRNPRRVIIGSHLGRPKGKYSKELSLRPVYSVLKARLWEELGVELDFCDLWDVGNVQSPWILLENLRFYSAEEDAGDKDAVDQYRNVFVDNMDVAVIDAFGCLHRECGSIQRTGLPSFSGLLVQKELNFTKEIMEERVDLMILGGKKVSDKIKLLESLGQKTGSLFVTGGLAFPFIRYILGKEVGKSIGESVSEEEVKRIHKICEEHKTRIILPSDFTVVCNDSVQTTSNIPPEGSAMDIGPETIEMLRREVSKAKAVFWNGPPGMYEEQSFSRGTEALVSALESLKGEGKKSFCGGGETAGAIRLFGSYDAFTYVSTGGGVLMKLLGGKRLPGLDFLSMQP

SEQ ID NO: 90339 - DNA, 1347 bp, Drosophila melanogaster
  CDS (1)..(1347)
atgcttccaattcggcagagtttataccaaagagctcaaactcgatttacaaaattaagatttccaagattttttagcaaagacgattgcaatggaaagcaagtaaagaagttgagcttaaaaaatgtagatgtggctgggaaaagggtttttatgagagtggactttaatgtacccatgaaagatggcaaaataaccaacaaccaacgaattgtttccgcacttcccagtattaaatatgccttggacaagaaatgtaagtccttggttttggcatcccacttggggcgtccggatggcaaaaagaacaaaaagtttagcctggaacccgtggccaaggagctggagagtgtgctgggccagccggttcaattcctggacgactgcgtgggtgatagcaccctgagagctttgaaggatccctccgacggcactgtgttcctgttggagaatcttcgtttctatgccgaggagacgggcagcagcaaggacgataacaagaagaaggtcaaagcagatcccgcgaaggtgaaggaattccgagccaagttggcgcagctgggcgagatctatgtgaacgatgcctttggaacagcacatcgtccgcatagttccatgatgggcgatggctacaaggtgcgagcggctggtttcctgctggacaaggaactggagtactttgccaaggttctccacgatccggccaagccctttttggccattctgggtggcgccaagatagccgataaaattccactgataacgaacctcctgaacaatgtaacggccatgatcatatccggtggcatggccttcacctttctcaaagtgctcaatggcatggagattggaaagtccctcttcgacgagaagggatccgagttggtcaacgacatagtctgcaaggcgaaggagaaggacgtgaatatactatttccgattgactttgtcatagccaataagatcgacaaggagccggataaagtggaacatgtggatgccacacagggcataccggaggacatgatgggtctggaccacggccaggcatccagtcagatgtttgctggcgctatttgtgcatccaaaaccatcgtctggaacggaccgccaggcttgttcgaaaacgagctattctccaaaggcaccgagtccatgctggaggcagtaatcggggccactaaccgaggagccaccacaatcgttggtggtggggatacggccaccgcttgcttgaagttcggaggcgccgacaaggtctcgcatgtgtccaccggtggaggagcttccctggagttgctggagggtaaggttctgcctggagtggctgctctttcggatgcctaa

SEQ ID NO: 90340 - protein, 448 aa, Drosophila melanogaster
MLPIRQSLYQRAQTRFTKLRFPRFFSKDDCNGKQVKKLSLKNVDVAGKRVFMRVDFNVPMKDGKITNNQRIVSALPSIKYALDKKCKSLVLASHLGRPDGKKNKKFSLEPVAKELESVLGQPVQFLDDCVGDSTLRALKDPSDGTVFLLENLRFYAEETGSSKDDNKKKVKADPAKVKEFRAKLAQLGEIYVNDAFGTAHRPHSSMMGDGYKVRAAGFLLDKELEYFAKVLHDPAKPFLAILGGAKIADKIPLITNLLNNVTAMIISGGMAFTFLKVLNGMEIGKSLFDEKGSELVNDIVCKAKEKDVNILFPIDFVIANKIDKEPDKVEHVDATQGIPEDMMGLDHGQASSQMFAGAICASKTIVWNGPPGLFENELFSKGTESMLEAVIGATNRGATTIVGGGDTATACLKFGGADKVSHVSTGGGASLELLEGKVLPGVAALSDA

SEQ ID NO: 90341 - DNA, 1326 bp, Bifidobacterium longum NCC2705
  CDS (1)..(1326): transl_table=11
gtgacaaaacaccgcattcagtcagtagacgaatgcggtgttttgttccggaatgcctgtaatatgcaaagtggcaaaattggccactttgacgtgcgattcgtcaaggaaaggatattcatgaagacactcaaggaccttggagatctcaagggcaagcgcgttctggttcgcgctgatttcaatgttccgctggacggcaccaccatcaccgatgacggtcgaatcaaggctgctctgccgaccatcaagaccctgcgcgaagaaggcgccaaggtcatcctcatggcccaccttggccgcccgaagggcaaggtcgttcctgagctgagcctggccccggttgccgcccgcctcggcgagctgctcggcgccaacgtgccgctggccaaggacacctacggcgaggacgctcaggccaaggtcgccgccatgaacgatggcgacgttgtgctgcttgagaacgttcgtttcaacccggaggagacctctaaggacgccgacgaacgcgccgcttacgccaagaagatcgccgccctcggcgaggccttcgtttccgatggcttcggcgtggtccaccgcgctcagggctccaactacgacgttgccgccgatctgccggccgccgcaggcctgctggtcgagaaggaagtcaaggccttgtccaaggccaccgagaacccggagcgtccgttcaccgtggtgctcggcggttccaaggtctccgacaagctcggcgtcatcgagaacctgctcgacaaggccaaccgtctggtcatcggcggtggcatggtgttcaccttcctcaaggccaagggctacgaggtcggcacctccctgcttgaagaggaccagcttgagaaggtcaagggctacatcgagaccgccgagaagaacggcgttgagctcgtgctgccgaccgacgtcgtcgtgaacgccggcttcccggccggtgacaccccggttgctccggaagtcgttgccgccgacgccatcccggccgacaagatgggtctggacatcggcccggagtcccagaagctcttccacgacaagatcgtcgactccaagaccgtcgtgtggaacggcccgatgggcgtgttcgaggttcctgagttcgccgccggcaccaaggccgtggcccagggtctggtcgacgccaccgcagtcggtgcgttcaccatcgtcggtggcggcgactccgcctccgccgtgcgcaacctcggcttcccggaggacggcttctcccacatctccaccggtggtggcgcttccctcgagttcctcgaaggcaaggagctccctggcctgaaggtgcttgagtaa

SEQ ID NO: 90342 - protein, 441 aa, Bifidobacterium longum NCC2705
MTKHRIQSVDECGVLFRNACNMQSGKIGHFDVRFVKERIFMKTLKDLGDLKGKRVLVRADFNVPLDGTTITDDGRIKAALPTIKTLREEGAKVILMAHLGRPKGKVVPELSLAPVAARLGELLGANVPLAKDTYGEDAQAKVAAMNDGDVVLLENVRFNPEETSKDADERAAYAKKIAALGEAFVSDGFGVVHRAQGSNYDVAADLPAAAGLLVEKEVKALSKATENPERPFTVVLGGSKVSDKLGVIENLLDKANRLVIGGGMVFTFLKAKGYEVGTSLLEEDQLEKVKGYIETAEKNGVELVLPTDVVVNAGFPAGDTPVAPEVVAADAIPADKMGLDIGPESQKLFHDKIVDSKTVVWNGPMGVFEVPEFAAGTKAVAQGLVDATAVGAFTIVGGGDSASAVRNLGFPEDGFSHISTGGGASLEFLEGKELPGLKVLE

SEQ ID NO: 90343 - DNA, 1197 bp, Streptococcus pyogenes SSI-1
  CDS (1)..(1197): transl_table=11
atggctaaattgactgttaaagacgttgatttgaaaggtaaaaaagtcctcgttcgtgttgactttaatgtgcctttgaaagacggcgttatcactaacgacaaccgtatcactgcggctcttccaacaatcaagtatatcatcgaacaaggtggtcgtgctatcctcttctctcaccttggacgtgttaaagaagaagctgacaaagaaggaaaatcacttgcaccggtagctgctgatttagctgctaaacttggtcaagatgttgtattcccaggtgttactcgtggttcaaaattagaagaagcaatcaatgctttggaagatggacaagttcttttggttgaaaacactcgttttgaagatgttgacggtaagaaagaatctaagaatgacgaagaacttggtaaatactgggcttcacttggagatggaatcttcgttaacgatgcatttggtacagcacaccgtgctcacgcatcaaacgtaggtatttcagcaaacgttgaaaaagctgtagctggtttccttcttgaaaacgaaattgcttacatccaagaagcagttgaaactccagaacgtccattcgtagctattcttggtggctcaaaagtttctgataagattggtgttatcgaaaatcttcttgaaaaagctgataaagttcttatcggtggtggtatgacttacacattctacaaagctcaaggtatcgaaatcggtaactcacttgtagaagaagacaaattggatgttgctaaagacctccttgaaaaatcaaatggtaaattgatcttgccagttgactcgaaagaagcaaacgcatttgctggttacactgaagttcgcgacactgaaggtgaagcagtttcagaaggcttccttggtcttgacatcggtcctaaatcaatcgctaaatttgatgaagcacttactggtgctaaaacagttgtttggaacggacctatgggtgtctttgaaaaccctgacttccaagctggtacaatcggtgtcatggacgctatcgttaaacaaccaggcgttaaatcaatcatcggtggtggtgattcagcagcagctgctatcaaccttggccgtgctgacaaattctcatggatcagtaccggcggaggcgctagcatggaacttctcgagggtaaagtattaccaggtttggcagcattgactgaaaaataa

SEQ ID NO: 90344 - protein, 398 aa, Streptococcus pyogenes SSI-1
MAKLTVKDVDLKGKKVLVRVDFNVPLKDGVITNDNRITAALPTIKYIIEQGGRAILFSHLGRVKEEADKEGKSLAPVAADLAAKLGQDVVFPGVTRGSKLEEAINALEDGQVLLVENTRFEDVDGKKESKNDEELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKDLLEKSNGKLILPVDSKEANAFAGYTEVRDTEGEAVSEGFLGLDIGPKSIAKFDEALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 90345 - DNA, 1278 bp, Bordetella parapertussis 12822
  CDS (1)..(1278): transl_table=11
ttggttttcccgtcacggggaaacggatctggcccttttcgcaggcaggccccggacgccatccacacaggaaccgaatacagtatgtccaacgtcaatacgctttccgcgctggccaagagcggcgctctgtccggcaagcgcgttttcatccgcgccgacctcaacgtgccgttcgacgacgccggccgcatcagcgaagacacccgcatccgcgcctcggtgcccggcatccgcctggcgctggacgccggcgaggcggtcatggtcacctcgcacctgggccgccccaaggagggcgcgctgaccgaggcggactcgctggccccggtcgcgcagcgcctgtccgaactgctgggcatgcaggtgcgcctggtgcccgactgggtcgacggcgtttccgtcgagccgggcgaagtcgtgctgctggagaactgccgcggcaacgtgggcgagaaaaaggacgacgaaggcttgtcgcgcaagatggcggcgctgtgcgatgtgtacgtcaacgacgccttcggcaccgcgcaccgcgccgaggccaccacgcacggcatcgcgcgcttcgcgccggtggcctgcgccggcccgctgctggaggccgagctcgaggcgctggggcgcgcgctgcatgatcccaaacggccgctggtggcgatcgtgggcggctccaaggtgtcgaccaagctgtccatcctgcaatcgctggccgacaaggtcgaccagctggtggtcggcggcggcatcgccaacaccttcatgctggccgccggcctgcccatcggcaagtcgctggccgagcccgagcaggtcgagcaggcgcgcgccgtgatcgaaatcatgaagcgccgcggcgccgaggtgccgattcccaccgacgtggtttgcgccaagtcgttcggcgcggacgccgcggccaccgtcaaggcggccgccgacgtggccgaggacgacatgatcctcgacatcggaccgcagaccgcgcagcgcctggccgacatcctcaaggcggccggcaccatcgtctggaacggtccggtcggcgtgttcgagttcgaccagttcgcccacggcaccgaggtggtggcgcgcgccatcgccgactcggcgggcttttcgattgccggcggcggcgatacgctggctgccatcgccaagtacggcatcgccgaccagaccggctatatctcgaccggcggcggcgctttcctggagttcctggaaggcaaggcgctgccggccgtggccgtgctgcaggcgcgcgccgcgtaa

SEQ ID NO: 90346 - protein, 425 aa, Bordetella parapertussis 12822
MVFPSRGNGSGPFRRQAPDAIHTGTEYSMSNVNTLSALAKSGALSGKRVFIRADLNVPFDDAGRISEDTRIRASVPGIRLALDAGEAVMVTSHLGRPKEGALTEADSLAPVAQRLSELLGMQVRLVPDWVDGVSVEPGEVVLLENCRGNVGEKKDDEGLSRKMAALCDVYVNDAFGTAHRAEATTHGIARFAPVACAGPLLEAELEALGRALHDPKRPLVAIVGGSKVSTKLSILQSLADKVDQLVVGGGIANTFMLAAGLPIGKSLAEPEQVEQARAVIEIMKRRGAEVPIPTDVVCAKSFGADAAATVKAAADVAEDDMILDIGPQTAQRLADILKAAGTIVWNGPVGVFEFDQFAHGTEVVARAIADSAGFSIAGGGDTLAAIAKYGIADQTGYISTGGGAFLEFLEGKALPAVAVLQARAA

SEQ ID NO: 90347 - DNA, 1176 bp, Vibrio vulnificus YJ016
  CDS (1)..(1176): transl_table=11
ttgagaggacacatcatgtctgtaatcaagatgactgacctggatctagcaggtaaacgtgtattcatccgtgctgacctaaacgtgccagtaaaagacggtaaagtaacttctgatgcacgtatcatcgcatctcttcctactatcaagctatgtctagaagctggcgcgaaagtaatggtcacttctcacctaggtcgtcctactgaaggtgaatacgcagaagagttctctctacaaccagttgttaactacctaaacgacgcgctagattgcgaagtgaaactggctaaagattacctagatggtcttgagctaaacgctggtgaacttgttgttcttgaaaacgttcgctttaacaaaggcgagaagaaaaacgacgaagaactttctaagaaatacgcggcactatgtgacgtattcgtaatggatgcattcggtacagctcaccgtgcacaagcgtcaactcacggtgtgggtatgtttgctgaagtagcgtgtgcgggccctctacttgctgctgaactagaagcactaggcaaagcaatgagcaacccagagcgtcctctagttgctatcgttggtggttcaaaagtgtctactaaactaacggttcttgagtcactatctaaaatcgctgaccaacttgttgttggtggtggtatcgcgaacacattcatcgcagctgaaggtcacaatgtaggtaagtctctatacgaagcggatcttgttgaaactgcacaaaaactgatgaaagagtgtgcaattcctgtcgcgactgacgtagcgtgtgcgaaagcattcgacgagaacgcagaagcggaaatcaaacatgtttctgaagtacaagacgacgacatgatcttcgaccttggtccagactcaacagctgcactagctgaaatcatcgcaaacgcgaaaactattctgtggaatggccctgttggtgtattcgagttcaaaaacttcgaagcgggtactaaaggtatttctgaagcgatcgctcagtctccagcattctctgtagcaggcggtggcgatacgctagcggctatcgacaagttcggtatcaaagcggacgtatcttacatctctactggcggcggtgcgttccttgagtttgtagaaggtaaagtacttccagcagttgaaatgctagaagcacgcgctaagtaa

SEQ ID NO: 90348 - protein, 391 aa, Vibrio vulnificus YJ016
MRGHIMSVIKMTDLDLAGKRVFIRADLNVPVKDGKVTSDARIIASLPTIKLCLEAGAKVMVTSHLGRPTEGEYAEEFSLQPVVNYLNDALDCEVKLAKDYLDGLELNAGELVVLENVRFNKGEKKNDEELSKKYAALCDVFVMDAFGTAHRAQASTHGVGMFAEVACAGPLLAAELEALGKAMSNPERPLVAIVGGSKVSTKLTVLESLSKIADQLVVGGGIANTFIAAEGHNVGKSLYEADLVETAQKLMKECAIPVATDVACAKAFDENAEAEIKHVSEVQDDDMIFDLGPDSTAALAEIIANAKTILWNGPVGVFEFKNFEAGTKGISEAIAQSPAFSVAGGGDTLAAIDKFGIKADVSYISTGGGAFLEFVEGKVLPAVEMLEARAK

SEQ ID NO: 90349 - DNA, 1344 bp, Eremothecium gossypii
  CDS (1)..(1344)
atgggccggtcgtggggtctgctctggatggcgtgcttgctgtacggcgtgttcacagagtgtcgcagatcttcacagcacgcacacacaggaaaaatgtcgctatcctctaagctaacagtcaaggacctgagccttgcgggcaaacgcgtgttcatccgcgtggacttcaacgtgccgctagacgggaagacgatcacgtcgaaccagcgcattgtggccgcgctacccacgatcaagtacgtgttggagcagggccccaaggcggtggtgttggcgtcgcacctagggcggcccaacggcgagcgcaacgagaagtactcgttggcgccggtggccgcggagctggagaagctgctgggccagaaggtgaactcctggacactgcgtgggcagcacgtgaccgctgcggtcaacggcgcggctgcggggtccgtgttcctgcttgagaacctgcggttccacatcgaggaggagggctcgcgcaaggtggacggcgagaaggtcaaggcgtctgcggaggacgtgcagaagttccgccagggcctcatgtcgctcgcggacgtctacgtcaacgacgccttcggcaccgcgcacagagcgcactcctcgatggtcggcttcgagctgcctgagagggccggcggcttcttgttgtcgcgcgagctggagtacttcagcaaggcgttggagaaccctacgagacccttcttggcgatcctgggcggtgccaaggttgccgacaagatccagttgatcgacaacttgttggacaaggtcgactcgattgtgatcggcggtggcatggccttcaccttcaagaaggtgcttgagaacatggagatcggtaactccatctacgacaaggcgggtgccgagatcgttcctaagctagcggagaaggccaagaagaacggcgtcaagatcgtgttgcctgtggacttcgtgatcggcgacgacttctcccaggacgccaacaccaagattgtctctgcctccgagggcattccatccggctgggagggtctagactgtggtcctgagtccagaaagctgttcagcgagaccatcgcgagcgcgaagaccatcgtgtggaacggcccaccaggtgtctttgagattccaaagttctccgagggtacccaggccatgcttgcggccgctgtcaaggcctccgaggctggcagcaccgtcatcatcggcggtggtgacaccgctaccgtggccaagaagtacggtgtggtcgagaagatctcccatgtgtccaccggtggtggtgcctccctagagctattggagggtaaggacctaccaggtgtcaccttcttgtccagcaagcagtag

SEQ ID NO: 90350 - protein, 447 aa, Eremothecium gossypii
MGRSWGLLWMACLLYGVFTECRRSSQHAHTGKMSLSSKLTVKDLSLAGKRVFIRVDFNVPLDGKTITSNQRIVAALPTIKYVLEQGPKAVVLASHLGRPNGERNEKYSLAPVAAELEKLLGQKVNSWTLRGQHVTAAVNGAAAGSVFLLENLRFHIEEEGSRKVDGEKVKASAEDVQKFRQGLMSLADVYVNDAFGTAHRAHSSMVGFELPERAGGFLLSRELEYFSKALENPTRPFLAILGGAKVADKIQLIDNLLDKVDSIVIGGGMAFTFKKVLENMEIGNSIYDKAGAEIVPKLAEKAKKNGVKIVLPVDFVIGDDFSQDANTKIVSASEGIPSGWEGLDCGPESRKLFSETIASAKTIVWNGPPGVFEIPKFSEGTQAMLAAAVKASEAGSTVIIGGGDTATVAKKYGVVEKISHVSTGGGASLELLEGKDLPGVTFLSSKQ

SEQ ID NO: 90351 - DNA, 1296 bp, Methanococcus maripaludis S2
  CDS (1)..(1296): transl_table=11
atgttacaaagaacgaatttaaccaaatcgcgaaaaaacggaggaataataatgtttttaactcttgacgactttgaattggaaggaaaaacggttgcattgagagttgacattaatagccctattgatgttaatactggagatattttagatgatacaaggattaaggcatgcagtgatacgataaaaagtctttcagaaaaaggagcaaaggttgttattttagcacaccagagcaggcctggaaaaaaagattttacgactcttgaagctcacgcgaaaaaactgtccgaagtattaaatatggaagttacacacgtagatggattaatctgcgcgtctgcacgtgaagcaattcttgcaatggataatggggaaataatacttcttgaaaacgtaaggcttcttgcagaagaagttttatccgattggaagtcttgggaagaaattactccagaaaaacaggctaaaacagtcatgattaagaaattacatccttttttcgattattttgttaacgatgcatttgcagcagctcacagggctcaaccttctcttgttggattttcttactatgttccaatgttatgcggaagggtcatggaaaaagaattatttacacttacaaaagttctcaaaaaccctgaaagaccttgcgtgtttgcattgggtggtgcaaaagctgacgacagtattgaagtattgaaaaacgttcttgaaaaacagaccgccgatcaggttttaacaagtggtgttgttgcaaatatctttttagttgcaaaaggttacaaaatcgggccaaatgaaaatgtaattgctgacatgggatacaccaaccagatagaaattgcaaaagagttaatttcaaaatatggggacaaaatcgtggttccaatcgatgcagcattaaatgtcgatggtgaacgggttgaaaaagaactcgacttaaacgaagaaataacttaccctattcacgacatgggcgaaaaaaccatgaaactctacgaagaaattttaaaagatgcaaaaacggttgttgcaaacggacctgctggagttttcgaaaataaaaatttcttaaaaggaacagaagaacttttaaaaagcactgcaaattcaaaaggcttttcggttatcggtggaggacacctctcagcagctgccgaagttgtagggttggcaggaaaaatggaccacatcagcactggtggcggtgcatgtatcgaatttttagctggtaaaaaacttcctgtaattgaaatgctgtccaaatcttacgaaaaacataaactttaa

SEQ ID NO: 90352 - protein, 431 aa, Methanococcus maripaludis S2
MLQRTNLTKSRKNGGIIMFLTLDDFELEGKTVALRVDINSPIDVNTGDILDDTRIKACSDTIKSLSEKGAKVVILAHQSRPGKKDFTTLEAHAKKLSEVLNMEVTHVDGLICASAREAILAMDNGEIILLENVRLLAEEVLSDWKSWEEITPEKQAKTVMIKKLHPFFDYFVNDAFAAAHRAQPSLVGFSYYVPMLCGRVMEKELFTLTKVLKNPERPCVFALGGAKADDSIEVLKNVLEKQTADQVLTSGVVANIFLVAKGYKIGPNENVIADMGYTNQIEIAKELISKYGDKIVVPIDAALNVDGERVEKELDLNEEITYPIHDMGEKTMKLYEEILKDAKTVVANGPAGVFENKNFLKGTEELLKSTANSKGFSVIGGGHLSAAAEVVGLAGKMDHISTGGGACIEFLAGKKLPVIEMLSKSYEKHKL

SEQ ID NO: 90353 - DNA, 1254 bp, Gallus gallus
  CDS (1)..(1254)
atgtctctctccaacaagctcaccctggataaggtggatgtgaagggcaagcgggtcgtcatgagggttgacttcaatgttccaatgaaggatcacaaaataaccaacaaccaaagaatcaaggcagctgtccctaccatcaagcactgcttggaccatggagccaagtcagtggttttgatgagtcacctgggccgcccggatggagttcccatgcctgacaagttctccttttctccagtagctgtggagcttaaagctctcctgggcagggaggtctcattcctgaaggattgtgttggtcctgaggtggagaaggcctgtgctaatcctgcaaacggctccgtcatcctgctagagaacctccgattccatgtagaagaagaagggaaagggaaggatgcttcagggaacaagatcaaagctgatgctgcaaaagtggaggctttcagagcctctctttctaaattgggagatgtttatgtcaatgatgcttttggaactgcccatcgtgctcacagctccatggtaggtgttcatcttcctcagaaggctgctggcttcctgatgaagaaagaactggattattttgcaaaggcccttgagagtccagagagacccttcttagcaattcttggaggagctaaagttcaggataagatccagctgatcagtaacatgttagataaggtcaacgagatgatcattggtggtggaatggcattcacctttctcaaagtgttaaacaacatgcagattggcaactcgctgtttgatgaagagggatcaaaaattgtcaaggacctgatggccaaggcagagaagaacggtgtgaagattaccttgccagttgacttcatcactgcagacaaatttgatgagcatgcacagactggggaagccacagtggcttcaggcattcctgctggctggatgggcttggactgcggccctgaaagtgttaagaagtttgttgaagttgtgggaagggccaaacaaatagtgtggaacggtccagttggagtctttgaatgggacaagttctccaaaggaaccaaagccctgatggacaaagtggtggaagtaactggaaagggctgcatcaccattattggtggtggagatactgctacatgctgtgcgaagtggaatactgaagataaagttagccacgttagcactggaggtggtgccagcctggaactgctagagggtaaggttcttcctggcgtggatgccttgagcagtgtgtag

SEQ ID NO: 90354 - protein, 417 aa, Gallus gallus
MSLSNKLTLDKVDVKGKRVVMRVDFNVPMKDHKITNNQRIKAAVPTIKHCLDHGAKSVVLMSHLGRPDGVPMPDKFSFSPVAVELKALLGREVSFLKDCVGPEVEKACANPANGSVILLENLRFHVEEEGKGKDASGNKIKADAAKVEAFRASLSKLGDVYVNDAFGTAHRAHSSMVGVHLPQKAAGFLMKKELDYFAKALESPERPFLAILGGAKVQDKIQLISNMLDKVNEMIIGGGMAFTFLKVLNNMQIGNSLFDEEGSKIVKDLMAKAEKNGVKITLPVDFITADKFDEHAQTGEATVASGIPAGWMGLDCGPESVKKFVEVVGRAKQIVWNGPVGVFEWDKFSKGTKALMDKVVEVTGKGCITIIGGGDTATCCAKWNTEDKVSHVSTGGGASLELLEGKVLPGVDALSSV

SEQ ID NO: 90355 - DNA, 1254 bp, Danio rerio
  CDS (1)..(1254)
atgtctctttcgaacaaacttcatttggacaaggtggacgtgaaaggaaagcgggtgatcatgagggtggacttcaatgtccctatgaagaacaatgtgatcacaaataaccagagaatcaaggctgcagtcccatctatccagcactgtttagataattgtgccaaagctgtggccctgatgagccacttgggccggcctgatggagtccctatgccagacaaatactctctggagcctgtggctgcagaactcaagaacctgctgggaaaagacgttcagttcctgaaagactgtgtgggtccagatgtggagaaagcctgtgcagaccctcctgcaggatctgtcattctgctggagaatctgcgctttcatgtggctgaggagggcaagggcaaagatgcatcgggtaacaagaccaaagcaagtcaggcagagatcgatgctttccgagcctccctgtccaaattgggtgacgtatacgtcaacgatgctttcggaactgcacatagagctcacagctctatggttggagtgaatctccctcagaaggctgctggttttctgatgaagaaagagctagactactttgccatggcccttgagaaaccacagaggcctttcttggccatcctcggaggggccaaggtcaaagataagattcagctgatcaacaacatgttggacaaggtgaatgagatgatcattggtggaggaatggcctttaccttcctcaaggttctcaagaacatggagatcggcacttccctgtttgatgaagagggttccacaattgtgaaagacctcatggccaaagcagaaaagaacggtgtaaagatcacacttccagtcgactttatcactgcagacaaatttgatgagaaggcaacaacagggaccgcaacggtagcagaaggtattcctgctggctggatgggtctagactgtggtcctgagagctcaaagctctatgcagaggctgtggccagagccaagcagattgtgtggaacggacccgttggcgtgttcgagtgggacaactttgctcatggaaccaagaacatgatggacaaagttgtagaagcgaccaaaaatggctgcatcaccattatcggtgggggagacacagctacctgctgtgccaagtgggacactgaggacaaggtcagccatgtgagcacagggggcggagccagtctggagctgctggagggtaaagtgctgcccggtgtcgatgccctcagtaacgtataa

SEQ ID NO: 90356 - protein, 417 aa, Danio rerio
MSLSNKLHLDKVDVKGKRVIMRVDFNVPMKNNVITNNQRIKAAVPSIQHCLDNCAKAVALMSHLGRPDGVPMPDKYSLEPVAAELKNLLGKDVQFLKDCVGPDVEKACADPPAGSVILLENLRFHVAEEGKGKDASGNKTKASQAEIDAFRASLSKLGDVYVNDAFGTAHRAHSSMVGVNLPQKAAGFLMKKELDYFAMALEKPQRPFLAILGGAKVKDKIQLINNMLDKVNEMIIGGGMAFTFLKVLKNMEIGTSLFDEEGSTIVKDLMAKAEKNGVKITLPVDFITADKFDEKATTGTATVAEGIPAGWMGLDCGPESSKLYAEAVARAKQIVWNGPVGVFEWDNFAHGTKNMMDKVVEATKNGCITIIGGGDTATCCAKWDTEDKVSHVSTGGGASLELLEGKVLPGVDALSNV

SEQ ID NO: 90357 - DNA, 1257 bp, Magnaporthe grisea 70-15
  CDS (1)..(1257)
atgtctctctctaacaagctctccatcacggacgttgatgtcaaggggaagcgggtgctcatccgtgtcgacttcaacgttcctcttgacgataacaagaacatcaccaacaaccagcgtattgccggcgctgtgccaacaatcaagcatgccctcgacaatggcgccaagacagttatcctgatgtcgcacctcggtcggccaaatggatcgcccaaccccaagtactcgctcaagcctgtcgtgtccgagcttgagaagcttttgggcggcaaaaaggtcaccttcgctcctgactgtgtcggccctgaggtcgaggaaatcgtcaacaaggccggcgagggcgacgtcgtactattggagaacctgcgcttccacatcgaggaggagggcagcgccaaggacaaggagggcaacaagaccaaggctgacaaggccaaggtcgaggagttccgcaagggcctcaccaagttgggagacatttacatcaacgatgctttcggcactgctcaccgtgctcactcttccatggttggcgtcgacctaccccagaaggccgctggtttcctgatgaagaaggagcttgactacttcgcacaggccctcgagtcgcccaagcgccccttcttggccattcttggtggtgccaaggtttcggacaaaatccagctgatcgacaacctgcttgacaaggtcaacacgctcatcgtttgcggtggcatggcctttaccttcaagaaggttctcgacaacatggccattggaaactcgctctttgacgaggcaggatccaagaccgtccctgagctcatgaagaaggcgcaggagaagggcgtcaaggtcgtcctgccggtcgacttcatcactgctgacaagttcgccgcggacgccaagactgggtctgccacggacaaggagggcatccctgagggctggatgggcttggactgcggcgagaagagtgtcgagctgttccagagcgccatcgacgagtcgcagaccgtcctgtggaacggccccgccggtgtctttgagtttgacgctttcgccaagggcaccaaggccactcttgacgctgccgtcagcggctgcggcaagggcaagattgttatcatcggaggtggtgacacagctaccgttgcggccaagtacggagttgaggacaagctgagccacgtctcgaccggcggtggtgccagcttggagctcctcgagggcaaggaactgcctggtgtcaccgcgctcagcagcaagtaa

SEQ ID NO: 90358 - protein, 418 aa, Magnaporthe grisea 70-15
MSLSNKLSITDVDVKGKRVLIRVDFNVPLDDNKNITNNQRIAGAVPTIKHALDNGAKTVILMSHLGRPNGSPNPKYSLKPVVSELEKLLGGKKVTFAPDCVGPEVEEIVNKAGEGDVVLLENLRFHIEEEGSAKDKEGNKTKADKAKVEEFRKGLTKLGDIYINDAFGTAHRAHSSMVGVDLPQKAAGFLMKKELDYFAQALESPKRPFLAILGGAKVSDKIQLIDNLLDKVNTLIVCGGMAFTFKKVLDNMAIGNSLFDEAGSKTVPELMKKAQEKGVKVVLPVDFITADKFAADAKTGSATDKEGIPEGWMGLDCGEKSVELFQSAIDESQTVLWNGPAGVFEFDAFAKGTKATLDAAVSGCGKGKIVIIGGGDTATVAAKYGVEDKLSHVSTGGGASLELLEGKELPGVTALSSK

SEQ ID NO: 90359 - DNA, 1257 bp, Gibberella zeae PH-1
  CDS (1)..(1257)
atgtcgctgtccaacaagctttccatcgccgacgttgacgtcaagggcaagaaggtcctcatccgagtcgacttcaacgtccctctcgacgccgacaagaacatcaccaacaaccagcgaattgtcggtgctctccccaccatcaaatacgccctcgagaatggcgccaagtctgtcatcctcatgtcccacctcggacgccccaacggctcccccaacgagaagtactccctcaagcccgtcgtcgccgagctcgagaagcttctcagcaagaaggtcacctttgcccccgactgtgtcggccccgaggtcgaggagatcgtcaacaaggctgaggatggctctgtcattctcctcgagaacctccgattccacattgaggaggagggctcctccaaagacaaggagggcaacaagaccaaggccgacaaggctcaggttgaggctttccgcaagggtctgaccgctcttggtgacgtctacatcaacgacgctttcggcactgctcaccgtgctcactcttccatggtcggtgtcgatctcccccaaaaggcctccggtttcctcgtcaagaaggagctcgagtacttcgccaaggccctcgagaacccccagcgccccttccttgctattctcggtggtgccaaggtctccgacaagatccagctcatcgacaacctccttgacaaggtcaacaccctcatcatctgcggtggcatggccttcaccttcaagaagacccttgagaacgtctccatcggaaactccctcttcgacgaggccggctccaagaccgtcggtaacctcgttgagaaggccaagcagaagggcgtcaagctcgtcctccccgtcgactacatcaccgccgacaagttcgacaaggatgccaacactggctacgccactgacaaggacggtatccccgacggctggcagggacttgactgcggtgaggagtccgtcaagctctacaaggaggccattgccgatgccaagaccatcctctggaacggtcccgccggtgtctttgagttcgagaagttcgccagcggcaccaaggccactctcgacgccgtcgttgacgctgtccagaaggacggcaagatcgtcatcatcggtggtggtgacactgccaccgttgccaagaagtacggtgttgaggacaagattagccacgtctctaccggcggtggtgccagcttggagctcctcgagggcaaggagcttcccggtgttactgctctgtccagtaagtaa

SEQ ID NO: 90360 - protein, 418 aa, Gibberella zeae PH-1
MSLSNKLSIADVDVKGKKVLIRVDFNVPLDADKNITNNQRIVGALPTIKYALENGAKSVILMSHLGRPNGSPNEKYSLKPVVAELEKLLSKKVTFAPDCVGPEVEEIVNKAEDGSVILLENLRFHIEEEGSSKDKEGNKTKADKAQVEAFRKGLTALGDVYINDAFGTAHRAHSSMVGVDLPQKASGFLVKKELEYFAKALENPQRPFLAILGGAKVSDKIQLIDNLLDKVNTLIICGGMAFTFKKTLENVSIGNSLFDEAGSKTVGNLVEKAKQKGVKLVLPVDYITADKFDKDANTGYATDKDGIPDGWQGLDCGEESVKLYKEAIADAKTILWNGPAGVFEFEKFASGTKATLDAVVDAVQKDGKIVIIGGGDTATVAKKYGVEDKISHVSTGGGASLELLEGKELPGVTALSSK

SEQ ID NO: 90361 - DNA, 1251 bp, Ustilago maydis 521
  CDS (1)..(1251)
atgtctctttccagcaagcttggtatcaccgatgtcgacctcaaggacaagaaggtcctgatccgtgtcgacttcaacgtccccatggacggcgacaagatcaccaacaaccagcgtattgtcgctgcccttcccactgtcaagtacgccatcgagcagaatgccaaggctgtcgtgctcatgtcgcacatgggtcgtcccgatggaaagcctgtccccaagtactcgctcaagcccgtcgctgccgaggtatccaagctgctcaacaaggatgtcgaattccttgctgactgcgtcggtgctgagacagagaaggctgtcgagtcggctaccggcggcaagatcttcttgctcgagaacctccgctaccacgttgaggaagagggcaagggcaccaatgaagccggagagaaggtcaaggctgaccccaagaaggtcgaggagttccgtgccagtctcaccaagctcggtgacgtctacatcaacgatgcctttggcacagctcaccgcgcccactcatcgatggttggtgtgcagctgccccaacgtgctgccggtttccttatgaagaaggagctcgagttctttgccaaggcgctcgagagccctgagcgccccttccttgctatcctcggtggtgccaaggtgtcggacaagatccagctcatcgacaacatgctggacaaggtcaactcgctcatcatctgcggtggtatggctttcaccttcaaaaagacgctcgacaatgtcaagattggcacctcgctctttgacgaggccggctcgcacaaagtcgctgagctcgttgagaaggccaagaagaacaacgtcgagctcgtcttccccgtcgactacatcaccgccgacaagtttgacaagaacgccaagaccggttcggccaccgatgccgacggtatccccgatgagtggatgggtctcgatgccggtgaggagtcgcgcaagaagttccgcgagaccattcttaaggccaagaccatcctgtggaacggccccgccggagtctttgagtttgacaactttgccggtggttccaaggccatgcttgacgcctgtctcgaggctgagaagaacggctctactgtcatcgttggaggtggtgacactgccacggtggttgccaagtacggcgctgaggacggcatctcgcactgctcgactggtggtggcgcttcgctggagctgctcgagggcaagaccttgcctggtgtcaaggagctttcggagaagtga

SEQ ID NO: 90362 - protein, 416 aa, Ustilago maydis 521
MSLSSKLGITDVDLKDKKVLIRVDFNVPMDGDKITNNQRIVAALPTVKYAIEQNAKAVVLMSHMGRPDGKPVPKYSLKPVAAEVSKLLNKDVEFLADCVGAETEKAVESATGGKIFLLENLRYHVEEEGKGTNEAGEKVKADPKKVEEFRASLTKLGDVYINDAFGTAHRAHSSMVGVQLPQRAAGFLMKKELEFFAKALESPERPFLAILGGAKVSDKIQLIDNMLDKVNSLIICGGMAFTFKKTLDNVKIGTSLFDEAGSHKVAELVEKAKKNNVELVFPVDYITADKFDKNAKTGSATDADGIPDEWMGLDAGEESRKKFRETILKAKTILWNGPAGVFEFDNFAGGSKAMLDACLEAEKNGSTVIVGGGDTATVVAKYGAEDGISHCSTGGGASLELLEGKTLPGVKELSEK

SEQ ID NO: 90363 - DNA, 1209 bp, Parachlamydia sp. UWE25
  CDS (1)..(1209): transl_table=11
gtgagggtgaaggataaattatcgattcgcgatttaaatttgaaagacaagaaagccttaattcgtgtcgattttaacgtccctttagaaaaaggtttgattacagatgatagtcgtattcaagcctctcttcccacaattcaatatgttttagatcaagaaggagccgttattttgatgagccatctcggtcgtcctaaaggtttgtttgattctaaattttcgttggctccttgtgctaaacgtttatcagaattattaaataagcctgtaaaaatggctgcagattgttgtggattagacgttgaacagatggttcgtcagctaaaatcaggagaagttttattgcttgaaaatttacgttttcacaaaggcgaagaaaggcctgatgatgaacctaattttacaagtgctttgtcagagttgggagatgtttatatcaatgatgcttttggaactgctcatcgtgctcatgcttcgacaacaaaaattgcaaaattttttcccaatcgtgcagcagcgggtttgttacttgaaaaggaaatttcttatctaggttgtgctttaacgaatcctaaacgtcctttttgtgcagtgttaggaggtgcaaaaatttccacaaagtttaaagtcatcgaagctttacagtctaaagcagatgttttattaatagggggagcgatggctttcacttttttcaaatctgaaggaatacctattggggattcgctttacgaaagcgaattcgttgctgtcgctcgtgaattgttaggtgttgagacacagtctcgctgccgccttttactacccatagacttggtcattgctaaaaaaatggatgaatccttcactgaaacgagaattatttcagttaaagaaggaattcctgatgggtatcaaggggtagatattgggccagacactattaaactttatcaagaagaattgaacagagcagctacgattttttggaacggccctttaggagtatttgaagttcctgctttttctaaagggactcaaactattgctcaaactcttgctgttgtcaacgcgattactattgttgggggaggggattccttagctgctatagaacaagctggggtttctaaacaaataaaccatctttcaactggagggggtgcctctttagaatatatagaatttgggcaattacctgggattgaagctctatcagataaataa

SEQ ID NO: 90364 - protein, 402 aa, Parachlamydia sp. UWE25
MRVKDKLSIRDLNLKDKKALIRVDFNVPLEKGLITDDSRIQASLPTIQYVLDQEGAVILMSHLGRPKGLFDSKFSLAPCAKRLSELLNKPVKMAADCCGLDVEQMVRQLKSGEVLLLENLRFHKGEERPDDEPNFTSALSELGDVYINDAFGTAHRAHASTTKIAKFFPNRAAAGLLLEKEISYLGCALTNPKRPFCAVLGGAKISTKFKVIEALQSKADVLLIGGAMAFTFFKSEGIPIGDSLYESEFVAVARELLGVETQSRCRLLLPIDLVIAKKMDESFTETRIISVKEGIPDGYQGVDIGPDTIKLYQEELNRAATIFWNGPLGVFEVPAFSKGTQTIAQTLAVVNAITIVGGGDSLAAIEQAGVSKQINHLSTGGGASLEYIEFGQLPGIEALSDK

SEQ ID NO: 90365 - DNA, 1245 bp, Picrophilus torridus DSM 9790
  CDS (1)..(1245): transl_table=11
atgaatggttcattctttacaatggacgatttcgatcttgatggtaaaagaatctatttaaggatagatataaattcccctgtaaaccctgaaaccggagaaattcttgatgattcacgcttcagggcatattcaaagaccataaatgagctgaaatcatcaaaggttgttatagtttcacaccagagccggcctggtaagaatgatttcacatcattaatgggtcatgccaggtacatgtcaaatataataaaaaaagagataaaatttattgattccctcttctcccatgatgccataaatgccatatcaaatatgtcagccggtgatataataatgcttgaaaattcaagattttacagcgaggagacattaaatgctgattttgaaactataaaaaacacacatatagtaagaaggctatcgccgctcttcgattattatgtaatcgatgcttttcctgcaatacacagggcccagacaacattaataggctttaagggctccggtccaaacatagctggaaggctgatggagcgtgagattacaatgcttgataaattcaaatttttcaggggctcgccaaaaattgcaattctggccggatcaaagatagaggattcaataaaggtctccagggcattcttaaaagataacatcgttgattacatattaaccggcggcgtggttgcaaatgcatttctttacgccggtggttttaacataggcagaaaaaacatggagtttataatcaagaataatgataattacgaatcattgattaacagtgcaacacagctcttacaaacatttcgcggcaggattttaatgcccgatgatttccttttgagtccatcgggcaggcatgtaacaataagcgaaagcataaacgatgatgagatcatagccgatataggctttaatactgttgataaatacagcaagataatatccagggcctccgcaatatttatgaatggcccaatgggaatctatgaaatacctgaatattcaataggaaccagggaaatatttaacattgttgccgagacccctgcactgaaaatagcgggtggcggccacacactgaatgcacttaatagcatgcatttaaccaaaaaactggattacacatcaacaggtggtggtgcattaataaattatttatcaggtgattcaattccagttatagatgctttaatagaaaataaaaggttatttgggggcaaatacaatggcaggtaa

SEQ ID NO: 90366 - protein, 414 aa, Picrophilus torridus DSM 9790
MNGSFFTMDDFDLDGKRIYLRIDINSPVNPETGEILDDSRFRAYSKTINELKSSKVVIVSHQSRPGKNDFTSLMGHARYMSNIIKKEIKFIDSLFSHDAINAISNMSAGDIIMLENSRFYSEETLNADFETIKNTHIVRRLSPLFDYYVIDAFPAIHRAQTTLIGFKGSGPNIAGRLMEREITMLDKFKFFRGSPKIAILAGSKIEDSIKVSRAFLKDNIVDYILTGGVVANAFLYAGGFNIGRKNMEFIIKNNDNYESLINSATQLLQTFRGRILMPDDFLLSPSGRHVTISESINDDEIIADIGFNTVDKYSKIISRASAIFMNGPMGIYEIPEYSIGTREIFNIVAETPALKIAGGGHTLNALNSMHLTKKLDYTSTGGGALINYLSGDSIPVIDALIENKRLFGGKYNGR

SEQ ID NO: 90367 - DNA, 1194 bp, Bartonella quintana str. Toulouse
  CDS (1)..(1194): transl_table=11
atgggttttcgtacacttgatgatgttgatgtcactgggaaacgtgttcttgtgcgggttgattttaatgtgccaatgtcgcaaggtaaggtatgcgatgaaacccgcctcaagcgacataaagaaacactccttgagcttcaaaaacgtggtgctaagcttattcttctctcccattgtggtcgccctaaaggacagggggagccagaattttcgctacgccccgttgtgcgagtgctggaaaaaataatcaaccaaccagttgcttttgcacccgattgtgtcggtgtcgcagcgcagacagcaattgaggcattgcaaaatggtggtcttttgctgcttgaaaatgttcgttttcatccaggtgaagaaaagaatgattgttcttttgctgaagctttagcccataatggggatctttatgtcaatgatgctttttcagtttctcatcgtgcccatgcttcggtggagggaataacacatttgttgccctcctatgcggggcgctctttacaatgtgaattgcaggcgttggaaaaaggacttgacaatccgaagcgtccagtggtcgcacttgttggaggtgcaaaagtttccagtaagctttttgtgctcaatcatttagttgaaaaagtcgattatttggtgattggcggtggcatggccaacagttttttagctgcgcaaggtgtccatattggtaagtcattgtgtgaacatgcactaatgcagacgataaaaaaagtcattgaaaaagcacaagagtaccaatgtacgcttctactccctgtggatgcagtggttgggtttcgctttgaaaaaggtgcaccgcatcgcctctatgatattggagatattcctgatgatggaatgattttggatattggtacccgctccattgcgcatatcaatgaagtgattgataaagccgctacccttgtgtggaatggcccccttggtgtttttgagatgtctccctttgatcaaggaacgattgcagttgcacgtcatgcagcagaatgcagcttgacagggaaatgtgtttcaattgctggagggggagatacggtttttgctcttaaccacgctggtgttgccaatgatttcacttatctttcaaccgcagggggagcctttttagaatggatggaaggcaaggtgcttcccggtatttttgctctcagacaagcttaa

SEQ ID NO: 90368 - protein, 397 aa, Bartonella quintana str. Toulouse
MGFRTLDDVDVTGKRVLVRVDFNVPMSQGKVCDETRLKRHKETLLELQKRGAKLILLSHCGRPKGQGEPEFSLRPVVRVLEKIINQPVAFAPDCVGVAAQTAIEALQNGGLLLLENVRFHPGEEKNDCSFAEALAHNGDLYVNDAFSVSHRAHASVEGITHLLPSYAGRSLQCELQALEKGLDNPKRPVVALVGGAKVSSKLFVLNHLVEKVDYLVIGGGMANSFLAAQGVHIGKSLCEHALMQTIKKVIEKAQEYQCTLLLPVDAVVGFRFEKGAPHRLYDIGDIPDDGMILDIGTRSIAHINEVIDKAATLVWNGPLGVFEMSPFDQGTIAVARHAAECSLTGKCVSIAGGGDTVFALNHAGVANDFTYLSTAGGAFLEWMEGKVLPGIFALRQA

SEQ ID NO: 90369 - DNA, 1188 bp, Acinetobacter sp. ADP1
  CDS (1)..(1188): transl_table=11
atgaactttaagcgtatgacggacctcgacttaagcgaaaaacgtgtattaattcgtgaagatttaaatgtaccagtaaaaaatggccagattaccagtgatgctcgtttgcgtgcagcattaccaaccattcaggctgcacttgctcaaggtgctgctgtgatggtttgctctcacttagggcgtcctgttgaaggtgaaccaaaacctgaacagtcacttgcacctgttgcagcttacctttcagatgcattagggcaggaagttaaacttttgactgactaccttgaaggggttgagatagcaccaggtcaagttgttcttcttgaaaatgtacgttttaacctcggcgaaaagaaaaataatgctgaacttgcacaaaaatatgcagcactctgtgatgtattcgtgatggatgcatttggcactgcacatcgtgcagaagcatcaaccgaaggtgctgctcgttatgccaaagttgcagcggcaggcccattgcttgcgactgagctagatgcattaggtcgtgcacttcaaacccctgaaaagccaatggtggcgattgttgcaggttctaaagtttcaacaaaacttgatgttttaacctcactttctgacatttgcggtcaattgattgtgggtggtggaattgccaataccttcttggcagcagctggtttcaatgtaggcaaatcgctttgtgaaaatgatttgattgataccgctaaagcaattgccgctaaagtatctgttccacttcctacggatgtggtggtagctgatgccacagagattgactttgctgacttcttgggttcattagcaaaagcacaagcaattgtgaaaaaagtggaagatattgctgacaatgacatgattctggatgtgggtcctgacacggcgaaagcatttgctgagatcttaaaaacagctaaaacgatactttggaacggcccagttggtgtatttgaagtagatcagtttggtgaaggaaccaaaacgctttcattggcaattgctgaatctaaaggattttctattgcaggtggtggtgatactttggctgcaattgataaatataaagttgctgacaaaattggttatatctcaacaggtggcggcgcattccttgagtttgtagaaggaaaaaccttaccagccgttgctgtattactcgaacgtgcctaa

SEQ ID NO: 90370 - protein, 395 aa, Acinetobacter sp. ADP1
MNFKRMTDLDLSEKRVLIREDLNVPVKNGQITSDARLRAALPTIQAALAQGAAVMVCSHLGRPVEGEPKPEQSLAPVAAYLSDALGQEVKLLTDYLEGVEIAPGQVVLLENVRFNLGEKKNNAELAQKYAALCDVFVMDAFGTAHRAEASTEGAARYAKVAAAGPLLATELDALGRALQTPEKPMVAIVAGSKVSTKLDVLTSLSDICGQLIVGGGIANTFLAAAGFNVGKSLCENDLIDTAKAIAAKVSVPLPTDVVVADATEIDFADFLGSLAKAQAIVKKVEDIADNDMILDVGPDTAKAFAEILKTAKTILWNGPVGVFEVDQFGEGTKTLSLAIAESKGFSIAGGGDTLAAIDKYKVADKIGYISTGGGAFLEFVEGKTLPAVAVLLERA

SEQ ID NO: 90371 - DNA, 1164 bp, Erwinia carotovora subsp. atroseptica SCRI1043
  CDS (1)..(1164)
atgtctgtaattaagatgaccgatctggatctggctggtaaacgtgttcttattcgtgcggatctgaacgtaccagtaaaagaagggaaagtgacgtctgatgcgcgcatccgtgcctctctgccgaccatcgaaatcgctctgaaacaaggcgctcgcgttatggtcacttcccacttgggacgtccgaccgaaggcgagtacaacgaagatttttctctgctgcctgttgttgactacctgaaagagaaactctcttctcccgtacgtctggcgaaagactacctagatggtgttgatgtcgccgaaggcgagctggttgtactggaaaacgtccgctttaacaaaggcgagaagaaagacgacgaagtgctctccaagaaatacgcggcactgtgcgatgtgttcgtgatggacgccttcggtacggcgcaccgtgcacaggcttcaacccacggcgtaggtaaatttgccactatcgcttgtgcgggcccgctgctgtctggtgagctggaagcgctgggtaaagcactgagcaaaccagcccgtccgatggtcgccattgtgggcggttctaaagtttctactaaactgaccgtactggattcactgtctaaaatcgccgatcagctgatcgtgggtggcggtatcgccaatacctttgttgccgcacaaggccacaatgtaggtaagtccctgtatgaagcagacctgatttctgaagcgaaaaagctgctggaaacgtgtgatattcctgttccgagcgatgtgcgtgtagcgtcagaattctctgaaactgctgcagcaacgctgaagtctgttacggaaattaaagacgaagagcagattcttgatctgggagatgtttccgctgagcgtttggctgaaattctgaagaatgccaaaaccatcctgtggaatggcccagttggcgtcttcgaattcccgaatttccgtaaaggaaccgagattatcgctcgtgctatcgcggatagcgacgcattctctatcgcaggtggcggcgatacgctagctgcgatcgatctgtttggtattgcagacaagatctcctacatttctactggtggtggcgcattcctggagttcgttgaagggaaaaaactgccagcagtcgttatgctggaagaacgcgccaagcagtaa

SEQ ID NO: 90372 - protein, 387 aa, Erwinia carotovora subsp. atroseptica SCRI1043
MSVIKMTDLDLAGKRVLIRADLNVPVKEGKVTSDARIRASLPTIEIALKQGARVMVTSHLGRPTEGEYNEDFSLLPVVDYLKEKLSSPVRLAKDYLDGVDVAEGELVVLENVRFNKGEKKDDEVLSKKYAALCDVFVMDAFGTAHRAQASTHGVGKFATIACAGPLLSGELEALGKALSKPARPMVAIVGGSKVSTKLTVLDSLSKIADQLIVGGGIANTFVAAQGHNVGKSLYEADLISEAKKLLETCDIPVPSDVRVASEFSETAAATLKSVTEIKDEEQILDLGDVSAERLAEILKNAKTILWNGPVGVFEFPNFRKGTEIIARAIADSDAFSIAGGGDTLAAIDLFGIADKISYISTGGGAFLEFVEGKKLPAVVMLEERAKQ

SEQ ID NO: 90373 - DNA, 1215 bp, Mesoplasma florum L1
  CDS (1)..(1215): transl_table=4
atgaattacaatttgaaaaaaacattaaaagatattaatgtaaaaggaaaaaaagttttagttcgtgttgactttaatgttccattaaaagatggagttattactgatgacaatcgtattcaagcagcattaccaacaattaaatatttagttgaaaatggcgcaaaagttatcttattttcacacttatcaagaattaaaagtgaagatgacaaaaaaactaaatcattagctccagtagcaaaaagattggaagaagttttagcacaatcagtaaactttgttaaccaaacaagaggaactgaattagaaactgcaattaatgcattaaatgaaaaagaagttttattatttgaaaacactcgtttcgaagatgtaaaagatggtgaagtagttaaagctgaatcaaaaaatgatccagaattaggaaaatactgagcaagccttggagatgtatttattaatgatgcatttggtactgcacaccgtgctcatgcttcaaacgttggtatagcttcaaacatttctgaatcagcattaggtttcttagttcaaaatgaaattgaaatgttaggtaaaggaatagacgcacctgaaagaccttttgttgcaattttaggaggagcaaaagtttctgacaaaattggtgttattgataaccttttaactaaagttgacaaaattttaattggtggaggtatgacttatacattccataaagcaatgggattagaaattggtaactcattattagaagctgataaagttgaattggctaaagaatacttagaaaaagctaatggaaaaataatgttacctgttgatagtttatgtgctcctgaatatgctgatgttgctccaacattatgtggagaaaatgttccagcaggaatgatgggattagatatcggaccaaaaactattgaaatgtatgaaaaagaattagcaaacgcaaaaactgttgtttgaaatggaccaatgggagttagtgaatttgaaaacttcaaagctggtactgttgctgtttgtgaagctgctgcaaaacgtaaagctgatggaggtttcactttaattggtggaggagactcagctgcagctgcaattaaattaggattcaaagatgaattctcatgaatttctacaggtggtggagcttcattagaatatatggaaggtaaagaattacctggaattgctgcaatccaaaacaaataa

SEQ ID NO: 90374 - protein, 404 aa, Mesoplasma florum L1
MNYNLKKTLKDINVKGKKVLVRVDFNVPLKDGVITDDNRIQAALPTIKYLVENGAKVILFSHLSRIKSEDDKKTKSLAPVAKRLEEVLAQSVNFVNQTRGTELETAINALNEKEVLLFENTRFEDVKDGEVVKAESKNDPELGKYWASLGDVFINDAFGTAHRAHASNVGIASNISESALGFLVQNEIEMLGKGIDAPERPFVAILGGAKVSDKIGVIDNLLTKVDKILIGGGMTYTFHKAMGLEIGNSLLEADKVELAKEYLEKANGKIMLPVDSLCAPEYADVAPTLCGENVPAGMMGLDIGPKTIEMYEKELANAKTVVWNGPMGVSEFENFKAGTVAVCEAAAKRKADGGFTLIGGGDSAAAAIKLGFKDEFSWISTGGGASLEYMEGKELPGIAAIQNK

SEQ ID NO: 90375 - DNA, 1209 bp, Propionibacterium acnes KPA171202
  CDS (1)..(1209): transl_table=11
atgaaatctgttgaggatctcggagacttgcgcggtaagcgcgtcgtcattcgctgcgacttcaatgtcccgctcgacggggacaagatcaccgacgacggccgtattaaggctgccctgcctactttgacccagctgcatgaggctggcgctcgcaccaccgtgctcgcgcacctcggtcgtcccaagggtgccgtcgatcccaagtactcgctggcgccagttgccaagcgcctcggtgagcttatgaaccttgacgtcaagcttgctggggacgttgttggtccctccgccactaaaacctctgagtcgctggctgatggcgagatcgccttggtcgaaaacgtccgcttcgagaagggcgagaccagtaaggacgaggccgagcgcgctgagctcgctcagaaatacgcctcgtttggtgagttttacgtctccaacggcttcggcgttgtgcaccgcaagcaggcttccgtctacgacgttgccaagctgctgccgagcgctgctggctccctcgttgccaaggaggtagaggtcctcgaaggcctgaccgccgatccgaagcggccgttcgtcgtcgtcctcggtggtgccaaggtcgccgacaagcttgccgtcatcgataacctgctcaaggccgctgacactctcgttattggtggcggtatggcgtacaccttcctcaaggcgaagggtctcgaggtcggtgactccctacttgacgaagattcgatcgacgcgtgcacgaagtatctcgaacaggccaaggctgcaggcaagcagatcctgcttcccgtagacgtgcgagtggtctccgacatcgatttcgaggcccgcactgtcggtcagatcgacgtcgtgcccgctgacgagattccttccgacaagatggcagtagacatcggtccggagaccgagaaggcttacgccaacgcgatcaagggtgccaagtcagtgttctggaacggaccaatgggcgttttcgagatcaagggcctcgagctcggcaccaaggccgtcgcccaggctcttaccgaggttgacggcctttcggtggtcggcgggggagactccgcctccgccgtgcgtaccctcggtttcgccgacgatcagttcggtcatatttctaccggtggtggcgcctccctcgagcttatggagggcaaggagctacccggaatcgcagtactcaaggagaacaactga

SEQ ID NO: 90376 - protein, 402 aa, Propionibacterium acnes KPA171202
MKSVEDLGDLRGKRVVIRCDFNVPLDGDKITDDGRIKAALPTLTQLHEAGARTTVLAHLGRPKGAVDPKYSLAPVAKRLGELMNLDVKLAGDVVGPSATKTSESLADGEIALVENVRFEKGETSKDEAERAELAQKYASFGEFYVSNGFGVVHRKQASVYDVAKLLPSAAGSLVAKEVEVLEGLTADPKRPFVVVLGGAKVADKLAVIDNLLKAADTLVIGGGMAYTFLKAKGLEVGDSLLDEDSIDACTKYLEQAKAAGKQILLPVDVRVVSDIDFEARTVGQIDVVPADEIPSDKMAVDIGPETEKAYANAIKGAKSVFWNGPMGVFEIKGLELGTKAVAQALTEVDGLSVVGGGDSASAVRTLGFADDQFGHISTGGGASLELMEGKELPGIAVLKENN

SEQ ID NO: 90377 - DNA, 1212 bp, Leifsonia xyli subsp. xyli str. CTCB07
  CDS (1)..(1212): transl_table=11
gtggcgcttcgcaccctcgactcactcggttcgctcgcgggcaagcgcgtcgtcgtccgctgtgatctgaacgtccccctgaaggacgggaagatcacggacgacggccgtgtgcgcgcgtccatccccaccctccacgctctcatcgcccagggcgcgaaggtcgcgatcgtctcgcacctgggccgccccgagggcgcgcccgatgcgcagtacagcctggctccggtcgcccagcggctctccgagctgctgggcaagccggtgacctttgccagcgacaccgtcggcgccggtgcggcggaggccgtctccggactggaggacggcgatgtcgctctgctggagaacctccggttcaacccgggggagaccagcaaggacgagggcgagcgtgaggcgtttgccgccgagctcgccgcgttcggcgacgccttcgtctccgacggcttcggcgtcgtccatcgcaagcaggcgagcgtctacgagctggccaaggcgctcccgagcgccgcgggcgcgctcatcgcgaccgagctcgacgtgctcgaccgcctcaccgagaaccctgagcggccctacacggtcctgctcggcggctcgaaggtgtcggacaagctcggcgtcatcggccacctgctgccgcgcgtcgactcgctgctcatcggcggcgggatgctgttcacctttctcgccgcgctcggccaccgggtcggctccagcctcctcgaggcggaccagatcggcaccgtcaagggctacctggagcaggcgaagcagctgggcgtggagatcgtgctgccgcgagatgtcgttgtcgcctccaggttcggcgtggatgcggagcacctcgttcgtcccgtcgaccgcatcgaggacaccgggtggggcacctctggtctcggtctggacatcggaccggagaccgcagaggtgttctcggagcgcatccgcgctgcgcgcacggtgttctggaacggcccgatgggcgtgttcgagctggccccgttcgcggccggaaccaaggccgtggcgcaggcgctcaccgaggtcgacggcctcggcgtcgtcgggggcggtgactcggccgcggcggttcatgcgctcggcttctcggacgaccagttcgggcatatttctaccggtggcggtgcgagcctcgaattccttgagggcaagcgcctgccgggtctggaggttttgggttggtag

SEQ ID NO: 90378 - protein, 403 aa, Leifsonia xyli subsp. xyli str. CTCB07
MALRTLDSLGSLAGKRVVVRCDLNVPLKDGKITDDGRVRASIPTLHALIAQGAKVAIVSHLGRPEGAPDAQYSLAPVAQRLSELLGKPVTFASDTVGAGAAEAVSGLEDGDVALLENLRFNPGETSKDEGEREAFAAELAAFGDAFVSDGFGVVHRKQASVYELAKALPSAAGALIATELDVLDRLTENPERPYTVLLGGSKVSDKLGVIGHLLPRVDSLLIGGGMLFTFLAALGHRVGSSLLEADQIGTVKGYLEQAKQLGVEIVLPRDVVVASRFGVDAEHLVRPVDRIEDTGWGTSGLGLDIGPETAEVFSERIRAARTVFWNGPMGVFELAPFAAGTKAVAQALTEVDGLGVVGGGDSAAAVHALGFSDDQFGHISTGGGASLEFLEGKRLPGLEVLGW

SEQ ID NO: 90379 - DNA, 1179 bp, Desulfotalea psychrophila LSv54
  CDS (1)..(1179): transl_table=11
atgaagtcgttacgtgaattggaactcgccggtaagcgagtcttggtacgggtggattttaatgtgccgatggatgataagcaacgaataaccgacgatattcgtattcgtatggttcttcccaccctacgctatgtgcttgaacagggtggccgcttaattatctgttctcatatgggtaggcccaagggcaagcgagttgaggagtatagtcttgctcccatagcccgtcatcttgcaggtctgctaggcagagatgtcggcattgctccggattgtattggtgctgaggtggaggcgcaggtggcagcccttggcgtaggcgaggtgcttcttttgcaaaaccttcgtttttacggcgaagaaacggaaaatgatgccgtctttgccggtaagcttgcaggacttgccgatgtctatgtaaatgatgcctttgccgtatctcatcgagcccatgcctccgtggttggagttgccgagcgggtagctgaaaaatgtgccggctttctcctgcagacagagatagattattttcataaatcgatgaatgaccccattcgtcccctggtggccctggtgggtggagccaaggtctcctctaagataggtgccctggaaaatatgcttggtaaggtcgataagatgattattggcggtgccatggccaataccttcttaatgagtcagggcgtcgatgttggtgcctcaaaggtggaggatgacctgcttgtcaccgccaggaattttctgcaggcagcaggggagcgggggatgaaggtctatcttcccgttgattttgtggttgcagatcgttttgccgccgatgcggtgcacaagactgtgcccgccgatagtgttccggagggttggatggccctcgatgtcggcccggcaagtagtattctctttcgagaggccctgcagggtgccggtaccatcgtctggaatgggcccatgggcgcttttgagatggatgcctttgccggagggaccatgagtctctgtcgtgatgttgccgcttcgcaggcgctttcgatcactggtggtggggattctaatgccgcagtgaagaaatcaggcgaggcagataatatctcctatatgtccaccggtggaggggccttcttgcagttgatggaggggaaaaccctacctggggtggatgccttggaagcataa

SEQ ID NO: 90380 - protein, 392 aa, Desulfotalea psychrophila LSv54
MKSLRELELAGKRVLVRVDFNVPMDDKQRITDDIRIRMVLPTLRYVLEQGGRLIICSHMGRPKGKRVEEYSLAPIARHLAGLLGRDVGIAPDCIGAEVEAQVAALGVGEVLLLQNLRFYGEETENDAVFAGKLAGLADVYVNDAFAVSHRAHASVVGVAERVAEKCAGFLLQTEIDYFHKSMNDPIRPLVALVGGAKVSSKIGALENMLGKVDKMIIGGAMANTFLMSQGVDVGASKVEDDLLVTARNFLQAAGERGMKVYLPVDFVVADRFAADAVHKTVPADSVPEGWMALDVGPASSILFREALQGAGTIVWNGPMGAFEMDAFAGGTMSLCRDVAASQALSITGGGDSNAAVKKSGEADNISYMSTGGGAFLQLMEGKTLPGVDALEA

SEQ ID NO: 90381 - DNA, 1182 bp, Borrelia garinii PBi
  CDS (1)..(1182): transl_table=11
atgtcaataaaaacagtaaaagactttaatagctttgcgggcaagcgagctttagtaagatgtgattttaatgttcccctaaaagaggggaacattagcgatgatactagaattaaggctgcattgcccacaatagaatacctgaaagaaaaaggagctagaattgtacttataagtcatttgggtagaccagagggcaaaaaaaatcttaaatattctcttaaacctgttgccaataaattgtcagagcttttgggccaggatgtcaagatgctttctgattgcattggaagagaaattgtaaataatactttacaaatgaaagatggtgatgttgtattgcttgaaaatgtaaggttttatgcggaagaagagaaaaacgataaaaattttgcaaaaaaactttctgagaatggagatgtttttgtaaatgatgcctttggtgcagctcatagggctcatgcttcaacggtgggggtttctgattatttaccatctgttggtggatttttaatggagaaagaagacaaatttcttggagaagtattaaaaaatcccgaaagaccatttgtttcgattattggtgggtctaaggtttcttcaaagattgcagtactggaatcacttttatcaaagtcaaatgtagttgtgattggcggtggaatggcctatacttttttacattccaaaggatattctataggcaaatctcttttagagagcgaatatattgatatagcttcttcttttttaaagaaagcaaaagagttggatgttaaagtaattttaccgcttgatcacattgtagcggacgattttaataaaaattctactcctgagtatattgattcctttgatattcctgaaaataagattggcatggatgttggaggtaagactttaaaagaaatcgaaaaggttataaaaactgctaagactataatttggaatggccctcttggtgtatttgaatttgattcattttcaaaaggaactgcaatggttgccgaaatggtagcatcttgcgcaggtttaactattgttggtggtggagattctgttgcagctgttaataaatttaatttatctgataagatcactcatgtttcaacaggtggcggtgcatcacttgaatatcttgaaggaaagattttaccaggtattaaggttttggagaagtaa

SEQ ID NO: 90382 - protein, 393 aa, Borrelia garinii PBi
MSIKTVKDFNSFAGKRALVRCDFNVPLKEGNISDDTRIKAALPTIEYLKEKGARIVLISHLGRPEGKKNLKYSLKPVANKLSELLGQDVKMLSDCIGREIVNNTLQMKDGDVVLLENVRFYAEEEKNDKNFAKKLSENGDVFVNDAFGAAHRAHASTVGVSDYLPSVGGFLMEKEDKFLGEVLKNPERPFVSIIGGSKVSSKIAVLESLLSKSNVVVIGGGMAYTFLHSKGYSIGKSLLESEYIDIASSFLKKAKELDVKVILPLDHIVADDFNKNSTPEYIDSFDIPENKIGMDVGGKTLKEIEKVIKTAKTIIWNGPLGVFEFDSFSKGTAMVAEMVASCAGLTIVGGGDSVAAVNKFNLSDKITHVSTGGGASLEYLEGKILPGIKVLEK

SEQ ID NO: 90383 - DNA, 1179 bp, Symbiobacterium thermophilum IAM 14863
  CDS (1)..(1179): transl_table=11
atggcgctgatgaccgtacgcgacatcgatgtcaagggcaagcgcgtgttcgtgcgtgtcgacttcaacgtcccgctggaagatggtcggatcacggatgacacccggatcagggcggccgtgcccaccatccggtacctggtggaggaaggggcggtcgctgtgctggcgtcgcacctgggccggcccaagggccagcggaacgagaagtactccctcgccccctgtgcccggcgcctgtccgagctgctgggccgggaggtcgtgttcgcccccgactgcatcggcgaggaggtcgagcggctggtggccgaacagccgcccgggtccgtggtcctgctcgagaacgtccgtttctacgcggaggaggagaagaacgaccccgagttcgccgcgaagctcgcgcgcctcggcgagatcttcgtcaacgacgcctttggcaccgcgcaccgggcgcacgcctcgacccggggggtggccgaccacatgccggttcgggtggcaggcttcctcatgcagaaagaggtcgacatcatgggcaaggccctgtccgaccccgaccggcccttcgtggcgatcatcggcggcgccaaggtctcggataagattatggtgatcgagaacctgttgaccaaggtcgaccggctcatcatcggcggcggcatggccaacaccttcctgcgggccaggggcttcgccaccggcaagtcgctggtggaggaggaccgggtcgacaccgcccgggagctgctggccaagggcggcgacaagatcctcctgcccaccgatctggtggtcgcctcggagttcaaggccgacgccgagcagaaggtcgttccggtggacgccatccccgagggctggatggccctggacatcgggccggagaccgcccgggcctttgccgacgtgatccgcggggctcacaccgtcgtgtggaacggcccgatgggcgtgtttgagatggagcccttcgcgcgcggcaccttcgcggtcgcccaggcgatggcggactgcgagggcgtgacgatcgtgggcggcggcgactccgtggcggctgtcgaggcggcgggcctggccgatcgcatgacccacgtctccacgggcggcggcgcctcgctggagttcctggaggggaaggaactgcccggcgttgcctgcctcgctgtgaagccgtga

SEQ ID NO: 90384 - protein, 392 aa, Symbiobacterium thermophilum IAM 14863
MALMTVRDIDVKGKRVFVRVDFNVPLEDGRITDDTRIRAAVPTIRYLVEEGAVAVLASHLGRPKGQRNEKYSLAPCARRLSELLGREVVFAPDCIGEEVERLVAEQPPGSVVLLENVRFYAEEEKNDPEFAAKLARLGEIFVNDAFGTAHRAHASTRGVADHMPVRVAGFLMQKEVDIMGKALSDPDRPFVAIIGGAKVSDKIMVIENLLTKVDRLIIGGGMANTFLRARGFATGKSLVEEDRVDTARELLAKGGDKILLPTDLVVASEFKADAEQKVVPVDAIPEGWMALDIGPETARAFADVIRGAHTVVWNGPMGVFEMEPFARGTFAVAQAMADCEGVTIVGGGDSVAAVEAAGLADRMTHVSTGGGASLEFLEGKELPGVACLAVKP

SEQ ID NO: 90385 - DNA, 1170 bp, Mannheimia succiniciproducens MBEL55E
  CDS (1)..(1170): transl_table=11
atgtcagtaatcaaaatgaccgatcttgatttagccggcaaacgtcttttcatccgcgccgatttaaacgtgccggtaaaagacggcaaagtgacttcagatgcgcgtatccgcgcaacaattcctactttaaaattagccttggaaaaaggcgccaaagtgatggtaacttctcacttgggccgtccgactgaaggtgaattcaaacctgaagactcattacaaccggtagttgattacttaaaagatgcaggatttaacgtacgcctagcacaaaactacttagacggcgttgaagtaaacgaaggcgaaatcgttgtattggaaaacgttcgtatcaacaaaggcgaaaagaaaaacgatcctgaattgggtaaaaaatatgccgcactttgcgacgtattcgtaatggatgcttttggtacggctcaccgtgcgcaggcttcaacttacggtgttgccgaatatgcgccggttgcttgcgcaggcccgttattagcggctgaattggatgctttgggtaaagccttaaaagaacctcaacgtcctatgcttgcaattgtaggcggttcaaaagtgtctactaaattaactgttttagacagcctttcaaaaattgccgatcaattaatcgtgggcggcggtattgccaatacctttattgccgctgaaggccataacgtcggtaaatctttatatgaagaagatttaattcctgaagcaaaacgtttagcggcagcaactaatatccctgttcctgtggatgtgcgtgtgggtacggaattctctgaaaatgcgccggcaaccgaaaaatcggtaaccgaagttcaagccgacgaatcaattttcgatatcggcgataaatccgcagaagaattggcgaaaattatcaaatccgctaaaaccattctttggaacggtccggtgggcgtgtttgaattccctaatttccgtaaaggtaccgaagtgatttctaacgcgattgcggaagcgactgcaaacggcgcattttctatcgccggtggcggtgataccttagccgctatcgatttattcggtatcaaagataaaatttcttatatttcaaccggcggcggtgcgttcttagaatttgttgaaggtaaggttttacctgcggtggaaatcttagaaaaacgtgcaaacggctaa

SEQ ID NO: 90386 - protein, 389 aa, Mannheimia succiniciproducens MBEL55E
MSVIKMTDLDLAGKRLFIRADLNVPVKDGKVTSDARIRATIPTLKLALEKGAKVMVTSHLGRPTEGEFKPEDSLQPVVDYLKDAGFNVRLAQNYLDGVEVNEGEIVVLENVRINKGEKKNDPELGKKYAALCDVFVMDAFGTAHRAQASTYGVAEYAPVACAGPLLAAELDALGKALKEPQRPMLAIVGGSKVSTKLTVLDSLSKIADQLIVGGGIANTFIAAEGHNVGKSLYEEDLIPEAKRLAAATNIPVPVDVRVGTEFSENAPATEKSVTEVQADESIFDIGDKSAEELAKIIKSAKTILWNGPVGVFEFPNFRKGTEVISNAIAEATANGAFSIAGGGDTLAAIDLFGIKDKISYISTGGGAFLEFVEGKVLPAVEILEKRANG

SEQ ID NO: 90387 - DNA, 1191 bp, Legionella pneumophila subsp. pneumophila str. Philadelphia 1
  CDS (1)..(1191): transl_table=11
atgaacctgattaaaatgagcgacattgatctgtctggcaaaagagttctgattcgtgaggatttaaatgtcccgatcaaagacggtatgattaccagtgatcaaagattgcaagcggccctgcctacaatcaaatccgctttggacagtggcgcagcagtaatcgtattgtctcatcttgggcgtccggaggaaggcaaatacgaaaaaaaattctctttggagcctgttgctgattatttaagggaaaacctggaatatcctgttcgcttcgtcaaagattacctgagcggcgtgggtgtaaaccctggggaattggtcgtatgcgaaaatgtccgatttaatcccggtgaaaaagccaatgacgaagctttggcaaaaaaactggcaagcctttgtgatgtctttgtcatggatgcttttggcacggcacacagggcacaagcgtctacctatggtgtcgctcaatatgctccagttgccgttgctggtcctctgctaatccgtgaacttgaagcgttaaaccaagtgcttaaagcgcctaaaaaacctatcgtcgctattgttggaggagccaaagtctcatccaagctcagtctattgaaacaattggtgggtatggttgatgttcttatccctggcggcggtattgccaatacttttctgaaagcccaagggtttgaaattggtatttccctttacgaacctgatttattggatgaggctcgccatatccttattctggccaaagagaaaggttgccaaattcctctacccaccgacgttgtagtaggcaaaacatttagtgaaacctgccctgctttcaacaaatctctgtctaatgtggctgcggacgatatgatccttgatattggcccagaaaccataagagattatgtagacctcatccatgacgccaacaccatcatctggaatggtccggttggtgtattcgaattcccgcagtttgcttatggaactagagccattgctatagcgattgccgagagtgatgccttttctattgctggtggtggtgataccttggctgctgttgatctttatgatttgaatcaacaaatttcttatatttccacaggaggtggggcatttctcgaatgtctggaaggaaaaaccttgcctgctgttgctattttgcaggagcgcgcaaaacatgttaagacgaactaa

SEQ ID NO: 90388 - protein, 396 aa, Legionella pneumophila subsp. pneumophila str. Philadelphia 1
MNLIKMSDIDLSGKRVLIREDLNVPIKDGMITSDQRLQAALPTIKSALDSGAAVIVLSHLGRPEEGKYEKKFSLEPVADYLRENLEYPVRFVKDYLSGVGVNPGELVVCENVRFNPGEKANDEALAKKLASLCDVFVMDAFGTAHRAQASTYGVAQYAPVAVAGPLLIRELEALNQVLKAPKKPIVAIVGGAKVSSKLSLLKQLVGMVDVLIPGGGIANTFLKAQGFEIGISLYEPDLLDEARHILILAKEKGCQIPLPTDVVVGKTFSETCPAFNKSLSNVAADDMILDIGPETIRDYVDLIHDANTIIWNGPVGVFEFPQFAYGTRAIAIAIAESDAFSIAGGGDTLAAVDLYDLNQQISYISTGGGAFLECLEGKTLPAVAILQERAKHVKTN

SEQ ID NO: 90389 - DNA, 1260 bp, Bacteroides fragilis YCH46
  CDS (1)..(1260): transl_table=11
atgcagacaattgacaatttcaattttgccggtaaaaaggcattcgttcgcgtggacttcaatgtacccttggacgaaaacttcaacattacagacgacactcgtatccgtgctgcacttcctaccctgaagaagattctggcagacggtggtagcatcatcatcggttctcacctgggccgtccgaaaggcgttgctgacaaattctctctgaaacacattgttaagcatgtatcagagttactgggcgttgaagttcagtttgccaacgactgtatgggcgaagaagctgctgtaaaagccgctgctctgcaaccgggcgaagtgctgttgcttgaaaaccttcgcttctacgctgaagaagaaggcaaaccaagaggattggctgaagacgcaaccgacgaagaaaaagccgcagccaagaaagccgtaaaagagagccagaaagaatttaccaagaaattggcttcgtatgcagactgctacgtaaacgacgcattcggtacagctcaccgtgctcatgcttctacagcactgatcgctaaatacttcgacaccaacaataagatgtttggctacctgatggaaaaagaagtgaaagccgttgataagatattgaacgacatcaagcgtccgtttactgccatcatgggtggatcaaaagtatcttctaagatcgaaatcatcgaaaacctgctgaacaaggtagacaacctgatcatcacaggcggtatgacttacactttcaccaaagcaatgggtggacagatcggtctgtctatctgcgaagatgacaaactggatctggctcgcgaactgatgcagaaagccaaagacaaaggtgtaaatctggtattagctgttgacgctaagattgctgacgctttctctaacgatgccaatactaaattctgcccggttaacgaaattcctgacggatgggaaggtcttgacatcggtccgaaatctgaagagatctttgccgaagtgatcaagaattctaagacaattctttggaatggtccgacaggtgtattcgaattcgaaaacttcactcacggctctcgttcagtaggcgaagctatcgttgaagctactaagaacggcgctttctcactcgttggcggtggcgactctgtagcttgtgtcaacaagttcggtctggcagacggtgtatcttatgtttctacaggcggtggagcactgctcgaagcaatcgaaggaaaagttcttccgggtattgccgctatccaggaataa

SEQ ID NO: 90390 - protein, 419 aa, Bacteroides fragilis YCH46
MQTIDNFNFAGKKAFVRVDFNVPLDENFNITDDTRIRAALPTLKKILADGGSIIIGSHLGRPKGVADKFSLKHIVKHVSELLGVEVQFANDCMGEEAAVKAAALQPGEVLLLENLRFYAEEEGKPRGLAEDATDEEKAAAKKAVKESQKEFTKKLASYADCYVNDAFGTAHRAHASTALIAKYFDTNNKMFGYLMEKEVKAVDKILNDIKRPFTAIMGGSKVSSKIEIIENLLNKVDNLIITGGMTYTFTKAMGGQIGLSICEDDKLDLARELMQKAKDKGVNLVLAVDAKIADAFSNDANTKFCPVNEIPDGWEGLDIGPKSEEIFAEVIKNSKTILWNGPTGVFEFENFTHGSRSVGEAIVEATKNGAFSLVGGGDSVACVNKFGLADGVSYVSTGGGALLEAIEGKVLPGIAAIQE

SEQ ID NO: 90391 - DNA, 1194 bp, Burkholderia mallei ATCC 23344
  CDS (1)..(1194): transl_table=11
atgagccaagtaaagcgtcttaccgacctgatcgccgaaggcaagctgtccggcaaacgcgtgttcatccgcgccgatctgaacgtgccgcaggacgatcacggcaacatcaccgaagacacgcgcgtgcgcgcgtcggtgcccgcgatccaggcggcgctcgacgcgggcgcggccgtgatggtcacgtcgcacctcggccgcccgacggaaggcgagttcaagcccgaggattcgctcgcgcccgtcgcgaagcgcctggccgagctgctcggccgcgatgtgccgctcgtcgcgaactgggtcgagaacggggtcgaggtcgcgcccgggcaggtcgtgctgctcgagaactgccgcgtgaacaagggcgagaagaagaactcggacgagctcgcgcagaagatggcgaagctctgcgacgtctacgtgaacgacgcgttcggcaccgcgcaccgcgcggaggcgaccacccacggcatcgcgaagtacgcccccgtcgcgtgcgcgggtccgctgctcgcggccgagctcgacgcgctcggcaaggcgctcggcaacccgaagcgcccgctggtggcgatcgtcgcgggctcgaaggtgtcgacgaagctgacgatcctgaagtcgctcgcggagaaggtcgatcaattgatcgtcggcggcggcatcgcgaacacgttcatgctcgcggcggggcttgcgatcggcaagtcgctcgccgaggccgatctcgtcggcgaggcgaaggcgatcatcgacgaagcccgcaagcgcggcgcgtcggtgccgatcccgaccgacgtcgtcgtcgcgaaggaattctcgccgacggccgccgccaccgtgaagaaggtcgccgacatcgaagccgacgacatgatcctcgacatcggcccggacaccgcgaaggcgctcgccggccagctcgagaaggcgggcacgatcgtctggaacggcccggtcggcgtgttcgagttcgaccagttcggcaacggcacgaagacgctcgccgacgcgatcgcgagctcggccgcgttctcgatcgcgggcggcggcgacacgcttgccgcgatcgcgaagtacggcatccacgacaaggtcagctacatctcgacgggcggcggcgcgttcctcgaattcctcgagggcaagaagctgcccgccgtcgaagtgctggaaacgcgcgcgtaa

SEQ ID NO: 90392 - protein, 397 aa, Burkholderia mallei ATCC 23344
MSQVKRLTDLIAEGKLSGKRVFIRADLNVPQDDHGNITEDTRVRASVPAIQAALDAGAAVMVTSHLGRPTEGEFKPEDSLAPVAKRLAELLGRDVPLVANWVENGVEVAPGQVVLLENCRVNKGEKKNSDELAQKMAKLCDVYVNDAFGTAHRAEATTHGIAKYAPVACAGPLLAAELDALGKALGNPKRPLVAIVAGSKVSTKLTILKSLAEKVDQLIVGGGIANTFMLAAGLAIGKSLAEADLVGEAKAIIDEARKRGASVPIPTDVVVAKEFSPTAAATVKKVADIEADDMILDIGPDTAKALAGQLEKAGTIVWNGPVGVFEFDQFGNGTKTLADAIASSAAFSIAGGGDTLAAIAKYGIHDKVSYISTGGGAFLEFLEGKKLPAVEVLETRA

SEQ ID NO: 90393 - DNA, 1194 bp, Burkholderia pseudomallei K96243
  CDS (1)..(1194): transl_table=11
atgagccaagtaaagcgtcttaccgacctgatcgccgaaggcaagctgtccggcaaacgcgtgttcatccgcgccgatctgaacgtgccgcaggacgatcacggcaacatcaccgaagacacgcgcgtgcgcgcgtcggtgcccgcgatccaggcggcgctcgacgcgggcgcggccgtgatggtcacgtcgcacctcggccgcccgacggaaggcgagttcaagcccgaggattcgctcgcgcccgtcgcgaagcgcctggccgagctgctcggccgcgatgtgccgctcgtcgcgaactgggtcgagaacggggtcgaggtcgcgcccgggcaggtcgtgctgctcgagaactgccgcgtgaacaagggcgagaagaagaactcggacgagctcgcgcagaagatggcgaagctctgcgacgtctacgtgaacgacgcgttcggcaccgcgcaccgcgcggaggcgaccacccacggcatcgcgaagtacgcccccgtcgcatgcgcgggcccgctgctcgcggccgagctcgacgcgctcggcaaggcgctcggcaacccgaagcgcccgctggtggcgatcgtcgcgggctcgaaggtgtcgacgaagctgacgatcctgaagtcgctcgcggagaaggtcgatcaattgatcgtcggcggcggcatcgcgaacacgttcatgctcgcggcggggctcgcgatcggcaagtcgctcgccgaggccgatctcgtcggcgaggcgaaggcgatcatcgacgaagcccgcaagcgcggcgcgtcggtgccgatcccgaccgacgtcgtcgtcgcgaaggaattctcgccgacggccgccgccaccgtgaagaaggtcgccgacatcgaagccgacgacatgatcctcgacatcggccaggacaccgcgaaggcgctcgccggccagctcgagaaggcgggcacgatcgtctggaacggcccggtcggcgtgttcgagttcgaccagttcggcaacggcacgaagacgctcgccgacgcgatcgcgagctcggccgcgttctcgatcgcgggcggcggcgacacgctcgccgcgatcgcgaagtacggcatccacgacaaggtcagctacatctcgacgggcggcggcgcgttcctcgaattcctcgagggcaagaagctgcccgccgtcgaagtgctggaaacgcgcgcgtaa

SEQ ID NO: 90394 - protein, 397 aa, Burkholderia pseudomallei K96243
MSQVKRLTDLIAEGKLSGKRVFIRADLNVPQDDHGNITEDTRVRASVPAIQAALDAGAAVMVTSHLGRPTEGEFKPEDSLAPVAKRLAELLGRDVPLVANWVENGVEVAPGQVVLLENCRVNKGEKKNSDELAQKMAKLCDVYVNDAFGTAHRAEATTHGIAKYAPVACAGPLLAAELDALGKALGNPKRPLVAIVAGSKVSTKLTILKSLAEKVDQLIVGGGIANTFMLAAGLAIGKSLAEADLVGEAKAIIDEARKRGASVPIPTDVVVAKEFSPTAAATVKKVADIEADDMILDIGQDTAKALAGQLEKAGTIVWNGPVGVFEFDQFGNGTKTLADAIASSAAFSIAGGGDTLAAIAKYGIHDKVSYISTGGGAFLEFLEGKKLPAVEVLETRA

SEQ ID NO: 90395 - DNA, 1176 bp, Methylococcus capsulatus str. Bath
  CDS (1)..(1176): transl_table=11
atggctttcaaacgcatgaccgacatcgatctcgccggcaagcgcgtcctgatccgggaagacttcaacgtccccgtcaaagatggccgggtcaccagcgacgcccgcatccgcgccgccctcccgaccatccgccacgcgctggacgccggcgctgcggtgatgctgatgtcgcatctcggccgccccaccgaaggggaatatgccgaggagttttccatgaaacccgttgccgaccggctgtccgaactattggggcagccggtgacactggtgaaggactacctgggtggcgccgacccggcggtcgggtcggtcgtgctattcgagaacgtgcgtttcaacaagggcgagaagaaggacgacgaggtcttggcgcgccagctcgccgcgctgtgcgacgtctacgtgatggatgccttcggtacggcgcaccgcgccgaggcttcgacgcacggcgtgggcaaatacgctcccaccgcctgtgccggcctgctgctggcgacggaattggatgcactgggcagagcgctccacgacccggcgcgccccttggtcgccatcgtcggcggctcgaaagtatcgaccaaactgacggttctggattccctttcgcaggtggtcgatcagctcatcgtcggtggcggtatcgccaacaccttcatcaaagccgccggcttcaatgtcgggaaatcactgtacgaggaggacctggtggccgaagccaggcgcctgatggaagccgccaaggccaagggcggggagatccccgtaccggtcgacgtggtggtcggcaaacgcttcgatgccgcggaacccgccatggtcaagagcgtcgcagacatcgccgaggacgacatgatcctcgacatcggtccggagaccagccgccgctacgccgagttcatcggccgcgccggcacggtggtctggaatggccccgtaggtgtcttcgaattcgaccagttcggggaaggcacccgccgattgggtctggccatcgccgaaagccatgcattttccatcgccggagggggagacacactggcagccatcgacaaatacggcatcgccgaccgcatctcctacatctcgacggggggcggcgccttcctggaatttctcgaaggcaagcaactgccggcggttgccatgctggagagccgcgcggactga

SEQ ID NO: 90396 - protein, 391 aa, Methylococcus capsulatus str. Bath
MAFKRMTDIDLAGKRVLIREDFNVPVKDGRVTSDARIRAALPTIRHALDAGAAVMLMSHLGRPTEGEYAEEFSMKPVADRLSELLGQPVTLVKDYLGGADPAVGSVVLFENVRFNKGEKKDDEVLARQLAALCDVYVMDAFGTAHRAEASTHGVGKYAPTACAGLLLATELDALGRALHDPARPLVAIVGGSKVSTKLTVLDSLSQVVDQLIVGGGIANTFIKAAGFNVGKSLYEEDLVAEARRLMEAAKAKGGEIPVPVDVVVGKRFDAAEPAMVKSVADIAEDDMILDIGPETSRRYAEFIGRAGTVVWNGPVGVFEFDQFGEGTRRLGLAIAESHAFSIAGGGDTLAAIDKYGIADRISYISTGGGAFLEFLEGKQLPAVAMLESRAD

SEQ ID NO: 90397 - DNA, 1233 bp, Nocardia farcinica IFM 10152
  CDS (1)..(1233): transl_table=11
atggctgtcaagacactccaggatctcctgaacgagggtgtcgaaggtcggggcgtgctggtgcgctccgacctgaacgtccccctcgacgacaacgggcagatcaccgatcccggccgcatcatcgcctcgatcccgacgctgaaggccctggtcgaggcgggcgccaaggtggtcgtcaccgcgcacctcggccgtcccaagggcgagccggacccgaagttctcgctcgcgccggtggcggcgaagctggccgaactgctcggccgcaacgtgcagctggccggtgacgtggtgggctacgacgcgctctcgcgctcggagggcctcaccgacggtgacgtgctgctgctggagaacgtgcgtttcgatccgcgcgagaccagcaaggacgaggccgagcgcggcaagctcgcggcggccctggtcgagctggtcggcgaggacggcgcgttcgtctccgacggtttcggcgtggtgcatcgcaagcaggcctcggtctacgacgtggccaagttgctgccgcactacgcgggcacgctggtcgccgccgaggtggacgtgctggccaagctcaccgacaacaccgagcggccctacgccgtggtgctgggcggctcgaaggtctccgacaagctcgccgtcatcgaggcgctggcgcccaaggtcgacaccctggtgatcggcggcggcatgtgcttcaccttccttgccgcacagggcctttcggtcggctcctcgctgctgcaggaggagatgatcgacacctgcaaggggctgctcgagcggtacgccgacgtcatccacctgccgcgcgacgtggtggtcgccgactcgttctccgccgacgcggagtcgaagtgcgtgccggccaacgagatcccggacggctggatgggtctggacatcggcgcggagtcggtggaccggttcgcggcgctgctgaccgaggccaagacggtgttctggaacggcccgatgggcgtgttcgagttcgagaagttcgccgcgggcacccgcggggtcgccgaggcgatcgtggcggccaccggcaagggggcgttcaccgtcgtcggcggcggcgactcggccgcggcggtccgcgcgctcggcctgcccgaggacggtttctcgcacatctccaccggcggcggcgcgtcgctggaatacctggagggcaaggaacttcccggcatcagtgtcctcgaggacaccgctccggagggcagctga

SEQ ID NO: 90398 - protein, 410 aa, Nocardia farcinica IFM 10152
MAVKTLQDLLNEGVEGRGVLVRSDLNVPLDDNGQITDPGRIIASIPTLKALVEAGAKVVVTAHLGRPKGEPDPKFSLAPVAAKLAELLGRNVQLAGDVVGYDALSRSEGLTDGDVLLLENVRFDPRETSKDEAERGKLAAALVELVGEDGAFVSDGFGVVHRKQASVYDVAKLLPHYAGTLVAAEVDVLAKLTDNTERPYAVVLGGSKVSDKLAVIEALAPKVDTLVIGGGMCFTFLAAQGLSVGSSLLQEEMIDTCKGLLERYADVIHLPRDVVVADSFSADAESKCVPANEIPDGWMGLDIGAESVDRFAALLTEAKTVFWNGPMGVFEFEKFAAGTRGVAEAIVAATGKGAFTVVGGGDSAAAVRALGLPEDGFSHISTGGGASLEYLEGKELPGISVLEDTAPEGS

SEQ ID NO: 90399 - DNA, 1194 bp, Rhodobacter sphaeroides 2.4.1
  CDS (1)..(1194)
atgggctggaagacactcgacgacatggatcttgccggcaaggtcgtgctggtgcgcgtggatgtgaacgtgccgatggaaaatggcgaagtcaccgacgccacccggatcgagaagatcgtccccaccgtcgaggatatcctgaagaagggcggcaagcccgtcctgctcgcccatttcggccgtccgaagggcaaggtcgtggacgagatgagcctccgcctcgtgctgcccgcgctgcagaacgcgctgcctggcaccaaggtgagctttgccgccgactgcgtgggccccgagcccgagcaggcggtggccgccatgctcgagggcgaggtgctcctcctcgagaacacccgcttccatgccggcgaggagaagaacgaccccgagctggccgccgcgatggcgaagctggggcaggtctatgtcaacgatgccttctcggccgcgcaccgcgcccatgcctcgaccgagggcctcgcccgtcttctgccctcggccgccggccggctgatggaggccgagctgaaggcgctcgaagccgctctcggccatcccgagcgccccgttgtggccgtggtgggcggggccaaggtctcgaccaagctcgaccttctgggcaatctcgtgggccgggtcgatcatctggtgatcggcggcggcatggccaacaccttcctcgtggcgcaggggatcgaggtcggcaagtcgctggccgagcgcgacatggccgatacggcgcgcgagatcctctccaaggcgaaggccgcgggctgcacgatccatcttccgctcgatgtggtggtggcgcgcgagttcaaggcgggggccgcgaacgagacggtcgagacggcggcctgcccggccgacgcgatgatcctcgatgccggtccgaagaccgtggccgccctctccgaagtgttcgcctcggctaagacgctgatctggaacggcccgctcggcgccttcgagatcgagcccttcgacgccgcgacgaatgcggcggcgcttcaggtggcgcagctcaccaaggcgggccagctcatttcggtcgcgggcggcggcgatacggtggccgccctcaacaaggcgggcgcggccgaaggcttctcctacatctcgacggcgggcggtgccttcctcgaatggatggagggcaaggagctgcccggagtggccgcgctcacggtctga

SEQ ID NO: 90400 - protein, 397 aa, Rhodobacter sphaeroides 2.4.1
MGWKTLDDMDLAGKVVLVRVDVNVPMENGEVTDATRIEKIVPTVEDILKKGGKPVLLAHFGRPKGKVVDEMSLRLVLPALQNALPGTKVSFAADCVGPEPEQAVAAMLEGEVLLLENTRFHAGEEKNDPELAAAMAKLGQVYVNDAFSAAHRAHASTEGLARLLPSAAGRLMEAELKALEAALGHPERPVVAVVGGAKVSTKLDLLGNLVGRVDHLVIGGGMANTFLVAQGIEVGKSLAERDMADTAREILSKAKAAGCTIHLPLDVVVAREFKAGAANETVETAACPADAMILDAGPKTVAALSEVFASAKTLIWNGPLGAFEIEPFDAATNAAALQVAQLTKAGQLISVAGGGDTVAALNKAGAAEGFSYISTAGGAFLEWMEGKELPGVAALTV

SEQ ID NO: 90401 - DNA, 1212 bp, Lactobacillus gasseri
  CDS (1)..(1212)
atggctaaattaatcgtttcagaccttgatcttaaaggtaaaaaagttttagttcgtgttgactttaatgttccaattaaaaatggtgttattggtgatgacaaccgtatcgttgctgcattgccaactattaagtacattattgaacatggtggtaaagcaatcttactcagtcacttaggccgtgtaaagtcagatgctgacaagaaggaattatcattacgtccagtagcagaacgcttaagtgagttattaaagaagcctgtaacttttgtaccagaaaatgaaggtaaagaagttgaagaaaccatcgataaaatgaaagatggcgacgttattgttcttgaaaacactagattccaagatattgacaatgactttggtaaacgtgaatctaagaacgatccaaaacttggcgaatactgggcaagtcttggcgatgtatttgtaaacgatgcatttggtactgctcacagaagtcacgcttcaaatgtaggtatcgcaactgctatgaagaaggctggtaaacctgcagcagctggtttcttacttgaaaaagaaatcaagttcttaggtgatgctgttgaaaacccagttcacccatttgtaactatccttggcggtgcaaaagtatcagacaagattggtgttattgaaaacttaattcctaagtcagatcacattttaattggtggtggtatggcttacacattcttagctgcacaaggccacaagattggtaaatcattatttgaagctgataaagttgaacttgcaaaagaattattagcaaaagctggcgataagattgtattgcctgtagataatgtcgcagcaactgaattctcaaacgatgcacctcacgaagttgttggtgatgatattcctgataacgaaatgggtcttgacattggtcctaagactgttgagaaatttagagacatcttaaaggatgctaagaccgtcgtatggaacggacctatgggtgcattcgaaatgccaaactacgcagaaggtaccttggaagttggtcgcgcattagctgatttgaaagatgccgttactattatcggtggtggtgactcaactgctgctgctaagcaattgggaattgctcctaagatcagccacatttctactggtggtggtgcttcacttaactaccttgaaggtaaagaattaccaggaatcgcttgtgtttctgacaagtaa

SEQ ID NO: 90402 - protein, 403 aa, Lactobacillus gasseri
MAKLIVSDLDLKGKKVLVRVDFNVPIKNGVIGDDNRIVAALPTIKYIIEHGGKAILLSHLGRVKSDADKKELSLRPVAERLSELLKKPVTFVPENEGKEVEETIDKMKDGDVIVLENTRFQDIDNDFGKRESKNDPKLGEYWASLGDVFVNDAFGTAHRSHASNVGIATAMKKAGKPAAAGFLLEKEIKFLGDAVENPVHPFVTILGGAKVSDKIGVIENLIPKSDHILIGGGMAYTFLAAQGHKIGKSLFEADKVELAKELLAKAGDKIVLPVDNVAATEFSNDAPHEVVGDDIPDNEMGLDIGPKTVEKFRDILKDAKTVVWNGPMGAFEMPNYAEGTLEVGRALADLKDAVTIIGGGDSTAAAKQLGIAPKISHISTGGGASLNYLEGKELPGIACVSDK

SEQ ID NO: 90403 - DNA, 1218 bp, Magnetospirillum magnetotacticum MS-1
  CDS (1)..(1218)
atgttccggaccatcgacagcttcgacgtcaagggcaagcgggtgctggtgcgcgccgatctcaacgttccggccaaggacggcaaggtcaccgataccacccgtatcgaccgctccgccgccaccttgaaggagctggcgggcaagggcgccaaggtcatcgtactgacccatttcggccgccccaagggccgtgacgccaagtactcccagaagctgctggtcgagccgctggcgcgggcggtgggacagcccgtcctgtgggccgatgactgcatcggcgtcgaggtcgagcagatgatcgccaagatgaaggacggcgagatcgcccttttggaaaacgtccgcttctacgagaacgaggaagagaacgacatcggctttgccaagatgctggccggtctcggcgatatctatgtcaacgacgccttctcgaccgcgcaccgcgcccatgcttccaccgaaggcgtggcccatctactgccctgtgccgccgggcgtctgatgcaggccgagttggaagcgctgggcaaggcgctggaacatcccgagaagcccgtggccgccatcgtcggcggcgccaaggtctccaccaagctggacctgctgggcaatctggtggcccgcgtcgattacctgatcatcggcggcggcatggccaacaccttcctgttcgcccagggcaagcaggtgggcaagtccttgtgcgagaaggatctggccgacaccgcgcgcgagattctggaaaaggccaaggccgcccattgccatatcgtcctgccggtcgatgccgtggtggcgggggagttcgccgagaatgccgccaatcaggtggtttccgtcgatgctgtgcccgccgacaagatgatcctggatgccggtccggcctcggccgaggccatcatcgaccgcctgggcggctgcaagaccctggtgtggaacggccccctgggcgccttcgagatcgcgcccttcgacaaggccaccaacgcggtggctcaatgggccgccgagcgcaccgttcagggcaagctgctgaccgtgggcgggggcggtgacaccgtctcggccctggccaaggcgggcgtcgaggacaagttctcctacatctccacggcgggcggcgccttcctggaatggctggaaggcaaggtcctgcccggcgtcgcggccctcgaggtcaagaactgcggctcgggctgcggctgcggcggctga

SEQ ID NO: 90404 - protein, 405 aa, Magnetospirillum magnetotacticum MS-1
MFRTIDSFDVKGKRVLVRADLNVPAKDGKVTDTTRIDRSAATLKELAGKGAKVIVLTHFGRPKGRDAKYSQKLLVEPLARAVGQPVLWADDCIGVEVEQMIAKMKDGEIALLENVRFYENEEENDIGFAKMLAGLGDIYVNDAFSTAHRAHASTEGVAHLLPCAAGRLMQAELEALGKALEHPEKPVAAIVGGAKVSTKLDLLGNLVARVDYLIIGGGMANTFLFAQGKQVGKSLCEKDLADTAREILEKAKAAHCHIVLPVDAVVAGEFAENAANQVVSVDAVPADKMILDAGPASAEAIIDRLGGCKTLVWNGPLGAFEIAPFDKATNAVAQWAAERTVQGKLLTVGGGGDTVSALAKAGVEDKFSYISTAGGAFLEWLEGKVLPGVAALEVKNCGSGCGCGG

SEQ ID NO: 90405 - DNA, 1218 bp, Leuconostoc mesenteroides subsp. mesenteroides ATCC 8293
  CDS (1)..(1218)
atggctaaattgactgtttcagatttggaactttcaggtaagaaagtattgatgcgcgttgatttcaacgtgcctatcaaggcaggcgttatcggaaacgataaccgtattgtggcagctttgccaacaatcaagtatgttttggaaaacaatggtcgcgcaattttgttctctcatttgggacgtattaagtctgaagacgataagaaagaattgtcattagcaccagttgccgcacgcttgggtgaattattgggtaaggacgttaagttcgtgccacaaactcgcggtgaagaattagaatcagcaatcaacgctttgcaagatggtgaagttttgatggttgaaaacacacgttttgaagacgttgttgatggtgaagtggtcaaaaacgaatcaaagaacaatcctgaattgggtaagtattgggcatcattgggtgatgatttgttcatcaacgatgcctttggtacagctcaccgtgcccacgcttcaaacgtaggtattgcttcaaatgtttcacaagcagctgctggcttcttgatggaaaaagaaatcaagttcttgggtgatgctgttgcgaacccagttcgtcctttcgttgctattatcggtggtgcaaaggtttctgataaaattgaaatcgtaaagtcattattgaacaaggctgataaggttatcgttggtggtggaatggcctatacattcgatgctgctaagggtaacaagattggtaattcattgtttgaagctgataaagttgaattggctaaggaattgatggcagaagctggcgacaagttggttttgccaattgattcaattgctgctgacgcattttcaaatgatgcaaagactgaagttgttgatgctgaagatggtattcctgacggctacatgggtctagatattggtcctaagtctgttaagttgttgcaagacacattgtctgatgcaaagactgttgtttggaacggacctatgggtgtgttcgaaatgtctaattttgcaaagggtactttggcaattggtgaagaattggttaaagtgactgaaaatggtggtacaacaatcgttggtggtggtgattcaactgctgcggtacaacaattgggtgttgccgacaagttgacccacatttcaactggtggtggtgcttcacttgaataccttgaaggtaaggaattgcctggaatcgcttcaatttcggaaaagtaa

SEQ ID NO: 90406 - protein, 405 aa, Leuconostoc mesenteroides subsp. mesenteroides ATCC 8293
MAKLTVSDLELSGKKVLMRVDFNVPIKAGVIGNDNRIVAALPTIKYVLENNGRAILFSHLGRIKSEDDKKELSLAPVAARLGELLGKDVKFVPQTRGEELESAINALQDGEVLMVENTRFEDVVDGEVVKNESKNNPELGKYWASLGDDLFINDAFGTAHRAHASNVGIASNVSQAAAGFLMEKEIKFLGDAVANPVRPFVAIIGGAKVSDKIEIVKSLLNKADKVIVGGGMAYTFDAAKGNKIGNSLFEADKVELAKELMAEAGDKLVLPIDSIAADAFSNDAKTEVVDAEDGIPDGYMGLDIGPKSVKLLQDTLSDAKTVVWNGPMGVFEMSNFAKGTLAIGEELVKVTENGGTTIVGGGDSTAAVQQLGVADKLTHISTGGGASLEYLEGKELPGIASISEK

SEQ ID NO: 90407 - DNA, 1161 bp, Azotobacter vinelandii
  CDS (1)..(1161)
atgaccgtgttgaagatgaccgacctcgacctcaagggtaagcgcgtactcatccgtgaagacctcaacgtgccggtgaaggacggtgtggtgaagagcgacgcccgcatcctcgcttcgctgccgaccatcaagctggcgctggagaagggcgcggcggtgatggtctgctcgcacctgggccgcccgaccgagggcgaatattccgaggagaacagcctgaagccggtcgccgactacctgtccggggccctcggtcgcgaggtgccgctgctcggggaatacctggacggggtgaaggtcgagccgggccaggtggtgctgttcgagaacgtgcgtttcaacaagggcgagaagaagaacgccgacgagctggcgcagcggtacgccgcgctctgcgacgtgttcgtcatggacgccttcggcaccgcccaccgcgccgagggttcgacccacggcgtcgccaggttcgccaaggtcgcctgcgccggtcccctgctggccgccgagctggaggcgctgggcaaggcgctggacaacccgcagcggccgatggccgccatcgtcgccggttccaaggtgtccaccaagctcgacgtgctcaactccctgagccaggtctgcgaccagttgatcgtcggcggcggcatcgccaacaccttcctcgccgcggccggatacaaggtcggcaagtcgctctacgaggccgatctggtcgacaccgccaaggccatcgccgccaaggtcagcgtgccgctgccggtggacgtggtggtcgccaaggcgttcgccgagtccgccgaagccaccgtcaaggccatcgacgaggtggccgatgacgacatgatcctcgacatcggcccgcagaccgccgcgcagttcgccgaactgctgaaatcctcccggaccatcctgtggaacggtccggtcggcgtgttcgagttcgaccagttcggcaacggcaccaaggtcctggccgaggccatcgcggcgagcccggccttctccatcgccggtggcggcgataccctggcggccatcgacaagtacggcgtgggcgagaaaatctcctacatttccaccggtgggggcgccttcctcgaattcgtcgagggcaaggtgctgccggccgtggcggtgctggaagagcgcgccaggtaa

SEQ ID NO: 90408 - protein, 386 aa, Azotobacter vinelandii
MTVLKMTDLDLKGKRVLIREDLNVPVKDGVVKSDARILASLPTIKLALEKGAAVMVCSHLGRPTEGEYSEENSLKPVADYLSGALGREVPLLGEYLDGVKVEPGQVVLFENVRFNKGEKKNADELAQRYAALCDVFVMDAFGTAHRAEGSTHGVARFAKVACAGPLLAAELEALGKALDNPQRPMAAIVAGSKVSTKLDVLNSLSQVCDQLIVGGGIANTFLAAAGYKVGKSLYEADLVDTAKAIAAKVSVPLPVDVVVAKAFAESAEATVKAIDEVADDDMILDIGPQTAAQFAELLKSSRTILWNGPVGVFEFDQFGNGTKVLAEAIAASPAFSIAGGGDTLAAIDKYGVGEKISYISTGGGAFLEFVEGKVLPAVAVLEERAR

SEQ ID NO: 90409 - DNA, 1155 bp, Desulfitobacterium hafniense DCB-2
  CDS (1)..(1155)
atgctagaggatccctctttgtgctttgttgattttaacgtacctatggatgaccatggcaatattaccaacgacacgaggattcgggcggctctgcctaccattcactatctgattgacgaaggggctaaaattatcctcgcttcccatttgggacgtcccaagggaaaaccggatccgaactattccctggctccggtggccaaacgtcttggtgaattgctcaagcgaccggtggccatggcgaccgattgtatcggtccggaggtagagaaagcagcagctcagctgcaggaaggtgaagtccttcttctagaaaatgtccgttatcatgccgaggaagaaaagaatgaaccggagtttgtcaagcaattagcccgcttagctgaagtgtatgttaacgatgctttcggtacagcccaccgggctcatgcttccacagaaggaatcgctcatcatcttcccggggtggccggctttctcctccaaaaggaaattgaaagtatgggcaaggctctggagaatccggagcggccttttgtggccatcattggcggagccaaggtcagtgacaaaatcggggtcattgagaacctgctccataaagtggacgctttgatcattggcggcggcatggccaataccttcctgaaagcccagggctattctctgggtaagtccctggtggaaggagataaattatccctggctcaggagattcttgagcaagggcgggaactccaggtggacattcttttgccccaggatgtggttgcggccaaagaatttaaagccgatgccccctatcgggtcacccctgtccgggagatcgccgaggacgaaatggctttggatatcggaccggaaagtgccggactgttcagtgcaagaatacaaaaggcccggactatcgtctggaacggccccatgggtgtctttgaaatggaacaatttgccaaggggacggagaaagttgctcaggctgtggccttatgtccgggtctgaccattgtcggcggtggagattccgtggccgccgtagaaaaaatgggtgtaggggagcaaatgagccatatctccacaggagggggggcttccctgaagctcctgaaaggcaagaacctgcccggtatagcggcactacaaaacatctaa

SEQ ID NO: 90410 - protein, 384 aa, Desulfitobacterium hafniense DCB-2
MLEDPSLCFVDFNVPMDDHGNITNDTRIRAALPTIHYLIDEGAKIILASHLGRPKGKPDPNYSLAPVAKRLGELLKRPVAMATDCIGPEVEKAAAQLQEGEVLLLENVRYHAEEEKNEPEFVKQLARLAEVYVNDAFGTAHRAHASTEGIAHHLPGVAGFLLQKEIESMGKALENPERPFVAIIGGAKVSDKIGVIENLLHKVDALIIGGGMANTFLKAQGYSLGKSLVEGDKLSLAQEILEQGRELQVDILLPQDVVAAKEFKADAPYRVTPVREIAEDEMALDIGPESAGLFSARIQKARTIVWNGPMGVFEMEQFAKGTEKVAQAVALCPGLTIVGGGDSVAAVEKMGVGEQMSHISTGGGASLKLLKGKNLPGIAALQNI

SEQ ID NO: 90411 - DNA, 1203 bp, Nostoc punctiforme PCC 73102
  CDS (1)..(1203)
atgtccaaaaaaagtttagcaagtttatcttcagctgatatatctgggaaacgtgccttagtgcgggttgactttaatgtgcctgtggacgatcaaggcaagattaccgacgatactcgcattcgcgccgctctaccaaccatccaagatttaacgcagaagggtgctaaagtcattctcgcaagtcattttggccgtcccaaaggtgtggatgacaaattacgcctaactcccgttgccaagcgtctctctgagttactggggcaagaagtcattaaaactgatgactccatcggcgatgaagttgcagcgaaagttgccgctttgcaaaatggccaagtgctattactagaaaatgtccgtttttatccagaagaagagaaaaacgatgcagaatttgccaaaaaattggcagccaatgctgatttttatgtaaatgatgcttttggtactgcacaccgcgcccatgcttctactgaaggcgtgactaaattccttagcccttctgtggctggatatttagttgagaaggaattgcaatatctgcaaaacgctattgaaaatccccaacgtcctttggcggcaattattggcggttccaaagtttccagcaaaattggtgtaattgaaaccctgctggagaagtgcgacaagctgattattggcggtgggatgattttcaccttctacaaagcccgtggtttgagtgttggtaagtcgttggtagaagaagacaagctagaactagcgaagtctttagaagctaaggctaaagaacggggtgttgctttattgctgcctacagatgtggtattggcagataactttgcccctgatgccaattctcaaaccgttagcattgagaatatccccgatggttggatgggtttggatattgggccagactcggtgaaatttttccaagaagcccttgcagataccaaaacggttatttggaacgggccaatgggtgtatttgagtttgataagtttgcggcaggtacggaagcgatcgctcatactctcgctgaaatcggtaaaactggtacaaccaccatcatcggtggtggtgactcagtagcggctgtggaaaaggttggtttagcagaccaaatgagccacatttcgaccggcggcggcgctagcttggagttacttgaaggcaaagtattgcctggaattgcagctttagatgatgcgtaa

SEQ ID NO: 90412 - protein, 400 aa, Nostoc punctiforme PCC 73102
MSKKSLASLSSADISGKRALVRVDFNVPVDDQGKITDDTRIRAALPTIQDLTQKGAKVILASHFGRPKGVDDKLRLTPVAKRLSELLGQEVIKTDDSIGDEVAAKVAALQNGQVLLLENVRFYPEEEKNDAEFAKKLAANADFYVNDAFGTAHRAHASTEGVTKFLSPSVAGYLVEKELQYLQNAIENPQRPLAAIIGGSKVSSKIGVIETLLEKCDKLIIGGGMIFTFYKARGLSVGKSLVEEDKLELAKSLEAKAKERGVALLLPTDVVLADNFAPDANSQTVSIENIPDGWMGLDIGPDSVKFFQEALADTKTVIWNGPMGVFEFDKFAAGTEAIAHTLAEIGKTGTTTIIGGGDSVAAVEKVGLADQMSHISTGGGASLELLEGKVLPGIAALDDA

SEQ ID NO: 90413 - DNA, 1206 bp, Bifidobacterium longum DJO10A
  CDS (1)..(1206)
atgaagacactcaaggaccttggagatctcaagggcaagcgcgttctggttcgcgctgatttcaatgttccgctggacggcaccaccatcaccgatgacggtcgaatcaaggctgctctgccgaccatcaagaccctgcgcgaagaaggcgccaaggtcatcctcatggcccaccttggccgcccgaagggcaaggtcgttcctgagctgagcctggccccggttgccgcccgcctcggcgagctgctcggcgccaacgtgccgctggccaaggacacctacggcgaggacgctcaggccaaggtcgccgccatgaacgatggcgacgttgtgctgcttgagaacgttcgtttcaacccggaggagacctctaaggacgccgacgaacgcgccgcttacgccaagaagatcgccgccctcggcgaggccttcgtttccgatggcttcggcgtggtccaccgcgctcagggctccaactacgacgttgccgccgatctgccggccgccgcaggcctgctggtcgagaaggaagtcaaggccttgtccaaggccaccgagaacccggagcgtccgttcaccgtggtgcttggcggttccaaggtctccgacaagctcggcgtcatcgagaacctgctcgacaaggccaaccgtctggtcatcggcggtggcatggtgttcaccttcctcaaggccaagggctacgaggtcggcacctccctgcttgaagaggaccagcttgagaaggtcaagggctacatcgagaccgccgagaagaacggcgttgagctcgtgctgccgaccgacgtcgtcgtgaacgccggcttcccggccggtgacaccccggttgctccggaagtcgttgccgccgacgccatcccggccgacaagatgggtctggacatcggcccggagtcccagaagctcttccacgacaagatcgtcgactccaagaccgtcgtgtggaacggcccgatgggcgtgttcgaggttcctgagttcgccgccggcaccaaggccgtggcccagggtctggtcgacgccaccgcagccggtgcgttcaccatcgtcggtggcggcgactccgcctccgccgtgcgcaacctcggcttcccggaggacggcttctcccacatctccaccggtggtggcgcttccctcgagttcctcgaaggcaaggagctccctggcctgaaggtgcttgagtaa

SEQ ID NO: 90414 - protein, 401 aa, Bifidobacterium longum DJO10A
MKTLKDLGDLKGKRVLVRADFNVPLDGTTITDDGRIKAALPTIKTLREEGAKVILMAHLGRPKGKVVPELSLAPVAARLGELLGANVPLAKDTYGEDAQAKVAAMNDGDVVLLENVRFNPEETSKDADERAAYAKKIAALGEAFVSDGFGVVHRAQGSNYDVAADLPAAAGLLVEKEVKALSKATENPERPFTVVLGGSKVSDKLGVIENLLDKANRLVIGGGMVFTFLKAKGYEVGTSLLEEDQLEKVKGYIETAEKNGVELVLPTDVVVNAGFPAGDTPVAPEVVAADAIPADKMGLDIGPESQKLFHDKIVDSKTVVWNGPMGVFEVPEFAAGTKAVAQGLVDATAAGAFTIVGGGDSASAVRNLGFPEDGFSHISTGGGASLEFLEGKELPGLKVLE

SEQ ID NO: 90415 - DNA, 1179 bp, Desulfovibrio desulfuricans G20
  CDS (1)..(1179)
atgaacgtactgaaaatgactgatcttgatctgcgcggaaagcgtgtgcttatccgcgaggacctgaacgctcccatcaaggacggggcggtggccaacgacaacaggctgcgcgcagccgcacctaccatccgccttgccatgcaggcaggagcacgggttatggtgatgtcgcatctgggccgcccggcagaaggcgcgtttgacgaatcggcatccatggcacctgtggcggcacggctggccgatattctgggctgccccgtgccggtggtgcgggactggctggacggggtggatgtgcccgaaggcggcgtggtgctgacagagaatgtacgcttcaacaagggcgaaaaaaagaacgacgaagagctgggcaggcgcatggcggccctgtgcgatgtttatgtgatggatgctttcggcacggcgcaccgtgcgcaggcttccacccatgccgttgccgcatttgctcccgtggcctgcgcgggtccgctgctggcggcggagctggaagctctgggcaaggctcttggcgccccgcgccaccctgtggttggcatcatcggcggttccaaggtctcgaccaagctcactctgctggaaacgctttcctccaaggtcgacaagcttattgtgggcgggggcattgccaatacgtttatccgtgccgcaggttttgccgtgggcaaatcactgtatgaagaagatctggtggccgaagccgcccgcctgatgcaggccgcagccgcagccggaggagagattcccgtgcctgtggatgtggtggtggccacggagtttgccgaaactgcaacgcctgtctgcaagccggtggatcaggtggccgataatgagatgattatggacatcgggccgcaaaccgccgccatgtatgcagaggtgctgcgcggagcaggaaccatcgtgtggaacggacctgtcggggtgttcgagtttgatgccttcggtgccggtacagaagcgctgtgcagggctgtggcgcaaagcagcgccttttccatcgccggcggcggtgacactgtggccgctgtggataaatacggcgtccgtgacggcgtatcctatatatccacgggcggaggggcttttctggagtttctggaaggcaaggagctgccggcagtggccatgctggaacagcgcgcaaaagcctga

SEQ ID NO: 90416 - protein, 392 aa, Desulfovibrio desulfuricans G20
MNVLKMTDLDLRGKRVLIREDLNAPIKDGAVANDNRLRAAAPTIRLAMQAGARVMVMSHLGRPAEGAFDESASMAPVAARLADILGCPVPVVRDWLDGVDVPEGGVVLTENVRFNKGEKKNDEELGRRMAALCDVYVMDAFGTAHRAQASTHAVAAFAPVACAGPLLAAELEALGKALGAPRHPVVGIIGGSKVSTKLTLLETLSSKVDKLIVGGGIANTFIRAAGFAVGKSLYEEDLVAEAARLMQAAAAAGGEIPVPVDVVVATEFAETATPVCKPVDQVADNEMIMDIGPQTAAMYAEVLRGAGTIVWNGPVGVFEFDAFGAGTEALCRAVAQSSAFSIAGGGDTVAAVDKYGVRDGVSYISTGGGAFLEFLEGKELPAVAMLEQRAKA

SEQ ID NO: 90417 - DNA, 1170 bp, Haemophilus somnus 2336
  CDS (1)..(1170)
atgtcagtaattaaaatgaccgacctagatttagcaggtaagagagtatttattcgtgcagatttaaatgtgccggtaaaagaggggaaagtcacttccgatgcacgtatcaaagcaactattcctacgttaaaacttgcacttgagaaaggtgctaaagtgatggtaacttctcatttaggtcgtccgacagagggggaatttaaacctgaagattcattacagcctgttgttgattatttgaaaggtgccggttttaacgttcgtttagcacaagattatctaaacggtgtagaagtcaatgaaggtgaaattgttgttcttgaaaacgtacgtgtgaataaaggtgagaagaaaaatgatccggaattaagtaaaaaatatgccgcactttgtgatgtatttgttatggatgctttcggtacggctcaccgtgcacaagcctcaacttacggtgtagcggagtttgcccctgttgcttgtgccggtccattattagcggcggaattagaggcgttaggtaaagcattaaaagagcctcagcgtccaatgttagcgattgtgggaggttcaaaagtatccactaaattaactgtcttggacagcttatcaaaaattgctgaccaactgattgttggtggcggtattgcgaatactttcattgctgcagaggggcataatgtgggtaaatccttatatgaagcggatttaattcctgaagcacaacgtttatcaaaagtaacgaatattcctgttccagttgatgtgcgtgtgggcactgaattttcagaaaccgcactatcaacagaaaaaagtgtagccgacgtttccggagaagaatccatttttgatattggtgataaatcagcagagcaattggctgatattatccgcaatgcaaaaactattctttggaatggtcctgtgggggtttttgaattccctaactttcgtaaaggtactgaaatcgtttctaatgcgattgctgaagcaaccgcaaatggtgctttctctattgctggtggtggtgatactttggcagcgattgatttattcggtatcaaagataaaatttcttatatttcgaccggtggtggtgcattcttagagtttgtagagggcaaagtattaccagcggttgaaattttagaaaaacgagcaaatggttaa

SEQ ID NO: 90418 - protein, 389 aa, Haemophilus somnus 2336
MSVIKMTDLDLAGKRVFIRADLNVPVKEGKVTSDARIKATIPTLKLALEKGAKVMVTSHLGRPTEGEFKPEDSLQPVVDYLKGAGFNVRLAQDYLNGVEVNEGEIVVLENVRVNKGEKKNDPELSKKYAALCDVFVMDAFGTAHRAQASTYGVAEFAPVACAGPLLAAELEALGKALKEPQRPMLAIVGGSKVSTKLTVLDSLSKIADQLIVGGGIANTFIAAEGHNVGKSLYEADLIPEAQRLSKVTNIPVPVDVRVGTEFSETALSTEKSVADVSGEESIFDIGDKSAEQLADIIRNAKTILWNGPVGVFEFPNFRKGTEIVSNAIAEATANGAFSIAGGGDTLAAIDLFGIKDKISYISTGGGAFLEFVEGKVLPAVEILEKRANG

SEQ ID NO: 90419 - DNA, 1176 bp, Actinobacillus pleuropneumoniae serovar 1 str. 4074
  CDS (1)..(1176)
atgtcagtgattaaaatggcagaccttgatcttgccggtaaacgtttatttatccgtgccgatttaaacgtaccggtaaaagatggcaaagtgacatctgacgcacgtattcgtgcaaccattcctaccttaaaattagctttacaaaaaggtgctaaagtaatggtgacttctcacttaggtcgtcctactgaaggtgtattcgaagaagcaaactctttacaacctgtggttgattacttaaacgcatcggatttaggcgtacctgtacgtttagtacgcgattacctagacggcgttgaagttgcggaaaacgaaatcgtagtacttgaaaacgttcgtatcaacaaaggcgaaaagaaaaacgatcctgaacttgcgaaaaaatatgcggcgctttgtgacgtattcgtgatggatgcattcggtacggcacaccgtgcggaaggttcgacttacggtgttgcggaatacgcgccggttgcttgtgcgggtcctctattagcggcggaattggatgcgctaggtaaagccttaaaagaaccgcaacgtccgatgttagcgatcgtaggcggctcaaaagtttctactaaattaaccgtattagacagcctttcaaaaattgcagaccaattaatcgttggcggcggtatcgcaaatactttcattgctgcggaaggtcacccggtaggcaaatcgttatacgaagcggatttaattcctgaagcgaaacgtttagcggcggcaaccaatattcctgttccggttgatgtacgcgtcggtaccgaattctctgaaatcgcaccggcaacggaaaaagcggtatctgaagttcaagcggacgaatcaattttcgatatcggtgacaaatctgcagaagaattggcaaatatcatcaaatcggcaaaaaccattctttggaacggtccggtcggtgtatttgaattccctaacttccgtaaaggtaccgaagtgatttcaaacgctatcgcagaagcgaccgcaaacggcgcattctcgatcgcaggtggcggtgataccttagcggcaatcgatttattcggtattgcggataaaatttcttatatctcaaccggcggcggcgccttcttagaattcgtagaaggtaaagtattaccggcggtcgaaattttagaaaaacgtgcaaacggctaa

SEQ ID NO: 90420 - protein, 391 aa, Actinobacillus pleuropneumoniae serovar 1 str. 4074
MSVIKMADLDLAGKRLFIRADLNVPVKDGKVTSDARIRATIPTLKLALQKGAKVMVTSHLGRPTEGVFEEANSLQPVVDYLNASDLGVPVRLVRDYLDGVEVAENEIVVLENVRINKGEKKNDPELAKKYAALCDVFVMDAFGTAHRAEGSTYGVAEYAPVACAGPLLAAELDALGKALKEPQRPMLAIVGGSKVSTKLTVLDSLSKIADQLIVGGGIANTFIAAEGHPVGKSLYEADLIPEAKRLAAATNIPVPVDVRVGTEFSEIAPATEKAVSEVQADESIFDIGDKSAEELANIIKSAKTILWNGPVGVFEFPNFRKGTEVISNAIAEATANGAFSIAGGGDTLAAIDLFGIADKISYISTGGGAFLEFVEGKVLPAVEILEKRANG

SEQ ID NO: 90421 - DNA, 1203 bp, Psychrobacter sp. 273-4
  CDS (1)..(1203)
atgaattttttgcgtatgagcgagctgagtttgaccaataaagtagtgttgattcgtgaagacctcaatgtgcctatcaaagaaggtaaggtcgctagtgacgcacgcttacaagccagcctgccgacgattaagatggcgttagagaagggcgcagcggtgattgtttgctcgcatttgggtcgcccgacagaaggaagttctgaagccatttattcattagcgcctgttgctgactatttaagcgataaattatcagcgcctgttacgcttaataatgactacctcgctcaaggcgtagctatcaaagcgggcgaggtcgtattgttagaaaacgtacgttttaatgaaggcgaaaagaaaaataacgcggcgctcgcgcaaaaatatgctgatttgtgcgatgtatttgtgatggacgcttttgggacagcacatcgtgctcaggcgtcgacagaaggcgtgacccaagcgatgcaccaagctggcaagacggcttgtgctggacctttattggcagccgagcttgatgcattgagtttggcgcttgaaacgccagcacagcccatgttagctatcgttggtggctcaaaagtctctaccaaattagaggttttgcatagtttggctgagctctgctcgcagattatcgttggtggcgggattgccaataccttcttagccgcgcaaggtcatagcgttggagcttcactttatgaagcagatctggtcgatacagctcgtgaaataatgggtaaaaccgagattttattacctgaatatgtcgtcgttgctaataaaaatgacattgattttgcagattttacaggctcattgcaaaaggcagttgcgaccatcaagtctgttgataatatcggcgacaatgacatgatattggatatcgcgccagacagtgctataaagttggctgctgctattaccaatgccaaaactatcttatggaatggtccagtaggggtttttgaagtggatgcgtttggtcagggcactcagatagtggcagaagcggtcaaaaatagccaaggtttttctatcgcgggcggcggtgatacgcttgctgcgattgataaatatcaagtggcagatggcgtcagctacatgtcaacgggtggtggtgctttcttagagtttgtagaaggtaaagtcttgccggcggttgctgctttacaaattaatgaataa

SEQ ID NO: 90422 - protein, 400 aa, Psychrobacter sp. 273-4
MNFLRMSELSLTNKVVLIREDLNVPIKEGKVASDARLQASLPTIKMALEKGAAVIVCSHLGRPTEGSSEAIYSLAPVADYLSDKLSAPVTLNNDYLAQGVAIKAGEVVLLENVRFNEGEKKNNAALAQKYADLCDVFVMDAFGTAHRAQASTEGVTQAMHQAGKTACAGPLLAAELDALSLALETPAQPMLAIVGGSKVSTKLEVLHSLAELCSQIIVGGGIANTFLAAQGHSVGASLYEADLVDTAREIMGKTEILLPEYVVVANKNDIDFADFTGSLQKAVATIKSVDNIGDNDMILDIAPDSAIKLAAAITNAKTILWNGPVGVFEVDAFGQGTQIVAEAVKNSQGFSIAGGGDTLAAIDKYQVADGVSYMSTGGGAFLEFVEGKVLPAVAALQINE

SEQ ID NO: 90423 - DNA, 1182 bp, Dechloromonas aromatica RCB
  CDS (1)..(1182)
atgaacgttatcaagctgaccgacctcgatgtttccggcaagcgtgttttcatccgcgccgacctcaatgtgccgcaggacgaagccggcaacatcaccgaggacacccgcatccgcgcctcgctgccgtcgatcaagtactgcctggaaaaaggcgccgccgtcatggtcacctcccacctcggccggccgaccgaaggcgaactgaatcacgaagacagcctgatgccggtcgccgtgcgtctcggccagatgctgcatacctccgtccgcctgatcaccgactgggtcgatggcggctttgaagtcaagccgggcgaagtcgtcctgctcgaaaactgccgcgtcaacaagggcgagaagaagaacaatgacgaactggcccagaagatggccaagctgtgcgacatctacgtcaatgacgccttcggtaccgcccaccgtgccgaagccaccacccacggcatcgccaagtacgccccggtcgcctgtgccggcatgctgatgggcgctgaaatcgatgcgctgtccaaggcactgcatgagcctaaacgtccgttggtcgccatcgtcggcggctccaaggtgtcgtccaagctgaccatcctcaagtcgctggccagcaaggtcgaccagttgatcgtcggtggcggcatcgccaacactttcctgcttgccgacggcaagcggattggccactcgctggccgagccggatctggtcaaggaagcccacaccatcatggacatcatgaaggaacgcggcgccgaagtccccctgccaaccgacgtcgtcgtcgccgacgaagtctcggccctggcccgcgccaacaagatttcggtcgatgacgtacacgccaacgaccgcatcctcgacgtcggtccgaagaccgccgccaagtttgccgaaatcatcgccaatgccggcaccatcgtctggaacggcccggtcggcgttttcgaattgccgcaatttgccggcggcaccaagatgatggcctccgccatcgcccactccgaggctttctcgattgccggcggcggtgacacgctggctgccatcgccaagttccatatcgccgacgatgttggctatatctcgacgggcggcggcgccttcctggagttcctcgaaggcaagaccctgccggccatcgccatcctcgaagaacgcgccgcataa

SEQ ID NO: 90424 - protein, 393 aa, Dechloromonas aromatica RCB
MNVIKLTDLDVSGKRVFIRADLNVPQDEAGNITEDTRIRASLPSIKYCLEKGAAVMVTSHLGRPTEGELNHEDSLMPVAVRLGQMLHTSVRLITDWVDGGFEVKPGEVVLLENCRVNKGEKKNNDELAQKMAKLCDIYVNDAFGTAHRAEATTHGIAKYAPVACAGMLMGAEIDALSKALHEPKRPLVAIVGGSKVSSKLTILKSLASKVDQLIVGGGIANTFLLADGKRIGHSLAEPDLVKEAHTIMDIMKERGAEVPLPTDVVVADEVSALARANKISVDDVHANDRILDVGPKTAAKFAEIIANAGTIVWNGPVGVFELPQFAGGTKMMASAIAHSEAFSIAGGGDTLAAIAKFHIADDVGYISTGGGAFLEFLEGKTLPAIAILEERAA

SEQ ID NO: 90425 - DNA, 1149 bp, Synechococcus elongatus PCC 7942
  CDS (1)..(1149)
atgcgtgtcgacttcaatgtccctttggacggcaatgggaaaattacggatgacacccgcatccgtgcggctctgccgacgattcgctacctgtcggaaagtggtgccaaggtgattctggtcagccactttggtcgtcccaaaggcaagcccgtcgagagcatgcgcttaacgccggtggctgagcgcctctcggaattgctgggtcgccctgttgttaagacaaccgatgctgtgggtgccggtgccgaagcgcaagtggcagccaccagcaatggccaagtcgtgttgttggagaacgtgcgtttccacgctgaggaagaagccaacgacgctgaatttgcgaaagcactagctagcttggccgatatctacgtcaatgatgcctttggtgctgctcaccgggctcacgcttccacggctggcgtgactgaatatctttcgccttgcgtggctggttacctgttggagaaagagttgcaatacctacaagccgcgatcgacaatccccaacggcccttggctgcgatcgtcggcggttcgaaagtttccagcaaaattggcgtgatcgaaacgctgctggataagtgcgacaaactgctgattggtggcggcatgatctttaccttctacaaagcccaaggactttcggtcggcggctcactggtagaagaggacaaactcgatctggcgcgatcgctgatggctaaagcgcaagaaaaaggcgtgcaactgttgctgcccgtggatgtagtagtggccgataagtttgcgccggatgctaatgccaaaaccgtggcgatcgatgcgattcccgatggctggatgggcctagatatcggacctgagtcggtcaagcaattcgaggaagccttggccgattgccgctcggtcatttggaatggcccgatgggcgtatttgagttcgatcaattcgctgtcggtaccgaagcgatcgctcgtagcttggcaggactgacccgcaagggtgcaaccacgatcattggtggtggtgactcggtcgctgccgttgagaaagtcggtgttgcttcggaaatgagccacatttccaccggtggtggtgccagcttggaactgctggaaggcaaagtcctgccgggtgtggctgcactggatgacgctgcctaa

SEQ ID NO: 90426 - protein, 382 aa, Synechococcus elongatus PCC 7942
MRVDFNVPLDGNGKITDDTRIRAALPTIRYLSESGAKVILVSHFGRPKGKPVESMRLTPVAERLSELLGRPVVKTTDAVGAGAEAQVAATSNGQVVLLENVRFHAEEEANDAEFAKALASLADIYVNDAFGAAHRAHASTAGVTEYLSPCVAGYLLEKELQYLQAAIDNPQRPLAAIVGGSKVSSKIGVIETLLDKCDKLLIGGGMIFTFYKAQGLSVGGSLVEEDKLDLARSLMAKAQEKGVQLLLPVDVVVADKFAPDANAKTVAIDAIPDGWMGLDIGPESVKQFEEALADCRSVIWNGPMGVFEFDQFAVGTEAIARSLAGLTRKGATTIIGGGDSVAAVEKVGVASEMSHISTGGGASLELLEGKVLPGVAALDDAA

SEQ ID NO: 90427 - DNA, 1119 bp, Ralstonia eutropha JMP134
  CDS (1)..(1119)
atgaatgtgccgcaggatgacgccggcaatatcaccgaggacacccgcatccgcgcttcggtgccggccatcgaggcctgcctggctgctggcgccgccgtgatggtcacgtcgcacctgggccgcccgaccgaaggcgagttcaagccggccgattcgctggcgccgattgccacgcgcctgtccgaactgctgggcaagccggtgaagctggtgcagaactgggtcgatggcgtggaggtcgctccgggtcaggtggtgctgctggaaaactgccgcgtgaacaagggcgaaaagaagaacagcgacgaactggcgcagaagatggccaagctgtgcgacgtgtacgtcaatgacgcgttcggcaccgctcaccgcgccgaagcgaccacgcacggcatcgccaagtacgcgccgatcgcctgcgccggcccgctgctggccgccgagatcgacgcgctgggcaaggcgctgggccagccggcgcgtccgctggtcgccatcgtggccggctcgaaggtctcgaccaagctgaccatcctgaagtcgctggccgacaaggtggacaacctgatcgtcggcggcggcatcgccaacaccttcatgctggccgccggcctgaagatcggcaagtcgctggccgaagccgacctggtggccgatgccaagaccatcatcgacatcatggccaagcgcggtgcctcggtacccattccggtcgacgtcgtgtgcgccaaggcgttcagcgccaccgccgccgccaccgtcaaggacgtcaaggacgtggccgacgacgacatgatcctcgacatcgggccgaagaccgccgcgcaattggccgaccagctcaaggctgccggtaccatcgtgtggaacggcccggtgggcgtgttcgagttcgaccagttcggcaacggcaccaaggtgctggccgaagccatcgccgattccaaggcattctcgatcgccggcggcggcgacacgctggccgccatcgccaagtacggcattgccgaccgcgtgggctatatctcgaccggcggcggcgcgttcctggagttcctggaaggcaagaagctgcccgcattcgaagtgctggagcaacgcgcagcaggctga

SEQ ID NO: 90428 - protein, 372 aa, Ralstonia eutropha JMP134
MNVPQDDAGNITEDTRIRASVPAIEACLAAGAAVMVTSHLGRPTEGEFKPADSLAPIATRLSELLGKPVKLVQNWVDGVEVAPGQVVLLENCRVNKGEKKNSDELAQKMAKLCDVYVNDAFGTAHRAEATTHGIAKYAPIACAGPLLAAEIDALGKALGQPARPLVAIVAGSKVSTKLTILKSLADKVDNLIVGGGIANTFMLAAGLKIGKSLAEADLVADAKTIIDIMAKRGASVPIPVDVVCAKAFSATAAATVKDVKDVADDDMILDIGPKTAAQLADQLKAAGTIVWNGPVGVFEFDQFGNGTKVLAEAIADSKAFSIAGGGDTLAAIAKYGIADRVGYISTGGGAFLEFLEGKKLPAFEVLEQRAAG

SEQ ID NO: 90429 - DNA, 1182 bp, Methylobacillus flagellatus KT
  CDS (1)..(1182)
atgaccgtaatcaacatgacggaccttgacctcgcgggcaagcgcgtcttcattcgcgccgatcttaacgtgccggtcagcgatggcaaagtcacttccgatgcgcgtatcaccgcctccattcccaccatacgccatgccctggatgccaaggcacgcgttatggtgacttcccaccttggtcgcccggaagaaggcgtatattcggaggaaaactccttgcagcccgtggctgacgtgctggccgacaagctgggtcagccggtgcgcctgatcaaggactgggtcgacggtggctttgaagtggcggaaggcgaagtggtcttgctggaaaattgccgcttcaataaaggtgagaaaaaaaacgccgaagaaaccgcgcgcaagtatgccgcgctatgcgatgtattcgtgatggacgctttcggtacagctcaccgcgcagaggcctccacctacggggtggcgcaatatgcaccggtcgcggcggcgggcttgctactggtcggcgagctggatgcactgggcaaggccctgtgcgaacctgcccgccccatggtcgcgattgtcggcggctccaaggtctccaccaagcttaccgtgctggaaagcctggctgaaaaggtcgaccagctcgtggtaggcggcggtattgccaataccttcctcaaggcagctggaaaaccgattggccgctcactgagcgaggacgacctggtacctactgcccaatgcctgatggaaaaaatggcgaagcgtggtgcggccgtgccaatcgcggtggatgtggtctgcggcaagcagttcgacgccaatgagcctgccgtactcaaatcggcggaggacgtggccgacgacgacatgatcttcgacattggccccgagtcggccaagcaactggccgagatcatcctcaatgcaggcaccgtggtctggaacggcccggtcggcgtattcgagttcgaccagttcggcgaaggcaccaagaccatcgccgacgccattgccaagaccaaggccttcaccctggccggcggcggcgacaccattgctgcgatccagaaatacgatatctatgacaaggtgtcttatatctcgacggcgggcggggcatttctggaattccttgaaggcaagaaattgccggcggtggagattttggaacagcgtgctaaaggttga

SEQ ID NO: 90430 - protein, 393 aa, Methylobacillus flagellatus KT
MTVINMTDLDLAGKRVFIRADLNVPVSDGKVTSDARITASIPTIRHALDAKARVMVTSHLGRPEEGVYSEENSLQPVADVLADKLGQPVRLIKDWVDGGFEVAEGEVVLLENCRFNKGEKKNAEETARKYAALCDVFVMDAFGTAHRAEASTYGVAQYAPVAAAGLLLVGELDALGKALCEPARPMVAIVGGSKVSTKLTVLESLAEKVDQLVVGGGIANTFLKAAGKPIGRSLSEDDLVPTAQCLMEKMAKRGAAVPIAVDVVCGKQFDANEPAVLKSAEDVADDDMIFDIGPESAKQLAEIILNAGTVVWNGPVGVFEFDQFGEGTKTIADAIAKTKAFTLAGGGDTIAAIQKYDIYDKVSYISTAGGAFLEFLEGKKLPAVEILEQRAKG

SEQ ID NO: 90431 - DNA, 1203 bp, Crocosphaera watsonii WH 8501
  CDS (1)..(1203)
atgtctaagaaaacgatcgccaatttatcagcagcggatctcgctggaaaacgagtattagtaagggttgattttaacgttcctttcgacaacggaagcatcaccgatgacacccgtattcgtgcagctttacccaccatcaaagaattgatcagcaatggggcaaaagttatcctctgtagccacatgggtcgtcccaagggtaaagtagttgatagcatgagtttaacgccggttgcagcccgtttaggggagttattagggcaaaaagtcaccatgtgtgatgattgtgttggagagtccgttacagccgccattggtgggctagaaaatggtcaagttgctctactggaaaatctccgtttccactcagaagaagaaggtaacgatcccgaatttgccaagcagttagcagctaacgccgatttatacgttaacgatgcctttggaactgctcaccgcgcccacgcttctactgaaggggtgacacactatttaagtcctagtgttgctggttatttgattgagaaagaactgcaatatttacaagctgcgatcgaaaacccccaacgtcctttagtggctattatcggtggttctaaagtttctagtaaaattggtgtaattgaaaccctactggaaaaatgcgataagctcatcattggcggtggcatgattttcaccttttataaagcccgtggcttaaatgttggtaagtctttggtagaagacgataagttagaattagctaagtctctcgaagccaaagccaaagagaaaggtgtggatttcttgttaccttctgatgtagttttagccgataactttgcccctgatgctaatgctaaaactaccagtattgacaacattgaagacggttggatgggcttagatattggccctgattccattaaactgttccaagacgctttatctgattgtaaagcagtcatttggaatggtccgatgggagtatttgaattcgataaatttgctgctgggaccgaagcgatcgcccgtaccttagctgagttaaccggcacaggaaccactactattatcggcggtggtgactctgttgctgctgttgaaaaagttggtgtggctgagaaaatgagccacatttctactggtggtggtgctagtttagaactgttagaaagtaaagttttacctggtattgctgccttagacgaagcgtga

SEQ ID NO: 90432 - protein, 400 aa, Crocosphaera watsonii WH 8501
MSKKTIANLSAADLAGKRVLVRVDFNVPFDNGSITDDTRIRAALPTIKELISNGAKVILCSHMGRPKGKVVDSMSLTPVAARLGELLGQKVTMCDDCVGESVTAAIGGLENGQVALLENLRFHSEEEGNDPEFAKQLAANADLYVNDAFGTAHRAHASTEGVTHYLSPSVAGYLIEKELQYLQAAIENPQRPLVAIIGGSKVSSKIGVIETLLEKCDKLIIGGGMIFTFYKARGLNVGKSLVEDDKLELAKSLEAKAKEKGVDFLLPSDVVLADNFAPDANAKTTSIDNIEDGWMGLDIGPDSIKLFQDALSDCKAVIWNGPMGVFEFDKFAAGTEAIARTLAELTGTGTTTIIGGGDSVAAVEKVGVAEKMSHISTGGGASLELLESKVLPGIAALDEA

SEQ ID NO: 90433 - DNA, 1185 bp, Exiguobacterium sp. 255-15
  CDS (1)..(1185)
atgaataagaaatcaattcgcgatatcgatgtaaaaggaaaacgcgtgtttacacgtgtggacttcaacgtaccgctagaagacggcaaaatcacagatgatacacgcatccgtgctgcccttccgacaatcaaacacttggttgacggtggagcgaaagtcatcctcgcaagccatatgggacgtccaaaaggcgagaaaaaccctgagttctcacttgcaccagtcgtagcacgccttagcgaactgcttggtaaggacatcaagctcgttgaagaagcatacggtccggtcgctgaagaagcagtcagcaagcttgaagaaggagacgtcatcgttcttgaaaacgttcgtttctacccaggcgaaacgaaaaacgatcctgaactcgcagaaggttttgcgaaacttgcagacgttttcgtcaacgacgcatttggtgcagcgcaccgtgcgcacgcttctacagaaggaatcgcccatcatgtcgagactgctgtagcaggattgttgatcgaaaaagaacttcaagttctcggtaaagctctctcaaacccggatcgtccgtttacagcgatcatcggtggttcgaaagtcgctgacaaaatcggcgtcatcgatcacttgcttgatatcgtcgacacgttgatcatcggcggaggattatcttatacattcctcaaagctcaaggttatgaagtcggtacgtcacttcttgaagtcgacaaaatcgaacaggcgaaggaattcatgaaaaaagcagaagacaaaggcgtgaaattcttgatgccggttgactgtgtcatcacgaaggaattcggcgaagaaacatatgttggatcacgcgacatcgacagtatcccagcggatcacatgtcactcgatatcggtccaaaaacggtagaactgtatgcagaagcaatcaaggcttcgaaacttgttgtctggaacggaccaatgggtgtgttcgaacttgataaatatgcaaacggaacaaaaggtgtcgctcaagcattagcggacagcgatgcatactcgatcatcggtggtggagattctgctgcagcggctgagaagtttggtcttgcagataaaatgagtcacatttcaacaggtggcggcgcaagcctcgagttcatggaaggaaaagctcttccaggtgtcgaagcgcttaacgacaagtaa

SEQ ID NO: 90434 - protein, 394 aa, Exiguobacterium sp. 255-15
MNKKSIRDIDVKGKRVFTRVDFNVPLEDGKITDDTRIRAALPTIKHLVDGGAKVILASHMGRPKGEKNPEFSLAPVVARLSELLGKDIKLVEEAYGPVAEEAVSKLEEGDVIVLENVRFYPGETKNDPELAEGFAKLADVFVNDAFGAAHRAHASTEGIAHHVETAVAGLLIEKELQVLGKALSNPDRPFTAIIGGSKVADKIGVIDHLLDIVDTLIIGGGLSYTFLKAQGYEVGTSLLEVDKIEQAKEFMKKAEDKGVKFLMPVDCVITKEFGEETYVGSRDIDSIPADHMSLDIGPKTVELYAEAIKASKLVVWNGPMGVFELDKYANGTKGVAQALADSDAYSIIGGGDSAAAAEKFGLADKMSHISTGGGASLEFMEGKALPGVEALNDK

SEQ ID NO: 90435 - DNA, 1179 bp, Rubrobacter xylanophilus DSM 9941
  CDS (1)..(1179)
atggacaagcggagcgtgagggacctcgagctgcgcgggaagaaggtgctcgtccgggtggacttcaacgtgccggtaaagggcggcgaggtgaccgacgacacccgcatccggcgggcgctgcccaccatccgctacctgctgcagcggggggcgagggtcgccctgatctcccacctgggccgcccgaagggcgagcccgacccccgctacaggatggaccccgtggcccggcggctcgaggagctgctcggggagccggtcaggaagctggataccgccacgggccctgaggtcggcagggcgctggaggagctggagcggggcgtgatcctgctggagaactcccgcttctaccccggggagacaaagaacgaccccgccttcgccgccgagctggccgggcccttcgacctctacgtcaacgacgccttcggggcggcccacagggcccacgccaccaccgtgggggtcgccgagcggctgcccgccgccgccggcttcctgctggagcaggagctggactacctggatggggtgctgcgcagcccggagcggcccttcgtggccatcctcggcggggccaaggtctcggacaagctgggggtcatcgagagcctgctcggggtggccgaccgcctcctcgtcgggggggcgatgtgcttcaccttcctgaaggccaggggcctcggggtcggagcctcgctggtcgaggacgactacctcggggaggcgcgtcgcctcatggagggggccgccgacaggctcgtgctcccggtggacgtggtcgtcgccgagaggatggaggagggggcccggacccggaccgtcccggtggaggagatcccggagggctggatgggcctggacatcggcccccggacggtcgagctcttccgccggcacatcctgcaggccaggaccatcttctggaacggccccatgggggtcttcgagatcgacgcgttcgccaggggcaccgagggcgtggccagggccgtcgccgagagcggggccacgagcgtcgtggggggcggcgactcggtcgccgccgtcaggaagctcggcctggaggacaggatgagccacatctccaccggcggcggggcctcgctggagtacgtcgagggcagggagctgcccggcgtggccgtgctgcccgagagggaggaggtctag

SEQ ID NO: 90436 - protein, 392 aa, Rubrobacter xylanophilus DSM 9941
MDKRSVRDLELRGKKVLVRVDFNVPVKGGEVTDDTRIRRALPTIRYLLQRGARVALISHLGRPKGEPDPRYRMDPVARRLEELLGEPVRKLDTATGPEVGRALEELERGVILLENSRFYPGETKNDPAFAAELAGPFDLYVNDAFGAAHRAHATTVGVAERLPAAAGFLLEQELDYLDGVLRSPERPFVAILGGAKVSDKLGVIESLLGVADRLLVGGAMCFTFLKARGLGVGASLVEDDYLGEARRLMEGAADRLVLPVDVVVAERMEEGARTRTVPVEEIPEGWMGLDIGPRTVELFRRHILQARTIFWNGPMGVFEIDAFARGTEGVARAVAESGATSVVGGGDSVAAVRKLGLEDRMSHISTGGGASLEYVEGRELPGVAVLPEREEV

SEQ ID NO: 90437 - DNA, 1197 bp, Mesorhizobium sp. BNC1
  CDS (1)..(1197)
atggccggtttcaagacattggacgatttgaaggatgtagcgggaaagcgtgtgcttctgcgcgtggacttgaatgtgccggtaaaggatggggaggttacggacacgacccgcatcgagcgtgttgcgccgaccattacggagctttccgacaagggtgccaaggttatcttgcttgcccatttcggtcggcccaagggcaagccggatgcagaggcttctctacagccgattgcacatgcggtggaagcagtcctcgatcggcgcgtccacttcgcatccagctgcataggcgaaccggcgaagaaggccgtggacgaaatgacgggcggggacatcctgcttctggaaaacacccgctttcacgcgggcgaggaaaagaacgacccggaatttacgaaggcgctcgcggcaaatggcgacatctatgtcaacgatgccttttctgccgcccatcgcgcgcatgcctcgacggaagggctggcgcatctccttcccgcttatgcgggacgcaccatccaggcggagctcgaagctctccagcgcggtcttggagatccgaaacgccctgtggtggcgatcgtcggcggcgcgaaagtctccaccaaaatcgatctgctcaccaatctcgtgaagaaggtcgactgtctcgttatcggaggcgggatggccaacaccttccttgcagcgcgcggcacttccgtcggcaagtcgttatgcgagcacgatcttagggaaacagccaaacagatcatgatcgatgcggctgaggccggctgtgcgatcatcctgccagtcgacgcggtggtggcacggaaattcgaagctggggcggaaaccgagacggtcgacatcgacgccgtgccggaagatgctatgatcctcgatgtcgggccgaagtcggtcgaaaaggtgaaagagtggctggaccgggccgacacgctggtttggaatgggcctctcggcgctttcgagctttcgcctttcgacaaggctaccatggaggtagcaaagtatgccgcccggcgaacccgtgagagcctcctggtgtcggtcgcaggcggcggcgatacggtagcagcactcaaccaggcggatgtgtctgatgacttcagctatgtctcgaccgccggtggcgctttccttgagtggatggaaggcaaggaccttccgggcgttgcagcgcttcagaagtga

SEQ ID NO: 90438 - protein, 398 aa, Mesorhizobium sp. BNC1
MAGFKTLDDLKDVAGKRVLLRVDLNVPVKDGEVTDTTRIERVAPTITELSDKGAKVILLAHFGRPKGKPDAEASLQPIAHAVEAVLDRRVHFASSCIGEPAKKAVDEMTGGDILLLENTRFHAGEEKNDPEFTKALAANGDIYVNDAFSAAHRAHASTEGLAHLLPAYAGRTIQAELEALQRGLGDPKRPVVAIVGGAKVSTKIDLLTNLVKKVDCLVIGGGMANTFLAARGTSVGKSLCEHDLRETAKQIMIDAAEAGCAIILPVDAVVARKFEAGAETETVDIDAVPEDAMILDVGPKSVEKVKEWLDRADTLVWNGPLGAFELSPFDKATMEVAKYAARRTRESLLVSVAGGGDTVAALNQADVSDDFSYVSTAGGAFLEWMEGKDLPGVAALQK

SEQ ID NO: 90439 - DNA, 1185 bp, Ehrlichia canis str. Jake
  CDS (1)..(1185)
atgttaaggtctcatgattttactttttgtaatatgaaaaaaatacaagatttcagttgtagtggtaagacagtgttactgcgtgcagacttaaatgtaccaatggataatggtgtagtgttggatgatactaggattgttagattgactacaactattaagtacttactgagtaatgatgcaaagattgtaataatgtcgcactatggccgccctaagtcttatgataaagaattttctttgaagtttttgattgagtacctaaataagatatttacaacaaatgtaatatttatagatggtgtaattggggattatgtagaacaaactatacaatctgcttcattaggttcaatattattactagaaaatttgagattttatgcagaagaagaaacaaatgatttagcgtttgctaaacagcttgctttattggctgatatatatgttaatgatgctttttcttgtttacaccgtaaacatgcatctatagatgcgattactagattaattccttcttttattggctttaattttcaggaagaaatgaaatatttgaattgtgttgtttctaatagtgaaaaaccagttgcagttatagttggtggctcaaaaatatcaacaaaaattcacatgttgaaaaatctgactaaaaaggtggattttttaatagtaggtggagctattgcaaataactttttactatcgcaaggtctgaaaataggaagatcattatatgaagaattagaaaaagatcttgtaaaagaaataatggatcttgctaaaagacatgagtgtaaaattattgttccagttgattatgtagtggctaagaattctatttatgggaaaagttcaataaaagataatgatactatagaatctgatgatgtaatattagatataggacctcaaacgattaatatagttactgcaacagtaaataagtgtagaacgattttatggaatggtccatgtggtatgtttgaaaaggagcagttttcaaaaggaacatttagtgttgcaaacttattagcaaaattaactaaggcaggtaaacttaaaagtattgttggtggtggtgatagtatatgtgcaatcaagttatctggtctttcaaatgatgactttacttatatttcaacaggtggaggtgctttactgcactttcttagtattgcgtag

SEQ ID NO: 90440 - protein, 394 aa, Ehrlichia canis str. Jake
MLRSHDFTFCNMKKIQDFSCSGKTVLLRADLNVPMDNGVVLDDTRIVRLTTTIKYLLSNDAKIVIMSHYGRPKSYDKEFSLKFLIEYLNKIFTTNVIFIDGVIGDYVEQTIQSASLGSILLLENLRFYAEEETNDLAFAKQLALLADIYVNDAFSCLHRKHASIDAITRLIPSFIGFNFQEEMKYLNCVVSNSEKPVAVIVGGSKISTKIHMLKNLTKKVDFLIVGGAIANNFLLSQGLKIGRSLYEELEKDLVKEIMDLAKRHECKIIVPVDYVVAKNSIYGKSSIKDNDTIESDDVILDIGPQTINIVTATVNKCRTILWNGPCGMFEKEQFSKGTFSVANLLAKLTKAGKLKSIVGGGDSICAIKLSGLSNDDFTYISTGGGALLHFLSIA

SEQ ID NO: 90441 - DNA, 1191 bp, Listeria monocytogenes str. 1/2a F6854
  CDS (1)..(1191): transl_table=11
atggctaaaaaagttgtaactgatttagatttaaaagacaaaaaagttttagttcgtgttgactttaacgtgccaatgaaagacggtaaaatcactaacgataaccgtattgtagctgcacttccaacaattgagtacatcttagaacaaaacggtaaagcaattctattttctcaccttggaaaagtaaaaacagaagaagataaagaaggaaaatctcttcgtccagtagccgctcgtttaagcgaattacttggaaaagaagtgaaattcgttcctactactcgtggtccagaacttgaagcagcaattgctgagttaaaagacggcgaagtacttctttttgaaaatacacgttttgaagatattgatggtaaaaaagaaagcaaaaatgatccagaacttggaaaatactgggctagccttggcgacgttttcgtaaatgacgcttttggtactgctcaccgtgcgcacgcgtctaacgttggaatcgcttctaacttagaatcagcggccggatttttgatggaaaaagaaattaaattcatcggcggtgtagttgataatccagcacgtccactagtagcaatcctaggtggtgcaaaagtttctgacaaaatcggtgttatcgaaaacttacttacaaaagcagacaaagtacttgtcggcggcggaatgactttcactttcatggcagctcaaggtcaagaaattggtaaatctcttttagaagcagataaagttgaacttgctaaaggcttacttgaaaaagctggcgataaattagtattaccagttgatgcagttgtatctaaagaattcagtaacgatgctcctttccatacagttagtgcagatagcattccagctgatgaaatgggactagatattggtcaagctacaatcgacttatttacaaaagaacttcaaggcgctaaaacagttgtatggaatggtccaatgggcgtattcgaacttagcaactttgctaaaggtacaattggcgtttgtgaagctattgcaaacttaactgatgcaacaactatcatcggtggtggggattctgcagcagcagctatggacttaggttttgctgataaattcacacatatttctactggtggcggcgcatctttagagtatcttgaaggtaaagagcttcctggtgttgcttctattagcgacaaataa

SEQ ID NO: 90442 - protein, 396 aa, Listeria monocytogenes str. 1/2a F6854
MAKKVVTDLDLKDKKVLVRVDFNVPMKDGKITNDNRIVAALPTIEYILEQNGKAILFSHLGKVKTEEDKEGKSLRPVAARLSELLGKEVKFVPTTRGPELEAAIAELKDGEVLLFENTRFEDIDGKKESKNDPELGKYWASLGDVFVNDAFGTAHRAHASNVGIASNLESAAGFLMEKEIKFIGGVVDNPARPLVAILGGAKVSDKIGVIENLLTKADKVLVGGGMTFTFMAAQGQEIGKSLLEADKVELAKGLLEKAGDKLVLPVDAVVSKEFSNDAPFHTVSADSIPADEMGLDIGQATIDLFTKELQGAKTVVWNGPMGVFELSNFAKGTIGVCEAIANLTDATTIIGGGDSAAAAMDLGFADKFTHISTGGGASLEYLEGKELPGVASISDK

SEQ ID NO: 90443 - DNA, 1182 bp, Rubrivivax gelatinosus PM1
  CDS (1)..(1182)
atggccttcatgaccctggaccagatcaacctgcgcggccagcgggtgttcatccgctgcgacttcaacgtgccgctcgatgccgccggtcgcatcaccgacgacacccgcatccgcgccagcatccccggcatccgccacgcgctgacccagggggcgcgcgtcatgctcgcctcgcacctcggtcgacccggcgagggcgcactgacgccggccgactcgctcgcaccggtagcgcgccgtgtcggtgaactgctcgaccgcgaggtgccgctggtcggcgactggctcgcacggcctttcgacgtcacccccgggcaggccgtgatgctggagaactgccgcgccaatgtgggcgaaaaggccaactcgcgcgagctggcgctgcgcatggccgaactgtgcgatgtctatgtgaacgacgccttcggcaccgcccaccgcgccgaggccacgacggaagccctggcgcgcgttgccccggtggcctgcgccggcccgctgatggcgtcggagctgaacgcgctcggacgcgcactggctcggccggcccggcctctggcggccatcgtcggcggttcgaaagtgtcgaccaagctgtcggtgctgaagtcgctggccgaccaggtcgagttgctggtggtcggtggcggcatggccaacaccttcctgctggccgcggggcagaaggtgggcaagtcgctgtgcgagccggacatggtcgagacggccgcgcaggtggcctcgacgctcgccgcgcgcggcgccgagctcttcatgccgatcgacgtggtgaccgccaccgagttctccgaggacgccatcccggcgatcaaggcgctgagcgaggtcgggcccgacgacctgatcctcgacttcggtcctcggtcgatgcaggccctcgtcgagcgactggcgccctgcaagaccatcgtgtggaacggcccgctgggcgtgttcgagatcgagcagttctcctacggcacccgcacgctggccaccgccatcgccgcatcgcaggccttctcgatcgccggtggcggcgacaccgtcgccgcgatcaaccgcttcgacgtggccaaggacatcgactatgtctccaccgccggcggtgccttcctcgagttcctcgagggcagaacgctgcccgctgtgaaggcgctccaggaccgcgccgcctga

SEQ ID NO: 90444 - protein, 393 aa, Rubrivivax gelatinosus PM1
MAFMTLDQINLRGQRVFIRCDFNVPLDAAGRITDDTRIRASIPGIRHALTQGARVMLASHLGRPGEGALTPADSLAPVARRVGELLDREVPLVGDWLARPFDVTPGQAVMLENCRANVGEKANSRELALRMAELCDVYVNDAFGTAHRAEATTEALARVAPVACAGPLMASELNALGRALARPARPLAAIVGGSKVSTKLSVLKSLADQVELLVVGGGMANTFLLAAGQKVGKSLCEPDMVETAAQVASTLAARGAELFMPIDVVTATEFSEDAIPAIKALSEVGPDDLILDFGPRSMQALVERLAPCKTIVWNGPLGVFEIEQFSYGTRTLATAIAASQAFSIAGGGDTVAAINRFDVAKDIDYVSTAGGAFLEFLEGRTLPAVKALQDRAA

SEQ ID NO: 90445 - DNA, 1194 bp, Rubrivivax gelatinosus PM1
  CDS (1)..(1194)
ttgaaggttctgcggttctccgatctcatccagcaaggtcgcgtcgccggccaacgtgtcttcatccgggccgatctgaacgtgccgcaggacgacgccgggcgcatcaccgaggacacccgcatccgcgcctcgatcccctgcatcgagatggcgctggcggccggtgcggccgtgatggtgacctcgcacctgggccgtccgaccgagggcgagttcaaggccgaggactccctggcgccggtcgcgcgccgtctggccgagttgctgggccgcaaggtgccgctgctgcaggactggaccggcggtgtcgaagtcgcgccgggtgaactggtgctgctcgagaactgccgcgtcaacaagggcgagaagaagaacgacgaaacgctggcccggaagatggccgcgctctgcgacatcttcgtgcacgacgccttcggcaccgcgcaccgcgccgaggcctcgacctatggcattgcgcagttcgccaaggtggcctgtgccggcccgctgctggcggccgagatcgacgccatcaccaaggccctgaagagcccgaagcgcccgctggtggccatcgtggcgggctccaaggtcagcaccaagctgtcgatcctgaagtcgctggcggccaacgtcgaccagctgatcgtcggcggcggcatcgccaacacgttcatgctggcggtcggtctgtccatcggcaagtcgctggccgagcccgatctggtggatgaggcgcgcgccatcatcgacatgatgaaggcgcgtggcgccgcggtgccgatcccgatcgacgtggtcgtggccgacgagttctctgccatcgcacgcgccaacaaggtgaccgccaccgaggtgcggcccgatgacctgatcctcgacatcggcccgcgcaccgcggccgagctggccggcatcatcgcgcgcgccggcacggtggtctggaacgggccgatgggcgtgttcgaatacgaccagttcgccggcggaacgcgcacgctggctgcggccatcgcccattcgccggctttcagcatcgccggcggcggcgacacactggcggcgatcgcaaagtacggcatcgagaaggacatcggctacatctccaccggtggcggcgccttcctcgaggtgctggagggcaagaccctgccggccttcgagatcctcgagcagcgggccgccggctga

SEQ ID NO: 90446 - protein, 397 aa, Rubrivivax gelatinosus PM1
MKVLRFSDLIQQGRVAGQRVFIRADLNVPQDDAGRITEDTRIRASIPCIEMALAAGAAVMVTSHLGRPTEGEFKAEDSLAPVARRLAELLGRKVPLLQDWTGGVEVAPGELVLLENCRVNKGEKKNDETLARKMAALCDIFVHDAFGTAHRAEASTYGIAQFAKVACAGPLLAAEIDAITKALKSPKRPLVAIVAGSKVSTKLSILKSLAANVDQLIVGGGIANTFMLAVGLSIGKSLAEPDLVDEARAIIDMMKARGAAVPIPIDVVVADEFSAIARANKVTATEVRPDDLILDIGPRTAAELAGIIARAGTVVWNGPMGVFEYDQFAGGTRTLAAAIAHSPAFSIAGGGDTLAAIAKYGIEKDIGYISTGGGAFLEVLEGKTLPAFEILEQRAAG

SEQ ID NO: 90447 - DNA, 1164 bp, Pseudomonas fluorescens PfO-1
  CDS (1)..(1164)
atgaccgtgttgaagatgtccgacctcgatctgcaaggtaagcgcgtattgatccgcgaagacctcaacgtcccagtcaaggacggtgttgtcaccagcgatgcgcgtatcctggcttcgctgccgaccatcaagctggccctggaaaaaggcgcggccgtgatggtctgctcgcacctgggtcgtccgaccgaaggcgaattctctgccgagaacagcctcaagcctgtcgccgactacctgagcaaggccctgggccgcgaagtgccgctggtggccgactacctgggcggcgttgacgtcaaggccggcgacatcgtgctgttcgaaaacgtgcgcttcaataagggcgagaaaaagaacgccgacgaattggcccagcaatatgccgccctgtgcgacgtgttcgtgatggacgctttcggcaccgctcaccgtgctgaaggttcgacccacggcgtcgccaagttcgccaaagtcgccgctgccggcccgctgctggctgctgagctcgacgcactgggcaaagccctgggcgccccggccaagccgatggcggccatcgttgccggctccaaggtctcgaccaagctcgacgtactgaacagcctgagccagatctgcgatcaactgatcgtcggcggcggcatcgccaacaccttcctcgcggcggccggtcacccggtcggcaagtcgctgtacgagccggacctgctggacaccgcgcgcgccatcgccgccaaggtcagcgtgccgctgccggtcgacgtggtggttgccaaggaattcgctgaaagcgccgaagcgaccgtgaaactgatcgctgacgtcgctgccgacgacatgatcctcgacatcggcccgcaaaccgcggccaacttcgccgaactgctgaagtcgtcgaaaaccatcctgtggaacggcccggtcggcgtgttcgaattcgaccagttcggcaacggcaccaaagtgctggccgaagccatcgcagaaagcgcggcgttctcgattgccggcggtggcgacaccctggcggccatcgataaatatggcgtagcggaaaagatctcctacatttccaccggcggcggcgcgttcctcgaattcgtcgaaggcaaggtgctgccggccgttgaagtcctggaaagccgggccaaggcctga

SEQ ID NO: 90448 - protein, 387 aa, Pseudomonas fluorescens PfO-1
MTVLKMSDLDLQGKRVLIREDLNVPVKDGVVTSDARILASLPTIKLALEKGAAVMVCSHLGRPTEGEFSAENSLKPVADYLSKALGREVPLVADYLGGVDVKAGDIVLFENVRFNKGEKKNADELAQQYAALCDVFVMDAFGTAHRAEGSTHGVAKFAKVAAAGPLLAAELDALGKALGAPAKPMAAIVAGSKVSTKLDVLNSLSQICDQLIVGGGIANTFLAAAGHPVGKSLYEPDLLDTARAIAAKVSVPLPVDVVVAKEFAESAEATVKLIADVAADDMILDIGPQTAANFAELLKSSKTILWNGPVGVFEFDQFGNGTKVLAEAIAESAAFSIAGGGDTLAAIDKYGVAEKISYISTGGGAFLEFVEGKVLPAVEVLESRAKA

SEQ ID NO: 90449 - DNA, 1194 bp, Rhodospirillum rubrum
  CDS (1)..(1194)
atggccagcttcaagacgattgacgacctggatgtgaacggcaagcgcgtgctggtgcgcgccgacctcaacgtgccgatccgcgatggtgtggtcactgataccacccgcatcgaccgctcggccgaaaccatcctggccctggccagcaggggcgcctgcgtggtcgtctgctcgcacttcggccgccccaagggcaagcgcgttcccgagatgagcctgaggccgatcgtcgagccgctgtcgcgggccctgggcggcgttccggtggccttcgccgaggattgcgtcggtccggccgccgaattggtggtcaatggtctggcgccgggcgaagtcgccctgcttgaaaacctgcgcttccacgacgaagaagaaaagaacgatccggccttcgcccagaagctggccgatctgtgcgatctctacgtcaacgacgctttttcgtcggcccaccgcgcccacgcctcgaccgaatatatcgcccgtctggtgcccgctgccgccggccggctgatgcaggccgagttggaggccctgggcaaggcgctggataatcccgaacgcccggtcgcggccatcgtcggcggcgccaaggtctcgaccaagctagagctgctcggcaatctggtgtccaaggtcgatatgatcatcatcggcggcggcatggccaataccttcctcttcgcccagggcatcgagatcggcgccagcttgtgcgagaaggatatggccgataccgcccgcgccatccttgaaaaggccgccgcggcgaagtgcgagatcgtgctgccgatcgacgccgtggtcgcctcggccttcaaggaaggggccgaaaaccatgtggtggcgatcgatgccgtgccggccgacaagatgatccttgatgtcggcccgcaaaccgcccaggcggtgatcgccaaactcggcgagtgcaagaccctggtgtggaacggtcccttcggcgccttcgagatcaaacccttcgacgccgccaccaatacggtggcccaggccgccgcccaggcgaccgccgagggccggctgctgaccgtggccggcgggggcgatacggtctcggccctggccaatgccggggtggaagacaagttctcctatgtctcgacggccggcggcgccttcctggaatggctggagggcaaaacgctgccgggtgtcgccgccttgctgtag

SEQ ID NO: 90450 - protein, 397 aa, Rhodospirillum rubrum
MASFKTIDDLDVNGKRVLVRADLNVPIRDGVVTDTTRIDRSAETILALASRGACVVVCSHFGRPKGKRVPEMSLRPIVEPLSRALGGVPVAFAEDCVGPAAELVVNGLAPGEVALLENLRFHDEEEKNDPAFAQKLADLCDLYVNDAFSSAHRAHASTEYIARLVPAAAGRLMQAELEALGKALDNPERPVAAIVGGAKVSTKLELLGNLVSKVDMIIIGGGMANTFLFAQGIEIGASLCEKDMADTARAILEKAAAAKCEIVLPIDAVVASAFKEGAENHVVAIDAVPADKMILDVGPQTAQAVIAKLGECKTLVWNGPFGAFEIKPFDAATNTVAQAAAQATAEGRLLTVAGGGDTVSALANAGVEDKFSYVSTAGGAFLEWLEGKTLPGVAALL

SEQ ID NO: 90451 - DNA, 1194 bp, Burkholderia fungorum LB400
  CDS (1)..(1194)
atgaacaaggtattgcgtctctccgatctgatcgccgaaggcaagctatccggcaaacgcgtgttcatccgcgccgatctgaacgtgccgcaggacgatcaaggcaacatcaccgaagacacccgtatccgcgcttccgtgccggccatcaaggccgcgctcgacgcgggcgccgccgtgatggtcacgtcgcacctgggccgtcccacagagggtgatttcaagcctgaagactcgcttgcgccggtcgcgaaacgtctggccgaactgctcggccgcgaggtgccgctggtggcgaactgggtcgaaaacggcgtgaacgtcgcgccgggctcggtcgtgctgctggaaaactgccgcgtcaacaagggcgaaaagaaagattccgacgagctcgcgcagaaaatggcgaagctctgcgacatctacgtgaacgacgcattcggcaccgcgcaccgcgccgaagccaccacgcacggtattgccagatacgcgccggtggcgtgcgccggcccgctgctcgcggccgaactcgaagcgctcggcaaggcgctgggcgcgccgaagcgtccgctggtggcgatcgtcgccggctcgaaggtgtcgaccaagctgaccattctgaagtcgctcgccgacaaggtcgatcaactgatcgtgggcggcggcattgccaacacgttcatgctggccgcgggcctgaagatcggcaagtcgctcgccgaagccgatctggtgaacgaagccaaagccatcatcgacgcggcgaaagcccgcggcgcctcggtgccgatcccgaccgacgtggtcacggcgaaagagttttccccgaccgccaaggcagaagtcaaagcagtcgccgacgttcaggacgacgacctgatcctcgacatcgggccggaaacggccaaagtgctcgccgcgcaactggaaaaggccggcacgatcgtgtggaacggtccggtcggcgtgttcgaattcgaccagtttggcaacggcacgaagacgctggcggaggctatcgccaaatcgtcggcgttctcgattgccggcggcggcgatacgcttgctgcgatcgccaagtacggcatccacgacaaggtcagctatatctcgacgggcggcggcgctttcctcgaattcctcgaaggcaagaagctgccggcggtcgaagttctggaatcgcgggcttaa

SEQ ID NO: 90452 - protein, 397 aa, Burkholderia fungorum LB400
MNKVLRLSDLIAEGKLSGKRVFIRADLNVPQDDQGNITEDTRIRASVPAIKAALDAGAAVMVTSHLGRPTEGDFKPEDSLAPVAKRLAELLGREVPLVANWVENGVNVAPGSVVLLENCRVNKGEKKDSDELAQKMAKLCDIYVNDAFGTAHRAEATTHGIARYAPVACAGPLLAAELEALGKALGAPKRPLVAIVAGSKVSTKLTILKSLADKVDQLIVGGGIANTFMLAAGLKIGKSLAEADLVNEAKAIIDAAKARGASVPIPTDVVTAKEFSPTAKAEVKAVADVQDDDLILDIGPETAKVLAAQLEKAGTIVWNGPVGVFEFDQFGNGTKTLAEAIAKSSAFSIAGGGDTLAAIAKYGIHDKVSYISTGGGAFLEFLEGKKLPAVEVLESRA

SEQ ID NO: 90453 - DNA, 1254 bp, Magnetococcus sp. MC-1
  CDS (1)..(1254)
atgaccctctatgcgagccctgtttttctaatgaatgcgtctccaaaaagtgatgaggttctcatgaacaagcgtaccatccgtgatattgacatcaaaggtaagcgggttttcatgcgtgtggattttaatgtgcccctcaatgaggatggcacggtccgcagcgataagcgcattcagggtgcgctgcccaccattcgttatgccattgagcagggggctaaagtaattttggcttctcacttggggcgcccctcaggggataagtttgaacccgaattttcactaaagcctgcgggtgaagcgcttgccgcgctgttgggccaaccggtcaagctggccccagattgtgtaggggccgaggtcgaagcaatggtggccgccatgcaggatggtgatgtggtgttgctggagaatgtgcgttttcacaagggtgaaaccaaggcggatgttgagctttccaagggttttgccaagttggccgatgtggtggtaaacgatgcctttggcacggcacaccgggcccattcgtccaatgtgggcattaccgagtttgtgcgccctgcggtggccgggtttttgatggccgatgagatggactattttgataaggtattgggtgcgcccgagcgtccggtcatggccattttggggggggccaagatctcaggcaagattgatgtgatcgaggcgctgctggacaaaatggataagatcattattggcggtggcatgtccttcaccttcttcaaagccatgggttatgaaattggcaactcgttgtgtgaagatgagatgttgccggtggcagaaaaaaccttggctaaagccaaagagaagggggtatccctgatcctgccagtggattgcgtggcggcggacgcctttcgtgaggatgccaatacccagatctgctcggtagaagcactacccgctggctggatggggctggatatcgggcctgagagcgtcaagctgtttgccaaggcgttggagggggttaaaaccgtcatttggaacggccccatgggggtgtttgaaatggccccctttgccagtggcaccaaccatttggcccatttgttggcggagagtgattgtctttcggtgatcgggggtggtgatacggcggcggcggttaaacaagcgggcgtggccaagcaactctcttacatctccactggtggtggggcctcgctggagttgatggagggcaaacagctgcccggtatcacctcgctggatgataaatag

SEQ ID NO: 90454 - protein, 417 aa, Magnetococcus sp. MC-1
MTLYASPVFLMNASPKSDEVLMNKRTIRDIDIKGKRVFMRVDFNVPLNEDGTVRSDKRIQGALPTIRYAIEQGAKVILASHLGRPSGDKFEPEFSLKPAGEALAALLGQPVKLAPDCVGAEVEAMVAAMQDGDVVLLENVRFHKGETKADVELSKGFAKLADVVVNDAFGTAHRAHSSNVGITEFVRPAVAGFLMADEMDYFDKVLGAPERPVMAILGGAKISGKIDVIEALLDKMDKIIIGGGMSFTFFKAMGYEIGNSLCEDEMLPVAEKTLAKAKEKGVSLILPVDCVAADAFREDANTQICSVEALPAGWMGLDIGPESVKLFAKALEGVKTVIWNGPMGVFEMAPFASGTNHLAHLLAESDCLSVIGGGDTAAAVKQAGVAKQLSYISTGGGASLELMEGKQLPGITSLDDK

SEQ ID NO: 90455 - DNA, 1188 bp, Thermobifida fusca
  CDS (1)..(1188)
atgcggacgatcgaggatctcgacgtcgcgggcaagcgcgtcttcgtccgagccgatctcaacgtgccgctcgacggtgaccgcatcaccgacgacggtcgtatccgggccagcctgcccaccatcactgcactgcgcgagcggaacgcgcgcgtgatcatcggcgcccacttgggccgccccaaaggcaaggtcgaccctgcctactcgctgaagccggtcgccgcccgcctgggtgagctgctgggcaccgaggtgcgcttcgcctccgacaccgcaggcgaatccgcccaggccatcagccgcgagctggccgacggcgaggtcgccctcgtggagaacctgcgttttgagccgggcgagaccagcaaggacgacgccgaacgcggtgagttcgccgatcggctcgccgcactggctgagctgtacgtcggcgacggtttcggcgccgtgcaccgcaagcacgccagcgtctacgacctgccgaagcgtctgccgcacgccgccggcggactggtgctggccgaagtcaacgtgctgcgcaagctgaccgagtccccgcagcgcccctacgtggtcgtactgggcggctccaaggtctccgacaaactcggcgtcatcgacaacctgctcaacaccgccgaccgcatcctcatcggcggcggcatggcctacaccttcctcgccgcgcagggctacgaggtgggcgccagcctgctggagcgggaccagatcgacaccgtcaaggggtacctgcgccgggctgaggagcgcggtgtggaactcgtgctcccggtggacgtggtggccgcagagaagttcgctgcggacgccgcccacgacgtggtcgacgtccgggagatccccgcggaccggatggggctggacatcggaccggcctcggctgagctcttcgcgtcgaaactggcggacgccgcgaccgtgttctggaacggcccgatgggcgtgttcgaaatggagccgtacgcgaagggcacccgctccgtggcgcaggccctagccgactcctcggcgttcaccgtggtcggcgggggcgactcggccgcagccgtccgggcactcggcttcgacgagaaggcgttcagccacatctccaccggtggcggtgccagcctggagtacctcgaaggaaagaccctgcccggcatcgcggcattggaggaatag

SEQ ID NO: 90456 - protein, 395 aa, Thermobifida fusca
MRTIEDLDVAGKRVFVRADLNVPLDGDRITDDGRIRASLPTITALRERNARVIIGAHLGRPKGKVDPAYSLKPVAARLGELLGTEVRFASDTAGESAQAISRELADGEVALVENLRFEPGETSKDDAERGEFADRLAALAELYVGDGFGAVHRKHASVYDLPKRLPHAAGGLVLAEVNVLRKLTESPQRPYVVVLGGSKVSDKLGVIDNLLNTADRILIGGGMAYTFLAAQGYEVGASLLERDQIDTVKGYLRRAEERGVELVLPVDVVAAEKFAADAAHDVVDVREIPADRMGLDIGPASAELFASKLADAATVFWNGPMGVFEMEPYAKGTRSVAQALADSSAFTVVGGGDSAAAVRALGFDEKAFSHISTGGGASLEYLEGKTLPGIAALEE

SEQ ID NO: 90457 - DNA, 1242 bp, Methanosarcina barkeri str. fusaro
  CDS (1)..(1242)
atgtctcagaaaataactggaaaggattatttgacgatgagtgatgtcgtactggacaataaaagagtacttgtaagggtggactttaactcaccaatggatgataatggaaacatcctggacgataagaaaattaagagccatttgcctacgttgcagtccctggagcactcaaaagtggtcctgatgtctcatcagggtcgacctggagatgaagactataccaccctggaagcccatgcaaagctggcaacagagcttttgggtcgagaagtaacctacgaggatgatatattcagctcatgcgcaaggaatgctataaaatcccttgcccagggagagatcctgctccttgagaacacgcgtttcaatgccgaagagatcacgaaccgcccgcctgagaaacaggctaaaagccagatggtcaagaagttgtatccactatttgatctctttataaacgatgctttttcagtttctcacagatctcagtgttctgtggtagggtttacagaagtcttgcctagcgttgctggcatacttatggataaggaaattacaggcttggataaagccttgaaatgtcgtgagcacccagcaatcttcatactgggaggagcgaaagccaacgactccataaaggcgatttctaatattctcaaacgggctggagctgataagatccttaccacaggggtagtagctacaatatttatgatggcaatgggcgtcgatgtaagcgaggtcaacaggaaattcattgaagataagaaatatatggaccagatttcgattgcttccaagctactcaaggattactcaggcaagatcatcgtgcctcaggatgtagcgttaaacagtggtggagaacgtcaagaagtcgaagtggacaagataaaaaaaggaaatcttccaatagctgatattggccgagagaccatcgaaaattattccaaatatcttaaggaagcaaaactatgtgtttttcatggcccaaccggtatttttgaactagataatttcaggcttggtacggatgaacttcttaaggctgcggctcaagcaagctattctgtcgcaggaggagggcataccttagatgccattgatcaactcggtctgggctctaaattttctcatataagcatgggtggaggtgcaagtataacctatatctctggcgagcccttgccaggaatcacagctctgaaaaaaaatgcattcaggtaccatcaaggttaa

SEQ ID NO: 90458 - protein, 413 aa, Methanosarcina barkeri str. fusaro
MSQKITGKDYLTMSDVVLDNKRVLVRVDFNSPMDDNGNILDDKKIKSHLPTLQSLEHSKVVLMSHQGRPGDEDYTTLEAHAKLATELLGREVTYEDDIFSSCARNAIKSLAQGEILLLENTRFNAEEITNRPPEKQAKSQMVKKLYPLFDLFINDAFSVSHRSQCSVVGFTEVLPSVAGILMDKEITGLDKALKCREHPAIFILGGAKANDSIKAISNILKRAGADKILTTGVVATIFMMAMGVDVSEVNRKFIEDKKYMDQISIASKLLKDYSGKIIVPQDVALNSGGERQEVEVDKIKKGNLPIADIGRETIENYSKYLKEAKLCVFHGPTGIFELDNFRLGTDELLKAAAQASYSVAGGGHTLDAIDQLGLGSKFSHISMGGGASITYISGEPLPGITALKKNAFRYHQG

SEQ ID NO: 90459 - DNA, 1239 bp, Methanosarcina barkeri str. fusaro
  CDS (1)..(1239)
atgacttctagagactttcttacaatcgatgattttgacacgcacggaaagacaattcttgtaagggttgacctgaactcccctatggatccacagggtaatattctggatgatatgcggatccgaagccatattgccaccttgaaggatcttgaggacgcaaaagttgttttgcttgcacaccagagcaggcccggaaaaaaagactttactacaatgaagcctcatgccaacctgatgtccaaatacctgggaaagcaggttctttatgtagatgatatttttggaacttatgcaaagaccaggattgcttctatggaaaatggagatgtcatcctgctcgaaaatgtaaggttctattctgaagaaagcctcgaaagaactccagcagaacaggcaaaaacttatccggttaaaaaactggcaccttttgtagatatcttccttaatgatgcctttgccgtatctcacaggtctcaactttccgtagtaggatttacagaggttctccctaccggagccggaagggtcatggaaaaggaactcacgtctttggatcgggggatcaaaggaggggaacggccaacgattttcgttctcggaggggcaaaagtcgatgattcgctccatgtggcggaaaatgtgctttcaaatggaggagctgaccgggtactcctgaccggagtagtagcaaatgtggcacttgcggcatccggtatagatatcggaaaagtaaatctggacttcatcaaatcccagggctacgaagaccagatcgaaaaagcaaaaagtatacttacgaaattcaaagataaagttggtcttccaagggatgtggctttaaacgacaataagaagcgggtcgaattgcctgtttcagaacttaattctaattctcttcctataaacgatattgggcttgaaaccattgtggactttaccagtgaaatcgcaagtgcaaaaactgttatcttaaacggccctgcggggatttccgaagttgctgagtttgcccttggaacgcacgagattataaaagctgctattaaatccgagttttcaatcattggcggtgggcatatttcggcagaagttgagcatctcgggcttgcacaccgtttctctcacatcagtacaggtggcggggcactaattgattatctctcaggagtaaagctgcctggtgtagaggccctgaaatctgcagctaagagatatgaagaagctaagaaaatctaa

SEQ ID NO: 90460 - protein, 412 aa, Methanosarcina barkeri str. fusaro
MTSRDFLTIDDFDTHGKTILVRVDLNSPMDPQGNILDDMRIRSHIATLKDLEDAKVVLLAHQSRPGKKDFTTMKPHANLMSKYLGKQVLYVDDIFGTYAKTRIASMENGDVILLENVRFYSEESLERTPAEQAKTYPVKKLAPFVDIFLNDAFAVSHRSQLSVVGFTEVLPTGAGRVMEKELTSLDRGIKGGERPTIFVLGGAKVDDSLHVAENVLSNGGADRVLLTGVVANVALAASGIDIGKVNLDFIKSQGYEDQIEKAKSILTKFKDKVGLPRDVALNDNKKRVELPVSELNSNSLPINDIGLETIVDFTSEIASAKTVILNGPAGISEVAEFALGTHEIIKAAIKSEFSIIGGGHISAEVEHLGLAHRFSHISTGGGALIDYLSGVKLPGVEALKSAAKRYEEAKKI

SEQ ID NO: 90461 - DNA, 1197 bp, Geobacter metallireducens GS-15
  CDS (1)..(1197)
atggcaatccgctatatcgacgaaatcgaaagtctcaaggggaaaaaggtatttatcagggtcgacttcaacgttcctctggatgaacatcagaatataaccgaagacacccggatccgggccgtccttcccactatcaactttgcccttgatgcgggcgccaaggtaattcttgcatcccacttgggtcgcccaaagggtgagcgaaaaccgaagtattccatggctccggcggccaagcgcctctcgcgcctgctcaacaaggaagtgcaactggctcccgactgcatcggcgatgaagtcaagaagatgatcgacgccatgaaaccgggcgaagtccttctactcgaaaacgtccgtttctacgagggcgaagagaaaaatgacgccgatttcgccaaggccctggccaacgactgtgaaatatacatcaacgacgcctttgccgtctcccacagggcccacgcatccgtcgaagccatcacgaagtttttcccggtcgtcgctgccggtttcctcatgaacaatgagattaattatttcgagaaggcgatgcaaaagcccatcaggcccttggtcgccattctcggcggggccaaggtttccggaaaacttgaggtattggaaagcctggtcaacaaggtagacaagattatcattggcggcggcatggccttcacgttcctcaaagccctcggctataacgtcggcaaatcgctggtggaggaagaactgctggaaatcgccctcactacctacaccaaggcccgtgaaaaaggcgtgaaattctatctaccggtcgactgcgttgcggccgaccgcttcaaccccgaggctgaaaccaaagtgacgaccattcaggaaatccccgaggagtggatggcactcgacatcggaccggcaaccgtgaccctcttcacggaagcgctccagaacgccaaaaccattatctggaatggtcccatgggcgtattcgagatggatgccttctcccgcggaacctttgccatggtttcggccgtggccaactcctatgctctcaccatcgtcggaggaggagacaccgattcagccgtccatcgcgcgggggaatacgcgaagatcagctacatttccacaggcggcggcgcgttcctggaactcctcgaagggaagcatcttcccggcatcaaagtgctggaagaaaacggcaagtag

SEQ ID NO: 90462 - protein, 398 aa, Geobacter metallireducens GS-15
MAIRYIDEIESLKGKKVFIRVDFNVPLDEHQNITEDTRIRAVLPTINFALDAGAKVILASHLGRPKGERKPKYSMAPAAKRLSRLLNKEVQLAPDCIGDEVKKMIDAMKPGEVLLLENVRFYEGEEKNDADFAKALANDCEIYINDAFAVSHRAHASVEAITKFFPVVAAGFLMNNEINYFEKAMQKPIRPLVAILGGAKVSGKLEVLESLVNKVDKIIIGGGMAFTFLKALGYNVGKSLVEEELLEIALTTYTKAREKGVKFYLPVDCVAADRFNPEAETKVTTIQEIPEEWMALDIGPATVTLFTEALQNAKTIIWNGPMGVFEMDAFSRGTFAMVSAVANSYALTIVGGGDTDSAVHRAGEYAKISYISTGGGAFLELLEGKHLPGIKVLEENGK

SEQ ID NO: 90463 - DNA, 1188 bp, Novosphingobium aromaticivorans DSM 12444
  CDS (1)..(1188)
atgagcttcaagacccttgacgacatcggcgacctgaccggcaagaccgtgctggtgcgcgaggacctcaacgtgccgatgcaggacggcgcggtcaccgacgacacgcgtctgcgcgccaccatcgcgacgctgaacgagctgtccgacaagggcgcgaaggtgctcgtgctggcgcactttggccgccccaagggccagccgtcggaagaattttctttgaagaagctcgctgccccgctcgcgcacgtactgggccgtccggtcagctacatcgactgggaaagcgacaaggccgctgtggctgctctgacgcccggtgcgattgccgtgcttgagaacacccgcttcttcgacggcgaggaaaagaacgacccagccgtgatcgagcgtttcgccagcctcggcgacatttacgtcaatgatgccttttccgccgcccaccgcgcccacgcttcgaccgaaggcctggcacacgtgctgccggcctatgcaggccgcgccatggaggccgagctcaaggcattgcagaaggcgttgggggaacccgaacgtccggtggcagccgttgttggcggggccaaggtgtcgaccaagctcgacgtgctcaagcaccttgtcagcaaggtcgatcacctgatcatcggtggtggcatggccaacacgttccttgcggcgcgcggcgtgaacgtgggcaagtcgctgtgcgaacacgaccttaccggcaccgccgaggaaattctcgacaatgccgacaagtcgggctgcaccgttcacctgccgtacgacgtggtcgtttcgaaggagttcaccgcaaacccgccgagcctgcggacctgcaatgttcatgaggtcgctgcagacgagatgatcctcgacgtgggcccggccgcggtcgaggcgcttgctgatgtgctcaagacctgcaagacgctggtgtggaacggtccgatgggggcgttcgagaccgagccgttcgacgccgccaccgtggcgttggcgcgcacggctgcagctctgaccaaggaaggttcactcgtgtcggtggcgggcgggggcgataccgtggctgccctgaaccatgcgggcgtggttggtgatttctcttacatctcgactgcaggcggcgccttccttgagtggatggaaggaaaggaattgcccggcgtcgcggcgctggaaggatag

SEQ ID NO: 90464 - protein, 395 aa, Novosphingobium aromaticivorans DSM 12444
MSFKTLDDIGDLTGKTVLVREDLNVPMQDGAVTDDTRLRATIATLNELSDKGAKVLVLAHFGRPKGQPSEEFSLKKLAAPLAHVLGRPVSYIDWESDKAAVAALTPGAIAVLENTRFFDGEEKNDPAVIERFASLGDIYVNDAFSAAHRAHASTEGLAHVLPAYAGRAMEAELKALQKALGEPERPVAAVVGGAKVSTKLDVLKHLVSKVDHLIIGGGMANTFLAARGVNVGKSLCEHDLTGTAEEILDNADKSGCTVHLPYDVVVSKEFTANPPSLRTCNVHEVAADEMILDVGPAAVEALADVLKTCKTLVWNGPMGAFETEPFDAATVALARTAAALTKEGSLVSVAGGGDTVAALNHAGVVGDFSYISTAGGAFLEWMEGKELPGVAALEG

SEQ ID NO: 90465 - DNA, 1239 bp, Ferroplasma acidarmanus
  CDS (1)..(1239)
atggataggtccccgttttacactatggacgattttgatttcaatggcaagagagtgtatcttagaatagatataaattccccaattaaccctataaccggagaagtagtggatgatacaagattcattcattatttgaggacaattaacgaacttaaaaactcaaaggttgttattattgcccaccagggaaggccgggcgacagtgattttgtaagtttgcggcaacatgcagggcatcttggcaggctgttaggcagagatgttttattcgttgattcattgatagggtctgcagtggaaacagctataaggaacatgaaaaatggagatattatcatgctggagaactccagattctatagcgaagaaatacttataaaagatgatggggctgcccagaaaaacacatttattgtcaggaatttatcaaaattatttgattactttataatcgatgcttttcctgcgatacacagggaccagacaacacttaccggattcaaggatataaaacccaatatagctggcaggcttatggaaactgaaattaatagcatagacaggttcatgaattctaaatcacatccgaaactggctataatgggtggagccaaaataagggatgctataaaggtaacaggcccattcctggagaaagggatagtggacaatataatttttggtggtgtggcagcaaacatattcctgtgggcttccgggatagacatagggaaaaggaacatggaattcatcgaaaaacaggataaaaattataagaaattgctggaggaatgcaaatcgttgttatcccgattctccgatcgcatatacctccctgaagatttcatgcttaatcccttacagacagaaataaaaacaggtgagaaggttccagatgggcagttgctggcggatattggatttgagtccattaaaacttttagcagtattatagaaaaagcaaaaaatatatttctcaatggcccgatgggaatgtatgaaataaatgaatactcacttggaaccagggaaatatttaatgcagtttcccagagccctgcatcaaaaatagtcgggggagggcacacaataaatgcaattaatgaattcgggctttcagattccatgggatatatatcaaccgggggtggcgccctgataaattatttatccggtgagcctatacctgtaatagactcacttgtttataacaggaaaaaatttggaggtaattaa

SEQ ID NO: 90466 - protein, 412 aa, Ferroplasma acidarmanus
MDRSPFYTMDDFDFNGKRVYLRIDINSPINPITGEVVDDTRFIHYLRTINELKNSKVVIIAHQGRPGDSDFVSLRQHAGHLGRLLGRDVLFVDSLIGSAVETAIRNMKNGDIIMLENSRFYSEEILIKDDGAAQKNTFIVRNLSKLFDYFIIDAFPAIHRDQTTLTGFKDIKPNIAGRLMETEINSIDRFMNSKSHPKLAIMGGAKIRDAIKVTGPFLEKGIVDNIIFGGVAANIFLWASGIDIGKRNMEFIEKQDKNYKKLLEECKSLLSRFSDRIYLPEDFMLNPLQTEIKTGEKVPDGQLLADIGFESIKTFSSIIEKAKNIFLNGPMGMYEINEYSLGTREIFNAVSQSPASKIVGGGHTINAINEFGLSDSMGYISTGGGALINYLSGEPIPVIDSLVYNRKKFGGN

SEQ ID NO: 90467 - DNA, 1188 bp, Cytophaga hutchinsonii
  CDS (1)..(1188)
atgaaaacagtagacagttttaacttttcaggtaaaaaagccctgatacgcgttgattttaacgtccctcttaataagagttttgaaattacagatgatacaagattaaaagcagtattacctactgtttcgaaagtattaaaagatggtggttcagcaattttgatgtcacacttaggtagaccaaaaggtggaccggaagaaaaatattctttaaaacacatccttccttatctgaacaaaatgttcggacaggaagtattgtttgcggcggattgtatcggtgaagatgcaaaagcaaaagcagcagcattaaaaccaggtcaggtattattacttgagaacttacgtttctatccggaagaagaaaaaggcgatgttgaattcgcaaaaaaactttctgtattaggtgatgtatgggtgaatgatgcatttggtaccgcacacagagcacatgcttcaacagcggtaatcggacaattcttcaaagataaagtttgcgggtatgtaatgcaggctgaacttgacaatgcaaataaattattaaagcaaggtgaaaaaccaatcacagctgttatgggaggttctaaaatctctgataaaatcatggtgattgaaaacttattagatacggttgacaacctgataatcggtggcggtatgtcttataccttcacaaaagcattaggcggaaagattggcaaatcaatcaacgaaccagataaattagagcttgcgctttcgttaattgaaaaagctaaagcgaaaaatgttaaattatatttaccgttagataacgttgttgcagatgatttcagcaacgatgcaaacaagcagacagtaaaaacgggtgaaattccggatggctgggaagggctggatatcggacctgaaactgttaagttattcagcgaagtagttgcaaactctaaaactgttttatggaacggaccaatgggcgtgtttgaatttgcaaactttgctactggtacgattgctattgctaaagcagttaaagaagcaacacaaaaaggagctttctcattaatcggtggtggcgactcagctgctgcaatcaacaatttaggtttcggtaacgatgtatcttacgtttctacaggcggcggtgcattacttgaatacttcgaaggcaaaacacttccgggtgtggcggcgttggagaaatag

SEQ ID NO: 90468 - protein, 395 aa, Cytophaga hutchinsonii
MKTVDSFNFSGKKALIRVDFNVPLNKSFEITDDTRLKAVLPTVSKVLKDGGSAILMSHLGRPKGGPEEKYSLKHILPYLNKMFGQEVLFAADCIGEDAKAKAAALKPGQVLLLENLRFYPEEEKGDVEFAKKLSVLGDVWVNDAFGTAHRAHASTAVIGQFFKDKVCGYVMQAELDNANKLLKQGEKPITAVMGGSKISDKIMVIENLLDTVDNLIIGGGMSYTFTKALGGKIGKSINEPDKLELALSLIEKAKAKNVKLYLPLDNVVADDFSNDANKQTVKTGEIPDGWEGLDIGPETVKLFSEVVANSKTVLWNGPMGVFEFANFATGTIAIAKAVKEATQKGAFSLIGGGDSAAAINNLGFGNDVSYVSTGGGALLEYFEGKTLPGVAALEK

SEQ ID NO: 90469 - DNA, 1194 bp, Clostridium thermocellum ATCC 27405
  CDS (1)..(1194)
atggcaatgatgaacaagaaaaccattgaggatattgacgtaaaaggtaaaaaggttatagtcagggttgattttaatgtgcctttggacgaaaacagaaagattaccgatgacaagagaatagttggtgcgcttccaaccatcaagtatctggttgaacacggtgcaaaaactatattggtttcacacctgggaagaccaaaagaaggttttgaggaaaagtacagcatggctccgactgccgtaagattgggagaacttcttggaaaagaagtaataatggcgaaagatgttattggtcctgatgcaaaggcaaaagcagcggcattaaaagaaggagaagttttaatgctcgaaaatgtcagattccacaaggaagagactaaaaacgatcctgcttttgcaaaagaattggcaagcatggctgaaatttatgtaaatgatgcgttcggaactgcccacagagcccacgcttcaacggcaggtcttgccgactatctgccggcggtatgcggatacctcatccaaaaggaaattgaggttatgggcaaggctctgtcaaatcctgaaagaccgtttgtggcaatattgggcggtgccaaggtttcagacaaaataggcgttattgagaaccttattgacaaagttgacactcttataatcggcggaggtatggcatataccttctttaaagcaaagggatacagcataggaacatccctgtgtgaagatgataaagttgagcttgcaaagagccttatggataaagcagagaaaaagggagtaaaactcttgcttcctgtggacaatgttgtaggcaaagagttcagcaatgatacagaacgcaagactgttccgtctgaccagattccggacggatggatgggtatggacatcggtgaggaaacaatcaagttgtattctgaggcaatcaagaatgccaaaaccgtggtatggaacggtcctatgggcgtatttgagttctccaactttgccaacggtacaagggaagttgcaagagcggttgccgagtccggagcaatttcaataatcggaggcggagattctgccgcagctatagaacagcttggttttgccgataagattacccacatttcaaccggaggcggcgcgtctttggagtttcttgaaggaaaagtattgccgggaattgatgtattaatggataaataa

SEQ ID NO: 90470 - protein, 397 aa, Clostridium thermocellum ATCC 27405
MAMMNKKTIEDIDVKGKKVIVRVDFNVPLDENRKITDDKRIVGALPTIKYLVEHGAKTILVSHLGRPKEGFEEKYSMAPTAVRLGELLGKEVIMAKDVIGPDAKAKAAALKEGEVLMLENVRFHKEETKNDPAFAKELASMAEIYVNDAFGTAHRAHASTAGLADYLPAVCGYLIQKEIEVMGKALSNPERPFVAILGGAKVSDKIGVIENLIDKVDTLIIGGGMAYTFFKAKGYSIGTSLCEDDKVELAKSLMDKAEKKGVKLLLPVDNVVGKEFSNDTERKTVPSDQIPDGWMGMDIGEETIKLYSEAIKNAKTVVWNGPMGVFEFSNFANGTREVARAVAESGAISIIGGGDSAAAIEQLGFADKITHISTGGGASLEFLEGKVLPGIDVLMDK

SEQ ID NO: 90471 - DNA, 1197 bp, Microbulbifer degradans 2-40
  CDS (1)..(1197)
atgactcaagaggaaatatccatggctgttattcagatgaaggacctcgatcttaaaggcaaacgcgttcttattcgccaagatctaaacgtacccctacaggatggtgaaatcacctccgatgtacgtatccaagcatcattgcctaccatcaaagccgcagtagacgcgggtgctaaagtgatgttgatgtctcacttgggccgccctaccgaaggcgaatacgctgacgaattttctttaaagcctgttgctgcacgcttaaccaaattgttgggcaaagaagtgggcttggtaaaaaactggcaagaaggcgttgctgttgctgaaggcgaagttgtattgctagaaaacgtgcgctttaacgtgggcgagaaaaaagacgacgaaacattagctaaagcgtacgcagcattgtgcgacgtatttgtgatggatgcattcggtaccgcgcaccgcgcgcaagcatctacccacggcgtcgcgaaatttgcaccggttgcctgcgcaggcccgctattgtctggcgagttgagtgcattagaaaaagccctagccaaccctgcgcgcccaatggttgcggtggtaggtggctctaaagtttctacaaaattaaccgtattagatgcgctttctaaaattgttgatgtaatggttgtgggtggcggtatctccaacactttcgttgctgctgccggtaacgaagtaggcaactctttatacgaaaaagatttaattccagaagcgcaacgcttgtgtgcagaaactgaagttatttacgcgcacgatgtgcgagtaactaaagagggcttcagcgattggaatcacaactctgtaactgaagttaaagtacctgcagatattcaagccgacgaagaaattattgactacggcccagaaactgcgcaaaaagttgccgctattttgaaagatgctaaaaccattatttggaacggcccgtgtggcgttttcgagtttgatgcgtttgctaaaggtaccgaagtggttgcgcgcgcaattgcagaaagcgaaggcttctctattgccggcggcggtgacaccttagcggcaattgataaattcggtttggccgacggcgtttcttacatttctaccggtgggggtgctttcttggaatacgtagaagggaagccgttacccgctgtagtgatgttagaagagagagctaagggttaa

SEQ ID NO: 90472 - protein, 398 aa, Microbulbifer degradans 2-40
MTQEEISMAVIQMKDLDLKGKRVLIRQDLNVPLQDGEITSDVRIQASLPTIKAAVDAGAKVMLMSHLGRPTEGEYADEFSLKPVAARLTKLLGKEVGLVKNWQEGVAVAEGEVVLLENVRFNVGEKKDDETLAKAYAALCDVFVMDAFGTAHRAQASTHGVAKFAPVACAGPLLSGELSALEKALANPARPMVAVVGGSKVSTKLTVLDALSKIVDVMVVGGGISNTFVAAAGNEVGNSLYEKDLIPEAQRLCAETEVIYAHDVRVTKEGFSDWNHNSVTEVKVPADIQADEEIIDYGPETAQKVAAILKDAKTIIWNGPCGVFEFDAFAKGTEVVARAIAESEGFSIAGGGDTLAAIDKFGLADGVSYISTGGGAFLEYVEGKPLPAVVMLEERAKG

SEQ ID NO: 90473 - DNA, 1215 bp, Oenococcus oeni PSU-1
  CDS (1)..(1215)
atgacaaaattaactgtaaaagaccttgacttaaaaggcaaaaaagttttgatgcgggttgatttcaacgtaccgattaaggatggcgttattggcaatgacaaccgtgttgttgctgctttgccaacgattaaatatgttcttgaacagggtggaaaggctattctttttagccatctcggtcgtattaagaaggctgaggacaagccaggcttgagtttggccccggtggccaagcatctgagcgatttgcttaatcaagaagttgttttccctggaaaaaccgaggggaaagagctcgaagatgctatcgacaaattaaaagacggccaggtattaatggttgaaaatacacgctatgaggacgtcgacgccaatggcgagtacgttaaacgcgaatccggcaacgaccctgaattaggtaaatattgggctgatttgggggatgatttgtttgtcaacgatgcttttggaacagcacatcgttcccatgcgtcgaatgttggcattgcctcgaatgtttcgaaaactgctgctggatttctaatggaaaaagaaatcaagtatttggatgaggctgttaataatccaaagcgtccattcgtggctgtcttaggaggcgccaaagtttctgataaaatcgaagttatcaaaaatttgttgtcaaaagccgacaaagttattgttggtggtgggatgagttacactttttccaacgccaagggcgtgaagattggtaattctttgtttgaagccgataaagtctctttggccaaagaaattatgaaagaagcaggtgacaagctcgttttgcctgaggattcggttgcagctgaaagctttgcaaacgatgttccaacaaaggtttttgaaaacggtattcctgatggttggatgggtcttgatattggaccaaaaacgatcgagaaattcaaaaataccctaaaaggggccaagacagttgtttggaacggtccgatgggtgtctttgaaatgagtaatttcgctaacggaactttggaattaggaaagtttattggatccctaacttctgaaggagcggcaacaattgttggtggtggtgattcaactgccgcagtttctcaacttggaattgctgatcaatttactcacatttctacaggtggtggagctagtcttgaatatctggaaggtaaaactcttcctggcattgctgctatttctgataagtga

SEQ ID NO: 90474 - protein, 404 aa, Oenococcus oeni PSU-1
MTKLTVKDLDLKGKKVLMRVDFNVPIKDGVIGNDNRVVAALPTIKYVLEQGGKAILFSHLGRIKKAEDKPGLSLAPVAKHLSDLLNQEVVFPGKTEGKELEDAIDKLKDGQVLMVENTRYEDVDANGEYVKRESGNDPELGKYWADLGDDLFVNDAFGTAHRSHASNVGIASNVSKTAAGFLMEKEIKYLDEAVNNPKRPFVAVLGGAKVSDKIEVIKNLLSKADKVIVGGGMSYTFSNAKGVKIGNSLFEADKVSLAKEIMKEAGDKLVLPEDSVAAESFANDVPTKVFENGIPDGWMGLDIGPKTIEKFKNTLKGAKTVVWNGPMGVFEMSNFANGTLELGKFIGSLTSEGAATIVGGGDSTAAVSQLGIADQFTHISTGGGASLEYLEGKTLPGIAAISDK

SEQ ID NO: 90475 - DNA, 1203 bp, Pediococcus pentosaceus ATCC 25745
  CDS (1)..(1203)
ttggctaaattaactgtttcagatttagatgttaagaacaagaaagttttgatgcgcgttgactttaacgtgccagttaaaaatggtgtgattggtgatgacaaccgtgtcgttgctgctcttccaacaattaaatacattatcgaaaacggtggaaaggcaattcttttctctcacttaggtcgtatcaagactgaagaagacaaaaaagaattgactcttcgtccagttgctcaacgcctttcagatcttcttggcaaaccagttacatttgttcctgtaacacgcggtgcacaacttgaagatgctgttaatggcatgaacgacggcgatgtattattgttcgaaaacacacgttttgaagacttagatggcaagaaggaaagtaaaaacgatcctgaacttggcaaatactgggcatcacttggcgacatgttcgtaaacgatgctttcggtacagctcaccgtgcccacgcttcaaacgttggtgttgctgaagcaatgaaggctgacggcaagcaagttgctgctggtttccttatggaaaaagaaatcaagttcttgggtgaagctgttgacgaacctaagcatccatttgttgctattttaggtggcgcaaaggtttctgacaagattggtgtaattgatcacttacttaataaagctgacaaagttattattggtggtggtatgacatacacattctacgctgctaaaggcatgagcattggtaactcacttgttgaagctgacaagattgatgttgctaaagaaatccttgctaagggtggcgacaagattgttcttccttcagacagtatcgttgctgaaaaatttgataacgatgttcctaacaaagttgtcgaaggcgatattcctgatggttacatggctcttgatattggacctaagtcagttgcagaatttaaggatgtccttaaagatgctaagactgttgtatggaacggaccaatgggtgtattcgaaatgagcaactatgctaacggtacacttgaagttggtaagttcttaggtacattatcagacgctacaacaattgttggtggtggtgactcaactgctgctgttaagcaattaggcgttggcgaccaattgacacatatctcaactggtggtggagcttcacttgaataccttgaaggtaaagaacttcctggtatcgctgctatttcaaacaaataa

SEQ ID NO: 90476 - protein, 400 aa, Pediococcus pentosaceus ATCC 25745
MAKLTVSDLDVKNKKVLMRVDFNVPVKNGVIGDDNRVVAALPTIKYIIENGGKAILFSHLGRIKTEEDKKELTLRPVAQRLSDLLGKPVTFVPVTRGAQLEDAVNGMNDGDVLLFENTRFEDLDGKKESKNDPELGKYWASLGDMFVNDAFGTAHRAHASNVGVAEAMKADGKQVAAGFLMEKEIKFLGEAVDEPKHPFVAILGGAKVSDKIGVIDHLLNKADKVIIGGGMTYTFYAAKGMSIGNSLVEADKIDVAKEILAKGGDKIVLPSDSIVAEKFDNDVPNKVVEGDIPDGYMALDIGPKSVAEFKDVLKDAKTVVWNGPMGVFEMSNYANGTLEVGKFLGTLSDATTIVGGGDSTAAVKQLGVGDQLTHISTGGGASLEYLEGKELPGIAAISNK

SEQ ID NO: 90477 - DNA, 1197 bp, Trichodesmium erythraeum IMS101
  CDS (1)..(1197)
atgacaaaaaaaactgtagcaagtttatcaaaatctgacttatctggcaaaaaggtacttatgcgggctgattttaatgtacctgttgataatggtagtattacagacgatactagaattcgggcagctcttcccacaattcaagatttaactgagaaaggtgcaaaagttatcttgactagtcattttggacggccaaagggaaaggttaatgaaaagatgcgtctgactcttgtgggggagagactctctgaagtattgggtaaagaagttaaaaagtgtgacgactgcattggtgatgaagtaacttctactgtggcggaaatgaaagatggtgatgtagttttgctagaaaatgttcgcttctactctggagaggaggggaatgatccagagtttgccaaacaacttgcttctgtggcagatttatatgtgaatgatgcttttggaactgctcatcgtgctcatgcttcgactgagggcgtgactaaatatttgagtccttctgttgctggttatttaattgaacaggaactaaaattcctccaaggtgcaattgatagtcctcaaaaacctttagctgcaattattggtggttctaaggtttctagtaaaattggtgtaatagaagctttgttggataagtgtgataagttgctcttgggtggtggtatgattttcactttctacaaagctcgtggtttaagtgtgggtaagtctctggttgaggaagataagatagaattggcaaagtctttggaagctaaggcaaaagagaaaggtgtaacaatgttgttacctactgatgtggttgtagctgataagtttgacccagaggcgaatactcaaactgttagtattgaagctattccggatggttggatgggtttggatatcggacctgagtctgcaaaggtttttcaagatgctttagcagactgtaaaactgtaatttggaatggtccgatgggggtatttgagatggagaaatttgctaaaggtactgaagcgatcgctcagactcttgctgataagcaggatgctattactattattggtggtggtgactctgttgctgcggtggagcagttaggtttgggtgaaaaaatgagtcacatttctactggtggtggtgctagtttggaattgttggaaggtaagaagttacctggtattgttgctttagatgatcaataa

SEQ ID NO: 90478 - protein, 398 aa, Trichodesmium erythraeum IMS101
MTKKTVASLSKSDLSGKKVLMRADFNVPVDNGSITDDTRIRAALPTIQDLTEKGAKVILTSHFGRPKGKVNEKMRLTLVGERLSEVLGKEVKKCDDCIGDEVTSTVAEMKDGDVVLLENVRFYSGEEGNDPEFAKQLASVADLYVNDAFGTAHRAHASTEGVTKYLSPSVAGYLIEQELKFLQGAIDSPQKPLAAIIGGSKVSSKIGVIEALLDKCDKLLLGGGMIFTFYKARGLSVGKSLVEEDKIELAKSLEAKAKEKGVTMLLPTDVVVADKFDPEANTQTVSIEAIPDGWMGLDIGPESAKVFQDALADCKTVIWNGPMGVFEMEKFAKGTEAIAQTLADKQDAITIIGGGDSVAAVEQLGLGEKMSHISTGGGASLELLEGKKLPGIVALDDQ

SEQ ID NO: 90479 - DNA, 1182 bp, Moorella thermoacetica ATCC 39073
  CDS (1)..(1182)
atggccaagttaaccctcaaagatctggagcttaacaataaacgggtcctggtgcgggtcgatttcaacgtccccctggaggcaggccgggtgactgacaatacccgtatccgggcggccctgcctaccattgaatacctgctggaccacggcgcccgggtgattcttatgtcccacctgggccggcccaagggtaaggtcaaggaagagctgcgcctggacccggtggccagggaactggaaagcctcctgggccggcaggtacataaggtcaacgactgcgtcggtcccgaagttgaggccgcagccgccgccctcaagcccggcgaggttctcctcctggaaaacctgcgcttccatcccgaagaagaaaagaacgaccccggtttcgcccggcagctggccagcctggccgatgtctatgtgaacgacgcctttggcgccgcccatcgcgcccatgcttccaccgagggcgtagcccactacctgccggcggcggccggtttcctgctccaaaaggagatcgagaccctgggcaaggccctggctgatcccgagcggccctttgtggccattattggcggggccaaggtatccgacaagatcagcgttatccgtaacctccttaccaaagtagacaccctgattatcggcggtggcatggccaacaccttcctgaaggcccagggctatgccatgggtaaatccctggtcgaagaagatcaggtacccctggcccaggagttgatccagcttgccgcccagaagggggtaaaaatgctcctgccccgggacctggtagtggcccaggagtttaaggccgatgccccccaccaggtagttgctgtaaatgccgtgcctgacggctggatggccctggatatcggcccggaaacggcccgggcctacgccggcgccctggagggagcccgtaccgtcgtctggaacggccccatgggcgtctttgagatggaggcctttgcccacggcaccgaggctgtagcccgggcagtggccgccgtcgacggcatgaccatcgttggtggcggcgattccgtcgctgccgtggaaaagatgggcgtggccggaaagatcgggcatatctccaccggtggcggcgcctccctggagttcctggaaggcaaagcccttcccggcgttgtcgccctgacggaaaagtaa

SEQ ID NO: 90480 - protein, 393 aa, Moorella thermoacetica ATCC 39073
MAKLTLKDLELNNKRVLVRVDFNVPLEAGRVTDNTRIRAALPTIEYLLDHGARVILMSHLGRPKGKVKEELRLDPVARELESLLGRQVHKVNDCVGPEVEAAAAALKPGEVLLLENLRFHPEEEKNDPGFARQLASLADVYVNDAFGAAHRAHASTEGVAHYLPAAAGFLLQKEIETLGKALADPERPFVAIIGGAKVSDKISVIRNLLTKVDTLIIGGGMANTFLKAQGYAMGKSLVEEDQVPLAQELIQLAAQKGVKMLLPRDLVVAQEFKADAPHQVVAVNAVPDGWMALDIGPETARAYAGALEGARTVVWNGPMGVFEMEAFAHGTEAVARAVAAVDGMTIVGGGDSVAAVEKMGVAGKIGHISTGGGASLEFLEGKALPGVVALTEK

SEQ ID NO: 90481 - DNA, 1182 bp, Thiobacillus denitrificans ATCC 25259
  CDS (1)..(1182)
atggcattcatccgcgtcaccgatctcgatctggcgggcaagcgcgtcttcatccgcgccgacatgaacgtgcccgtcaaggacggcaaggtcacgtccgacgcgcgcatcaccgcctcgatgcgcaccatcgagcactgcatgagggccggcgccaaggtcatggtgacctcgcacctcggccgcccgaccgaaggcgagttcaaggaagaggattcgctgaagcccgtcgtcgacgtgatcgcgcagaagctcggcaaaaacgtgcgcctgatccgtgaatggaccgagggcggtttcgacgtcgcgaacggcgaactcgtcgtgctcgagaactgccgcgtcaacaagggcgagaagaagaacgtcgacgagaccgcgaagaaatacgccgcgctgtgcgacgtcttcgtgatggacgccttcggcaccgcgcaccgcgccgaagcctcgacccacggcatcgccaaattcgcgccgaccgctgccgccggcattctgctcaccgaagagctcgacgcgctggccaaggcgctcgccaacccggcgcggccgatggtcgcgatcgtcggcggctccaaggtctcgaccaagctgaccgtgctcgaggcgctgtccgagaaggtcgaccagttggtcgtcggcggcggcatcgccaacaccttcctcgccgcgatgggcaagaacgtcggcaagtcgctgtgtgaacacgacctgatcccgactgccaagacgctgatcgagaagatggccgcgcgcggcgcctcgatcccgatcgccgtcgacgtggtgtgcggcaagaagttcgacgccaacgagcccgccgtgctgaagagcgccgacgaggtggccgacgacgacatgatcttcgacatcggcccgaagagcgcgcaggagcttgccgacatcatcgccaaggccggcacgattgtgtggaacggcccggtcggcgtgttcgagttcgaccagttcggcgaaggcaccaagaccgtctcgatggcgatcgccaacgccccgggcttcagcctggccggcggcggcgacaccatcgccgcgatccagaaatacgacatctacgacaaagtgagctatatctcgaccgccggcggcgccttcctcgaatacctggaaggcaaggtgttgccggccgtggcgattctggaggaacgcgcgcaaggctaa

SEQ ID NO: 90482 - protein, 393 aa, Thiobacillus denitrificans ATCC 25259
MAFIRVTDLDLAGKRVFIRADMNVPVKDGKVTSDARITASMRTIEHCMRAGAKVMVTSHLGRPTEGEFKEEDSLKPVVDVIAQKLGKNVRLIREWTEGGFDVANGELVVLENCRVNKGEKKNVDETAKKYAALCDVFVMDAFGTAHRAEASTHGIAKFAPTAAAGILLTEELDALAKALANPARPMVAIVGGSKVSTKLTVLEALSEKVDQLVVGGGIANTFLAAMGKNVGKSLCEHDLIPTAKTLIEKMAARGASIPIAVDVVCGKKFDANEPAVLKSADEVADDDMIFDIGPKSAQELADIIAKAGTIVWNGPVGVFEFDQFGEGTKTVSMAIANAPGFSLAGGGDTIAAIQKYDIYDKVSYISTAGGAFLEYLEGKVLPAVAILEERAQG

SEQ ID NO: 90483 - DNA, 1191 bp, Silicibacter sp. TM1040
  CDS (1)..(1191)
atgggctggaagacactcgacgacatggatctgcaaggcaaaagcgttttgacccgcgtggatatcaacgtcccgatggaagacggcaaagtcaccgatgacacccgcatccgccgcctcgtgccgacgatttccgacctgctctccaagggtgcaaaacctgtgctgctggcgcattttggccgcccgaagggcaaggtggtgcccgagatgtcgttgcagccgctggtccccgcgctggaggccgcctttggcgcgccggtgatgtttgtggccgattgccgaggccccgctgcaaaaggcgccgttgacgcgctcgcgcccgggcagatcctgctccttgagaacacgcgcttttatcccggcgaagaacaaaacgatgccgatctcgccaaagagatggccgcgcttggtgatatctactgcaatgatgccttctctgccgcccaccgcgcccatgcctccaccgaggcgctggcgcgcctgctgcctgcctgcgcgggccgcctgatggaggcagaactgaaagcgctcgaaggctctctggccacgcctgaacgccccgtcactgcggttgtgggcggcgccaaagtttcgaccaaactggaccttctgggcaatctggtggccaaggtagacacgcttgtgatcggcggcggcatggccaatacctttcttgcggcccaaggcatcgacgtgggcaaatcgctttgcgaacatgacatgacaggcaccgccaaggacatcatggcccgcgccgaggcggcaggctgcaccatcctgctgccgtcggacgtggtggtcgcgcgcgaattcaaggccggcgccgacaatgaaaccgtacccgcggacgcctgccctgcggatgcgatgatcctggatgctggccccgcctcggttgcggccatttccacagtctttgccgagagcaagaccctgatctggaacggcccgcttggtgcctttgaaatcgcgccctttgatattgcgaccaatacagcggcgcaaaaggcggcagaactcaccaaggccggccagctgatttccgttgcgggcggaggcgacaccgtcgctgcgctcaatcaggccggagcggcagaggcctttagctacatctccaccgccgggggcgccttccttgagtggatggagggcaaggtcctgcccggcgtcgctgccctgcagacctga

SEQ ID NO: 90484 - protein, 396 aa, Silicibacter sp. TM1040
MGWKTLDDMDLQGKSVLTRVDINVPMEDGKVTDDTRIRRLVPTISDLLSKGAKPVLLAHFGRPKGKVVPEMSLQPLVPALEAAFGAPVMFVADCRGPAAKGAVDALAPGQILLLENTRFYPGEEQNDADLAKEMAALGDIYCNDAFSAAHRAHASTEALARLLPACAGRLMEAELKALEGSLATPERPVTAVVGGAKVSTKLDLLGNLVAKVDTLVIGGGMANTFLAAQGIDVGKSLCEHDMTGTAKDIMARAEAAGCTILLPSDVVVAREFKAGADNETVPADACPADAMILDAGPASVAAISTVFAESKTLIWNGPLGAFEIAPFDIATNTAAQKAAELTKAGQLISVAGGGDTVAALNQAGAAEAFSYISTAGGAFLEWMEGKVLPGVAALQT

SEQ ID NO: 90485 - DNA, 1242 bp, Methanococcoides burtonii DSM 6242
  CDS (1)..(1242)
atgaataccttgactgctaaagattttctcacgatagacgattttgatataggggatagaacaattcttgtgagggtggacctgaactctccaatgagtcctggcggtggcatacttgatgatatgaggatcaaaagccatataccgacccttatggacctggaggatgcgaaggtagtgctgttagctcaccagagccgaccaggaaagaacgatttcactactatgcaactacatgctgatgtgatgtccagttcactgggtcggaaagttacctatatcgatgatatttttggtacccatgcaagagatagcatcgcttcaatggaaaagggggatgttatccttctggagaatgtgcgtttctattctgaagaaagcttgagaagacctgttgatgaacatcaggggactcatatggtgcgaaaacttgctccgcttttcgatattttcctgaacgatgcatttgcggtgtcccatcgttcccatctttcgatcacagggttttctggagttcttccgtctggagcaggtcgtcttatggagagggaaataacttctcttgatgtgagccttaaaggatctgaatctccatgcatatttgttcttggcggtgcgaaggtcgatgattctctcaaggtggctgagcatgtcctttcaagtggcggtgctgacagggttctggttacaggagtggtcgcaaatgtcgtgcttgctgcatcaggtgttgatattggtggacctaatatgaagttcatcgaatcccagggatatcttgaccagatagataaggcgaaaaatatcctggagagattcgatggtaagctcggttttccaagggatgttgctcttaatgataatggagaacgtatcgaggcaaacatcgatgatgtggcttcgtcaaatcttccaattaatgatatcggtcttgagaccattgtagcgtattcaagcgagattgaaaatgcgaagacggttgttttaaatggtcctgcgggcgtttctgagatagagggctttgagataggcacctctgagatcatcaaggcagcaacaaatgccggttattcaattgctggcggtggccacattactgctgaagtgcgtaatatgggttatgagaagatgttctcacacataagcacaggtggcggggcatgtattgattatcttgccggggacctcttgcctggcattgaagctttaaaggttgctgcaaaaagatatagggaatttgaatga

SEQ ID NO: 90486 - protein, 413 aa, Methanococcoides burtonii DSM 6242
MNTLTAKDFLTIDDFDIGDRTILVRVDLNSPMSPGGGILDDMRIKSHIPTLMDLEDAKVVLLAHQSRPGKNDFTTMQLHADVMSSSLGRKVTYIDDIFGTHARDSIASMEKGDVILLENVRFYSEESLRRPVDEHQGTHMVRKLAPLFDIFLNDAFAVSHRSHLSITGFSGVLPSGAGRLMEREITSLDVSLKGSESPCIFVLGGAKVDDSLKVAEHVLSSGGADRVLVTGVVANVVLAASGVDIGGPNMKFIESQGYLDQIDKAKNILERFDGKLGFPRDVALNDNGERIEANIDDVASSNLPINDIGLETIVAYSSEIENAKTVVLNGPAGVSEIEGFEIGTSEIIKAATNAGYSIAGGGHITAEVRNMGYEKMFSHISTGGGACIDYLAGDLLPGIEALKVAAKRYREFE

SEQ ID NO: 90487 - DNA, 1203 bp, Chloroflexus aurantiacus
  CDS (1)..(1203)
atgaacaagaagaccatccgtgatgtggattgggccggaaaacgtgcgctggtacgagttgatttcaacgtgccactcgatgatcagggtcagattaccgatgatacccggattcgggcggcattaccgaccattcgctatctgctggaacacggtgccagtgtggtcttgatgtcgcacctggggcgtccgaagggtaaacccaatccgaagtacagtttacgtccggttgttgagcgtttgtttgaattgctgcccgaagcgaaagaggtcaagaagaccgaggcgatcaccgggccggcggctgaagcggctgtggcgatgctgaaaccagggcaggtcctggtactcgaaaacacccgcttcgatccccgtgaagagccaaacgatccagcgatggccgctgaactggcgaaattgggtgatgttttcgttaacgatgccttcggcaccgctcaccgggccaatgccagcactgagggtgtagcgcactacctgccggcagttgccggttttcttatggaaaaggaactgacgtacatcggtggcgccctgaataatccgcagcgtccattcgtaaccgtcatcggtggtgcgaaaatcagtgacaagatcggcgtgatcgaaaatctgctgggtaaggtcgatgcactgctcattggtggtggtatggccaacacctttctgcttgccaaagggctgaatgttggtgattcgctggtcgaaccggacagtgtaccggtggcccagcagttgatggcccgtgctgaagagcggggtgcccggctgcttttgccggttgacgtggtgattgccgatgcgtttagtgccgatgcccagcgccaggttgttgatgtaagtgacattcctgccggctggcgtgtgctcgatattggccccaagaccatcgaacgatacagtgccgagattcgggctgcccgcacggttatctggaatgggccaatgggtgtctttgaactagagccgtttgccgtcggtacacgcgctatcgcccaggcaatggccgaagcggctgccaatggcgcaatcacaattgttggtggtggcgatagtgtggccgcagtggaacaggccggcctggccgataagatgtcgcatgtgagtaccggcggtggtgcctcacttgagttacttgagggacgagtcttacccggtgtggctgcgttgcaagatgcagagtag

SEQ ID NO: 90488 - protein, 400 aa, Chloroflexus aurantiacus
MNKKTIRDVDWAGKRALVRVDFNVPLDDQGQITDDTRIRAALPTIRYLLEHGASVVLMSHLGRPKGKPNPKYSLRPVVERLFELLPEAKEVKKTEAITGPAAEAAVAMLKPGQVLVLENTRFDPREEPNDPAMAAELAKLGDVFVNDAFGTAHRANASTEGVAHYLPAVAGFLMEKELTYIGGALNNPQRPFVTVIGGAKISDKIGVIENLLGKVDALLIGGGMANTFLLAKGLNVGDSLVEPDSVPVAQQLMARAEERGARLLLPVDVVIADAFSADAQRQVVDVSDIPAGWRVLDIGPKTIERYSAEIRAARTVIWNGPMGVFELEPFAVGTRAIAQAMAEAAANGAITIVGGGDSVAAVEQAGLADKMSHVSTGGGASLELLEGRVLPGVAALQDAE

SEQ ID NO: 90489 - DNA, 1194 bp, Polaromonas sp. JS666
  CDS (1)..(1194)
atgaatttcatccgtttttccgacctgtgtgccagcggcaaggccgccggccagcgcgttttcatccgtgccgacctgaacgtgccgcaggatgacagcggcgccatcaccgaagacacgcgcatacgtgcctccattccctgcctgcaaatggcgctggacgcgggtgcggccgtgatggtgacctcccacctcgggcgtccggtggagggcgaattcaagccggccgactcgctggccccggtggccaaacgcctgggcgagctgatgaagcgcgagattccgctggtcacccagtgggtggacggcgtggacgtccagcccgggcagctggtgttgctggagaactgccgcctcaaccccggcgagaagaaaaacagcgaagcgctggcccgcaagatggccgccctgtgcgacatctttgtgcacgacgcgtttggcaccgcccaccgcgccgaggcctcgacctatggcattgcgcaatacgccaaggtagcgagcgccgggccgctgctggccgccgagatggacgcgatttcgacggcgctgtccaacccgcgcaggccgctggtcgcgatcgtcgcgggcagcaaggtctcgaccaagctgaccatcctcaagtccctggccagcaatgtggaccagctgatcgtgggcggcggcatcgccaacaccttcatgctggcggccggcctgaagattggcaaaagcctggcggaggccgacctgctgcccgaggcccgtgccgtgatcgaggccatgaaggcacgcggcgctgcggtgcccatccccaccgacgtggtcacggccaagaccttcgcggccgatgccacggccaccgtcaaggccgccaccgacgtggaagacgacgacctgatcctggacatcggccccgagaccacggcccggttggcggcgcagctcaaggcggctggcaccattgtctggaatggcccggtgggcgtgttcgagtttgatgctttttcgcgcggtaccgaaggcattgcccgggcgatcgccgacagcagcgccttttcgattgccggtggtggcgacacgctggctgccatcgccaaatacggcatcgagaaacaggtgggctacatctccacggggggcggcgcattcctggaggtgctggaaggcaagacgctgccagccttcgaaatcctgcagaagcgggccgccggctag

SEQ ID NO: 90490 - protein, 397 aa, Polaromonas sp. JS666
MNFIRFSDLCASGKAAGQRVFIRADLNVPQDDSGAITEDTRIRASIPCLQMALDAGAAVMVTSHLGRPVEGEFKPADSLAPVAKRLGELMKREIPLVTQWVDGVDVQPGQLVLLENCRLNPGEKKNSEALARKMAALCDIFVHDAFGTAHRAEASTYGIAQYAKVASAGPLLAAEMDAISTALSNPRRPLVAIVAGSKVSTKLTILKSLASNVDQLIVGGGIANTFMLAAGLKIGKSLAEADLLPEARAVIEAMKARGAAVPIPTDVVTAKTFAADATATVKAATDVEDDDLILDIGPETTARLAAQLKAAGTIVWNGPVGVFEFDAFSRGTEGIARAIADSSAFSIAGGGDTLAAIAKYGIEKQVGYISTGGGAFLEVLEGKTLPAFEILQKRAAG

SEQ ID NO: 90491 - DNA, 1530 bp, Trypanosoma brucei
  CDS (1)..(1530): transl_table=4
atgtccactgcaccgaatgcgaagaacaacataagcctgaagaagtctgtgggcgatgtttggccgttaaccggaaaacgagtgcttatgcgtgtcgatttcaacgttcctatgcaaaatggccatattactaacgattatcgaatccgtgcggcgattccaacgatacgacgggttattgatcagggtggtatttgtattctcctgagccatcttggacggcccagaggcgtttcaatggttgcgggtgtgcgagatataagacggcgatatcacgaggctcagtttcacgacaacaaaggtaaaacagcgttttttagtgttctaccgggagaggagaaagttaaaatattagcgaaatccagtgcacgggaagaggcaacgcacatatcacctgaggtgaaatctggaaaaacaatgctgtttgcgcgccttcctgaggacgagaagaaatctttgctcatgcagtacttaaacgaaaacaaagacagtgcgttaccgcagatgagtgttagtgcaggctacgaagagcaatacagatctcgtccagttgctgtaaggcttgccgaattactcggccaacatgtatattttgctcacgactgcttggatgccagagtagaggtttcgcggttaaagcgtggaaatgttatgttacttgaaaatgtacggttctacagcgaagaaaacggtgaaaatgctgaggaacgtgaagccatggccaagatccttgcgtcatatggtgatgtttacatcagtgatgcttttggtgcagctcaccgtgacagtgctaccatgaccggaattccaaagattttgggtcacggtgctgccggttatttgatggagaaggagatttcatacttcgctaaggtacttggtaacccgccgcgtccgctggttgctatcgttggtggagcgaaagtgagcgaaaagatccaacttctggataacatgttgcagcgcatcgattatctcttaattggtggtgcaatggcatacacatttctgaaggctcagggttacagcattggaatatcgaagtgcgaggaaagtaaacttgaatttgctcgatccctgctgaagaaggcggaggaccgcaaggtgcaggttattcttccaattgatcatgtttgccacacggaattcaaagctgtggattctccattgataactgaggatcaaaacatccctgaagggcatatggctctggatattggtcccaagactattgaaaaatatgttcagacgattgggaagtgtaagagcgccatttggaacggtcccatgggtgtatttgaaatggttccttattccaaaggtacatttgcaattgcgaaagccatgggtcgaggaactcagaaacgtggactcatgagtatcatcggtggtggcgagagtgcgggtgcggctgaactctgtggtgaagctgcacgtatttctcatgtttcaactggtggtggtgcgtctttggaactcctcgagggcaaaacgcttcccggtgttgcagtattggatgataaggagtaa

SEQ ID NO: 90492 - protein, 509 aa, Trypanosoma brucei
MSTAPNAKNNISLKKSVGDVWPLTGKRVLMRVDFNVPMQNGHITNDYRIRAAIPTIRRVIDQGGICILLSHLGRPRGVSMVAGVRDIRRRYHEAQFHDNKGKTAFFSVLPGEEKVKILAKSSAREEATHISPEVKSGKTMLFARLPEDEKKSLLMQYLNENKDSALPQMSVSAGYEEQYRSRPVAVRLAELLGQHVYFAHDCLDARVEVSRLKRGNVMLLENVRFYSEENGENAEEREAMAKILASYGDVYISDAFGAAHRDSATMTGIPKILGHGAAGYLMEKEISYFAKVLGNPPRPLVAIVGGAKVSEKIQLLDNMLQRIDYLLIGGAMAYTFLKAQGYSIGISKCEESKLEFARSLLKKAEDRKVQVILPIDHVCHTEFKAVDSPLITEDQNIPEGHMALDIGPKTIEKYVQTIGKCKSAIWNGPMGVFEMVPYSKGTFAIAKAMGRGTQKRGLMSIIGGGESAGAAELCGEAARISHVSTGGGASLELLEGKTLPGVAVLDDKE

SEQ ID NO: 90493 - DNA, 1263 bp, Trypanosoma brucei
  CDS (1)..(1263): transl_table=4
atgtcactaaaagagaggaagagcattaacgaatgcgatcttaagggaaagaaggttcttatccgtgttgactttaatgttcctctggatgatggtaatattaccaacgactaccgaatccgatcagctctgccagccgtccaaaaagttctcacagaaggcggcagctgtgttctcatgagccacctcgggaggccgaaaggcgtttctatggctgaaggcaaagaactgcggagcgctggcggtattcccgggttcgagcagaaggcaacactcaaaccggtagccaagcgcctcagcgaattgttatcgagacccgtcacattcgcacctgactgtctgaacgctgcagatgtcgtctctaagatgtctccgggcgatgttgttctgcttgaaaatgtacggttctacaaagaagagggcagcaagagcactgaggaacgtgaagccatggccaagatccttgcgtcatatggtgatgtttacatcagtgatgcttttggtacagctcaccgtgacagtgctaccatgaccggaattccaaagattttgggtcacggtgctgccggttatttgatggagaaggagatttcatacttcgctaaggtgcttggtaacccgccgcgtccgctggttgctatcgttggtggagcgaaagtgagcgaaaagatccaacttctggataacatgttgcagcgcatcgattatctcttaattggtggtgcaatggcatacacatttctgaaggctcagggttacagcattggaaaatcgaagtgcgaggaaagtaaacttgaatttgctcgatccctgctgaagaaggcggaggaccgcaaggtgcaggttattcttccaattgatcatgtttgccacacggaattcaaagctgtggattctccattgataactgaggatcaaaacatccctgaagggcatatggctctggatattggtcccaagactattgaaaaatatgttcagacgattgggaagtgtaagagcgccatttggaacggtcccatgggtgtatttgaaatggttccttattccaaaggtacatttgcaattgcgaaagccatgggtcgaggaactcacgagcatggactcatgagtatcatcggtggtggtgacagcgcaagtgcagctgagttgagcggtgaggcgaagcgcatgtctcatgtttcaacgggtggtggtgcgtctttggaactcctcgagggcaaaacgcttcccggtgttacagtattggacgaaaaggagtaa

SEQ ID NO: 90494 - protein, 420 aa, Trypanosoma brucei
MSLKERKSINECDLKGKKVLIRVDFNVPLDDGNITNDYRIRSALPAVQKVLTEGGSCVLMSHLGRPKGVSMAEGKELRSAGGIPGFEQKATLKPVAKRLSELLSRPVTFAPDCLNAADVVSKMSPGDVVLLENVRFYKEEGSKSTEEREAMAKILASYGDVYISDAFGTAHRDSATMTGIPKILGHGAAGYLMEKEISYFAKVLGNPPRPLVAIVGGAKVSEKIQLLDNMLQRIDYLLIGGAMAYTFLKAQGYSIGKSKCEESKLEFARSLLKKAEDRKVQVILPIDHVCHTEFKAVDSPLITEDQNIPEGHMALDIGPKTIEKYVQTIGKCKSAIWNGPMGVFEMVPYSKGTFAIAKAMGRGTHEHGLMSIIGGGDSASAAELSGEAKRMSHVSTGGGASLELLEGKTLPGVTVLDEKE

SEQ ID NO: 90495 - DNA, 1254 bp, Pongo pygmaeus
  CDS (1)..(1254)
atgtcgctttctaacaagctgacgctggacaagctggacgttaaagggaagcgggtcgttatgagagtcgacttcaatgttcctatgaagaacaaccagataacaaacaaccagaggattaaggctgctgtcccaagcatcaaattctgcttggacaatggagccaagtcagtagtccttatgagccacctaggccggcctgatggtgtccctatgcctgacaagtactccttagagccagttgctgtagaactcaaatctctgctgggcaaggatgttctgttcttgaaggactgtgtaggcccagaagtggagaaagcctgtgccaacccagctgctgggtctgtcatcctgctggagaacctccgctttcatgtggaggaagaagggaagggaaaagatgtttctgggaacaaggttaaagccgagccagccaaaatagaagctttccgagcttcactttccaagctaggggatgtctacgtcaatgatgcttttggcactgctcacagagcccacagctccatggtaggagtcaatctgccacagaaggctggtgggtttttgatgaagaaggagctgaactactttgcaaaggccttggagagcccagagcgacccttcctggccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccagggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctggaaggtaaagtccttcctggggtggatgctctcagcaatatttag

SEQ ID NO: 90496 - protein, 417 aa, Pongo pygmaeus
MSLSNKLTLDKLDVKGKRVVMRVDFNVPMKNNQITNNQRIKAAVPSIKFCLDNGAKSVVLMSHLGRPDGVPMPDKYSLEPVAVELKSLLGKDVLFLKDCVGPEVEKACANPAAGSVILLENLRFHVEEEGKGKDVSGNKVKAEPAKIEAFRASLSKLGDVYVNDAFGTAHRAHSSMVGVNLPQKAGGFLMKKELNYFAKALESPERPFLAILGGAKVADKIQLINNMLDKVNEMIIGGGMAFTFLKVLNNMEIGTSLFDEEGAKIVKDLMSKAEKNGVKITLPVDFVTADKFDENAKTGQATVASGIPAGWMGLDCGPESSKKYAEAVTRAKQIVWNGPVGVFEWEAFAQGTKALMDEVVKATSRGCITIIGGGDTATCCAKWNTEDKVSHVSTGGGASLELLEGKVLPGVDALSNI

SEQ ID NO: 90497 - DNA, 1173 bp, Thermus thermophilus HB8
  CDS (1)..(1173): transl_table=11
atgcggacccttttggacctggaccccaagggcaagcgggtcctggtgcgggtggactacaacgtccccgtccaagacgggaaggtccaggacgagacccggatcctggaaagcctccccaccctccgccacctcctcgccgggggggcttccctcgtcctcctctcccacctgggccgccccaagggcccggaccccaagtactccctggccccggtgggggaggccttgagggcccacctcccagaggcccgcttcgcccccttccctccgggctcggaggaggcgaggcgggaggcggaggccctgaggcccggggaggtcctcctcctggagaacgtccgctttgagccgggagaggagaagaacgaccccgagctttccgcccgctacgccaggctcggggaggccttcgtcctggacgccttcgggagcgcccaccgggcccacgccagcgtggtgggggtggcgaggctcctccccgcctacgccggcttcctcatggagaaggaggtgagggccctttcccgcctcctcaaggacccggaaaggccctacgccgtggtgctgggcggggccaaggtctcggacaagatcggggtcattgagagcctccttccccgcatagaccgcctcctcattggcggggccatggccttcaccttcctcaaggccctagggggagaggtggggaggagcctggtggaggaggaccggctggacctggccaaggacctcttggggcgggccgaggccttgggggtcagggtctacctccccgaagacgtggtggcggcggagcgcatagaggcgggggtggagacccgggtcttcccggcccgggccatccccgtcccctacatgggcctggacatcggccccaagacccgggaggccttcgcccgggccctggaaggggcgaggacggtcttctggaacgggcccatgggggtctttgaggtgcctccctttgacgaggggaccttggccgtggggcaggccatcgccgccctcgagggcgccttcaccgtggtgggcgggggcgactcggtggcggcggtgaaccgcctgggccttaaagagcgcttcggccacgtctccaccgggggcggggcgagcctggagttcctggaaaagggcaccctgcccggcctcgaggtcctggaaggctaa

SEQ ID NO: 90498 - protein, 390 aa, Thermus thermophilus HB8
MRTLLDLDPKGKRVLVRVDYNVPVQDGKVQDETRILESLPTLRHLLAGGASLVLLSHLGRPKGPDPKYSLAPVGEALRAHLPEARFAPFPPGSEEARREAEALRPGEVLLLENVRFEPGEEKNDPELSARYARLGEAFVLDAFGSAHRAHASVVGVARLLPAYAGFLMEKEVRALSRLLKDPERPYAVVLGGAKVSDKIGVIESLLPRIDRLLIGGAMAFTFLKALGGEVGRSLVEEDRLDLAKDLLGRAEALGVRVYLPEDVVAAERIEAGVETRVFPARAIPVPYMGLDIGPKTREAFARALEGARTVFWNGPMGVFEVPPFDEGTLAVGQAIAALEGAFTVVGGGDSVAAVNRLGLKERFGHVSTGGGASLEFLEKGTLPGLEVLEG

SEQ ID NO: 90499 - DNA, 1203 bp, Haloarcula marismortui ATCC 43049
  CDS (1)..(1203): transl_table=11
atgactttccagacgctcgatgacctcgacgacggacagcgcgttctcgtccgactcgacctcaactcaccggtggaggacggcacggtacaggacaatcgacggttcgaccgccacgcggagacggtcagcgaactcgtcgaccgtgggttcgaggtcgcggtgctggcccatcagggccgcccgggccgcgacgacttcgtctcgcttgcgcaacacgccgagatcctcgccgaccatatcgaccacgacgtggacttcgtcgacgagacctacgggccacaggcgattcacgacatcgctgacctcgacggcggcgacgtactcgtgcttgagaacacgcggatgtgcgacgatgaactgcccgaggaagaccccgaagtcaaatcacagacagagttcgtccagacgttgaaagacgagttcgacgcatacatcaacgacgcctactctgcggcccaccgctcacacgcctcactcgtcggcttcccgctggtgatggacgcctacgctggccgcgtgatggaaaccgagtacgaggccaacaccgccatcgccgagaaggagttcgacgggcaggtgacgatggtcgtcggcggaacgaaggcaacggacgttatcgacgtgatgacccacctcgatgagaaggtcgacgacttcctgcttggcggtatcgccggggagctgttcctgcgggccgctggctacccggtcggctacgacatcgacgacgcgaacctctacgacgagcagtgggaggaaaacagcgagaaaatcgagtccatgctcgaagaccaccgcgaccagatcacgctcgcggtcgatctggcctacgaagacgacggtgaccgcgccgagcaggccgtcgacgacatcgaggaaaaaagcgtctcctacctcgacgttgggagcgagaccgtcatggagtattcgccggtcatccgcgactccgaggccgtcttcgtgaagggcgcgctggggatgttcgaagacgagcggttctcggtcggcactgccggcgtcctcgaagccattgccgacaccgactgcttctccgtcgtgggcggcggcgacacttcgcgagctatcgagatgtacgggatggaagaagacgagttcggccacgtctctatcgcgggcggggcctacatccgggcactgaccggcgcggaactggtcggcgtcgaagtgctgcagcgttaa

SEQ ID NO: 90500 - protein, 400 aa, Haloarcula marismortui ATCC 43049
MTFQTLDDLDDGQRVLVRLDLNSPVEDGTVQDNRRFDRHAETVSELVDRGFEVAVLAHQGRPGRDDFVSLAQHAEILADHIDHDVDFVDETYGPQAIHDIADLDGGDVLVLENTRMCDDELPEEDPEVKSQTEFVQTLKDEFDAYINDAYSAAHRSHASLVGFPLVMDAYAGRVMETEYEANTAIAEKEFDGQVTMVVGGTKATDVIDVMTHLDEKVDDFLLGGIAGELFLRAAGYPVGYDIDDANLYDEQWEENSEKIESMLEDHRDQITLAVDLAYEDDGDRAEQAVDDIEEKSVSYLDVGSETVMEYSPVIRDSEAVFVKGALGMFEDERFSVGTAGVLEAIADTDCFSVVGGGDTSRAIEMYGMEEDEFGHVSIAGGAYIRALTGAELVGVEVLQR

SEQ ID NO: 90501 - DNA, 1185 bp, Bacillus clausii
  CDS (1)..(1185)
atgaacaaaaaaacgctttatgactacgattttgcaggcaaaacggtattttgccgagtcgatttcaatgttccgatgaaagatggaaagattactgatgaaacgcggattcaagcagctttgcctacgattaaatacttaagtgaacaaggggcgcgcgttttgctagcaagccatcttggccgcccgaaaggcgaagtggtagaaagcttgcgcttggcgcctgtcgcgacacgccttagcgagctgttaggaaaagaagtacaagccgtccaggaagcgcacggtccagtagcaaaacaagcagtggaaggtcttgaagacggtggcgtgttgctgcttgaaaatgtccgcttttacccaggggaagaaaagaacgatcctgaattagcgaaagcgtttgctagcctagccgacatttttgtcaatgatgcatttggggcggcacaccgtgcccacgcttcaacggaaggcattgcccactatttgccgtcagcagctggttttctaatggaaaaagaactggatgtactcggcaaagcgttaagcaaccctgaacgtccgtttacagcagtcattggtggcgcaaaagtaaaagacaagattggcgttattgacaacttgctagataaagtcgacaatttaattattggcggcggtctcgcatacacgtttgtcaaagcgcaaggctatgaagttggcaaatcgttgcttgaagaagataagctcgatttagccaagcagtttatggaaaaggctgaacaaaaaggcgttaagttttatatgcctgaagatgtcattgttgccgatgatttttctgacgacgccaacaaaaaagaagtggccattagcggcattccagctgattgggaagcgcttgacattgggccaaaaacacgaaaaacctatgaagctgtattaaaagcttcaaaattagtgatttggaacgggccaatgggtgtgtttgagctcgaatcgtttgcaggtggcacaaaagcagttgcaaatgcgttggcagaggcgtcagatacgtattcagtcattggtggcggcgattcagcggcagccgttgaacaatttggccttgccgacaaaatgagccatatttcaacaggcggaggcgccagccttgaatttatggaaggcaaggaacttccaggcgttgtcgcactatcagaaaaataa

SEQ ID NO: 90502 - protein, 394 aa, Bacillus clausii
MNKKTLYDYDFAGKTVFCRVDFNVPMKDGKITDETRIQAALPTIKYLSEQGARVLLASHLGRPKGEVVESLRLAPVATRLSELLGKEVQAVQEAHGPVAKQAVEGLEDGGVLLLENVRFYPGEEKNDPELAKAFASLADIFVNDAFGAAHRAHASTEGIAHYLPSAAGFLMEKELDVLGKALSNPERPFTAVIGGAKVKDKIGVIDNLLDKVDNLIIGGGLAYTFVKAQGYEVGKSLLEEDKLDLAKQFMEKAEQKGVKFYMPEDVIVADDFSDDANKKEVAISGIPADWEALDIGPKTRKTYEAVLKASKLVIWNGPMGVFELESFAGGTKAVANALAEASDTYSVIGGGDSAAAVEQFGLADKMSHISTGGGASLEFMEGKELPGVVALSEK

SEQ ID NO: 90503 - DNA, 1248 bp, Toxoptera citricida
  CDS (1)..(1248)
atggcactaaacaaactaagcatcaagagtttagaagtggcaaacaaacgagttttgatcagagttgattttaatgttccattaaaagatggaaaaataaccaataaccaacgtattgttgctgcattagatagcatcaattatgtccttgaaaatggtgccaaatctttagttctcatgtcccatcttggacgtccagatggattaccaaattcaaagtactctatgaaaccagttgcagaggaactccaaaaactccttaataagaatgttacatttttgtctgactgtgttggcccagaagtagaaaatgcttgtgcagatcctgctcctggttcaatatttcttctggagaatcttcgattccatattgaagaagaaggaaaaggtgtaaatgctgctggggaaaaagctaaggctgacaaagaagatgtgaaaaaattcagagagtcattacaaaaattgggagatgtgtatgttaacgatgcttttggtactgcacacagagcccacagttctatgatgggtgaagggtttgaaaagcgtgctgccggcattttgttgaacaaagagctcacttattttgctaaagctttggataatcctgaaaggcctttcttagctatcttaggaggagctaaagttgctgataagattcaacttattgaaaatcttttagataaagttgatgaaatgattattggaggaggtatggcttacactttcttgaaagagtcaaaggggatgaaaattggcgattccttatatgatgaagctggagccaaaattgttggcaaattattagataaagctaatgctcgcaatgttaaaattcatttgccagttgattttgtcactgctgataaatttgatgaaaatgctaataccagttctgcaactgttgaagaaggtattcctgagggttggatgggtttggattgcggaccagaatctaggaaattgttttctgaacctattgctcgtgctaaggtcattgtatggaatgggcctgctggagtttttgagtttgataaatttgcttttggaactaaagcattaatggatgatgttgtacaggccactaaaaatggaactgtcactataattggaggtggtgatactgcaacttgtgctgctaaatgggggactgaaagtcaaataagccatgtgagcactggaggtggtgcaagtcttgaactacttgaaggaaaagtcttaccaggagttgcagctttgactgatgcataa

SEQ ID NO: 90504 - protein, 415 aa, Toxoptera citricida
MALNKLSIKSLEVANKRVLIRVDFNVPLKDGKITNNQRIVAALDSINYVLENGAKSLVLMSHLGRPDGLPNSKYSMKPVAEELQKLLNKNVTFLSDCVGPEVENACADPAPGSIFLLENLRFHIEEEGKGVNAAGEKAKADKEDVKKFRESLQKLGDVYVNDAFGTAHRAHSSMMGEGFEKRAAGILLNKELTYFAKALDNPERPFLAILGGAKVADKIQLIENLLDKVDEMIIGGGMAYTFLKESKGMKIGDSLYDEAGAKIVGKLLDKANARNVKIHLPVDFVTADKFDENANTSSATVEEGIPEGWMGLDCGPESRKLFSEPIARAKVIVWNGPAGVFEFDKFAFGTKALMDDVVQATKNGTVTIIGGGDTATCAAKWGTESQISHVSTGGGASLELLEGKVLPGVAALTDA

SEQ ID NO: 90505 - DNA, 1215 bp, uncultured archaeon GZfos1D1
  CDS (1)..(1215)
atgaacgataaattaaaggagttcttgacgatagatgattttgatctatacggaaaaacagtgctcttccgggcggacataaactcggtgattatagacgggcaagtgcagatgaaggagcggatagtggagaatgcgaagacgatacagaagcttttggataaaaaagcaaaggtggttatcctcgcgcatcaaggtcgtgcagggcaagcggattttctacatctggagcagcatgcgcaattgctcaggaatttcatggatttgaaatacattgacgatataatgggcccgagtgcgagggcggcgataaagggtcttgatcatggagaagttttgttgctcgataacgtgcggatgctagcagaggagacacttaacaaaacaccggaggagcattcgcactccttttttgtgaagagtcttgcacctcttgccgatatctacataaatgatgccttctccgtggctcaccgatcgcacgcatcagtgcttggcttcccggcggttctggatgcgggaatagggcgattgatggagcgggagttgaaaactctggaaagagcggtatataaaataaaaagtccgtgtgtttatatccttggtggtgtaaaacccgaggaagtgtttgatataatagatgtcacattgaaacgtaaaagagtagatactatactcacaacaggagctcttggcactcttttcctatatgctcgaggtataattgagccaggggaagaacaaaaagtggatacgcattttatgtggaatgtggagcaagccaaaagattcctggagatgggtaaggacataataaagtatcccgaagatgttgccgtggcggtagatggcgagagaagagaaatacccgtggcacagttgaagcctaaccaaccagcatatgatataggagagaagacgagtgaggaatattcagaacaaataaaaaatgcgagaacggtgataatgaaagggccggcagggttatatgaaaataaggcatttgcaaagggcacgcgcgatatttttgaagcgatttcgcattccaaagcatattctcttctcggtggtggccatacatcagcagcaataagtgaagtgggaatagataggaagactatgtctaatgcccacgtcagccttgcgggtggtgcattcctgcgatattttgtcgataagcatctacccgggatagaagtgttaaagaaacattaa

SEQ ID NO: 90506 - protein, 404 aa, uncultured archaeon GZfos1D1
MNDKLKEFLTIDDFDLYGKTVLFRADINSVIIDGQVQMKERIVENAKTIQKLLDKKAKVVILAHQGRAGQADFLHLEQHAQLLRNFMDLKYIDDIMGPSARAAIKGLDHGEVLLLDNVRMLAEETLNKTPEEHSHSFFVKSLAPLADIYINDAFSVAHRSHASVLGFPAVLDAGIGRLMERELKTLERAVYKIKSPCVYILGGVKPEEVFDIIDVTLKRKRVDTILTTGALGTLFLYARGIIEPGEEQKVDTHFMWNVEQAKRFLEMGKDIIKYPEDVAVAVDGERREIPVAQLKPNQPAYDIGEKTSEEYSEQIKNARTVIMKGPAGLYENKAFAKGTRDIFEAISHSKAYSLLGGGHTSAAISEVGIDRKTMSNAHVSLAGGAFLRYFVDKHLPGIEVLKKH

SEQ ID NO: 90507 - DNA, 1245 bp, Euglena gracilis
  CDS (1)..(1245)
atgcctggaagcgctttgggcccaaagttgagcattgatgatttggacatcaaggataaaaatgtcctcgttcgagtggatttcaacgtcccaatgaaagatggcaaaatcttggacgatttccgtatgaggtcggctttgccgaccttggagaaggttatcaattccggtgggaaacttatcattatgagccacatgggtcgcccagcggagaccggctatgaagccaagtattccttgaagccaatcgcagatcatctgggcacccttttgggcaaacctgtgaccttcgctgctgattgcatggatgccgctgcagaggttgccaagttgacacctggcgacgtccttgttttggagaacttgcgtttctaccctcatgagggaagcaaggacaaggaccaacgccttgaaatggcgaaaaagttggcatcctatgctgatttgtacgtcagtgacgcatttggcactgcacatcgggatgctgcatccatgactggtgttcctgaggtgatgggacagggtgcctctggctatttgatgaagaaggagattgactacttttcaaaggctctgaaggagcctgaaaagccagttgttgctatcgttggtggtgcaaaggtgtctgacaagattcaacttctggagaacatgctgaagactgtcaatcaaatggtcattggtggcgccatggcatacacctttttgaaggctcaaggcaagagcactgggaaatccaagtgtgagacagaagcggagacgaagaaagggaagattgatattgtggagttggcagggaagcttctttcaaaggcaaaggagcagggggttgagatctaccttcctgtggaccaccgctgctctgctgaattcaaggatgttgagcctgtcatcacgtccgatgagaacattcctgatgatttgatggcacttgatattgggccaaagactgaagaactgtactgcagcgttgactttgccaaggcaaagacggccatctggaatgggccgatgggagtgtttgagcttgagcatttcaagccaggaacttgggcggtcgcaagaccactggcggaccactctgactcatgctgctccatcgtgggcggaggggactccgagcgccgcgagaagtcgggatatgcccccaagctgtcccacatctccactggtggcggggcctccctggagctcctggagggcaaggtgctgcctgggctggccatcttgaccgacaagccttga

SEQ ID NO: 90508 - protein, 414 aa, Euglena gracilis
MPGSALGPKLSIDDLDIKDKNVLVRVDFNVPMKDGKILDDFRMRSALPTLEKVINSGGKLIIMSHMGRPAETGYEAKYSLKPIADHLGTLLGKPVTFAADCMDAAAEVAKLTPGDVLVLENLRFYPHEGSKDKDQRLEMAKKLASYADLYVSDAFGTAHRDAASMTGVPEVMGQGASGYLMKKEIDYFSKALKEPEKPVVAIVGGAKVSDKIQLLENMLKTVNQMVIGGAMAYTFLKAQGKSTGKSKCETEAETKKGKIDIVELAGKLLSKAKEQGVEIYLPVDHRCSAEFKDVEPVITSDENIPDDLMALDIGPKTEELYCSVDFAKAKTAIWNGPMGVFELEHFKPGTWAVARPLADHSDSCCSIVGGGDSERREKSGYAPKLSHISTGGGASLELLEGKVLPGLAILTDKP

SEQ ID NO: 90509 - DNA, 1254 bp, Xenopus laevis
  CDS (1)..(1254)
atgtctctgtccaacaagctgaccctggataaggtggatgtgaaagggaagcgggtagtcatgagggttgacttcaatgtcccaatgaaaaataataagattacaaacaaccaaaggattaaggctgctgttcccagcatccagcactgcttggacaatggtgctaaatctgtggttcttatgagccacttgggcagaccagatggtgtccctatgcctgacaagtactctctggcaccagctgctgaggaactcaaagctctgatgaagagagagattgtcttcctgaaggactgtgtgggcccagaggtggaagctgcatgtgctgacccagcccctggaacagtgttgcttctggagaaccttcgcttccatgtggaggaagaagggaagggtaaagacgcttctgggaacaagatcaaagcagatgctgccaaagtagatacatttagagcatctctttctaaacttggcgatgtttacatcaatgatgcatttggaactgcacacagagctcacagctccatggttggcgtaaagctgccccagagggctgctggctttttaatgaagaaggagcttgattactttgctaaggctttggagaaccccgagagacctttccttgctatccttggaggtgctaaagtaaaagacaaaatccagctaatctctaacatgctggataaagtgaatgagatgattattggtggagggatggcctttacattcctaaaggttctcaacaatatgtccattggaacctctctatatgatgaagagggagcaaccattgttaaggacttgatggccaaggctgagaagaatggagtgaaaattacacttcctgtagactttaccaccgctgagaagtttgatgaaaatgccagtacaggacaagccagtgtctctgctggaattcctgatggatggatgggacttgactgtggcccagagagtgtgaagctatttgtggaagctgtgggcagagccaagcagattgtgtggaacggtcccgttggggtgtttgagtgggacaattttgccaaaggaaccaaagctgttatggataaagtggtagaggtcactggcaaaggctgcattacaatcattggtggaggagacactgctacctgctgtgcaaagtgggatacggaggacaaagttagtcacgtcagtacaggaggaggagccagtctagagctgttagaaggaaaggtcctacctggagttgatgctttgagcaatgtgtaa

SEQ ID NO: 90510 - protein, 417 aa, Xenopus laevis
MSLSNKLTLDKVDVKGKRVVMRVDFNVPMKNNKITNNQRIKAAVPSIQHCLDNGAKSVVLMSHLGRPDGVPMPDKYSLAPAAEELKALMKREIVFLKDCVGPEVEAACADPAPGTVLLLENLRFHVEEEGKGKDASGNKIKADAAKVDTFRASLSKLGDVYINDAFGTAHRAHSSMVGVKLPQRAAGFLMKKELDYFAKALENPERPFLAILGGAKVKDKIQLISNMLDKVNEMIIGGGMAFTFLKVLNNMSIGTSLYDEEGATIVKDLMAKAEKNGVKITLPVDFTTAEKFDENASTGQASVSAGIPDGWMGLDCGPESVKLFVEAVGRAKQIVWNGPVGVFEWDNFAKGTKAVMDKVVEVTGKGCITIIGGGDTATCCAKWDTEDKVSHVSTGGGASLELLEGKVLPGVDALSNV

SEQ ID NO: 90511 - DNA, 1254 bp, Brachydanio rerio
  CDS (1)..(1254)
atgtctctttcgaacaaacttcatttggacaaggtggacgtgaaaggaaagcgggtgatcatgagggtggacttcaatgtccctatgaagaacaatgtgatcacaaataaccagagaatcaaggctgcagtaccatctatccagcactgtttagataattgtgccaaagctgtggtcctgatgagccacttgggccggcctgatggagtccctatgccagacaaatactctctggagcctgtggctgcagaactcaagaacctgctgggaaaagacgttcagttcctgaaagactgtgtgggtccagatgtggagaaagcctgtgcagaccctcctgcaggatctgtcattctgctggagaatctgcgctttcatgtggctgaggagggcaagggcaaagatgcatcgggtaacaagaccaaagcaagtcaggcagagatcgatgctttccgagcctccctgtccaaactgggtgacgtatacgtcaacgatgctttcggaactgcacatagagctcacagctctatggttggagtgaatctccctcagaaggctgctggttttctgatgaagaaagagctagactactttgccatggcccttgagaaaccacagaggcctttcttggccatcctcggaggggccaaggtcaaagataagattcagctgatcaacaacatgttggacaaggtgaatgagatgatcattggtggaggaatggcctttaccttcctcaaggttctcaagaacatggagatcggcacttccctgtttgatgaagagggttccacaattgtgaaagatctcatggccaaagcagaaaagaatggtgtaaagatcacacttccagtcgactttatcactgcagacaaattcgatgagaaggcgacaacagggaccgcaacggtagcagaaggtattcctgctggctggatgggtctagactgtggtcctgagagctcaaagctctatgcagaggctgtggccagagccaagcagattgtgtggaacggacccgttggcgtgttcgagtgggacaactttgctcatggaaccaagaacatgatggacaaagttgtagaagcgaccaaaaatggctgcatcaccattatcggtgggggagacacagctacctgctgtgccaagtgggacactgaggacaaggtcagccatgtgagcacagggggcggagccagtctggagctgctggagggtaaagtgctgcccggtgtcgatgccctcagtaacgtataa

SEQ ID NO: 90512 - protein, 417 aa, Brachydanio rerio
MSLSNKLHLDKVDVKGKRVIMRVDFNVPMKNNVITNNQRIKAAVPSIQHCLDNCAKAVVLMSHLGRPDGVPMPDKYSLEPVAAELKNLLGKDVQFLKDCVGPDVEKACADPPAGSVILLENLRFHVAEEGKGKDASGNKTKASQAEIDAFRASLSKLGDVYVNDAFGTAHRAHSSMVGVNLPQKAAGFLMKKELDYFAMALEKPQRPFLAILGGAKVKDKIQLINNMLDKVNEMIIGGGMAFTFLKVLKNMEIGTSLFDEEGSTIVKDLMAKAEKNGVKITLPVDFITADKFDEKATTGTATVAEGIPAGWMGLDCGPESSKLYAEAVARAKQIVWNGPVGVFEWDNFAHGTKNMMDKVVEATKNGCITIIGGGDTATCCAKWDTEDKVSHVSTGGGASLELLEGKVLPGVDALSNV

SEQ ID NO: 90513 - DNA, 1254 bp, Sus scrofa
  CDS (1)..(1254)
atgtctctttctaagaagttaactttggacaaactggacgtgaaagggaaacgagtcatcatgagagtagacttcaatgttcccatgaagaggaaccaagttacaaacaaccaaagaatcaaggcttccctcccaagcatcagatactgcctagataacggagccaggtcagtagttctcatgagtcatttaggtagacctgatggtgttgcgatgcctgataaatactccttagagccggtggctgctgaactcaaatccttgctggggaaagacgttctgttcctaaaagactgtgtgggctcagaagcagagcaagcttgtgccaacccacctgcgggttcagtcatcctactggagaaccttcgctttcatgtggaagaggaagggaagggccaagatccttctgggaataagctgaaagctgagccagataaagtagaagccttccgcgcatcgctctccaagctgggggatgtgtatgtcaatgatgcttttggcacggctcaccgggctcacagttccatggtgggagtgaatctgccgcagaaggcatctggattcctgatgaaaaaggagctggattactttgccaaagccttggaaaacccagagagaccctttctggctatccttggtggagctaaagtggcagacaagatccaactcatcaaaaatatgctggacaaagtcaatgagatgattattggtggcggaatggcctttaccttccttaaggtactcaacaacatggagattggtgcctccctgttcgacaaagagggagccacgattgtcaaagagatcatggccaaagctgaaaagaatagggtgaacattacctttcctgttgactttgtcattgctgacaagtttgaggaaaatgctaaggttggccaggccacggtagcgtcaggtatacctgccggctgggtggctttggactgtggtcctgagaccaacaagaagaatgcacaagttgtggcccgagccaagctaattgtgtggaatggacctttaggggtctttgaatgggatgcctttgctaatggaacgaaagccctcatggatgaaattgtgaaagccacctccaagggctgtatcactattataggaggtggagacacggccacttgctgtgccaaatggaacactgaagataaagtcagtcatgtgagcactggaggaggtgccagtctagagcttctggaaggtaaagtccttcctggagtggaggctctcagcaatctgtag

SEQ ID NO: 90514 - protein, 417 aa, Sus scrofa
MSLSKKLTLDKLDVKGKRVIMRVDFNVPMKRNQVTNNQRIKASLPSIRYCLDNGARSVVLMSHLGRPDGVAMPDKYSLEPVAAELKSLLGKDVLFLKDCVGSEAEQACANPPAGSVILLENLRFHVEEEGKGQDPSGNKLKAEPDKVEAFRASLSKLGDVYVNDAFGTAHRAHSSMVGVNLPQKASGFLMKKELDYFAKALENPERPFLAILGGAKVADKIQLIKNMLDKVNEMIIGGGMAFTFLKVLNNMEIGASLFDKEGATIVKEIMAKAEKNRVNITFPVDFVIADKFEENAKVGQATVASGIPAGWVALDCGPETNKKNAQVVARAKLIVWNGPLGVFEWDAFANGTKALMDEIVKATSKGCITIIGGGDTATCCAKWNTEDKVSHVSTGGGASLELLEGKVLPGVEALSNL

SEQ ID NO: 90515 - DNA, 1221 bp, uncultured bacterium 106
  CDS (1)..(1221): transl_table=11
atggataaaatgggtatgaccgaaaaaaattttattgaagatttaaatcttaatggattgcgtgtcttgacacgtgttgattttaatgtacccctcaacaaagatttgcaaattactgacaatgggagaattgaggccgctttgacgaccattcggtacatcgttgaacaaagaggaaaagcgatcttgatgtcgcacttgggccgtccgggtggagagcgggtcgagagcctgagcctaaaaccggccgcggaagagttgtcactgttgctcgggcagcctgtaacctttgctaaagattgtattggtgaagaggttgaggctctgattgaagggatgcaaaacggagaagtacttttgctggaaaatttgcgttttcataaagcagaaacgaaaaatgagcctgagttttgcggagcattgggcaaactgggagatgtttatgttaatgatgcttttggaacggcacatcgggcccatgcttctactgccggagttacaggatttattccggaatccgccgtcggatatttgattcgtaaagaactgcagtttcttggtggagcagttatgaatcctgcaagaccttttactgcaattttaggaggcgctaaagtatccgataaaattaaagttatcgacaaattgttaaacaaagttcaaactttaataatcggaggaggaatgtcatgcacttttttgaaagctcaaggttacaaaattggcgcttccctgttggaagaagactccttggatttcgcaaaagaactgatacagaaggcacaggagaaaggtgttgaactcctgttgcccgtggatgcggtaattgcagacagttttgacaaaagtgcttcaacccgaagcgtttctgtagaagagggtgcttcggatggttggcttattttggacattggtccaaaaagtgctgaaatattttgcgactccgtacgtaaatcaggaactgttctttggaatggccctatgggggtttttgagatggaaccctttgctctgggaacattcgcaattgcacaatgtcttgcggaagtgactgacaaaggtgttgtgacaattattggaggcggagattccgcggcagcgatacaacaatttggactcagtgaacggatcactcatgtctcaaccggaggtggtgcgtcacttgaatttttggaaggcaaagaacttccgggagtgaccgcaattcagcaatctaaataa

SEQ ID NO: 90516 - protein, 406 aa, uncultured bacterium 106
MDKMGMTEKNFIEDLNLNGLRVLTRVDFNVPLNKDLQITDNGRIEAALTTIRYIVEQRGKAILMSHLGRPGGERVESLSLKPAAEELSLLLGQPVTFAKDCIGEEVEALIEGMQNGEVLLLENLRFHKAETKNEPEFCGALGKLGDVYVNDAFGTAHRAHASTAGVTGFIPESAVGYLIRKELQFLGGAVMNPARPFTAILGGAKVSDKIKVIDKLLNKVQTLIIGGGMSCTFLKAQGYKIGASLLEEDSLDFAKELIQKAQEKGVELLLPVDAVIADSFDKSASTRSVSVEEGASDGWLILDIGPKSAEIFCDSVRKSGTVLWNGPMGVFEMEPFALGTFAIAQCLAEVTDKGVVTIIGGGDSAAAIQQFGLSERITHVSTGGGASLEFLEGKELPGVTAIQQSK

SEQ ID NO: 90517 - DNA, 1188 bp, Fritschea bemisiae
  CDS (1)..(1188): transl_table=11
atggataaactctctttgagagatttgaagctcaaccaaaaaagggtgctgatgcgggtcgattttaatgttcccttaaatgcagatggttcgattcgagatgcgacgcggatcattttaacccttccttcaattgaatatattttaaggcaaaaggggcgtttggttttaatcagccatttgggtcgacctaaggggtcttttgactcaaaggtttcattaaggccttgcgcgcaaaaattgggtgagcttctcgggaaagaggtcggattttgcttcgattgtattggagctgaagttcaaaaaagggttcaaaacttaaaccctggggaggttcttcttttagaaaaccttcggtttcacaaaggagaagagtctcctgaaaaagatccagggtttgcacaatctcttgctgagctcggggatgtttacattaatgacgcttttggagccgcccatcgctcgcacgcttcaatcgttccgattgcgcaattttttccagcaaattgtggggtaggatttttaatggaaaaagaaattgctgcattttcaaaaatatatttaaatccaaaccgtccgttctatgcaatggttggaggggccaaaattgggaataaaatagatattttacaggccctttctaaaagagtcgatggattgtttattggagggggaatggcttttaccttttttaaggcaaaagggcttgcaattggagagtccatttgcgatgaaagccggttaaaatttgctcgtgactttttgaaagagtgtgaaaggaaagggattcggctccaccttcccatagatgttgtggtgacaaatgggaaaaagattcaaacagttcaaataaaaggcggtgttcccgataaatgggaggggaaagatattgggcctcaaacagttgagctgtggtcgaaagagctcaatcgaggagctacccttttttggaatgggccgatgggggtttttgaggaaagggcgtttgcctcgggaacggagcggctggcgcactttttatccgaagtgcctggagatgtcacgatagggggaggggacttagttgccgctgtccaatctctgaatctggaaaaaaaattgagccacgtttcctcgggaggaggcgcctctttggaatttttagccaatggaaccttgcctggagtggaggcccttagtaataaataa

SEQ ID NO: 90518 - protein, 395 aa, Fritschea bemisiae
MDKLSLRDLKLNQKRVLMRVDFNVPLNADGSIRDATRIILTLPSIEYILRQKGRLVLISHLGRPKGSFDSKVSLRPCAQKLGELLGKEVGFCFDCIGAEVQKRVQNLNPGEVLLLENLRFHKGEESPEKDPGFAQSLAELGDVYINDAFGAAHRSHASIVPIAQFFPANCGVGFLMEKEIAAFSKIYLNPNRPFYAMVGGAKIGNKIDILQALSKRVDGLFIGGGMAFTFFKAKGLAIGESICDESRLKFARDFLKECERKGIRLHLPIDVVVTNGKKIQTVQIKGGVPDKWEGKDIGPQTVELWSKELNRGATLFWNGPMGVFEERAFASGTERLAHFLSEVPGDVTIGGGDLVAAVQSLNLEKKLSHVSSGGGASLEFLANGTLPGVEALSNK

SEQ ID NO: 90519 - DNA, 1461 bp, Chlorarachnion sp
  CDS (1)..(1461)
atgctcgtcaaggcactctctgtgtctgccgttgctctctccatggttctttgctaccaggcagtatccatggcaaatcagcaagttgctgtcgagcctctcgttggaggtgggttctccatggcaggtgtccgccctgtttcccgcatggctgttgctcctatgcactccgtttctcctatgaacgttggccgcttctccaagccttctgttaccaagttctctgcagtctcccgccctcagcagcttaaggttaacgttgaaaagaagatgtctgttggtgacttgaagaaggaagagctcgacggaaaggttgctctcgttcgttgcgacctcaacgttcctcttgacggaaagaccatcactgatgacacccgtatccgcgcttccatcccaaccatcaagcacctggttgagagcggcgctaaggttctccttacctcccaccttggacgtcctaaagacggacctgaggataagttctccctcgctcctgtcgctgctcgtctttccgagctcctcggacaggacgtgaccttcgtcaaggactgcattggagagcctgtcaaggaggctgttgccaccatgacacctggatccgtcgctctcctcgagaacgttcgtttctacaaggaagagaccaagaacgaaccagagttcgctaagaagctcgctgctaacgctgacctcttcgtgaacgatgctttcggaaccgctcaccgtgctcacggatccaccgagggagtaccgctcacctcaagccttccgtcgctggattccttcttcagaaggagctcgactaccttcaggcgctgtgcagaacctgctcgtcctttcgctgctatcgttggtggatccaaggtttcctccaagatcggtgttatcgagtccctcctcgagaaggttgacaagctcgtcatcggaggcggtatggttttcaccttcctcaaggctcgcggcctcgaagtaggaagctccctcgtcgaggaggacaagctcgagctcgctaaggaccttgagcgcatcgcaaaggagaagggcgttgaactcatcctccctaccgacgttgtcctcgctgatgcattcgccaaggatgctaacacccaggtcgctgatgctaccgcaatccctgagggatggatgggacttgaccaggggcctaaggctaccgaggagatcattgctgctctcaaggactgcaagactgttatctggaacggacctatgggtgtcttcgaattcgaggcgttctccaagggaaccttcggagttgctgacgctctcgctgatctcaccaagggaggcgcaaccaccatcatcggcggaggagactccgttgctgctgtagagcaggctggccttgctgaccagatgtcccacatctctaccggaggtggagcttccctcgagctcctcgaaggaaaggtccttcctggagttgctgcccttaacgcagcttaa

SEQ ID NO: 90520 - protein, 486 aa, Chlorarachnion sp
MLVKALSVSAVALSMVLCYQAVSMANQQVAVEPLVGGGFSMAGVRPVSRMAVAPMHSVSPMNVGRFSKPSVTKFSAVSRPQQLKVNVEKKMSVGDLKKEELDGKVALVRCDLNVPLDGKTITDDTRIRASIPTIKHLVESGAKVLLTSHLGRPKDGPEDKFSLAPVAARLSELLGQDVTFVKDCIGEPVKEAVATMTPGSVALLENVRFYKEETKNEPEFAKKLAANADLFVNDAFGTAHRAHGSTEGVPLTSSLPSLDSFFRRSSTTFRRCAEPARPFAAIVGGSKVSSKIGVIESLLEKVDKLVIGGGMVFTFLKARGLEVGSSLVEEDKLELAKDLERIAKEKGVELILPTDVVLADAFAKDANTQVADATAIPEGWMGLDQGPKATEEIIAALKDCKTVIWNGPMGVFEFEAFSKGTFGVADALADLTKGGATTIIGGGDSVAAVEQAGLADQMSHISTGGGASLELLEGKVLPGVAALNAA

SEQ ID NO: 90521 - DNA, 1263 bp, Schistosoma japonicum
  CDS (1)..(1263)
atgggtttgtcgaagcttagtatctccgatgtagatttaaaggataaacttggcttactcctaatgctttgtagggttgattttaacgtccctatgaaagatggaaaagtcactaatacccaacggattgcagctgctataccaactattaaatatgccttggataagggagctaaaagcgtagtcctgatgtctcacttaggtagacctgatgggtataaagttgaaaaatattcgctgaaacccgtttgctctgaagtttccaagttgttaggcaaagaagttactttccttagtgactgtgttggtcctgatgtcattagtgcgtgttctaatcctgctcctggcagcgtcttcttacttgagaatttacgctttcatatagaagagaaaggaaaaggtgtctcaccatctgaagataaaacaaaggccactgctgatcaaatcaaagctttcagtgaaagtttaacaaaacttggggatgtttatgtcaatgatgccttcggaacagcacatcgtgctcatgcctctatggtcggctgccaattgccacaaaaagcttgtggatttctcatgaataaagagttgacatatttcgctaaagctctggaaaatcctgaacgtcctttcttagctattttgggcggcgctaaggttagcgataagatccagttgatcaataatatgctggacaaggttaacgaattgatcattgggggcggcatggcgtatactttccttaagcaaatacacaatatgcatataggagctagtttatttgacgcaccaggtgcagaaattgttcagaaggtaatggaaactgcaaaggctaaacacgtggcaattcacttacctgttgattttgtaactgctgataaatttgctgaagatgctaacaccggaacagcaactatagaatctggaattccagatggttggatggggctggatattggtccgaaaaccatagaggaattccgtaaagtgataagtcgtgccaaaacaatagtttggaatggtccgatgggtgtttttgaaatggataagtttgctgcagggacaaaagcagcaatggatgcggtagttgaagctactaaaaacggtgctacaactattattggtggcggtgatacagcgacttgttgtgccaagtggaacacagaagataaagtcagtcatgtcagtaccggtggtggtgctagccttgaacttttagaaggtaaacaactgccaggagtcgttgcacttacggatgctcactaa

SEQ ID NO: 90522 - protein, 420 aa, Schistosoma japonicum
MGLSKLSISDVDLKDKLGLLLMLCRVDFNVPMKDGKVTNTQRIAAAIPTIKYALDKGAKSVVLMSHLGRPDGYKVEKYSLKPVCSEVSKLLGKEVTFLSDCVGPDVISACSNPAPGSVFLLENLRFHIEEKGKGVSPSEDKTKATADQIKAFSESLTKLGDVYVNDAFGTAHRAHASMVGCQLPQKACGFLMNKELTYFAKALENPERPFLAILGGAKVSDKIQLINNMLDKVNELIIGGGMAYTFLKQIHNMHIGASLFDAPGAEIVQKVMETAKAKHVAIHLPVDFVTADKFAEDANTGTATIESGIPDGWMGLDIGPKTIEEFRKVISRAKTIVWNGPMGVFEMDKFAAGTKAAMDAVVEATKNGATTIIGGGDTATCCAKWNTEDKVSHVSTGGGASLELLEGKQLPGVVALTDAH

SEQ ID NO: 90523 - DNA, 1254 bp, Xenopus laevis
  CDS (1)..(1254)
atgtctctgtccaacaagctgaccctggataaggttgatgtgaaagggaaaagggtagtcatgagggttgacttcaatgtcccaatgaaaaacaatcagattacaaacaaccaaaggattaaggctgctgttcccagcatccagcactgtttagaccatggtgctaaatctgtggttcttatgagccacttgggcagaccagatggggtccctatgcctgacaagtactctctggccccagtggctgaggaactcaaatctctgatgaagagagagattgtcttcttgaaagactgtgtgggtccagaagtggaagctgcatgttctgacccagccactggaacagttttacttctggagaaccttcgcttccatgtggaggaagaagggaagggtaaagatgctgctgggaacaagatcaaagcagatgctgccaatgtagattcatttagagcatcactttctaaactaggagatgtttacatcaatgatgcttttggaactgcacacagagctcacagctccatggttggtgtaaagctgccccagagggctgctggctttttaatgaagaaggagcttgattactttgctaaggctttggagaaccctgagagacctttccttgctatccttggaggtgctaaagtaaaggacaaaatccagctaattagtaacatgctggatcaagtgaatgagatgattattggtggtgggatggcctttacattcctgaaggttctcaacaatatgtccattggaacctccctatatgatgaagagggagcaaacattgttaaggacttgatggccaaggcagagaagaatggagtcaaaattacacttcctgtagactttactactgctaacaagtttgatgaaaatgccagtacagggcaagccagcgtctctactggaattcctgatggatggatgggacttgactgtggcccagagagtgtgaagctgttcgtggaagctgtgggcagagccaaacagattgtgtggaatggtccagttggggtgtttgaatgggacaattttgctaaaggaaccaaagccgtaatggacaaagtggtagaggtcactggcaaaggttgcattacaatcattggtggaggagacactgctacctgctgtgctaaatgggataccgaggacaaagttagccatgtcagtacaggaggaggagccagtctagagctgctagaaggaaaggtcctaccaggagttgatgccctgagcaatgtgtaa

SEQ ID NO: 90524 - protein, 417 aa, Xenopus laevis
MSLSNKLTLDKVDVKGKRVVMRVDFNVPMKNNQITNNQRIKAAVPSIQHCLDHGAKSVVLMSHLGRPDGVPMPDKYSLAPVAEELKSLMKREIVFLKDCVGPEVEAACSDPATGTVLLLENLRFHVEEEGKGKDAAGNKIKADAANVDSFRASLSKLGDVYINDAFGTAHRAHSSMVGVKLPQRAAGFLMKKELDYFAKALENPERPFLAILGGAKVKDKIQLISNMLDQVNEMIIGGGMAFTFLKVLNNMSIGTSLYDEEGANIVKDLMAKAEKNGVKITLPVDFTTANKFDENASTGQASVSTGIPDGWMGLDCGPESVKLFVEAVGRAKQIVWNGPVGVFEWDNFAKGTKAVMDKVVEVTGKGCITIIGGGDTATCCAKWDTEDKVSHVSTGGGASLELLEGKVLPGVDALSNV

SEQ ID NO: 90525 - DNA, 1257 bp, Chondrus crispus
  CDS (1)..(1257)
atgtctttctccaagctctgtatcgacgctctcgatctcgctggcaagcgcgtcttcatccgtgtcgacttcaacgtccccttcgacaaggagaccggcaagaccatcaccaacacccagcgtatcgacgccgccctccccaccatcaaatacgctctggaaaagggcgccaagtccgtcgtcctcgcttcgcatctcggacgcccgtccggccgtgttaaccccaagttctcgctcaagcccgtggcagacgtcgtctcggagaagatcggcaagacggtcaccttcctcgaagatgccgtcggctccgctactgaggaggcttgcaaggaccccgagaccggatccgtcttcttgctcgagaatttgcgcttccacatcgaggaggagggcaagggcgttgatgctgatggcaacaagatcaaggctgatgctgctaaggtgacggagtttcggaagagtctcagcactttggctgatgtttacgttaacgacgcctttggcactgctcaccgcgctcactcgtccatggtcggcgtggatctcccacaaaaggcctctggctttctcatgaagaaggagcttgagtattttggaaaggccctgcaggaaccccaacgcccgtttcttagcattttaggaggatccaaggtgtccgataagatccaactcattgagaacttacttgataaggtcgatgagatgatcattggaggaggtatggcattcacattcaagaaagccgtcgagggaatggccattggacagtcgcttttcgacgaagccggtgcaaagatcgcgcaggaaattgtggacaaagctaaggcgaagaatgtcaagcttcatttccccgtcgacttcacgattgctgacaagtttgccccagtggctaacacaagagttgcgacggactcagagggcattccggatgaatggatgggtctcgatgcaggtccgaagagccaagaggcaatgcgcgaggtcgtgttgcgggcgaagacagtcgtgtggaacggtcctgtcggcgtgtttgagtttgaagcgtttgcaaaaggaacaaaggccgtggtcgatgctgtcgtggaagctacttcatctggagctgtgacgatcattggtggaggtgacacggccactgcagtaaaagagatgggtgcagcggattctgtgtctcacgtttccacgggcggtggtgcgagcctcgaactgctcgaaggaaagactctacccggcgtggccgcattgacagacgcatga

SEQ ID NO: 90526 - protein, 418 aa, Chondrus crispus
MSFSKLCIDALDLAGKRVFIRVDFNVPFDKETGKTITNTQRIDAALPTIKYALEKGAKSVVLASHLGRPSGRVNPKFSLKPVADVVSEKIGKTVTFLEDAVGSATEEACKDPETGSVFLLENLRFHIEEEGKGVDADGNKIKADAAKVTEFRKSLSTLADVYVNDAFGTAHRAHSSMVGVDLPQKASGFLMKKELEYFGKALQEPQRPFLSILGGSKVSDKIQLIENLLDKVDEMIIGGGMAFTFKKAVEGMAIGQSLFDEAGAKIAQEIVDKAKAKNVKLHFPVDFTIADKFAPVANTRVATDSEGIPDEWMGLDAGPKSQEAMREVVLRAKTVVWNGPVGVFEFEAFAKGTKAVVDAVVEATSSGAVTIIGGGDTATAVKEMGAADSVSHVSTGGGASLELLEGKTLPGVAALTDA

SEQ ID NO: 90527 - DNA, 1371 bp, Chondrus crispus
  CDS (1)..(1371)
atggtcaccggcttcgtaccctgcgccgctcccctgcgcgccaccacccgccagacggccgccgtgtccgttgtctcccgctctgccagcaccttcgttgccccctcgcgccgcgtcacggcccctgccgcccccgtccccaccgtccgcatgaccactgccgccgccaccaccaagaagtccattaaggacctcagccccgcggacatcgccggcaaacgcgtccttgtccgctgcgatctcaacgtcccgctcgatggcaagaccatcaccgacgacacacgcatccgcgcatctgtccccaccatcaagttcctcatggaagccggcgcaaaggtcctcctctcctcccatctcggccgccccaaggatggtccggaggataagttctccctcagccccgtcgccgcccgccttacccaactgctgggcaaggacgttaccatggctccagattgcattggtgacggagtcacaaaaatcgtgtccggcatggctaacggtgatgtcactcttctcgagaacgttcgcttctacaaggaggagacgaagaacgaccctgactttgctaagaaacttgctgctaacgctgattttttcgtcaacgatgcttttggtaccgcccatcgcgcccatggctcgaccgccggtgttacggcgcatcttaagccctctgttgccggcttacttctggagaaggagcttgcatacctcgcaggcactgtgtcggaccccgcgcgcccgtttgctgcaattgttggtggttccaaggtatcttccaagattggcgttatcgactcgcttctccagaaggttgacaagctcatcattggaggcggtatggtcttcaccttcctcaaagcaaagggcctcaacgttggttcttcccttgttgaggatgataagctcgagcttgcgagggagcttgtcaaaacggccgaagccaagggtgtctccatcatccttcccactgacgtcgtcctcgctgacaagttcgccgctgatgccaacactcaggtgacctctgttgactctatccccgatggatggatgggtctggaccaaggagaagacagcacaaagctcattcagaatgagcttaaggagtgcaagaccgtaatctggaacgggccgatgggtgtgtttgagatggagaagttcgcgaagggtacgttcgccattgctgacacattagccgatctcactgaatccggctgcattaccatcatcggtggtggtgactctgtcgcagctgtcgagaaggctggtctggctgagaagatgtcccatatctctactggtggtggtgcctcgctcgagcttttggaaggaaaggtgcttcctggcgtggctgctttggatgacaattag

SEQ ID NO: 90528 - protein, 456 aa, Chondrus crispus
MVTGFVPCAAPLRATTRQTAAVSVVSRSASTFVAPSRRVTAPAAPVPTVRMTTAAATTKKSIKDLSPADIAGKRVLVRCDLNVPLDGKTITDDTRIRASVPTIKFLMEAGAKVLLSSHLGRPKDGPEDKFSLSPVAARLTQLLGKDVTMAPDCIGDGVTKIVSGMANGDVTLLENVRFYKEETKNDPDFAKKLAANADFFVNDAFGTAHRAHGSTAGVTAHLKPSVAGLLLEKELAYLAGTVSDPARPFAAIVGGSKVSSKIGVIDSLLQKVDKLIIGGGMVFTFLKAKGLNVGSSLVEDDKLELARELVKTAEAKGVSIILPTDVVLADKFAADANTQVTSVDSIPDGWMGLDQGEDSTKLIQNELKECKTVIWNGPMGVFEMEKFAKGTFAIADTLADLTESGCITIIGGGDSVAAVEKAGLAEKMSHISTGGGASLELLEGKVLPGVAALDDN

SEQ ID NO: 90529 - DNA, 1245 bp, Phytophthora infestans
  CDS (1)..(1245)
atggccaagctcagcatcaagaacgtggacgtcaagggcaagcgcgtgctcatccgcgtggatttcaacgttcctttcgcacaggacggctccatctccaacacgcagcgcatcgacgccgcgctgcccactgtgcagtacgtgctggaccagggtgctaaggctgtggtgctcatgtcccatttgggccgccccgagggcaagcccaaggccaaggactcgctggcccctgtggctgtggctgtggaacagaagctcggtcgtaaggtgacgttcctgaaggactgtgttggccccgaggttgaggctgcctgcgccaacccgactgagggcagcattattctgcttgagaaccttcgttttcacgtcgaagaggagggtaagggcaaggatgccgagggcaacaagaccaaggcgtcgtctgaggctgtggcagctttccgcgcctcgctgagcaagcttggcgacgtgtacgtcaacgacgcgttcggtacggcccaccgcgctcacagctccatggtgggcgtggatctccctattaaggccgctggctttctgctggacaaggagctagtgtacttcgccaaggctctggacgcccctcagcgccccttcgtgtcgattctgggtggtgccaaggttgctgacaagatccagctcatcatgaatatgctggacaaggtggacgagatggtcatcggtggcggcatggcctacacgttcaagaaggtgatcaacaacatggagatcggtggatcgctgtacgacgaggaaggcgccaagatcgtgcctcagatcgtggagaaggccaaggccaagggcgtgacgcttcacctgcctgtggacttcgtcatcgccgacaagttcgccgcggatgctgctacgaagatctcgacggaagaggagggcatccctgctggctggatgggtctggacgtcggccccaagtcgcaggaagcgttcagcgccgctgtggcgaaggccaagaccgtcgtctggaacggacccatgggcgtgttcgagttcgatgcttttgctgacggcacgaaagttgtcatggacgctgtggtcaaggccaccgagtcgggcgccactacgatcattggcggcggcgacacggccacgtgctgcgtcaagttcaacacggaggacaaggtctctcatgtgagcacgggcggcggtgccagtctggagcttctggagggcaagattctgcctggtgtggacgccctgtcctcggcgtga

SEQ ID NO: 90530 - protein, 414 aa, Phytophthora infestans
MAKLSIKNVDVKGKRVLIRVDFNVPFAQDGSISNTQRIDAALPTVQYVLDQGAKAVVLMSHLGRPEGKPKAKDSLAPVAVAVEQKLGRKVTFLKDCVGPEVEAACANPTEGSIILLENLRFHVEEEGKGKDAEGNKTKASSEAVAAFRASLSKLGDVYVNDAFGTAHRAHSSMVGVDLPIKAAGFLLDKELVYFAKALDAPQRPFVSILGGAKVADKIQLIMNMLDKVDEMVIGGGMAYTFKKVINNMEIGGSLYDEEGAKIVPQIVEKAKAKGVTLHLPVDFVIADKFAADAATKISTEEEGIPAGWMGLDVGPKSQEAFSAAVAKAKTVVWNGPMGVFEFDAFADGTKVVMDAVVKATESGATTIIGGGDTATCCVKFNTEDKVSHVSTGGGASLELLEGKILPGVDALSSA

SEQ ID NO: 90531 - DNA, 1197 bp, Streptococcus agalactiae
  CDS (1)..(1197): transl_table=11
atggctaaattgactgttaaagacgttgatttgaaggtaaaaaaagtcctcgttcgtgttgactttaatgtgcctttgaaagacggcgttatcactaacgacaaccgtatcactgcggctcttccaacaatcaagtatatcatcgaacaaggtggtcgtgctatcctcttctctcaccttggacgtgttaaagaagaagctgacaaagaaggaaaatcacttgcaccggtagctgctgatttagctgctaaacttggtcaagatgttgtattcccaggtgttactcgtggtgcaaaattagaagaagcaatcaatgctttggaagatggacaagttcttttggttgaaaacactcgttttgaagatgttgacggtaagaaagaatctaagaatgacgaagaacttggtaaatactgggcttcacttggagatggaatcttcgttaacgatgcatttggtacagcacaccgtgctcatgcatcaaacgtaggtatttcagcaaacgttgaaaaagctgtagctggtttccttcttgaaaacgaaattgcttacatccaagaagcagttgaaactccagaacgcccattcgtagctattcttggtggctcaaaagtttctgataagattggtgttatcgaaaaccttcttgaaaaagctgataaagttcttatcggtggtggtatgacttacacattctacaaagctcaaggtatcgaaatcggtaactcacttgtagaagaagacaaattggatgttgctaaagacctccttgaaaaatcaaacggtaaattgatcttgccagttgactcaaaagaagcaaacgcatttgctggttatactgaagttcgcgacactgaaggtgaagcagtttcagaagggttccttggtcttgacatcggtcctaaatcaatcgctaaatttgatgaagcacttactggtgctaaaacagttgtatggaacggacctatgggtgtctttgaaaaccctgacttccaagctggtacaatcggtgtaatggacgctatcgttaaacaaccaggcgttaaatcaatcatcggtggtggtgattcagcagcagctgctatcaaccttggtcgtgctgacaaattctcatggatctctactggtggtggagcaagcatggaattgctcgaaggtaaagtattaccaggtttggcagcattgactgaaaaataa

SEQ ID NO: 90532 - protein, 398 aa, Streptococcus agalactiae
MAKLTVKDVDLKVKKVLVRVDFNVPLKDGVITNDNRITAALPTIKYIIEQGGRAILFSHLGRVKEEADKEGKSLAPVAADLAAKLGQDVVFPGVTRGAKLEEAINALEDGQVLLVENTRFEDVDGKKESKNDEELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKDLLEKSNGKLILPVDSKEANAFAGYTEVRDTEGEAVSEGFLGLDIGPKSIAKFDEALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 90533 - DNA, 1347 bp, Drosophila melanogaster
  CDS (1)..(1347)
atgcttccaattcggcagagtttataccaaagagctcaaactcgatttacaaaattaagatttccaagattttttagcaaagacgattgcaatggaaagcaagtaaagaagttgagcttaaaaaatgtagatgtggctgggaaaagggtttttatgagagtggactttaatgtacccatgaaagatggcaaaataaccaacaaccaacgaattgtttccgcacttcccagtattaaatatgccttggacaagaaatgtaagtccttggttttggcatcccacttggggcgtccggatggcaaaaagaacaaaaagtttagcctggaacccgtggccaaggagctggagagtgtgctgggccagccggttcaattcctggacgactgcgtgggtgatagcaccctgaaagctttgaaggatccctccgacggcactgtgttcctgttggagaatcttcgtttctatgccgaggagacgggcagcagcaaggacgataacaagaagaaggtcaaagcagatcccgcgaaggtgaaggaattccgagccaagttggcgcagctgggcgagatctatgtgaacgatgcctttggaacagcacatcgtccgcatagttccatgatgggcgatggctacaaggtgcgagcggctggtttcctgctggacaaggaactggagtactttgccaaggttctccacgatccggccaagccctttttggccattctgggtggcgccaagatagccgataaaattccactgataacgaacctcctgaacaatgtaacggccatgatcatatccggtggcatggccttcacctttctcaaagtgctcaatggcatggagattggaaagtccctcttcgacgagaagggatccgagttggtcaacgacatagtctgcaaggcgaaggagaaggacgtgaatatactatttccgattgactttgtcatagccaataagatcgacaaggagccggataaagtggaacatgtggatgccacacagggcataccggaggacatgatgggtctggaccacggccaggcatccagtcagatgtttgctggcgctatttgtgcatccaaaaccatcgtctggaacggaccgccaggcttgttcgaaaacgagctattctccaaaggcaccgagtccatgctggaggcagtaatcggggccactaaccgaggagccaccacaatcgttggtggtggggatacggccaccgcttgcttgaagttcggaggcgccgacaaggtctcgcatgtgtccaccggtggaggagcttccctggagttgctggagggtaaggttctgcctggagtggctgccctttcggatgcctaa

SEQ ID NO: 90534 - protein, 448 aa, Drosophila melanogaster
MLPIRQSLYQRAQTRFTKLRFPRFFSKDDCNGKQVKKLSLKNVDVAGKRVFMRVDFNVPMKDGKITNNQRIVSALPSIKYALDKKCKSLVLASHLGRPDGKKNKKFSLEPVAKELESVLGQPVQFLDDCVGDSTLKALKDPSDGTVFLLENLRFYAEETGSSKDDNKKKVKADPAKVKEFRAKLAQLGEIYVNDAFGTAHRPHSSMMGDGYKVRAAGFLLDKELEYFAKVLHDPAKPFLAILGGAKIADKIPLITNLLNNVTAMIISGGMAFTFLKVLNGMEIGKSLFDEKGSELVNDIVCKAKEKDVNILFPIDFVIANKIDKEPDKVEHVDATQGIPEDMMGLDHGQASSQMFAGAICASKTIVWNGPPGLFENELFSKGTESMLEAVIGATNRGATTIVGGGDTATACLKFGGADKVSHVSTGGGASLELLEGKVLPGVAALSDA

SEQ ID NO: 90535 - DNA, 1248 bp, Aedes aegypti
  CDS (1)..(1248)
atggctctcaataaactcagcatcgagaatgttgatttgaagggcaaacgagtttttatgcgtgtggatttcaatgtccctatcaaagagggaaagatcaccagcaaccagcgtatcgtagctgccctggacagtattaaatatgccttggaaaagggtgccaagtccgttgtccttgcctcccaccttggacgtccggacggcaacaagaatgccaaatacaccctagccccggtggccgaggagatgacgaagctgttgggtcgtgatgtgaccttcctgaacgactgtatcggtgctgaggttgaagccgcatgcaaagaccctgcacccggttcgatcattttgttggagaatgtccgattctacgttgaagaggagggcaagggcgttgacgcctccggcaataaggttaaggctgataaggacaaggtcaaggccttccgcgaaagtcttgctaaattgggagatttgtatgtcaacgatgctttcggaactgctcatcgtgcgcatagttccatgatgggtgagggatacgcccagcgtgctgctggtttgttgttgaacaaggaattgcgttacttctcgcaagctctggataacccgccacgaccattccttgccattctgggtggagctaaggttgctgacaaaatccagctcattgaaaatctcctcgacaaggtgaacgaaatgatcattggaggtggaatggcatttacgttccttaaggtattgaacaatatgcaaattggaggatcattgttcgacgaggagggttcaaagaccgttcagaagctggtggacaaagccaaggccaacaacgtgcaactgcatttaccagtggatttcgtaactggcgataaatttgccgaagatgctgccgttggagctgctaccgtcgagagcggaattcccgctggacacatgggtctcgacgttggaccgaagtctcgtgaggcattcgctgctccgattgcccgctccaagatcattgtttggaacggtccacccggcgtttttgagttccccaatttcgccaacggaacgaaagctcttatggatgccgttgtcgctgcaacaaaggcaggcactgtatctattattggcggtggagataccgcttcgtgtcgcgccaagtggggaacagaatctcaggtatcacacgtttctactggtggtggagcgtctttggaactgttggaaggcaaggttctacctggtgtcgacgccttgagcagcgcttaa

SEQ ID NO: 90536 - protein, 415 aa, Aedes aegypti
MALNKLSIENVDLKGKRVFMRVDFNVPIKEGKITSNQRIVAALDSIKYALEKGAKSVVLASHLGRPDGNKNAKYTLAPVAEEMTKLLGRDVTFLNDCIGAEVEAACKDPAPGSIILLENVRFYVEEEGKGVDASGNKVKADKDKVKAFRESLAKLGDLYVNDAFGTAHRAHSSMMGEGYAQRAAGLLLNKELRYFSQALDNPPRPFLAILGGAKVADKIQLIENLLDKVNEMIIGGGMAFTFLKVLNNMQIGGSLFDEEGSKTVQKLVDKAKANNVQLHLPVDFVTGDKFAEDAAVGAATVESGIPAGHMGLDVGPKSREAFAAPIARSKIIVWNGPPGVFEFPNFANGTKALMDAVVAATKAGTVSIIGGGDTASCRAKWGTESQVSHVSTGGGASLELLEGKVLPGVDALSSA

SEQ ID NO: 90537 - DNA, 1248 bp, Aedes aegypti
  CDS (1)..(1248)
atggctctcaataaactcagcatcgagaatgttgatttgaagggcaaacgagtttttatgcgtgtggatttcaatgtccctatcaaagagggaaagatcactagcaaccagcgtatcgtagctgccctggacagtattaaatatgccttggaaaagggtgccaagtccgttgtccttgcctcccaccttggacgtccggacggcaacaagaatgccaaatacaccctagccccggtggccgaggagatgaagaagctgttgggtcgtgatgtgaccttccttaacgactgtatcggtgctgaggttgaagccgcatgcaaagaccctgcaccgggttcgatcattttgttggagaatgtccgattctacgttgaagaggagggcaagggcgttgacgcctccggcaataaggttaaggctgataaggacaaggtcaaggctttccgcgaaagtcttgccaaattgggagatgtgtatgtcaacgatgctttcggaactgctcatcgtgcgcatagttccatgatgggtgagggatacgcccagcgtgctgctggtttgttgttgaacaaggaattgcgttacttctcgcaagctctggataacccgccacgaccattccttgccattctgggtgcagctaaggttgctgacaaaatccagctcattgaaaatctcctggacaaggtgaacgaagtgatcattggaggtggaatggcatttacgttccttaaggtattgaacaatatggaaattggaggatcattgttcgacgaggagggttcaaagatcgttcagaagctggtagacaaagccaaggccaacaacgtgcaactgcatttaccagtggatttcgtaactggtgataaatttgccgaagatgctgccgttggagctgctaccgtcgagagcggaattcccgctggacacatgggtctcgacgttggacccaagtctcgtgaagcattcgctgctccgattgcccgctccaagatcattgtttggaacggtccacccggcgtttttgagttccccaatttcgccaacggaacgaaagctcttatggatgccgttgtcgctgcaacaaaggcaggcactgtatctattattggcggtggagataccgcttcgtgttgcgccaagtggggaacagaatctcaggtatcacacgtttctactggtggtggagcgtctttggaactgttggaaggcaaggttctacctggtgtcgacgccttgagcagcgcttaa

SEQ ID NO: 90538 - protein, 415 aa, Aedes aegypti
MALNKLSIENVDLKGKRVFMRVDFNVPIKEGKITSNQRIVAALDSIKYALEKGAKSVVLASHLGRPDGNKNAKYTLAPVAEEMKKLLGRDVTFLNDCIGAEVEAACKDPAPGSIILLENVRFYVEEEGKGVDASGNKVKADKDKVKAFRESLAKLGDVYVNDAFGTAHRAHSSMMGEGYAQRAAGLLLNKELRYFSQALDNPPRPFLAILGAAKVADKIQLIENLLDKVNEVIIGGGMAFTFLKVLNNMEIGGSLFDEEGSKIVQKLVDKAKANNVQLHLPVDFVTGDKFAEDAAVGAATVESGIPAGHMGLDVGPKSREAFAAPIARSKIIVWNGPPGVFEFPNFANGTKALMDAVVAATKAGTVSIIGGGDTASCCAKWGTESQVSHVSTGGGASLELLEGKVLPGVDALSSA

SEQ ID NO: 90539 - DNA, 1248 bp, Aedes aegypti
  CDS (1)..(1248)
atggctctcaataaactcagcatcgagaatgttgatttgaagggcaaacgagtttttatgcgtgtggatttcaatgtccctatcaaagagggaaagatcactagcaaccagcgtatcgtagctgccctggacagtattaaatatgccttggaaaagggtgccaagtccgttgtccttgcctcccaccttggacgtccggacggcaacaagaatgccaaatacaccctagccccggtggccgaggagatgaagaagctgttgggtcgtgatgtgaccttccttaacgactgtatcggtgctgaggttgaagccgcatgcaaagaccctgcaccgggttcgatcattttgttggagaatgtccgattctacgttgaagaggagggcaagggcgttgacgcctccggcaataaggttaaggctgataaggacaaggtcaaggctttccgcgaaagtcttgccaaattgggagatgtgtatgtcaacgatgctttcggaactgctcatcgtgcgcatagttccatgatgggtgagggatacgcccagcgtgctgctggtttgttgttgaacaaggaattgcgttacttctcgcaagctctggataacccgccacgaccattccttgccattctgggtggagctaaggttgctgacaaaatccagctcattgaaaatctcctggacaaggtgaacgaaatgatcattggaggtggaatggcatttacgttccttaaggtattgaacaatatggaaattggaggatcattgttcgacgaggagggttcaaagatcgttcagaagctggtagacaaagccaaggccaacaacgtgcaactgcatttaccagtggatttcgtaactggtgataaatttgccgaagatgctgccgttggagctgctaccgtcgagagcggaattcccgctggacacatgggtctcgacgttggacccaagtctcgtgaagcattcgctgctccgattgcccgctccaagatcattgtttggaacggtccacccggcgtttttgagttccccaatttcgccaacggaacgaaagctcttatggatgccgttgtcgctgcaacaaaggcaggcactgtatctattattggcggtggagataccgcttcgtgttgcgccaagtggggaacagaatctcaggtatcacacgtttctactggtggtggagcgtctttggaactgttggaaggcaaggttctacctggtgtcgacgccttgagcagcgcttaa

SEQ ID NO: 90540 - protein, 415 aa, Aedes aegypti
MALNKLSIENVDLKGKRVFMRVDFNVPIKEGKITSNQRIVAALDSIKYALEKGAKSVVLASHLGRPDGNKNAKYTLAPVAEEMKKLLGRDVTFLNDCIGAEVEAACKDPAPGSIILLENVRFYVEEEGKGVDASGNKVKADKDKVKAFRESLAKLGDVYVNDAFGTAHRAHSSMMGEGYAQRAAGLLLNKELRYFSQALDNPPRPFLAILGGAKVADKIQLIENLLDKVNEMIIGGGMAFTFLKVLNNMEIGGSLFDEEGSKIVQKLVDKAKANNVQLHLPVDFVTGDKFAEDAAVGAATVESGIPAGHMGLDVGPKSREAFAAPIARSKIIVWNGPPGVFEFPNFANGTKALMDAVVAATKAGTVSIIGGGDTASCCAKWGTESQVSHVSTGGGASLELLEGKVLPGVDALSSA

SEQ ID NO: 90541 - DNA, 1248 bp, Aedes aegypti
  CDS (1)..(1248)
atggctctcaataaactcagcatcgagaatgttgatttgaagggcaaacgagtttttatgcgtgtggatttcaatgtccctatcaaagagggaaagatcaccagcaaccagcgtatcgtagctgccctggacagtattaaatatgccttggaaaagggtgccaagtccgttgtccttgcctcccaccttggacgtccggacggcaacaagaatgccaaatacaccctagccccggtggccgaggagatgaagaagctgttgggtcgtgatgtgaccttcctgaacgactgtatcggtgctgaggttgaagccgcatgcaaagaccctgcacccggttcgatcattttgttggagaatgtccgattctacgttgaagaggagggcaagggcgttgacgcctccggcaataaggttaaggctgataaggacaaggtcaaggccttccgcgaaagtcttgctaaattgggagatttgtatgtcaacgatgctttcggaactgctcatcgtgcgcataggtccatgatgggtgagggatacgcccagcgtgctgctggtttgttgttgaacaaggaattgcgttacttctcggaagctctggataacccgccacgaccatcccttgccattctgggtggagctaaggttgctgacaaaatccagctcattgaaaatctcctcgacaaggtgaacgaaatgatcattggaggtggaatggcatttacgttccttaaggtattgaacaatatggaaattggaagatcattgttcgacgaggagggttcaaagatcgttcagaagctggtagacaaagccaaggccaacaacgtgcaactgcatttaccagtggatttcgtaactggcgataaatttgccgaaaatgctgccgttggacctgctaccgtcgagagcggaattcccgctggacacatgggtctcgacgttggaccgaagtctcgtgaggcattcgctgctccgattgcccgctccaagatcattgtttggaacggtccacccggcgtttttgagttccccaatttcgccaacggaacgaaagctcttatggatgccgttgtcgctgcaacaaaggcaggcactgtatctattattggcggtggagataccgcttcgtgtcgcgccaagtggggaacagaatctcaggtatcacacgtttctactggtggtggagcgtctttggaactgttggaaggcaaggttctacctggtgtcgacgccttgagcagcgcttaa

SEQ ID NO: 90542 - protein, 415 aa, Aedes aegypti
MALNKLSIENVDLKGKRVFMRVDFNVPIKEGKITSNQRIVAALDSIKYALEKGAKSVVLASHLGRPDGNKNAKYTLAPVAEEMKKLLGRDVTFLNDCIGAEVEAACKDPAPGSIILLENVRFYVEEEGKGVDASGNKVKADKDKVKAFRESLAKLGDLYVNDAFGTAHRAHRSMMGEGYAQRAAGLLLNKELRYFSEALDNPPRPSLAILGGAKVADKIQLIENLLDKVNEMIIGGGMAFTFLKVLNNMEIGRSLFDEEGSKIVQKLVDKAKANNVQLHLPVDFVTGDKFAENAAVGPATVESGIPAGHMGLDVGPKSREAFAAPIARSKIIVWNGPPGVFEFPNFANGTKALMDAVVAATKAGTVSIIGGGDTASCRAKWGTESQVSHVSTGGGASLELLEGKVLPGVDALSSA

SEQ ID NO: 90543 - DNA, 1215 bp, Mycoplasma capricolum subsp
  CDS (1)..(1215): transl_table=4
atgaattataataacaaaaaaacattaaaagacatagatgttaaaaataaaactgtactagttcgtgtggattttaatgtaccaattcaaaatggagttattactgatgataatcgtataattgctgctcttcctactataaattacttaatagaaaatgatgccaaaatagtattattttcacatttatcaagaattaaaactaatgaagataaattaaaaaaatctttagctccagttgcaaaaagattagaagaattattgaataaaaaagttaaatttattaaccaaactagaggaaaagaattagaacaagctgttagtttattgcaaactaaagaaattattttagttgaaaatactagatttgaagatgttttagatgatcaagttgttaagtatgaatcaaaaaatgatcctgaattaggaaagtattgagcaagtttaggtgaagtatttgtaaatgatgcttttggaacagcacatagatcacatgcttcaaatgttggaattgcttcaaatattaaaatttcagctattggttttttagttgaaaaagaattaaaaatgttatctcaagcagttaatgactctaaaaaaccatttattgcaattttaggtggagcaaaagtttcagataaaattggtgttattgaaaatttattaccaaaagttgataaattactaattggtggtggaatgagctatacttttttaaaagctcaaggtcgtagcattggtaaatcattattagaagaagataaaattgatttagctaaacattatttagaagttggaaaagataaaattgttttaccagttgatacagcatgtgcaaaagaatttgctgatgtaaagccaactatttttgaaactaatattcctgatgaatgagatggattagatgctggaccaaaaacaattgaaatgtataaagaagaaattaaaaaagctaaaactattgtttgaaatggtcctgttggtgtatttgaattcaaaaattttgaaactggtacaaaatctatatgtcaagcaattgctgaacaaactaaaactggagcctttactttaattggtggtggagatagtgcttctgctgctattaatatggggtttaaagataatttttcatgaatttcaacaggtggaggagcctcacttgaatttatggaaggaaaagaattacgaggaatttcggcaattcaaaataaataa

SEQ ID NO: 90544 - protein, 404 aa, Mycoplasma capricolum subsp
MNYNNKKTLKDIDVKNKTVLVRVDFNVPIQNGVITDDNRIIAALPTINYLIENDAKIVLFSHLSRIKTNEDKLKKSLAPVAKRLEELLNKKVKFINQTRGKELEQAVSLLQTKEIILVENTRFEDVLDDQVVKYESKNDPELGKYWASLGEVFVNDAFGTAHRSHASNVGIASNIKISAIGFLVEKELKMLSQAVNDSKKPFIAILGGAKVSDKIGVIENLLPKVDKLLIGGGMSYTFLKAQGRSIGKSLLEEDKIDLAKHYLEVGKDKIVLPVDTACAKEFADVKPTIFETNIPDEWDGLDAGPKTIEMYKEEIKKAKTIVWNGPVGVFEFKNFETGTKSICQAIAEQTKTGAFTLIGGGDSASAAINMGFKDNFSWISTGGGASLEFMEGKELRGISAIQNK

SEQ ID NO: 90545 - DNA, 1248 bp, Aedes aegypti
  CDS (1)..(1248)
atggctctcaataaactcagcatcgagaatgtcgatttgaagggcaaacgagtttttatgcgtgtggatttcaatgtccctatcaaagagggaaagatcaccagcaaccagcgtatcgtagctgccctggacagtattaaatatgccttggaaaagggtgccaagtccgttgtccttgcctcccaccttggacgtccggacggcaacaagaatgccaaatacaccctagccccggtggccgaggagatgaagaagctgttgggtcgtgatgtgaccttcctgaacgactgtatcggtgctgaggttgaagccgcatgcaaagaccctgcacccggttcgatcattttgttggagaatgtccgattctacgttgaagaggagggcaagggcgttgacgcctccggcaataaggttaaggctgataaggacaaggtcaaggccttccgcgaaagtcttgctaaattgggagatttgtatgtcaacgatgctttcggaactgctcatcgtgcgcatagttccatgatgggtgagggatacgcccagcgtgctgctggtttgttgttgaacaaggaattgcgttacttctcgcaagctctggataacccgccacgaccattccttgccattctgggtggagctaaggttgctgacaaaatccagctcattgaaaatctcctcgacaaggtgaacgaaatgatcattggaggtggaatggcatttacgttccttaaggtattgaacaatatggaaattggaggatcattgttcgacgaggagggttcaaagatcgttcagaagctggtagacaaagccaaggccaacaacgtgcaactgcatttaccagtggatttcgtaactggcgataaatttgccgaagatgctgccgttggagctgctaccgtcgagagcggaattcccgctggacacatgggtctcgacgttggaccgaagtctcgtgaagcattcgctgctccgattgcccgctccaagatcattgtttggaacggtccacccggcgtttttgagttccccaatttcgccaacggaacgaaagctcttatggatgccgttgtcgctgcaacaaaggcaggcactgtatctattattggcggtggagataccgcttcgtgttgcgccaagtggggaacagaatctcaggtatcacacgtttctactggtggtggagcgtctttggaactgttggaaggcaaggttctacctggtgtcgacgccttgagcagcgcttaa

SEQ ID NO: 90546 - protein, 415 aa, Aedes aegypti
MALNKLSIENVDLKGKRVFMRVDFNVPIKEGKITSNQRIVAALDSIKYALEKGAKSVVLASHLGRPDGNKNAKYTLAPVAEEMKKLLGRDVTFLNDCIGAEVEAACKDPAPGSIILLENVRFYVEEEGKGVDASGNKVKADKDKVKAFRESLAKLGDLYVNDAFGTAHRAHSSMMGEGYAQRAAGLLLNKELRYFSQALDNPPRPFLAILGGAKVADKIQLIENLLDKVNEMIIGGGMAFTFLKVLNNMEIGGSLFDEEGSKIVQKLVDKAKANNVQLHLPVDFVTGDKFAEDAAVGAATVESGIPAGHMGLDVGPKSREAFAAPIARSKIIVWNGPPGVFEFPNFANGTKALMDAVVAATKAGTVSIIGGGDTASCCAKWGTESQVSHVSTGGGASLELLEGKVLPGVDALSSA

SEQ ID NO: 90547 - DNA, 1248 bp, Aedes aegypti
  CDS (1)..(1248)
atggctctcaataaactcagcatcgagaatgttgatttgaagggcaaacgagtttttatgcgtgtggatttcaatgtccctatcaaagagggaaagatcactagcaaccagcgtatcgtagctgccctggacagtattaaatatgccttggaaaagggtgccaagtccgttgtccttgcctcccaccttggacgtccggacggcaacaagaatgccaaatacaccctagccccggtggccgaggagatgaagaagctgttgggtcgtgatgtgaccttccttaacgactgtatcggtgctgaggttgaagccgcatgcaaagaccctgcaccgggttcgatcattttgttggagaatgtccgattctacgttgaagaggagggcaagggcgttgacgcctccggcaataaggttaaggctgataaggacaaggtcaaggctttccgcgaaagtcttgccaaattgggagatgtgtatgtcaacgatgctttcggaactgctcaccgtgcgcatagttccatgatgggtgagggatacgcccagcgtgctgctggtttgttgttgaacaaggaattgcgttacttctcgcaagctctggataacccgccacgaccattccttgccattctgggtggagctaaggttgctggcaaaatccagctcattgaaaatctcctggacaaggtgaacgaaatgatcattggaggtggaatggcatttacgttccttaaggtattgaacaatatggaaattggaggatcattgttcgacggggagggttcaaagatcgttcagaagctggtagacaaagccaaggccaacaacgtgcaactgcatttaccagtggatttcgtaactggtgataaatttgccgaagatgctgccgttggagctgctaccgtcgagagcggaattcccgctggacacatgggtctcgacgttggacccaagtctcgtgaagcattcgctgctccgattgcccgctccaagatcattgtttggaacggtccacccggcgtttttgagttccccaatttcgccaacggaacgaaagctcttatggatgccgttgtcgctgcaacaaaggcaggcactgtatctattattggcggtggagataccgcttcgtgttgcgccaagtggggaacagaatctcaggtatcacacgtttctactggtggtggagcgtctttggaactgttggaaggcaaggttctacctggtgtcgacgccttgagcagcgcttaa

SEQ ID NO: 90548 - protein, 415 aa, Aedes aegypti
MALNKLSIENVDLKGKRVFMRVDFNVPIKEGKITSNQRIVAALDSIKYALEKGAKSVVLASHLGRPDGNKNAKYTLAPVAEEMKKLLGRDVTFLNDCIGAEVEAACKDPAPGSIILLENVRFYVEEEGKGVDASGNKVKADKDKVKAFRESLAKLGDVYVNDAFGTAHRAHSSMMGEGYAQRAAGLLLNKELRYFSQALDNPPRPFLAILGGAKVAGKIQLIENLLDKVNEMIIGGGMAFTFLKVLNNMEIGGSLFDGEGSKIVQKLVDKAKANNVQLHLPVDFVTGDKFAEDAAVGAATVESGIPAGHMGLDVGPKSREAFAAPIARSKIIVWNGPPGVFEFPNFANGTKALMDAVVAATKAGTVSIIGGGDTASCCAKWGTESQVSHVSTGGGASLELLEGKVLPGVDALSSA

SEQ ID NO: 90549 - DNA, 1440 bp, Leishmania major
  CDS (1)..(1440)
atgtctctcgtgctgaagaagagcatcgatgacgccaccgtcagggacaagaaggtgctcatccgcgtggacttcaacgtccccgtgaagaacggtaagatcacgaatgacttccgcattcgctccgcccttccgacgatccaaaaggtgctgaaggagggcggctcctgcatcctgatgagccaccttggtcggccgaagggtgcgagaatgagtgacccaagtccggagaagggtgtgcgcgggtacgaggaggccgccacgctgcgcccggttgctgcacgcatcgcggagctgctggggcagaaggtggagtttgcaccggactgcctggacgctgcggcgtacgcgtcgaagctgaagaacggcgacgtgctgttgctggagaacgtgcgtttctacgcggaggagggcagcaagaaggaggaggagcgcgacgcgatggcgaaggtactggcgtcgtacgcggacctgtatgtcagtgacgcctttggcactgcgcaccgcgacagcgcgacgatgacgggcatccccaaggtgctgggtgcgggctacgccgggtacctgatggagaaggagatcaactacttctcgcgagtgctgaacaacccgccgcggccgctggttgcgattgtcggcggtgcgaaggtcagcgacaagatcgagctgcttgacaacatgctgggccgcatcaactaccttgtgattggtggcgcgatggcgtacacgttccagaaggcgcagggccgcaagatcggcatctcgatgtgcgaggaggataagctggaccttgccaagtcgctgctgaagaaggcgcaagagcgcggtgtgcaggtgtttctgccagttgaccacgtgtgcaacaaggaatttaaggccgcggactcgccgctggtgacggagagcgtggacgtcccggacggctacatggcgctcgacattggcccaaggacgatccacatgtacgaggaagtgattggccgctgcaagagcgcgatctggaacggcccgatgggcgtgttcgagatgccgtgctactcgaagggcacatttgccgttgcgaaggcgatggggactggaacgcagaagaacgggctgctgagcatcatcggcggtggtgacagcgcgagcgctgcggagctgagcggcgaggcgaagaacatgtcgcatgtgtccaccggcggcggtgcgtccctggagctgctggagggcaagacgctgcctggcgtcgccattctgacggacaaggacgtgaaggagcggggagcttcgtgcaagttcgctttcggggtcgggagcccgagcagggaggcttgtccgctccgttgtgggcatatctttggcggtgcctccatcgtaagagagatagttaagatcgtcgtcgcgctgctgatcggcatttttattggtcgccgcatgagcaccaagctgatccggtaa

SEQ ID NO: 90550 - protein, 479 aa, Leishmania major
MSLVLKKSIDDATVRDKKVLIRVDFNVPVKNGKITNDFRIRSALPTIQKVLKEGGSCILMSHLGRPKGARMSDPSPEKGVRGYEEAATLRPVAARIAELLGQKVEFAPDCLDAAAYASKLKNGDVLLLENVRFYAEEGSKKEEERDAMAKVLASYADLYVSDAFGTAHRDSATMTGIPKVLGAGYAGYLMEKEINYFSRVLNNPPRPLVAIVGGAKVSDKIELLDNMLGRINYLVIGGAMAYTFQKAQGRKIGISMCEEDKLDLAKSLLKKAQERGVQVFLPVDHVCNKEFKAADSPLVTESVDVPDGYMALDIGPRTIHMYEEVIGRCKSAIWNGPMGVFEMPCYSKGTFAVAKAMGTGTQKNGLLSIIGGGDSASAAELSGEAKNMSHVSTGGGASLELLEGKTLPGVAILTDKDVKERGASCKFAFGVGSPSREACPLRCGHIFGGASIVREIVKIVVALLIGIFIGRRMSTKLIR

SEQ ID NO: 90551 - DNA, 1254 bp, Leishmania major
  CDS (1)..(1254)
atgtctctcgtgctgaagaagagcatcgatgacgccaccgtcagggacaagaaggtgctcatccgcgtggacttcaacgtccccgtgaagaacggtaagatcacgaatgacttccgcattcgctccgcccttccgacgatccaaaaggtgctgaaggagggcggctcctgcatcctgatgagccaccttggtcggccgaagggtgcgagaatgagtgacccaagtccggagaagggtgtgcgcgggtacgaggaggccgccacgctgcgcccggttgctgcacgcatcgcggagctgctggggcagaaggtggagtttgcaccggactgcctggacgctgcggcgtacgcgtcgaagctgaagaacggcgacgtgctgttgctggagaacgtgcgtttctacgcggaggagggcagcaagaaggaggaggagcgcgacgcgatggcgaaggtactggcgtcgtacgcggacctgtatgtcagtgacgcctttggcactgcgcaccgcgacagcgcgacgatgacgggcatccccaaggtgctgggtgcgggctacgccgggtacctgatggagaaggagatcaactacttctcgcgagtgctgaacaacccgccgcggccgctggttgcgattgtcggcggtgcgaaggtcagcgacaagatcgagctgcttgacaacatgctgggccgcatcaactaccttgtgattggtggcgcgatggcgtacacgttccagaaggcgcagggccgcaagatcggcatctcgatgtgcgaggaggataagctggaccttgccaagtcgctgctgaagaaggcgcaagagcgcggtgtgcaggtgtttctgccagttgaccacgtgtgcaacaaggaatttaaggccgcggactcgccgctggtgacggagagcgtggacgtcccggacggctacatggcgctcgacattggcccaaggacgatccacatgtacgaggaagtgattggccgctgcaagagcgcgatctggaacggcccgatgggcgtgttcgagatgccgtgctactcgaagggcacatttgccgttgcgaaggcgatggggactggaacgcagaagaacgggctgctgagcatcatcggcggtggtgacagcgcgagcgctgcggagctgagcggcgaggcgaagaacatgtcgcatgtgtccaccggcggcggtgcgtccctggagctgctggagggcaagacgctgcctggcgtcgccattctgacggacagagaatga

SEQ ID NO: 90552 - protein, 417 aa, Leishmania major
MSLVLKKSIDDATVRDKKVLIRVDFNVPVKNGKITNDFRIRSALPTIQKVLKEGGSCILMSHLGRPKGARMSDPSPEKGVRGYEEAATLRPVAARIAELLGQKVEFAPDCLDAAAYASKLKNGDVLLLENVRFYAEEGSKKEEERDAMAKVLASYADLYVSDAFGTAHRDSATMTGIPKVLGAGYAGYLMEKEINYFSRVLNNPPRPLVAIVGGAKVSDKIELLDNMLGRINYLVIGGAMAYTFQKAQGRKIGISMCEEDKLDLAKSLLKKAQERGVQVFLPVDHVCNKEFKAADSPLVTESVDVPDGYMALDIGPRTIHMYEEVIGRCKSAIWNGPMGVFEMPCYSKGTFAVAKAMGTGTQKNGLLSIIGGGDSASAAELSGEAKNMSHVSTGGGASLELLEGKTLPGVAILTDRE

SEQ ID NO: 90553 - DNA, 1263 bp, Dictyostelium discoideum
  CDS (1)..(1263)
atgtcttcaaataaaattggtaataaattaagtcttgacaaggtagatgtaaaaggtaaaagagttttaattagagttgattataatgtaccattagataaaaataataatattacaagtactcaaagaattgatgcatcaattccaacattagaatattgtttaaagaatggtgctaaatcaattgtattgatgtcacatttaggtcgtccagatggtttggttaaaccagagtatagtttgaaaccagtggttaaagtattggaagatcaattaaaaagaccaattaaattcttatcagattgtgttggtgaacaagttgaaaaagaatgtgcaaatccagaggaaggtaccgttattttattggagaatctccgtttccacattgaagaggaaggttcaggtgttgatgcagagggtaaaaaggtcaaagccaacccagagaaagttaaagaattccgtgaatcactcaccaagctcggtgatgtctatgtgaacgatgcctttggtactgctcatagagcacatagttcaatggttggtattaatctcccacaaaaagccgctggtttcctcatgaaaaaagaattggaatactttgccaaggctttagagtcaccatcaaaaccattcttggcaattcttggcggtgcaaaggttagtgataaaattaaactcattgaaaaccttttgtataaagtcgatgaaatgatcattggtggtggtatggccttcactttcaagaaattcattgataacaaagagattggttcatcattgtttgagaaaacagccgaacaaatcaccaaagatatcattgccaaagccgctaaaaataatgtaaaattacatttcccagtcgattatgtcattgccgataaatttgataatgatgccaacatcaaaaccgtcactcaagatcaaggtatcccagaaggttggatgggtttagattgtggtccagagactatcaaagaaaacagagataccatctcaagagcaaaaaccatcgtttggaatggtcctatgggtgtatttgaaaagagcaatttcgaagccggtacaaaagctgccatggatgatgttgtcaatgccacaaccaatggtgctatcactatcattggtggtggtgataccgccacttgtgctgccaaatacaacactgaagataaagttagtcatgtctcaactggtggtggtgcttcattagaattattagaaggtaaagaattaccaggtgttactgctttatctgatttatga

SEQ ID NO: 90554 - protein, 420 aa, Dictyostelium discoideum
MSSNKIGNKLSLDKVDVKGKRVLIRVDYNVPLDKNNNITSTQRIDASIPTLEYCLKNGAKSIVLMSHLGRPDGLVKPEYSLKPVVKVLEDQLKRPIKFLSDCVGEQVEKECANPEEGTVILLENLRFHIEEEGSGVDAEGKKVKANPEKVKEFRESLTKLGDVYVNDAFGTAHRAHSSMVGINLPQKAAGFLMKKELEYFAKALESPSKPFLAILGGAKVSDKIKLIENLLYKVDEMIIGGGMAFTFKKFIDNKEIGSSLFEKTAEQITKDIIAKAAKNNVKLHFPVDYVIADKFDNDANIKTVTQDQGIPEGWMGLDCGPETIKENRDTISRAKTIVWNGPMGVFEKSNFEAGTKAAMDDVVNATTNGAITIIGGGDTATCAAKYNTEDKVSHVSTGGGASLELLEGKELPGVTALSDL

SEQ ID NO: 90555 - DNA, 1350 bp, Phaeodactylum tricornutum
  CDS (1)..(1350)
atgttgttccgtatgttgacttcaacggctttgcggcgttcaccagtaaccaccagcttgacctgttgctgtaaagcaaatgcttttgcagtccgaattcgtagctttcacgctgccccagtgatccaagccaaaatgacggtcgagcaactggcccagcaagtccatatgaaagggaccaatgttctcgtgcgcgttgatttgaatgcccccctggccacggatgatgtaacggtgacggatgacacacgcctgcgcgccattgttccaaccacgaaattcttgctcgagcagggagccaacgtgattctctgcagccattttggccgacccaagggtgaaattatcgaaactggcaagaatggtcggctcaacccagtggtgaagccgctcgaagtactgctggggcagacgattaccaaacttgatgattgcatgggaccggatgttgaagccgcaacgaaaaatttgggtgagggaaaggttgtcttgttggaaaacacccgtttttacagcggagaaaccaagaacgatccggaactcgcagccgggctcggaaaacttgctgattatttcgtcatggacgcctttggcacggctcaccgagcacattcttcgactgccggtgtgaccacccatatgaagttcaacgctgctggaaaacttatggagaaggaattgcaatacttgcaaggtgccgtggaagagcccaaacgccccatgatggctattgtcggtggtgccaaagtatccaccaaaattccggtcatcgaatcgcttttggacaagtgcgatgtcattttgattggcggcggtatgatctttaccttttacaaggctctcggttacgacattggcgcatcgctcgtggaagacgacattgtggaattggcgagttcattgatgaaaaaggccgaagaaaagggtgtcaaactgattctgcctgttgacgttgtcctggctgataagtttgacaatgatgcaaactcggccgtggcgaaggtcaccgacatttccggagactggatgggactggacattggaccggaaacgatcgatttgtttcgtagcgaaattgccgaagccaatacaattgtttggaacggtccgatgggcgtctttgaatttagcaactttgcggctggcaccaacgatgttgcccagatgctcgcccaagccactgccgaacggggcgccgtcaccataattggtggtggcgactctgtggccgccgtcaacaaagcgggtttgggtgacaaggtttctcacatttcgacgggcggtggcgccagtttggagcttctggagggcaaggtattgcccggcgttgcggctttgacagaagtgtaa

SEQ ID NO: 90556 - protein, 449 aa, Phaeodactylum tricornutum
MLFRMLTSTALRRSPVTTSLTCCCKANAFAVRIRSFHAAPVIQAKMTVEQLAQQVHMKGTNVLVRVDLNAPLATDDVTVTDDTRLRAIVPTTKFLLEQGANVILCSHFGRPKGEIIETGKNGRLNPVVKPLEVLLGQTITKLDDCMGPDVEAATKNLGEGKVVLLENTRFYSGETKNDPELAAGLGKLADYFVMDAFGTAHRAHSSTAGVTTHMKFNAAGKLMEKELQYLQGAVEEPKRPMMAIVGGAKVSTKIPVIESLLDKCDVILIGGGMIFTFYKALGYDIGASLVEDDIVELASSLMKKAEEKGVKLILPVDVVLADKFDNDANSAVAKVTDISGDWMGLDIGPETIDLFRSEIAEANTIVWNGPMGVFEFSNFAAGTNDVAQMLAQATAERGAVTIIGGGDSVAAVNKAGLGDKVSHISTGGGASLELLEGKVLPGVAALTEV

SEQ ID NO: 90557 - DNA, 1326 bp, Phaeodactylum tricornutum
  CDS (1)..(1326)
atgaaattcgttcaagctgccatcttcgccctcgctgcctcggccagtactactgctgcttttgcccctgccaaaacctttggtgtccgtagctttgccccggtttctctgatcgagctcgaagccaaggcctccattgaagacctcagcgatgccgagcttaagggaaagaaggttctcgtccgttgcgacgtcaacgtccccctggacggtaagaagatcaccgacgatacccgaattcgttcctccatccctaccattgagtacttgaagaacaagggtgccatcgtcagtgtctgctcacatttgggacgccccaaggacggccccgaagataagttctccctcggaccttgcgccgagcgcatgggggaactcctcggacaaactgtaaccctcgcacccgactgcatcggtgaagaagtcgccaagattgtcaatgatgccaaggaaggcgatgttatcatgctcgagaacacccgcttctacaaggaagagaccaagaacgacccggaattcgtcgaaaagcttgccgctccctttgacctgtacgtcaacgacgcctttggaacggcccaccgtgcccatgcctccaccgaaggtgtgaccaagttcctcaaaccttccgttggaggattcttgctcgccaaggaactcgaataccttgatggtgccattagcaacggaaagaaacccatggccgccattgtcggtggatccaaggtctcttccaagatcaccgtcctcgaagccctgctcgataaatgcgacaaggtcatcatcggaggtggtatggtattcaccttcctcaaggcaaagggattcaatgttggtacctccctcgtcgaggatgactttgtggataccgccaaggaagtcttggccaaggccgaaaagttgggcaaggaaatccttcttcccattgatatcgtgattgccgacaagttcgacgcggaagccgagaccaaggtcgtaagtgccgaagaaatccctgatggctggatgggtctggacaacggtcccgaaaccaccgcacagcagaaggaagcactttccgactgcaagactatcatcatgaacggtcccatgggagtctttgagttcgaaaagttcgccaagggaacttttgaccttgtcaacatccttgccgatctttccaaagacaagggtgccattactattatcggaggaggtgattccgttgccgccactgaacagagcggacgtgccggtgacatgtcacacatctccaccggcggtggtgccagtttggagctgttggaaggaaaggtcctccccggtgtggccgcgctcaacgacaaataa

SEQ ID NO: 90558 - protein, 441 aa, Phaeodactylum tricornutum
MKFVQAAIFALAASASTTAAFAPAKTFGVRSFAPVSLIELEAKASIEDLSDAELKGKKVLVRCDVNVPLDGKKITDDTRIRSSIPTIEYLKNKGAIVSVCSHLGRPKDGPEDKFSLGPCAERMGELLGQTVTLAPDCIGEEVAKIVNDAKEGDVIMLENTRFYKEETKNDPEFVEKLAAPFDLYVNDAFGTAHRAHASTEGVTKFLKPSVGGFLLAKELEYLDGAISNGKKPMAAIVGGSKVSSKITVLEALLDKCDKVIIGGGMVFTFLKAKGFNVGTSLVEDDFVDTAKEVLAKAEKLGKEILLPIDIVIADKFDAEAETKVVSAEEIPDGWMGLDNGPETTAQQKEALSDCKTIIMNGPMGVFEFEKFAKGTFDLVNILADLSKDKGAITIIGGGDSVAATEQSGRAGDMSHISTGGGASLELLEGKVLPGVAALNDK

SEQ ID NO: 90559 - DNA, 1263 bp, Trypanosoma brucei
  CDS (1)..(1263)
atgtcactaaaagagaggaagagcattaatgaatgcgatcttaagggaaagaaggttcttatccgtgttgactttaatgttcctctggatgatggtaatattaccaacgactaccgaatccgatcagctcttccagccgtccaaaaagttctcacagaaggcggcagttgtgttctcatgagccacctcgggaggccgaaaggcgtttctatggctgaaggcaaagaactgcggagcactggcggtattcccgggttcgagcagaaggcaacactcaaaccggtagccaagcgcctcagcgaattgttatcgagacccgtcacattcgcacctgactgcctgaatgctgcagatgtcgtctctaagatgtctccgggcgatgttgttctgcttgaaaatgtacgcttctacaaagaagagggcagcaagagcactgaggaacgtgaagccatggccaagatccttgcgtcatatggtgatgtttacatcagtgatgcttttggtacagctcaccgtgacagtgctaccatgaccggaattccaaagattttgggtcacggtgctgccggttatttgatggagaaggagatttcatacttcgctaaggtacttggtaacccgccgcgtccgctggttgctatcgttggtggagcgaaagtgagcgacaagatccaacttctggataacatgttgcagcgcatcgattatctcttaattggtggtgcaatggcatacacatttctgaaggctcagggttacagcattggaatatccatgtgcgaggaaagtaaacttgaatttgctcgatccctgctgaagaaggcggaggaccgcaaggtgcaggttattcttccaattgatcatgtttgccacacggaattcaaagctgtggattctccattgataactgaggatcaaaacatccctgaaggacatatggctctggatattggtcccaagactattgaaaaatatgttcagacgattgggaagtgtaagagcgccatttggaacggtcccatgggtgtatttgaaatggttccttattccaaaggtacatttgcaattgcgaaagccatgggtcgaggaactcacgagcatggactcatgagtatcatcggtggtggtgacagcgcaagtgcagctgagttgagcggtgaggcgaagcgcatgtctcatgtttcaactggtggtggtgcgtctttggaactcctcgagggcaaaacgcttcccggcgttacagtattggacgaaaaggagtaa

SEQ ID NO: 90560 - protein, 420 aa, Trypanosoma brucei
MSLKERKSINECDLKGKKVLIRVDFNVPLDDGNITNDYRIRSALPAVQKVLTEGGSCVLMSHLGRPKGVSMAEGKELRSTGGIPGFEQKATLKPVAKRLSELLSRPVTFAPDCLNAADVVSKMSPGDVVLLENVRFYKEEGSKSTEEREAMAKILASYGDVYISDAFGTAHRDSATMTGIPKILGHGAAGYLMEKEISYFAKVLGNPPRPLVAIVGGAKVSDKIQLLDNMLQRIDYLLIGGAMAYTFLKAQGYSIGISMCEESKLEFARSLLKKAEDRKVQVILPIDHVCHTEFKAVDSPLITEDQNIPEGHMALDIGPKTIEKYVQTIGKCKSAIWNGPMGVFEMVPYSKGTFAIAKAMGRGTHEHGLMSIIGGGDSASAAELSGEAKRMSHVSTGGGASLELLEGKTLPGVTVLDEKE

SEQ ID NO: 90561 - DNA, 1323 bp, Trypanosoma brucei
  CDS (1)..(1323)
atgacccttaacgagaagaagagcattaatgaatgcgatcttaagggaaagaaggttcttatccgtgttgactttaatgttcccgtgaaaaacggtaagatcaccaacgactaccgaatccgatcagctctgccaacgctcaagaaggttctcacagaaggcggcagttgtgttctcatgagccacctcgggaggccgaaaggtattcccatggcgcaagctgacaaaatacggagcactggcggtgttcccgggttccaacagaaggcaacactcaaaccggtagccaagcgcctcagcgaactgctattgaggcccgtcacattcgcacctgactgcctgaatgctgcagatgtcgtctctaagatgtctccgggcgatgttgttctgcttgaaaatgtacgcttttacaaagaagagggcagcaagaaggcaaaagaacgtgaagccatggccaagatccttgcgtcatatggtgatgtttacatcagtgatgcttttggtacagctcaccgtgacagtgctaccatgaccggaattccaaagattttgggcaacggtgctgccggttatttgatggagaaggagatttcatacttcgctaaggtacttggtaacccgccgcgtccgctggttgctatcgttggtggagcgaaagtgagcgacaagatccaacttctggataacatgttgcagcgcatcgattatctcttaattggtggtgcaatggcatacacatttctgaaggctcagggttacagcattggaaaatcgaagtgcgaggaaagtaaacttgaatttgctcgatccctgctgaagaaggcggaggaccgcaaggtgcaggttattcttccaattgatcatgtttgccacacggaattcaaagctgtggattctccattgataactgaggatcaaaacatccctgaaggacatatggctctggatattggtcccaagactattgaaaaatatgttcagacgattgggaagtgtaagagcgccatttggaacggtcccatgggtgtatttgaaatggttccttattccaaaggtacatttgcaattgcgaaagccatgggtcgaggaactcacgagcatggactcatgagtatcatcggtggtggtgacagcgcaagtgcagctgagttgagcggtgaggcgaagcgcatgtctcatgtttcaactggtggtggtgcgtctttggaactcctcgagggcaaaacgcttcccggcgttgcagtattggacgaaaagtcggcggttgtgtcgtatgcctctgcaggtactggaactctttctaaccggtggagctctctttaa

SEQ ID NO: 90562 - protein, 440 aa, Trypanosoma brucei
MTLNEKKSINECDLKGKKVLIRVDFNVPVKNGKITNDYRIRSALPTLKKVLTEGGSCVLMSHLGRPKGIPMAQADKIRSTGGVPGFQQKATLKPVAKRLSELLLRPVTFAPDCLNAADVVSKMSPGDVVLLENVRFYKEEGSKKAKEREAMAKILASYGDVYISDAFGTAHRDSATMTGIPKILGNGAAGYLMEKEISYFAKVLGNPPRPLVAIVGGAKVSDKIQLLDNMLQRIDYLLIGGAMAYTFLKAQGYSIGKSKCEESKLEFARSLLKKAEDRKVQVILPIDHVCHTEFKAVDSPLITEDQNIPEGHMALDIGPKTIEKYVQTIGKCKSAIWNGPMGVFEMVPYSKGTFAIAKAMGRGTHEHGLMSIIGGGDSASAAELSGEAKRMSHVSTGGGASLELLEGKTLPGVAVLDEKSAVVSYASAGTGTLSNRWSSL

SEQ ID NO: 90563 - DNA, 1164 bp, Pseudomonas sp
  CDS (1)..(1164): transl_table=11
atgaccgtgttgaagatgaccgacctcgatctgcaaggtaagcgcgtgctgatccgcgaagacctcaacgtcccagtcaaggacggtgttgtcaccagcgatgcgcgcatccttgcttcgctgccgaccatcaagctggcgttggaaaaaggcgcggcagtcatggtctgctcgcacctgggccgtccgactgaaggcgagttttcagcagaaaacagcctcaagcctgttgctgattacttgagcaaggcgctgggccgtgaagtgccgctggtgagcgactacctcaatggcgtggacgttaaagccggcgacatcgtgctgttcgaaaacgtgcgcttcaacaaaggcgaaaagaaaaacgctgacgaattggccaagcaatacgcggccctgtgcgacgtgtttgtgatggatgcctttggcactgcacaccgcgccgaaggtccgacccacggcgtggccaagttcgccaaagtggcggctgcgggcccgttgctggcggcggaactggacgcactgggcaaagccctgggtgctccggccaagccaatggctgcgattgttgcaggctccaaggtgtcgaccaaacttgacgtactcaacagcctgagccagatctgcgacctgctgatcgttggcggtggcattgccagcacgttcctcgcggcggccggtcatccggtgggcaagtcgctgtacgagcctgatttgctggacaccgcgcgtgccatcgccgccaaggtcaacgtgccgttgcctaccgatgtggtcgtggccaaggaatttgctgaaagcgccgaagccaccgtcaagctgattgctgacgtggcagcagacgacatgattctggatatcggcccacaaacagccgagcacttcgcgcagctgttgaagacctcgaagactatcctgtggaacggacctgtcggcgtgttcgagttcgatcagttcggcaacggtaccaaagtgctggccaaggccatcgccgacagcgctgcattttctattgcaggcggcggcgacacattggcggccatcgacaagtacggtgtggccgatcaaatttcctacatctccaccggtggcggtgcattccttgagttcgttgaaggcaaagtgctgcctgctgtagaagtgctggaaagccgcgccaaagcctga

SEQ ID NO: 90564 - protein, 387 aa, Pseudomonas sp
MTVLKMTDLDLQGKRVLIREDLNVPVKDGVVTSDARILASLPTIKLALEKGAAVMVCSHLGRPTEGEFSAENSLKPVADYLSKALGREVPLVSDYLNGVDVKAGDIVLFENVRFNKGEKKNADELAKQYAALCDVFVMDAFGTAHRAEGPTHGVAKFAKVAAAGPLLAAELDALGKALGAPAKPMAAIVAGSKVSTKLDVLNSLSQICDLLIVGGGIASTFLAAAGHPVGKSLYEPDLLDTARAIAAKVNVPLPTDVVVAKEFAESAEATVKLIADVAADDMILDIGPQTAEHFAQLLKTSKTILWNGPVGVFEFDQFGNGTKVLAKAIADSAAFSIAGGGDTLAAIDKYGVADQISYISTGGGAFLEFVEGKVLPAVEVLESRAKA

SEQ ID NO: 90565 - DNA, 1239 bp, Methanosarcina acetivorans
  CDS (1)..(1239): transl_table=11
atgtctcagaaaactgctggaaaggattatttaactatggatgatgttgaactggataacaaaagaatacttttaagagtggactttaattcacctatggatgctaatggaaacatcctggatgatagaaaaattaagagccatttgtatacattgcggtccttggagaactcaagagtagttatgatgtctcatcagggtagacccggagataaggactatacaactctggaagctcatgcaaagctggcgacagaacttctgggcaggaaagtaacctatgaggatgacatattcagcgcttgcgcaaggaatgccataaaatcccttgagaaaggagatatcttgctccttgagaacacacgtttctatgccgaagagaacatgaatcgtgctcctgaagaacaggccagaacccagatggtacggaagctgtatcctttatttgatgtatttataaatgatgccttttcagtttctcacaggtctcaatgttctgtggtagggtttacagaggttttgcccagtgttgccggtatcctcatggatagggaaattacaggcctggacaaaggcttgaaatgtcatgaacatccggcagtcttcgcgctgggaggaacaaaagccaaagatatcgttaaggtcatttctgatattctcaagcggggtggcgctgacagaatccttactaccggggttgtagctacagtattcatgatggctataggcatcgaggtaggcgaggtcaacaggaaattcattgaggaccataaatatctggaccaggtttctatcgcttccaggctgctcaaggaatattcaggcaagatcatagtgcctaaggatatagcgctaaacaatgacggaaaacgtgaggaagtcaaagtggacaagataaagggagatcttccaatagctgatattggcccggagacaatatcagattattctaagtttcttaaagaagcaaagttaagcgtttttcacggcccggctggtattttcgagttagagagtttcaggctaggcaccgaagaacttcttaaagctgcagctcaatcaaattactctattgcaggaggagggcataccctagccgccattgatcaacttggcctggaatcaaaatattcccacttaagcatgggtggaggtgcgagcataacctatctctctggcgagcacatgccaggaattgaggctctaaaaaattatgcatccaggtgctgtaaagattaa

SEQ ID NO: 90566 - protein, 412 aa, Methanosarcina acetivorans
MSQKTAGKDYLTMDDVELDNKRILLRVDFNSPMDANGNILDDRKIKSHLYTLRSLENSRVVMMSHQGRPGDKDYTTLEAHAKLATELLGRKVTYEDDIFSACARNAIKSLEKGDILLLENTRFYAEENMNRAPEEQARTQMVRKLYPLFDVFINDAFSVSHRSQCSVVGFTEVLPSVAGILMDREITGLDKGLKCHEHPAVFALGGTKAKDIVKVISDILKRGGADRILTTGVVATVFMMAIGIEVGEVNRKFIEDHKYLDQVSIASRLLKEYSGKIIVPKDIALNNDGKREEVKVDKIKGDLPIADIGPETISDYSKFLKEAKLSVFHGPAGIFELESFRLGTEELLKAAAQSNYSIAGGGHTLAAIDQLGLESKYSHLSMGGGASITYLSGEHMPGIEALKNYASRCCKD

SEQ ID NO: 90567 - DNA, 1254 bp, Rhizopus niveus
  CDS (1)..(1254)
atgtctttatctaacaagctctctattcgcgacctcaacctcaaggacaaacgtgttcttattcgtgttgattttaatgttcccatgaaagacggtgccattaccaacaacaatcgtatcgttcaagctcttcctaccgtaaaatatgctcttgacaatggtgcctctgctgtcatcttaatgtctcacttgggtcgccctaacggtgaagctgtcgccaaatattctctcaaaccagtggctgctgaggttgaaaagcttttgggaaaacctgtcgaattcctcaacgactgcgtgggccctgatgtcgaaaaggcatgccaatccgccaaggacggtaaggttatccttttagaaaatcttcgtttccatatcgaagaagaaggttctgccaaggttgatggtcaaaaggttaaggctgatgctgaagcaatcaaaaaattccgtgcatctttgactactcttgctgatatatacatcaatgatgcctttggtactgctcaccgtgctcactcttccatggttggtgttgacctttctcaacgtgcagccggtttccttatgcaaaaggagcttgaatactttgcaaaggcactcgaaaatccctctcgcccttttcttgctatccttggtggtgccaaagtttctgataaaattcaattgattgaaaatatgcttgataaggtaaatgctttgattatctgtggtggtatggctttcactttcaaaaagacacttgataatgttaaaattggcaagtctctttttgatgaacctggttctaaattagtacaaaatcttgtaaaaaaagctgctgaaaagaatgtcaagattgtttttcctgttgactttatcactgctgataagtttgctcctgatgccagcacaggctatgccactgatgatgatggtatccctgatggatggcaaggccttgactgcggtgagcgatcaaacaaattattccgtgaggaaattttaaagtcaaagacaattgtctggaacggcccttctggtgtatttgaattcgatgccttctctagcggtaccaaggctgtccttgatgctgttattaatgctacaaaggaaggtgctactactattattattggtggaggtgacactgctactgctgctctcaaatggggtgctgaaggtcaagtctctcatatttctactggtggcggtgcctctcttgaacttcttgagggcaaggagcttcctggtgttactgctctttccagcaagaactaa

SEQ ID NO: 90568 - protein, 417 aa, Rhizopus niveus
MSLSNKLSIRDLNLKDKRVLIRVDFNVPMKDGAITNNNRIVQALPTVKYALDNGASAVILMSHLGRPNGEAVAKYSLKPVAAEVEKLLGKPVEFLNDCVGPDVEKACQSAKDGKVILLENLRFHIEEEGSAKVDGQKVKADAEAIKKFRASLTTLADIYINDAFGTAHRAHSSMVGVDLSQRAAGFLMQKELEYFAKALENPSRPFLAILGGAKVSDKIQLIENMLDKVNALIICGGMAFTFKKTLDNVKIGKSLFDEPGSKLVQNLVKKAAEKNVKIVFPVDFITADKFAPDASTGYATDDDGIPDGWQGLDCGERSNKLFREEILKSKTIVWNGPSGVFEFDAFSSGTKAVLDAVINATKEGATTIIIGGGDTATAALKWGAEGQVSHISTGGGASLELLEGKELPGVTALSSKN

SEQ ID NO: 90569 - DNA, 1263 bp, Trypanosoma congolense
  CDS (1)..(1263)
atgacgctgaacgagaagaagagcattaacgagtgtgaccttaaggggaagaagacccttgtccgcgttgacttcaatgtccccgtgaaaggcggggtgatcaccaacgactatcgcatccggtcagcacttccaacaattcaaaaggtactgaatgagggtggcagctgcatcctgatgagccacctgggcaggccgaaggggatttcgatctctgaggccgccgcggtgcgcagcgctggtaaggtgcccggctacgaggaggcggctaccctacggcctgttgcacaaaggctcggcgagcttctgtcgaagcctgtcgtgttcgcacccgactgtttggacgccgctgatgtcgtcaagaagatgtctcctggagatgttgtactgttggagaatgtgcgcttctaccgcgaggagggcagcaagaaggaggaggagcgcgaggccatggccaaggtcctcgcgtcctacggtgatatcttcgtgagcgacgcctttggcaccgcgcaccgtgacagcgccacgatgacgggcatcccgaaggtgcttgggcacggcgctgctggttacctgatggagaaggagatctcgtacttctccaaggtgcttggcaacccgccgcgtccactggtggcgattgttggcggctcgaaggtgagcgataagattcagctgcttgacaatatgctgcagcgaatcgactacctgttgattggcggggcgatggcgtacaccttcttgaaggcacaaggccaccgcattggcacctcgatgtgtgaggaggacaggctggacctcgcacggtcgctgctgaagaaggctgaggaccgcaaagtgcaggtgctgctgccggtggaccacgtgtgccacacggagttcaaggcagttgatacgcctgtggtgacggctgatgccgatatcccggatggccacatggcactggacattggccccaagacaattgcgaattatgttgagacgattggtaaatgcaagagtgcgatttggaatggccccatgggcgtgtttgaaatgacgccgtactcgaagggcacgtttgctgttgccaaggcgatgggcgactgcactcaaaagaacggactgatgagcatcatcggtggcggtgacagtgcgagtgctgctgagcagagcggtgaagcgacgcgcatgtcacacgtgtccactggtggcggtgcctcactggagctgcttgagggcaaaacgctcccaggcgtcgccatattggatgagaaagtatga

SEQ ID NO: 90570 - protein, 420 aa, Trypanosoma congolense
MTLNEKKSINECDLKGKKTLVRVDFNVPVKGGVITNDYRIRSALPTIQKVLNEGGSCILMSHLGRPKGISISEAAAVRSAGKVPGYEEAATLRPVAQRLGELLSKPVVFAPDCLDAADVVKKMSPGDVVLLENVRFYREEGSKKEEEREAMAKVLASYGDIFVSDAFGTAHRDSATMTGIPKVLGHGAAGYLMEKEISYFSKVLGNPPRPLVAIVGGSKVSDKIQLLDNMLQRIDYLLIGGAMAYTFLKAQGHRIGTSMCEEDRLDLARSLLKKAEDRKVQVLLPVDHVCHTEFKAVDTPVVTADADIPDGHMALDIGPKTIANYVETIGKCKSAIWNGPMGVFEMTPYSKGTFAVAKAMGDCTQKNGLMSIIGGGDSASAAEQSGEATRMSHVSTGGGASLELLEGKTLPGVAILDEKV

SEQ ID NO: 90571 - DNA, 1254 bp, Rhizopus niveus
  CDS (1)..(1254)
atgtctttatctaacaaactttctatccgtgaccttgacctcaagaataagcgtgtccttattcgtgttgacttcaacgttcccatgaaggatggtgctatcaccaacaacaaccgtattgttcaagctcttcctactgtcaagtatgctcttgacaatggtgcttctgctgtcatcttgatgtctcacttgggtcgtcctaacggtgaagctgttgccaagtactctcttaagcccgttgctgctgaagtggagaagcttttgggtaagcccgtcgaattcctcaacgactgtgtaggtcccgatgtcgaaaaggcctgtcaatctgctactggtggtaaggtcatccttttggaaaaccttcgtttccacatcgaagaagaaggttctgccaaggtccgatggtcaaaggtcaaggcagatgctgaagctgtcaaaaagttccgtgcatctttgactgctcttgctgatatctatgtcaatgatgccttcggtaccgctcaccgtgctcactcttctatggtcggtgttgacctttctcaacgtgctgctggtttccttatgcaaaaagaactcgagtactttgccaaggctctcgaaaatcccgctcgtcctttccttgctatcctcggtggtgccaaggtctccgataagatccaattgattgaaaacatgcttgacaaggtaaacgctttgattgtctgtggtggtatggctttcactttcaagaagacgcttgataacgtcaagcagattggtaagtctctctttgatgaagctggttccaagttggtacgaaaccttgtcaagaaggccgccgaaaagaacgtcaaactcgttttccctgttgactttgtcactgctgataaattcgctcctgatgctaacactggttatgcaaccgatgctgatggtattcctgatgaatgggaaggccttgactgtggtaaaaaatcctccgagttgttccgtgaagaaatcttgaagtccaagaccatcgtctggaacggtccctctggtgtattcgaattcgatgcttttgctaatggtaccaagtctgttcttaatgctgtcatcgaagctacaaaggaaggtgctactacaatcattggtggtggtgacactgctactgctgctctcaagtggggtgctgaaggtaaagtttctcacatctctactggtggtggtgcctctcttgaactcctcgaaggcaaagaacttcctggtgtcaccgctctttctagcaagaattaa

SEQ ID NO: 90572 - protein, 417 aa, Rhizopus niveus
MSLSNKLSIRDLDLKNKRVLIRVDFNVPMKDGAITNNNRIVQALPTVKYALDNGASAVILMSHLGRPNGEAVAKYSLKPVAAEVEKLLGKPVEFLNDCVGPDVEKACQSATGGKVILLENLRFHIEEEGSAKVRWSKVKADAEAVKKFRASLTALADIYVNDAFGTAHRAHSSMVGVDLSQRAAGFLMQKELEYFAKALENPARPFLAILGGAKVSDKIQLIENMLDKVNALIVCGGMAFTFKKTLDNVKQIGKSLFDEAGSKLVRNLVKKAAEKNVKLVFPVDFVTADKFAPDANTGYATDADGIPDEWEGLDCGKKSSELFREEILKSKTIVWNGPSGVFEFDAFANGTKSVLNAVIEATKEGATTIIGGGDTATAALKWGAEGKVSHISTGGGASLELLEGKELPGVTALSSKN

SEQ ID NO: 90573 - DNA, 1518 bp, Crithidia fasciculata
  CDS (1)..(1518)
atgctcctctccacgcaatcgattcccataaaaaagagcgtcgacgacatctggccggtggcaggcaaacgcgttctcattcgggtggacttcaacgtgcccaccagctctggcggcatcgacgacgacttccgcattcgctctgctatccccactattcgccgcatcgttgaccagggtggcatctgcatcctcatcagccacctcggccgccccaccggtgtggactacgacaccgcccatgcagagcaggaaaagcgccagacaccggtgcagctgcccaattcgcgtggcaagaccgccttcttctctgggctgcgtggcgatgcgaaggcgacgatcttggcgtggtcgagtcagcgagagaaggctgcaacgctctccaacccgtacggcagtggcaagacggccgtctttgcgcgcctgccagaggaagagaagcggcgcctgctgctgcgcttcatgagtgagcacaaggaggagctcttcccccagctcggctccgcgggctacgagaaggagttcagcttggagccggtggcggtgaagctggcggagctgctggatcagcacgtgtactttggccacgactgcctcggcgcgcaagcggatattgcaaagctgcggtgtggggaggtgatgctgctggagaaccttcgcttctacacgaacgagaactcatctgacgagcgcaagcgcatgctgatggcgcgtattctcgcctcgtatgccgatgtgtacatcaacgacgccttcggcacggcgcaccgcgacagcgcgagtttgacgggcatcccccgcgtgctgcagcagggtgcggccggctacctgatggagaaggagatctcgtacttctccaaggtgctgaacaacccaccccggccgctcttggcgattatcggcggcgcgaagctcagcgacaagatgcaggtgctggagaacctgctggactgcgtcgacagcctcttcatcggtggtggcttggcgtacacgtttctccggtctcagggctactcgatcggcacgtcccacttcgaggaggcttttgtgcccttcgcccaagcgcttcctctcgctggcagcggacggcaggtgcgggtggtgctgccagaggaccacgtctgccacgcccacacgcggccggccgaagcgccgctcacgacgacgagtgccaatataccggacggctacgcagggctggacattggcccgctcaccatccaatccatcacgcacctcgtgcggcagtgcagcagcgtgatctggaacggaccacttggcatgttcgagatgccatactacgccttcggcacgttttccattgcgcgagtggtgagtcagtcttcggctgcgaagggcactaccagcatcgtcggcggtggcgacacggcgagcgcgatgatgaagtccggcgaggcggctcacatttcgcacatctccacaggcggcaacgcatcgctggagctgctggaggggaaggtgctagccgccgtggcggtgctggacaacaaggagtga

SEQ ID NO: 90574 - protein, 505 aa, Crithidia fasciculata
MLLSTQSIPIKKSVDDIWPVAGKRVLIRVDFNVPTSSGGIDDDFRIRSAIPTIRRIVDQGGICILISHLGRPTGVDYDTAHAEQEKRQTPVQLPNSRGKTAFFSGLRGDAKATILAWSSQREKAATLSNPYGSGKTAVFARLPEEEKRRLLLRFMSEHKEELFPQLGSAGYEKEFSLEPVAVKLAELLDQHVYFGHDCLGAQADIAKLRCGEVMLLENLRFYTNENSSDERKRMLMARILASYADVYINDAFGTAHRDSASLTGIPRVLQQGAAGYLMEKEISYFSKVLNNPPRPLLAIIGGAKLSDKMQVLENLLDCVDSLFIGGGLAYTFLRSQGYSIGTSHFEEAFVPFAQALPLAGSGRQVRVVLPEDHVCHAHTRPAEAPLTTTSANIPDGYAGLDIGPLTIQSITHLVRQCSSVIWNGPLGMFEMPYYAFGTFSIARVVSQSSAAKGTTSIVGGGDTASAMMKSGEAAHISHISTGGNASLELLEGKVLAAVAVLDNKE

SEQ ID NO: 90575 - DNA, 1254 bp, Crithidia fasciculata
  CDS (1)..(1254)
atgtctctcgccccgaagaagacgatcgatgatgccgtggtgaagggcaagaaggtcctcatccgtgtggacttcaacgtgccggtgaagaacggcgagatcacgaacgacttccgcatccgctccgccctgccgacgatccagaaggtgctgaaggagggcggctcctgcatcctgatgagccacctcggccgcccgaagggtgcgaagatgagcgacccgaagccggccaagagcgtgcgcgggtacgaggaggctgcgacgctgcggccggtggctgcgcggctgtcggagctgctggggcagaaggtggagttcgcgccggactgcctggacgctgcgtcgtacgctgctaagctgaagggcggcgacgtgctgctgctggagaacgtgcgcttctacgcggaggagggcagcaagaaggaggaggagcgcgacgcgatggcgaaggtgcttgcggcgtacggcgacgtgtacgtgagcgacgccttcggcactgcgcaccgcgacagcgcggacatgacgggcatcccgaaggtgctgggtgcgggctacgccggctacctgatggagaaggagatcaactacttcgcgcaggtgctgaacaacccgccgcgtccgctggtggccatcgtgggcggtgcgaaggttagcgacaagatccagctgctggacaacatgctgggccgcatcaactacctggtgattggcggcgcgatggcgtacacgttccagaaggcgcagggccacgcgatcggcatctcgatgtgcgaggaggacaagctggaccttgccaagtcgctgctgaagaaggcgcaggagcgcaacgtggaggtgcttctgccggtggaccacgtgtgcaacaaggagttccaaggcgtggacgcgccgctggtgacgaaggacgtggagatcccggaggggtacatggcgctggacattggcccgaagacgatcaagatctacgaggacgtgattgccaagtgcaagagcacgatctggaacggcccgatgggtgtgttcgagatgccgtgctactcgaagggcacgttcgctgtggccaaggcgatgggcaacgggacgcagaagaacgggctgatgagcatcatcggcggcggcgacacggcgagcgctgcggagctgagcggggaggcgaagaacatgtcgcacgtgtcgactggcggcggcgcctcgctggagctgctggagggcaagtcgctgccgggtgtcaccgttctcaccaacaaggagtag

SEQ ID NO: 90576 - protein, 417 aa, Crithidia fasciculata
MSLAPKKTIDDAVVKGKKVLIRVDFNVPVKNGEITNDFRIRSALPTIQKVLKEGGSCILMSHLGRPKGAKMSDPKPAKSVRGYEEAATLRPVAARLSELLGQKVEFAPDCLDAASYAAKLKGGDVLLLENVRFYAEEGSKKEEERDAMAKVLAAYGDVYVSDAFGTAHRDSADMTGIPKVLGAGYAGYLMEKEINYFAQVLNNPPRPLVAIVGGAKVSDKIQLLDNMLGRINYLVIGGAMAYTFQKAQGHAIGISMCEEDKLDLAKSLLKKAQERNVEVLLPVDHVCNKEFQGVDAPLVTKDVEIPEGYMALDIGPKTIKIYEDVIAKCKSTIWNGPMGVFEMPCYSKGTFAVAKAMGNGTQKNGLMSIIGGGDTASAAELSGEAKNMSHVSTGGGASLELLEGKSLPGVTVLTNKE

SEQ ID NO: 90577 - DNA, 1266 bp, Trypanosoma brucei brucei
  CDS (1)..(1266)
atgtcactaaaagagaggaagagcattaacgaatgcgatcttaagggaaagaaggttcttatccgtgttgactttaatgttcctctggatgatggtaatattaccaacgactaccgaatccgatcagctctgccagccgtccaaaaagttctcacagaaggcggcagctgtgttctcatgagccacctcgggaggccgaaaggcgtttctatggctgaaggcaaagaactggggagcgctggcggtattcccgggttcgagcagaaggcaacactcaaaccggtagccaaggccctcagcgaattgttatcgagacccgtcacattcgcacctgactgtctgaacgctgcagatgtcgtctctaagatgtctccgggcgatgttgttctgcttgaaaatgtacggttctacaaagaagagggcagcaagaagagcactgaggaacgtgaagccatggccaagatcctttcgtcatatggtgatgtttacatcagtgatgcttttggtacagctcaccgtgacagtgctaccatgaccggaattccaaagattttgggcaacggtgctgccggttatttgatggagaaggagatttcatacttcgctaaggtacttggtaacccgccgcgtccgctggttgctatcgttggtggagcgaaagtgagcgacaagatccaacttctggataacatgttgcagcgcatcgattatctcttaattggtggtgcaatggcatacacatttctgaaggctcagggttacagcattggaatatccatgtgcgaggaaagtaaacttgaatttgctcgatccctgctgaagaaggcggaggaccgcaaggtgcagattattcttccaattgatcatgtttgccacacggaattcaaagctgtggattctccattgataactgaggatcaaaacatccctgaaggacatatggctctggatattggtcccaagactattgaaaaatatgttcagacgattgggaagtgtaagagcgccatttggaacggtcccatgggtgtatttgaaatggttccttattccaaaggtacatttgcaattgcgaaagccatgggtcgaggaactcacgagcatggactcatgagtatcatcggtggtggtgacagcgcaagtgcagctgagttgagcggtgaggcgaagcgcatgtctcatgtttcaacgggtggtggtgcgtctttggaactcctcgagggcaaaacgcttcccggtgttacagtattggatgataaggagtaa

SEQ ID NO: 90578 - protein, 421 aa, Trypanosoma brucei brucei
MSLKERKSINECDLKGKKVLIRVDFNVPLDDGNITNDYRIRSALPAVQKVLTEGGSCVLMSHLGRPKGVSMAEGKELGSAGGIPGFEQKATLKPVAKALSELLSRPVTFAPDCLNAADVVSKMSPGDVVLLENVRFYKEEGSKKSTEEREAMAKILSSYGDVYISDAFGTAHRDSATMTGIPKILGNGAAGYLMEKEISYFAKVLGNPPRPLVAIVGGAKVSDKIQLLDNMLQRIDYLLIGGAMAYTFLKAQGYSIGISMCEESKLEFARSLLKKAEDRKVQIILPIDHVCHTEFKAVDSPLITEDQNIPEGHMALDIGPKTIEKYVQTIGKCKSAIWNGPMGVFEMVPYSKGTFAIAKAMGRGTHEHGLMSIIGGGDSASAAELSGEAKRMSHVSTGGGASLELLEGKTLPGVTVLDDKE

SEQ ID NO: 90579 - DNA, 1242 bp, Alcaligenes eutrophus
  CDS (1)..(1242): transl_table=11
atgatgagcctatcccatgctacgaacccgcaaccgaaacccgcggcggcgccgcacacgctggccgcactgcttgcagccggtggactggctggcaagcgggtcttcatccgcgccgacctcaacgtcccgcaggatgcagcgggcgctatcaccgacgatacccgcatccgggcttccgtgcccgccatcgcggcctgcctgcaggcgggcgccgcggtgatggtcacctcgcacctgggccggccgcaggagggggcgcccgacccgcgccacagcctggcgccggtgggccgccgcctgtccgaactgctgggccgccaggtgccgctcttgtccggctggaccgagggcggcttccaggtgccgcccgggcaggtggtgctgctggaaaactgccgcatgaacacgggcgagaagaagaacagcgacgaactggcgcagaaaatggcggcgctgtgcgatgtctacgtcaacgacgcgttcggcaccgcccaccgcgccgaggcgaccacgcatggcatcgccaggtacgcccccattgcctgcgccggcccgctgctggccgccgagatcgacgcgctgggcaaggcgctgggccagccggcgcgtccgctggtggcgatcgtggccggctccaaggtctcgaccaagctgaccatcctgaagtcgctggccgacaaggtcgacaacctgatcgtcggcggcggcattgccaataccttcatgctggccgccggcctgaagatcggcaagtcgctggccgagcctgacctgctggccgatgccagggccatcatcgacatcatggccaggcgtggcgcctcggtgccgattccggtcgacgtggtgtgcgccaaggaattcagcgccactgccgcggccaccgtcaaggacgtcaaggacgtggccgacgacgacatgatcctggacatcggccccaagaccgccgcgatgctggccgagcagctcaaggccgccggcaccatcgtctggaacggcccggtgggcgtgttcgagttcgaccagttcggcaacggcaccagggtgctggcccaggccatcgctgaatcgaaggcgttctcgatcgccggcggcggcgacacgctggccgcgatcgccaagcacggcattgccgaccgcgtgggctatatctcgaccggcggcggcgcgttcctggaattcctggagggcaagacgctgcccgcgctggccgtgctggcacagcgcgccgctgcctga

SEQ ID NO: 90580 - protein, 413 aa, Alcaligenes eutrophus
MMSLSHATNPQPKPAAAPHTLAALLAAGGLAGKRVFIRADLNVPQDAAGAITDDTRIRASVPAIAACLQAGAAVMVTSHLGRPQEGAPDPRHSLAPVGRRLSELLGRQVPLLSGWTEGGFQVPPGQVVLLENCRMNTGEKKNSDELAQKMAALCDVYVNDAFGTAHRAEATTHGIARYAPIACAGPLLAAEIDALGKALGQPARPLVAIVAGSKVSTKLTILKSLADKVDNLIVGGGIANTFMLAAGLKIGKSLAEPDLLADARAIIDIMARRGASVPIPVDVVCAKEFSATAAATVKDVKDVADDDMILDIGPKTAAMLAEQLKAAGTIVWNGPVGVFEFDQFGNGTRVLAQAIAESKAFSIAGGGDTLAAIAKHGIADRVGYISTGGGAFLEFLEGKTLPALAVLAQRAAA

SEQ ID NO: 90581 - DNA, 1368 bp, Crithidia fasciculata
  CDS (1)..(1368)
atgtctctcgttccgaagaagagcatcgatgatgccgtggtgaagggcaagaaggtcctcatccgtgtggacttcaacgtgccggtgaagaacggcgagatcacgaacgacttccgcatccgctccgccctgccgacgatccagaaggtgctgaaggagggcggctcctgcatcctgatgagccacctcggccgcccgaagggtgcgaagatgagcgacccgaagccggccaagagcgtgcgcgggtacgaggaggctgcgacgctgcggccggtggctgcgcggctgtcggagctgctggggcagaaggtggagttcgcgccggactgcctggacgctgcgtcgtacgctgctaagctgaagggcggcgacgtgctgctgctggagaacgtgcgcttctacgcggaggagggcagcaagaaggaggaggagcgcgacgcgatggcgaaggtgcttgcggcgtacggcgacgtgtacgtgagcgacgccttcggcactgcgcaccgcgacagcgcggacatgacgggcatcccgaaggtgctgggtgcgggctacgccggctacctgatggagaaggagatcaactacttcgcgcaggtgctgaacaacccgccgcgtccgctggtggccatcgtgggcggtgcgaaggttagcgacaagatccagctgctggacaacatgctgggccgcatcaactacctggtgattggcggcgcgatggcgtacacgttccagaaggcgcagggccacgcgatcggcatctcgatgtgcgaggaggacaagctggaccttgccaagtcgctgctgaagaaggcgcaggagcgcaacgtggaggtgcttctgccggtggaccacgtgtgcaacaaggagttccaaggcgtggacgcgccgctggtgacgaaggacgtggagatcccggaggggtacatggcgctggacattggcccgaagacgatcaagatctacgaggacgtgattgccaagtgcaagagcacgatctggaacggcccgatgggtgtgttcgagatgccgtgctactcgaagggcacgttcgctgtggccaaggcgatgggcaacgggacgcagaagaacgggctgatgagcatcatcggcggcggcgacacggcgagcgctgcggagctgagcggggaggcgaagaacatgtcgcacgtgtcgactggcggcggtgcctcgctggagctgctggagggcaagtcgctgccgggcgtcaccgttctcaccaacaaggacgcgaaggcgcctgctgctgctgccgctgccggtggtgactgcccgtgcggttccggctgcgctgcggttcccgccgcagccacggcaacggtttcgatggtgctcgcctcgccatga

SEQ ID NO: 90582 - protein, 455 aa, Crithidia fasciculata
MSLVPKKSIDDAVVKGKKVLIRVDFNVPVKNGEITNDFRIRSALPTIQKVLKEGGSCILMSHLGRPKGAKMSDPKPAKSVRGYEEAATLRPVAARLSELLGQKVEFAPDCLDAASYAAKLKGGDVLLLENVRFYAEEGSKKEEERDAMAKVLAAYGDVYVSDAFGTAHRDSADMTGIPKVLGAGYAGYLMEKEINYFAQVLNNPPRPLVAIVGGAKVSDKIQLLDNMLGRINYLVIGGAMAYTFQKAQGHAIGISMCEEDKLDLAKSLLKKAQERNVEVLLPVDHVCNKEFQGVDAPLVTKDVEIPEGYMALDIGPKTIKIYEDVIAKCKSTIWNGPMGVFEMPCYSKGTFAVAKAMGNGTQKNGLMSIIGGGDTASAAELSGEAKNMSHVSTGGGASLELLEGKSLPGVTVLTNKDAKAPAAAAAAGGDCPCGSGCAAVPAAATATVSMVLASP

SEQ ID NO: 90583 - DNA, 1440 bp, Leishmania major
  CDS (1)..(1440)
atgtctctcgtgctgaagaagagcatcgatgacgccaccgtcagggacaagaaggtgctcatccgcgtggacttcaacgtccccgtgaagaacggtaagatcacgaatgacttccgcattcgctccgcccttccgacgatccaaaaggtgctgaaggagggcggctcctgcatcctgatgagccaccttggtcggccgaagggtgcgagaatgagtgacccaagtccggagaagggtgtgcgcgggtacgaggaggccgccacgctgcgcccggttgctgcacgcatcagcgagctgctggggcagaaggtggagtttgcaccggactgcctggacgctgcgtcgtacgcgtcgaagctgaagaacgcggacgtgctgttgctggagaacgtgcgtttctacgcggaggagggcagcaagaaggaggaggagcgcgacgcgatggcgaaggtactagcgtcgtacggcgacgtgtatgtcagtgacgcgtttggcactgcgcaccgcgacagcgcgacgatgacgggcatccccaaggtgctgggtgcgggctacgccgggtacctgatggagaaggagatcaactacttctcgcgagtgctgaacaacccgccgcggccgctggttgcgattgtcggcggtgcgaaggtcagcgacaagatccagctgcttgacaacatgctgggccgcatcaactaccttgtgattggtggcgcgatggcgtacacgttccagaaggcgcagggccgcaagatcggcatctcgatgtgcgaggaggataagctggaccttgccaagtcgctgctgaagaaggcgcaagagcggaatgtgcaggtgtttctgccagttgaccacgtgtgcaacaaggaatttaaggccgcggactcgccgctggtgacggagagcgtggacgtcccggacggctacatggcgctggacattggcccaaggacgatccacatgtacgaggaagtgattggccgctgcaagagcgcgatctggaacggcccgatgggcgtgttcgagatgccgtgctactcgaagggcacatttgccgttgcgaaggcgatggggactggaacgcagaagaacgggctgatgagcatcatcggcggtggtgacagcgcgagcgctgcggagctgagcggcgaggcgaagaacatgtcgcatgtgtccaccggcggcggtgcgtccctggagctgctggagggcaagacgctgcctggcgtcgccattctgacggacaaggacgtgaaggagcggggagcttcgtgcaagttcgctttcggggtcgggagcccgagcagggaggcttgtccgctccgttgtgggcatatctttggcggtgcctccatcgtaagagagatagttaagatcgtcgtcgcgctgctgatcggcatttttattggtcgccgcatgagcaccaagctgatccggtaa

SEQ ID NO: 90584 - protein, 479 aa, Leishmania major
MSLVLKKSIDDATVRDKKVLIRVDFNVPVKNGKITNDFRIRSALPTIQKVLKEGGSCILMSHLGRPKGARMSDPSPEKGVRGYEEAATLRPVAARISELLGQKVEFAPDCLDAASYASKLKNADVLLLENVRFYAEEGSKKEEERDAMAKVLASYGDVYVSDAFGTAHRDSATMTGIPKVLGAGYAGYLMEKEINYFSRVLNNPPRPLVAIVGGAKVSDKIQLLDNMLGRINYLVIGGAMAYTFQKAQGRKIGISMCEEDKLDLAKSLLKKAQERNVQVFLPVDHVCNKEFKAADSPLVTESVDVPDGYMALDIGPRTIHMYEEVIGRCKSAIWNGPMGVFEMPCYSKGTFAVAKAMGTGTQKNGLMSIIGGGDSASAAELSGEAKNMSHVSTGGGASLELLEGKTLPGVAILTDKDVKERGASCKFAFGVGSPSREACPLRCGHIFGGASIVREIVKIVVALLIGIFIGRRMSTKLIR

SEQ ID NO: 90585 - DNA, 1440 bp, Leishmania mexicana
  CDS (1)..(1440)
atgtcgctcgtgctgaagaagagtatcgatgatgtcgccttgaaggataagaaggtgctcatccgcgtggacttcaacgtccctgtgaaaaatggcgaaatcacgaatgacttccgcatccgttccgccttgccgacgatccagaaggtgctgaaggagggcggctcctgcatcctgatgagccaccttggcaggccgaagggtgcgaggatgagtgacccgaaaccagagaaaggtgtgcgcgggtacgaggaggctgcgacgcttcgcccggtcgctgcggccctctcggagcttctggagaagaaggtggcgtttgcgccggactgcctgaacgcttctatatacgtgtcgaagctgaagcgcggcgacgtgctgctgctggagaacgtgcgcttctacacggaggagggcagcaagaaggaggaggaggccgatgcgatggcgaaggtgctggcgtcatacgcggacctgtacgtcagcgatgcctttggcactgcgcaccgtgacagcgcgacgatgacgggcatccccaaggtgctgggctctggctatgcggggtacctgatggagaaggagatcaattacttctcgcgggtgctgaacaacccgccgcggccactggttgcgattgtcggcggcgcgaaggtgagcgacaagatcgagctgcttgacaacatgctgggccgcatcaattaccttgtgattggtggcgcgatggcgtacacgtttcagaaggcgcagggccgcaagatcggcatctcgatgtgcgaggaggataagctggatcttgccaagtcgctgctgaagaaggcgcaggagcgcggtgtgcaggtgcttctgccggtcgaccacgtgtgcaacaaagaattcaaggccgtggactcgccactggtgacggaggacgtggacgtaccggatggctacatggcgctggacattggcccaaagacgatccacatgtacgaggaggtgattggtcgctgcaagagtgccatctggaacggcccgatgggcgtgtttgagatgccgtgctactcgaagggcacatttgctgtcgcgaaggcgatggggactggaacgcagaaggacgggcttctgagcatcatcggcggtggcgacacggcgagtgctgcagagctgagcggcgaggcaaagaacatgtcgcatgtatccaccggcggcggtgcgtcgctcgagctgctggagggcaaaacgcttcctggcgttgctattctgacagacaaggaagtgaaggggcgtggacctttgttgaagtgcgcgtgtggtggtgcgagtccgagcaatgagtcttgtccgcgtaggagggagggtatctggggaggcggcttcatcgtaactgagattgtcaaacttgttggtgcgctgctgattggcatttttattggacgtcgcctgaacactaagcttatccggtaa

SEQ ID NO: 90586 - protein, 479 aa, Leishmania mexicana
MSLVLKKSIDDVALKDKKVLIRVDFNVPVKNGEITNDFRIRSALPTIQKVLKEGGSCILMSHLGRPKGARMSDPKPEKGVRGYEEAATLRPVAAALSELLEKKVAFAPDCLNASIYVSKLKRGDVLLLENVRFYTEEGSKKEEEADAMAKVLASYADLYVSDAFGTAHRDSATMTGIPKVLGSGYAGYLMEKEINYFSRVLNNPPRPLVAIVGGAKVSDKIELLDNMLGRINYLVIGGAMAYTFQKAQGRKIGISMCEEDKLDLAKSLLKKAQERGVQVLLPVDHVCNKEFKAVDSPLVTEDVDVPDGYMALDIGPKTIHMYEEVIGRCKSAIWNGPMGVFEMPCYSKGTFAVAKAMGTGTQKDGLLSIIGGGDTASAAELSGEAKNMSHVSTGGGASLELLEGKTLPGVAILTDKEVKGRGPLLKCACGGASPSNESCPRRREGIWGGGFIVTEIVKLVGALLIGIFIGRRLNTKLIR

SEQ ID NO: 90587 - DNA, 1323 bp, Trypanosoma brucei brucei
  CDS (1)..(1323)
atgacccttaacgagaagaagagcattaatgaatgcgatcttaagggaaagaaggttcttatccgtgttgactttaatgttcccgtgaaaaacggtaagatcaccaacgactaccgaatccgatcagctctgccaacgctcaagaaggttctcacagaaggcggcagctgtgttctcatgagccacctcgggaggccgaaaggtattcccatggcgcaagctggcaaaatacggagcactggcggtgttcccgggttccaacagaaggcaacactcaaaccggtagccaaggccctcagcgaactgctattgaggcccgtcacattcgcacctgactgcctgaacgctgcagatgtcgtctctaagatgtctccgggcgatgttgttctgcttgaaaatgtacggttctacaaagaagagggcagcaagaaggcaaaagaccgtgaagccatggccaagatccttgcgtcatatggtgatgtttacatcagtgatgcttttggtacagctcaccgtgacagtgctaccatgaccggaattccaaagattttgggcaacggtgctgccggttatttgatggagaaggagatttcatacttcgctaaggtacttggtaacccgccgcgtccgctggttgctatcgttggtggagcgaaagtgagcgacaagatccaacttctggataacatgttgcagcgcatcgattatctcttaattggtggtgcaatggcatacacatttctgaaggctcagggttacagcattggaaaatcgaagtgcgaggaaagtaaacttgaatttgctcgatccctgctgaagaaggcggaggaccgcaaggtgcaggttattcttccaattgatcatgtttgccacacggaattcaaagctgtggattctccattgataactgaggatcaaaacatccctgaagggcatatggctctggatattggtcccaagactattgaaaaatatgttcagacgattgggaagtgtaagagcgccatttggaacggtcccatgggtgtatttgaaatggttccttattccaaaggtacatttgcaattgcgaaagccatgggtcgaggaactcacgagcatggactcatgagtatcatcggtggtggtgacagcgcaagtgcagctgagttgagcggtgaggcgaagcgcatgtctcatgtttcaactggtggtggtgcgtctttggaactcctcgagggcaaaacgcttcccggcgttacagtattggacgaaaagtcggcggttgtgtcgtatgcctctgcaggtactggaactctttctaaccggtggagctctctttaa

SEQ ID NO: 90588 - protein, 440 aa, Trypanosoma brucei brucei
MTLNEKKSINECDLKGKKVLIRVDFNVPVKNGKITNDYRIRSALPTLKKVLTEGGSCVLMSHLGRPKGIPMAQAGKIRSTGGVPGFQQKATLKPVAKALSELLLRPVTFAPDCLNAADVVSKMSPGDVVLLENVRFYKEEGSKKAKDREAMAKILASYGDVYISDAFGTAHRDSATMTGIPKILGNGAAGYLMEKEISYFAKVLGNPPRPLVAIVGGAKVSDKIQLLDNMLQRIDYLLIGGAMAYTFLKAQGYSIGKSKCEESKLEFARSLLKKAEDRKVQVILPIDHVCHTEFKAVDSPLITEDQNIPEGHMALDIGPKTIEKYVQTIGKCKSAIWNGPMGVFEMVPYSKGTFAIAKAMGRGTHEHGLMSIIGGGDSASAAELSGEAKRMSHVSTGGGASLELLEGKTLPGVTVLDEKSAVVSYASAGTGTLSNRWSSL

SEQ ID NO: 90589 - DNA, 1527 bp, Trypanosoma brucei brucei
  CDS (1)..(1527)
atgtccactgcaccgaatgcgaagaacaacataagcctgaagaagtctgtgggcgatgtttttcggttaacggcgaagcgagtgcttatgcgtgtcgatttcaacgttcctatgcaaaatggccatattactaacgattatcgaatccgtgcggcgattccaacgatacggcgggttattgatcagggtggtatttgtattctcctgagccatcttggacggcccagaggcgtttcaatggttgcgggtgtgcgagatataagacggcgatatcacgaggctcagtttcacgacaacaaaggtaaaacagcgttttttagtgttctaccgggagaggagaaagttaaaatattagcgaaatccagtgcacgggaagaggcaacgcacatatcacctgaggtgaaatctggaaaaacaatgctgtttgcgcgccttcctgaggacgagaagaaatctttgcttatgcagtacttaaacgaaaacaaagacagtgcgttaccgcagatgagtgttagtgcaggctacgaagagcaatacagtcttcgtccagttgctgtaaggcttgccgaattactcggccaacatgtatattttgctcacgactgcttggatgccagagtagaggtttcgcggttaaagcgtggaaatgttatgttacttgaaaatgtacggttctacagcgaagaaaacggtgaaaatgctgaggaacgtgaagccatggccaagatccttgcgtcatatggtgatgtttacatcagtgatgcttttggtgcagctcaccgtgacagtgctaccatgaccggaattccaaagattttgggtcacggtgctgccggttatttgatggagaaggagatttcatacttcgctaaggtacttggtaacccgccgcgtccgctggttgctatcgttggtggagcgaaagtgagcgaaaagatccaacttctggataacatgttgcagcgcatcgattatctcttaattggtggtgcaatggcatacacatttctgaaggctcagggttacagcattggaaaatcgaagtgcgaggaaagtaaacttgaatttgctcgatccctgctgaagaaggcggaggaccgcaaggtgcagattattcttccaattgatcatgtttgccacacggaattcaaagctgtggattctccattgataactgaggatcaaaacatccctgaaggacatatggctctggatattggtcccaagactattgaaaaatatgttcagacgattgggaagtgtaagagcgccatttggaacggtcccatgggtgtatttgaaatggttccttattccaaaggtacatttgcaattgcgaaagccatgggtcgaggaactcagaaacgtggactcatgagtatcatcggtggtggtgagagtgcgggtgcggctgaactctgtggtaagctcagtatttctcatgtttcaactggtggtggtgcgtctttggaactcctcgagggcaaaacgcttcccggtgttgcagtattggatgataaggagtaa

SEQ ID NO: 90590 - protein, 508 aa, Trypanosoma brucei brucei
MSTAPNAKNNISLKKSVGDVFRLTAKRVLMRVDFNVPMQNGHITNDYRIRAAIPTIRRVIDQGGICILLSHLGRPRGVSMVAGVRDIRRRYHEAQFHDNKGKTAFFSVLPGEEKVKILAKSSAREEATHISPEVKSGKTMLFARLPEDEKKSLLMQYLNENKDSALPQMSVSAGYEEQYSLRPVAVRLAELLGQHVYFAHDCLDARVEVSRLKRGNVMLLENVRFYSEENGENAEEREAMAKILASYGDVYISDAFGAAHRDSATMTGIPKILGHGAAGYLMEKEISYFAKVLGNPPRPLVAIVGGAKVSEKIQLLDNMLQRIDYLLIGGAMAYTFLKAQGYSIGKSKCEESKLEFARSLLKKAEDRKVQIILPIDHVCHTEFKAVDSPLITEDQNIPEGHMALDIGPKTIEKYVQTIGKCKSAIWNGPMGVFEMVPYSKGTFAIAKAMGRGTQKRGLMSIIGGGESAGAAELCGKLSISHVSTGGGASLELLEGKTLPGVAVLDDKE

SEQ ID NO: 90591 - DNA, 1239 bp, Alcaligenes eutrophus
  CDS (1)..(1239): transl_table=11
atgatgagcctatcccatgcatcggtcccgcacacgaatcccacggcgccgcacacgctggccgcactgctcgccgctggcgggctggccggcaagcgtgtctttatccgcgccgacctcaacgtcccgcaggatgcagcgggcgatatcaccgacgatacccgcatccgtgcttccgtgcctgccatcgcggcctgcctgcaggcgggcgctgcggtgatggtcacctcgcacctgggccggccgcaggagggggcgcccgacccgcgccacagcctggcgccggtgggccgccgcctgtcggaactgctgggccgccaggtgccgctgttgtccggctggaccgagggcggcttccaggtgccgcccgggcaggtggtgctgctggaaaactgccgcatgaacacgggcgaaaagaagaacagcgacgagctggcgcagaagatggcggcgctgtgcgatgtctacgtcaacgacgccttcggcaccgcccaccgcgccgaggcgaccacgcatggcatcgccaggtacgcccccgttgcctgcgccggcccgcttctggccgccgagatcgacgcgttgggcaaggcgctgggccagccggcgcgtccgctggtggcgatcgtggccggctccaaggtctcgaccaagctgaccatcctgaagtcgctggccgacaaggtcgacaacctggtcgtcggcggcggcatcgccaataccttcatgctggccgccggcctgaagatcggcaagtcgctggccgagcctgacctgctggccgatgccagggccatcatcgacatcatggccgcccgcggcgcctcggtgccgatcccggtcgacgtggtgtgcgccaaggagttcagcgccaccgccgcggccgcggtcaaggacgtcagggacgtggccgacgacgacatgattctcgacatcggcccgaagaccgcggccatgctggccgaccagctcaaggccgccggcaccatcgtctggaatggcccggttggcgtgttcgaattcgaccagttcggcaatggcaccagggtgctggcacaggccatcgccgagtcgaaggcgttctcgatcgccggcggcggcgacacgctggccgccatcgccaagtacggcattgccgaccgcgtgggctacatctcgaccggcggcggcgcgttcctggaattcctggaaggcaagaagctgcccgcactggacgtgctggagcaacgggccgccagctga

SEQ ID NO: 90592 - protein, 412 aa, Alcaligenes eutrophus
MMSLSHASVPHTNPTAPHTLAALLAAGGLAGKRVFIRADLNVPQDAAGDITDDTRIRASVPAIAACLQAGAAVMVTSHLGRPQEGAPDPRHSLAPVGRRLSELLGRQVPLLSGWTEGGFQVPPGQVVLLENCRMNTGEKKNSDELAQKMAALCDVYVNDAFGTAHRAEATTHGIARYAPVACAGPLLAAEIDALGKALGQPARPLVAIVAGSKVSTKLTILKSLADKVDNLVVGGGIANTFMLAAGLKIGKSLAEPDLLADARAIIDIMAARGASVPIPVDVVCAKEFSATAAAAVKDVRDVADDDMILDIGPKTAAMLADQLKAAGTIVWNGPVGVFEFDQFGNGTRVLAQAIAESKAFSIAGGGDTLAAIAKYGIADRVGYISTGGGAFLEFLEGKKLPALDVLEQRAAS

SEQ ID NO: 90593 - DNA, 1233 bp, Aeropyrum pernix
  CDS (1)..(1233)
atggggggcaggctcgctactctggacgacgttgatgttaggggtaagaaggttatagtccgtttcgaccttaatagccctgtaggtaatggaggcgaaatactggacgactcccgtatagctgaggctgcaggaaccctaagggaactctgcgataggggtgcagcggtggtcgctctcagccaccagggcaggcctcttgaaagcgatttcgtcagcctggagagacatgcatcattactgtcaagatattcgggcgttgaagtgagatttgtgatggatgtaattgggcctgaggctctaaggacagttgcatcgctgagaccgggagaggcagtgctgcttgacaatactaggataattagcgaggactttattgaggctgagggcactgtccatgctagaggtattatggtcaccaggctctccaagctagctaacatgtatgttaacgaggctttctccgcttctcacaggagccaggcaagcattgtcggctttccctacgtcctcccctctgcgggcgggcgagtcttggagaaggagatccgctcgctaaaccgagcagtatcctcgggtgagagacccaaggtcgtcgtgctggggggcgcgaagctgaaggatgccgtcaggatagtggactacctatcctcatctggagttgcagacgaagtgctgaccacgggcctcgttggcctcctcttcctctatgcccgtggctacaggcttccgagagacgtgacaaagctcctggaaaagaaggggggtgaggaggctatagcgaaggctaggagaatcgttgaggaggggagaagggttaggacccctatagacttcgttgtggaggttggcgataagatctacataaagcctgcggacgagctgacagagggtgtgccaaaggacatagggccgtcgacggtagagtattttagagcgaagatgaggggtgccagggtaatagtgatgaggggtcctgccggggttatagaggaccccaggttcaggaggggcactgtcgagctggtcaaggccgccctgtcttcaggcgcctacactgtattcgggggcgggcatttcagggctatacttagagatctccccgaacatcttagtagtaaggtgggccacttgagcaccgggggcggggcactcttgtattatctgtcgggacggcccctccccggggttaaagccttagtagactcggcgaggatatttaatctggtttag

SEQ ID NO: 90594 - protein, 410 aa, Aeropyrum pernix
MGGRLATLDDVDVRGKKVIVRFDLNSPVGNGGEILDDSRIAEAAGTLRELCDRGAAVVALSHQGRPLESDFVSLERHASLLSRYSGVEVRFVMDVIGPEALRTVASLRPGEAVLLDNTRIISEDFIEAEGTVHARGIMVTRLSKLANMYVNEAFSASHRSQASIVGFPYVLPSAGGRVLEKEIRSLNRAVSSGERPKVVVLGGAKLKDAVRIVDYLSSSGVADEVLTTGLVGLLFLYARGYRLPRDVTKLLEKKGGEEAIAKARRIVEEGRRVRTPIDFVVEVGDKIYIKPADELTEGVPKDIGPSTVEYFRAKMRGARVIVMRGPAGVIEDPRFRRGTVELVKAALSSGAYTVFGGGHFRAILRDLPEHLSSKVGHLSTGGGALLYYLSGRPLPGVKALVDSARIFNLV

SEQ ID NO: 90595 - DNA, 1251 bp, Agaricus bisporus
  CDS (1)..(1251)
atgtctctctccaacaaactctccatcactgacctcgccctcaccggcaagcgtgtccttatccgcgtcgacttcaactcccccatccaagacggaaagataaccaaccccgcccgtatcaatgccgccctccccactatcaaatatgccctcgacaatggcgcctccaaggtcatcttaatgtcgcatctcggcaggcccgatggcaaggcgatctccaaatactcactcaaacctgtggcctcagagctggaaaagctcttgaagaaaccggtcttcttcttgcatgactgcgtcggccctgacatcgaaaaggcagtcctggaggcacccgagggtgctgtcgttctgctcgagaaccttcgcttccacattgaggaagaaggctctgccaagaacgaggaaggaaaaaaaatcaaagctgatccttccaaggtcacccagttccgcgagcagctcaccaggctcggcgatgtttatgtgaacgatgcctttggtacggctcatcgcgctcactccagcatggttggcatcaagcttcctcgaagggcttctgggtttttggtcaagaaagaactagactactttgcaaaggcactggaaaaccccgaacgacccttccttgctatccttggtggtgccaaagtgtctgacaagatccagctgattgaaaacatgctcgacaaggtcaactgtctcgtcatcggaggtggtatggcattcactttcaagaagacaatgcaaaatgttgcgattggcaactctctctttgacaaaccagggtctgaaaaagtggccgggatcgtcgaaaaggccaagaagaacaatgtcgaaattgtgttccccgtcgactatgttgtcggagacaagtttgatgcaaacgccaaccacaagatagtcacggatgacgaaggcgttccggatggttggatgggtctcgacgttggtccaaagtctaatgagctcttccgtgaagcggtcctgaaagccaagacgattctctggaacggtcctcccggagtgttcgaatttcctgcgtttgccaagggatcaaaggtgcttttggatgccacggtagaggcggtacaaaagggggctactgttatagttggtgggggtgatacagctacggtagttgcgaatcatgacgcagaagagaagctgagccacgtcagcactggtgggggtgcgagtctggagctgctggagggcaagacgctgcctggagtggcagaattgagcaacaaatga

SEQ ID NO: 90596 - protein, 416 aa, Agaricus bisporus
MSLSNKLSITDLALTGKRVLIRVDFNSPIQDGKITNPARINAALPTIKYALDNGASKVILMSHLGRPDGKAISKYSLKPVASELEKLLKKPVFFLHDCVGPDIEKAVLEAPEGAVVLLENLRFHIEEEGSAKNEEGKKIKADPSKVTQFREQLTRLGDVYVNDAFGTAHRAHSSMVGIKLPRRASGFLVKKELDYFAKALENPERPFLAILGGAKVSDKIQLIENMLDKVNCLVIGGGMAFTFKKTMQNVAIGNSLFDKPGSEKVAGIVEKAKKNNVEIVFPVDYVVGDKFDANANHKIVTDDEGVPDGWMGLDVGPKSNELFREAVLKAKTILWNGPPGVFEFPAFAKGSKVLLDATVEAVQKGATVIVGGGDTATVVANHDAEEKLSHVSTGGGASLELLEGKTLPGVAELSNK

SEQ ID NO: 90597 - DNA, 1203 bp, Anabaena sp
  CDS (1)..(1203)
atgtctaaaaaaactgtggctagtttatctgctgctgatatctctggtaaacgcgctttagtgcgtgttgactttaacgtgcctttagacgatcaaggcaacatcacagacgatactcgcattcgtgcggctctgccaaccatccaagatttgacgcaaaagggcgctaaggttattctagcaagccatttcggtcgtcccaagggtgtagatgagaagttgcgtcttaccccagtagccaagcggctatctgagttgttgggacaagaagttatcaaaaccgatgactcaattggtgatgaagttgcggctaaggtggctactttgcaaaatggccaagttcttttattagaaaacgtccgtttttataaagaagaagagaaaaacgatcctgaatttgctaaaaaattagcggctaatgctgatttctacgtaaacgatgcttttggtactgcacaccgcgctcatgcgtctacggaaggcgtgactaaattcctcagcccatctgtggctggatatttggttgagaaagaattgcagtacttacaaagtgcgatcgaaaatccccaacgtcctttagcagccattatcggtggttctaaggtttccagcaaaatcggtgtgattgaaacactactagagaagtgcgacaagctgatcattggtggtgggatgattttcaccttctacaaggctcgtggtttgaatgtgggtaaatctctggtggaagaagacaagctggaactggcgaagtctttggaagctaaagccaaggaacgcggcgttagcttgttgttacctacagatgtggtattagcagataactttgcacctgatgccaattctcaaactgtcagcattgaaaacatccccgatggttggatgggtttggatatcggccctgattctgtcaaagtcttccaagcagcccttgcagataccaaaactgtcatctggaacgggcctatgggtgtgtttgagtttgataagtttgctgctggtacagaagcgatcgctcatacactagcagagattggcaaaactggcacaactaccatcatcggcggtggtgactcggtagcggctgttgagaaggtaggtttggctgatcaaatgagccacatctccaccggcggcggcgctagcttagagttactcgaaggcaaagtactgcccggtatcgctgctttagatgaagcgtaa

SEQ ID NO: 90598 - protein, 400 aa, Anabaena sp
MSKKTVASLSAADISGKRALVRVDFNVPLDDQGNITDDTRIRAALPTIQDLTQKGAKVILASHFGRPKGVDEKLRLTPVAKRLSELLGQEVIKTDDSIGDEVAAKVATLQNGQVLLLENVRFYKEEEKNDPEFAKKLAANADFYVNDAFGTAHRAHASTEGVTKFLSPSVAGYLVEKELQYLQSAIENPQRPLAAIIGGSKVSSKIGVIETLLEKCDKLIIGGGMIFTFYKARGLNVGKSLVEEDKLELAKSLEAKAKERGVSLLLPTDVVLADNFAPDANSQTVSIENIPDGWMGLDIGPDSVKVFQAALADTKTVIWNGPMGVFEFDKFAAGTEAIAHTLAEIGKTGTTTIIGGGDSVAAVEKVGLADQMSHISTGGGASLELLEGKVLPGIAALDEA

SEQ ID NO: 90599 - DNA, 1239 bp, Aplysia californica
  CDS (1)..(1239)
atgaacaagctcagtattaacgacgtggatgtgagggacaagagagtcctgatcagagtcgatttcaacgtccccttgaaaaatggacagatctcaaacaaccagagaatcgctgcagccctgcctacgatcaagcttgccttggagaagggtgccaagtcagtggtgctcatgtctcatctcggtcggccagacgggcgcccaatccatgcggccagtatgaagccggtggtggcagagctggagaacctgttgggaaagaaaatcatgtttctggaagactgcgtgggttccaaggtagaggccgcctgtgccaacccggagcccggcagcgtgatcctgctggaaaatctccgcttccacgtggagaaggaggggaagggcaaggacgctcagggcaacaaggctaaggcagatgatgctgctgtggctgccttcagggcctccttgtccaaactgggagacgtctacgtgaacgacgcttttggcacagctcatagagctcacagctccatggtgggtgtggatctgccggtcaaggcctgcggtctgctcatgaagaaagagttggactactttgccaaagccctggagaaccccgctcgtccgttcctggctatcctgggaggagctaaagttgctgacaaaatccagctgattgagaaccttatggacaaagtcaatgagatgatcattggtggtggaatggctttcacattcttgaaagtactcaacaatatggacatcggaggttctctgtttgacgagggggccaagatcgttggccgtctggtggacaaggcgaaggagaagggagtgaagctccacctgccctccgacttcatcaccggcgacaagtttgccgacgtcgccaagtccgccacggcgtctgttgcgtctggcatcccagaaggttggatgggtctggatgttgggaccaaaaccaacgaagtattccagaaggtgattgaaggagcaaagacaattgtgtggaacgggccccccggagtgtttgagtttgagaacttcagcacgggctccaagcagatgatggactctgtggtcagggccaccgaggcaggaaccatcactatcattggtggatgtgacactgccacgtgtgccaagaattcaaacgccacggagaaggtgagccatgtgagcacaggaagcggaaccagcctggagctgttggaaggcaaaatccttcctggcgtggctgccctgtcccagccgtga

SEQ ID NO: 90600 - protein, 412 aa, Aplysia californica
MNKLSINDVDVRDKRVLIRVDFNVPLKNGQISNNQRIAAALPTIKLALEKGAKSVVLMSHLGRPDGRPIHAASMKPVVAELENLLGKKIMFLEDCVGSKVEAACANPEPGSVILLENLRFHVEKEGKGKDAQGNKAKADDAAVAAFRASLSKLGDVYVNDAFGTAHRAHSSMVGVDLPVKACGLLMKKELDYFAKALENPARPFLAILGGAKVADKIQLIENLMDKVNEMIIGGGMAFTFLKVLNNMDIGGSLFDEGAKIVGRLVDKAKEKGVKLHLPSDFITGDKFADVAKSATASVASGIPEGWMGLDVGTKTNEVFQKVIEGAKTIVWNGPPGVFEFENFSTGSKQMMDSVVRATEAGTITIIGGCDTATCAKNSNATEKVSHVSTGSGTSLELLEGKILPGVAALSQP

SEQ ID NO: 90601 - DNA, 1194 bp, Aquifex aeolicus
  CDS (1)..(1194): transl_table=11
atgcttagaaaaaagaccttaagggacgttgacgtaaaggggaagagagttctcgtaagggttgattacaacgttccactagacgaacagggaaacatagtagacgacacgcgtataagggcttcccttcccacagttgagtacctccttgacgcaaacgcaaaggtaattttgatgtcccatctaggaagacctaaaaacagggatccaaagtacagtttggcaccggtagccaaaagactttcaaggtatataaacaaggaggtaaaactcgccccggactgcgtgggagaagaagtaaagcgaattgtaaactccatgaaagagggagacgtagttctccttgaaaaccttaggttccataaagaagaaacggagtgcgatgagaactttgcgagagagcttgcgagtctgggagaagtttacgttgcggacgccttcggaacctgtcacagaaagcacgcaagcgtgtacctcgttcccaagtttttaaaacccgccgtaatgggatttttactggaaaaggaaatcacttactttgaaaaggcgatggtagcaccccagagacccgtggtcgctatcctgggaggtgctaaagtttcctccaaactcgaagtgataaagaacctaataaggagggtagacaaactatttataggcggcgctatggcctttaccttcctcaaagctatgggctacaaggttggaaattccctcgtggaggacgacctacaggacgttgcaagggatttaatagatgttgcaaaaaagctagagattaaactctaccttcccgttgactttgtgatagggcaggaagtctcggaaaacactcccacgaaagtagtaccctggcaggagataccagacgggtggatggggcttgatatcggacccgtttccgttgaactcgtaaaggaaataatttccgatgcccagacaattgtgtggaacgggcccatgggagtgtttgaaatagacaagttcaaacatggaacaatagaggtcgcgaaattactcgcccaatcttcagccctcacgatagcgggcggaggagatacggaccacgccattcacaaggcgggagtttatcacgcctttgacttcgtctccacaggaggaggagctttcctggaacttctcgcggggaaagaactgccctgtctcgttaaccttgacgacaaggaggcttaa

SEQ ID NO: 90602 - protein, 397 aa, Aquifex aeolicus
MLRKKTLRDVDVKGKRVLVRVDYNVPLDEQGNIVDDTRIRASLPTVEYLLDANAKVILMSHLGRPKNRDPKYSLAPVAKRLSRYINKEVKLAPDCVGEEVKRIVNSMKEGDVVLLENLRFHKEETECDENFARELASLGEVYVADAFGTCHRKHASVYLVPKFLKPAVMGFLLEKEITYFEKAMVAPQRPVVAILGGAKVSSKLEVIKNLIRRVDKLFIGGAMAFTFLKAMGYKVGNSLVEDDLQDVARDLIDVAKKLEIKLYLPVDFVIGQEVSENTPTKVVPWQEIPDGWMGLDIGPVSVELVKEIISDAQTIVWNGPMGVFEIDKFKHGTIEVAKLLAQSSALTIAGGGDTDHAIHKAGVYHAFDFVSTGGGAFLELLAGKELPCLVNLDDKEA

SEQ ID NO: 90603 - DNA, 1224 bp, Archaeoglobus fulgidus
  CDS (1)..(1224): transl_table=11
gtgatgatagacggccttccaacactagacgatattccgtacagaggaaagcacgttctgctgagggttgacatcaacgctcctattgtgaactcaacgattctcgacacgagcagattcgagagccacattccgacaattgaggctcttgaagactcaaagctcgttttgctcgcacaccagagccgacccggaaagaaggacttcacgagtctcgaaagccacgcatccacactttccaaactgctcgggaagagagtcgagtacatagacgaaattttcagcaaaggcgttctgagaagaataaaggagatggagaacggtgaggtaattttgctcgagaacgtgaggttctactccgaggagcagttgaacagaagcgctgaggagcatgccgagtgccacatggtcaggaaactcagcacagcctttgacctctttgtcaacgacgccttctccgcatcccatcgaagccacgcatctttggtcggcttcgttccggttctgccatccgtcgtgggaaggctcgtcgaaaatgaggttaccgccctcagcaaacccctcaagggggaggggagaaagatatttgtcctgggcggagctaaaatcaaggactcggtgaaagttctaaaaaacgtgctggaaaacaacattgcggaaaaagtcgttctcacgggtgtagttgccaactactttctcatgctgaaaggttacgatataggtgaagtgaacagaaaggttgtggaggacaacaaggaagacgtgagcgacgaggagatgataaacatactcaagaagtactccgacaaaattatccttcccattgacctcggtatagagaaagacggtgtcagggtagatatcccattggagaagtttgatgggaaatacagaataatggatattgggcttgaaaccgttaaccagctttcggaaatcatcccgaagtacgattatgtggttctgaacggtcctgcgggagtttttgaggatgagcgtttctctctcggaacttacgagattctgagggccgcgacaagggctggttactcggttgttggcggggggcacatcgcctcagcagcacgcctcttcggcctttcggacaagttcagccacatatcaactgcaggaggggcgtgcataaggttcctgagcggtgaaaagctggtagctcttgaggttatcaaggaatactgggcgaagaagtggggcaaatcttaa

SEQ ID NO: 90604 - protein, 407 aa, Archaeoglobus fulgidus
MMIDGLPTLDDIPYRGKHVLLRVDINAPIVNSTILDTSRFESHIPTIEALEDSKLVLLAHQSRPGKKDFTSLESHASTLSKLLGKRVEYIDEIFSKGVLRRIKEMENGEVILLENVRFYSEEQLNRSAEEHAECHMVRKLSTAFDLFVNDAFSASHRSHASLVGFVPVLPSVVGRLVENEVTALSKPLKGEGRKIFVLGGAKIKDSVKVLKNVLENNIAEKVVLTGVVANYFLMLKGYDIGEVNRKVVEDNKEDVSDEEMINILKKYSDKIILPIDLGIEKDGVRVDIPLEKFDGKYRIMDIGLETVNQLSEIIPKYDYVVLNGPAGVFEDERFSLGTYEILRAATRAGYSVVGGGHIASAARLFGLSDKFSHISTAGGACIRFLSGEKLVALEVIKEYWAKKWGKS

SEQ ID NO: 90605 - DNA, 1248 bp, Ashbya gossypii
  CDS (1)..(1248)
atgtcgctatcctctaagctaacagtcaaggacctgagccttgcgggcaaacgcgtgttcatccgcgtggacttcaacgtgccgctagacgggaagacgatcacgtcgaaccagcgcattgtggccgcgctacccacgatcaagtacgtgttggagcagggccccaaggcggtggtgttggcgtcgcacctagggcggcccaacggcgagcgcaacgagaagtactcgttggcgccggtggccgcggagctggagaagctgctgggccagaaggtgaactcctggacactgcgtgggcagcacgtgaccgctgcggtcaacggcgcggctgcggggtccgtgttcctgcttgagaacctgcggttccacatcgaggaggagggctcgcgcaaggtggacggcgagaaggtcaaggcgtctgcggaggacgtgcagaagttccgccagggcctcatgtcgctcgcggacgtctacgtcaacgacgccttcggcaccgcgcacagagcgcactcctcgatggtcggcttcgagctgcctgagagggccggcggcttcttgttgtcgcgcgagctggagtacttcagcaaggcgttggagaaccctacgagacccttcttggcgatcctgggcggtgccaaggttgccgacaagatccagttgatcgacaacttgttggacaaggtcgactcgattgtgatcggcggtggcatggccttcaccttcaagaaggtgcttgagaacatggagatcggtaactccatctacgacaaggcgggtgccgagatcgttcctaagctagcggagaaggccaagaagaacggcgtcaagatcgtgttgcctgtggacttcgtgatcggcgacgacttctcccaggacgccaacaccaagattgtctctgcctccgagggcattccatccggctgggagggtctagactgtggtcctgagtccagaaagctgttcagcgagaccatcgcgagcgcgaagaccatcgtgtggaacggcccaccaggtgtctttgagattccaaagttctccgagggtacccaggccatgcttgcggccgctgtcaaggcctccgaggctggcagcaccgtcatcatcggcggtggtgacaccgctaccgtggccaagaagtacggtgtggtcgagaagatctcccatgtgtccaccggtggtggtgcctccctagagctattggagggtaaggacctaccaggtgtcaccttcttgtccagcaagcagtag

SEQ ID NO: 90606 - protein, 415 aa, Ashbya gossypii
MSLSSKLTVKDLSLAGKRVFIRVDFNVPLDGKTITSNQRIVAALPTIKYVLEQGPKAVVLASHLGRPNGERNEKYSLAPVAAELEKLLGQKVNSWTLRGQHVTAAVNGAAAGSVFLLENLRFHIEEEGSRKVDGEKVKASAEDVQKFRQGLMSLADVYVNDAFGTAHRAHSSMVGFELPERAGGFLLSRELEYFSKALENPTRPFLAILGGAKVADKIQLIDNLLDKVDSIVIGGGMAFTFKKVLENMEIGNSIYDKAGAEIVPKLAEKAKKNGVKIVLPVDFVIGDDFSQDANTKIVSASEGIPSGWEGLDCGPESRKLFSETIASAKTIVWNGPPGVFEIPKFSEGTQAMLAAAVKASEAGSTVIIGGGDTATVAKKYGVVEKISHVSTGGGASLELLEGKDLPGVTFLSSKQ

SEQ ID NO: 90607 - DNA, 1254 bp, Aspergillus oryzae
  CDS (1)..(1254)
atgtctctctccaacaagcttgccatcaccgatgtcgaccttaaggacaagcgcgtcttgatccgtgtcgacttcaacgttcctctcgatgccgacaagaagatcaccaacaatcagcgtatcgtcggtgctctgcctaccatcaagtacgccattgagaatggtgctaaggccgttgtcctcatgtcccacctcggccgtcccgatggcaaggccaatcccaagtacagcctgaagcctgttgctactgagctggagaagctgcttagcaagtctgtcatcttcgccgagaactgcgtcggcaaggagactgaagagattgtgaacaaggccactggtggccagatcatcctccttgagaacctgcgtttccacgccgaggaggagggcagctctaaggatgccgagggcaagaaggtcaaggctgacaaggagaaggtcgaagagttccgcaagggactgactgctcttggtgacgtctacatcaacgacgctttcggaactgcccaccgtgctcacagctcgatggttggtgttgacctgccccagaaggcttccggcttcttggtgaagaaggaacttgagtactttgctaaggctttggaaagcccccagcgccccttcctggccattctgggaggtgccaaggtctctgacaagatccagctgatcgacaacctgttgcccaaggtcaacagcttgatcatcactggtgctatggccttcaccttcaagaagaccctcgagaacgtcaagattggcaacagtttgttcgatgaggccggtagcaagattgtcggcgatatcgttgagaaggccaagaagaacaatgtcaagattgttctgcccgttgactacgtgaccgctgacaagttcgccgccgatgccaagactggctatgccaccgatgctgacggtattcccgatggatacatgggcctggatgtcggtgagaagagtgttgagctgtacaagaagactattgccgaggccaagaccatcctctggaacggtcctcctggtgtcttcgagctggagcccttcgccaacgctaccaagaagacccttgatgctgctgttgcggctgctcagtctggttctattgtcatcatcggcggtggtgacactgcaaccgtcgctgccaagtacggtgctgaggccaagctcagccatgtctccaccggtggtggtgcatccctggagctccttgagggcaaggttctccctggtgttgatgctctgtcaagtaagtaa

SEQ ID NO: 90608 - protein, 417 aa, Aspergillus oryzae
MSLSNKLAITDVDLKDKRVLIRVDFNVPLDADKKITNNQRIVGALPTIKYAIENGAKAVVLMSHLGRPDGKANPKYSLKPVATELEKLLSKSVIFAENCVGKETEEIVNKATGGQIILLENLRFHAEEEGSSKDAEGKKVKADKEKVEEFRKGLTALGDVYINDAFGTAHRAHSSMVGVDLPQKASGFLVKKELEYFAKALESPQRPFLAILGGAKVSDKIQLIDNLLPKVNSLIITGAMAFTFKKTLENVKIGNSLFDEAGSKIVGDIVEKAKKNNVKIVLPVDYVTADKFAADAKTGYATDADGIPDGYMGLDVGEKSVELYKKTIAEAKTILWNGPPGVFELEPFANATKKTLDAAVAAAQSGSIVIIGGGDTATVAAKYGAEAKLSHVSTGGGASLELLEGKVLPGVDALSSK

SEQ ID NO: 90609 - DNA, 1185 bp, Bacillus cereus
  CDS (1)..(1185): transl_table=11
atgaacaaaaaatcaattcgtgacgtagatttaaaaggtaagcgtgtattttgccgcgttgacttcaacgtacctatgaaagaaggcaaaattacagatgaaactcgtatccgtgcagctcttcctacaattcaatatttagtagagcaaggtgcgaaagttattttagcaagccacttaggccgtccaaaaggtcaagtagtagaagaaatgcgtttaactccagtagcagcacgtttaggcgagcttcttggtaaagacgttaaaaaagcagacgaagcattcggaccagctgtacaagaaatggttgcagcaatgaacgaaggcgacgtattagttcttgaaaacgtacgtttctatgcgggcgaagaaaagaacgatgcagaacttgcgaaagaatttgcagctcttgctgacatcttcgtaaacgatgcattcggtgcagctcaccgtgctcacgcttctacagcaggtatcgcggactacctaccagcagtatctggtttactaatggaaaaagagttagatgttcttggaaaagcactttctaacccagatcgtccattcacagctatcatcggtggtgcgaaagtaaaagataaaatcggtgtaattcgtcatctattagacaaagtagataacttaatcatcggtggcggacttgcttacacattcgttaaagctttaggtcatgaaattggtctatctctatgtgaagacgacaagattgaactagctaaagaatttatgcaacttgcaaaagaaaaaggcgtaaacttctacatgccagttgatgttgtaatcactgaggaattctctgaaactgcaacaactaaaatcgttaatatcgattctatcccttctaactgggaaggcgtggacatcggtcctaaaacacgtgaaatttatgcagatgtaattaaaaactctaagcttgttgtatggaatggaccaatgggtgtattcgaaatgactccattcgcagaaggtacaaaagcagtaggacaagcattagcagatgcagaaggtacatactctgttatcggcggtggtgactctgcagcagctgttgaaaaattcggtatggctgataaaatgagccacatttctactggcggcggtgcgtcattagaattcatggaaggtaaagagcttccaggtgtagtttgtcttaacgacaaataa

SEQ ID NO: 90610 - protein, 394 aa, Bacillus cereus
MNKKSIRDVDLKGKRVFCRVDFNVPMKEGKITDETRIRAALPTIQYLVEQGAKVILASHLGRPKGQVVEEMRLTPVAARLGELLGKDVKKADEAFGPAVQEMVAAMNEGDVLVLENVRFYAGEEKNDAELAKEFAALADIFVNDAFGAAHRAHASTAGIADYLPAVSGLLMEKELDVLGKALSNPDRPFTAIIGGAKVKDKIGVIRHLLDKVDNLIIGGGLAYTFVKALGHEIGLSLCEDDKIELAKEFMQLAKEKGVNFYMPVDVVITEEFSETATTKIVNIDSIPSNWEGVDIGPKTREIYADVIKNSKLVVWNGPMGVFEMTPFAEGTKAVGQALADAEGTYSVIGGGDSAAAVEKFGMADKMSHISTGGGASLEFMEGKELPGVVCLNDK

SEQ ID NO: 90611 - DNA, 1185 bp, Bacillus halodurans
  CDS (1)..(1185)
atgaacaaacaatctgttcgtgatgtggaattacaagggaaaaaagtgttttgtcgcgttgattttaacgtgccgatgaaagatggggtcgtgacagatgatacgagaattcgtgccgcgttaccaacgattcaattgttagcagaaaaaggcgcacgcatcattctcgcaagccatctcggtcgtccgaaaggagaagttgtagaggaacttagactcgatccagttgctgctagactgcaagagcttcttggaaagcctgtagcgaaagtcaatgtcgcccacggaccagaggcagagcaagcggcgaacgaactgaaagatggcgatgtgcttttacttgaaaatgttcgtttttaccctggggaagaaaaaaatgatccagagctagcaaaagcttttgcgtctttagcggatgtctatgtgaacgacgccttcggtgcagcacaccgtgcccacgcgtcaacggaaggtattgcacaccatgttacggctgttgcaggcttgctcatggaaaaggagcttgaggtgcttggcaaggcactttccaaccctgagcgcccatttacagcgatcattggtggagcaaaagtgaaagataaaattggtgtcattgaaaaccttttagataaagttgataacttaattattggcggcggacttgcgtacacattcatcaaagcgcaaggacatgagatcggcaaatctcttttagaagcagacaaaatggatttggctctttccttcatggaaaaggcgaaagaaaaaggagtcaacttctacgtaccacaagatgcgattgtagccgatgatttctcgaatgatgcgaatacgaaagcggtggacattgatcaaatcccagccgattgggaagcgctcgatatcggtccaaaaacgcgcgagacctaccgcaatgtcattcaatcctcaaagctcgtcatttggaacgggccaatgggtgtatttgagctcgatgcttttgctggtggcacgaaagctgttgctgaagcgcttgctgatgcaaacgatacgtattctgtcatcggcggtggagattcggcggccgctgtagaaaagttcggtttagctaaccagatgagccatatctcaacaggtggtggagcatctcttgagtttatggaagggaaagctttacctggcgttgtagcgttaaacgataaataa

SEQ ID NO: 90612 - protein, 394 aa, Bacillus halodurans
MNKQSVRDVELQGKKVFCRVDFNVPMKDGVVTDDTRIRAALPTIQLLAEKGARIILASHLGRPKGEVVEELRLDPVAARLQELLGKPVAKVNVAHGPEAEQAANELKDGDVLLLENVRFYPGEEKNDPELAKAFASLADVYVNDAFGAAHRAHASTEGIAHHVTAVAGLLMEKELEVLGKALSNPERPFTAIIGGAKVKDKIGVIENLLDKVDNLIIGGGLAYTFIKAQGHEIGKSLLEADKMDLALSFMEKAKEKGVNFYVPQDAIVADDFSNDANTKAVDIDQIPADWEALDIGPKTRETYRNVIQSSKLVIWNGPMGVFELDAFAGGTKAVAEALADANDTYSVIGGGDSAAAVEKFGLANQMSHISTGGGASLEFMEGKALPGVVALNDK

SEQ ID NO: 90613 - DNA, 1185 bp, Bacillus megaterium
  CDS (1)..(1185): transl_table=11
atgaacaaaaaaacgttgaaagacatcgatgtaaaaggaaagcgagtattttgtcgcgtagactttaacgtaccaatgaaagacggaaaagtaacagacgaaactcgtattcgtgcagctattcctactattcaatatttagtagaacaaggtgcaaaagtaattttagctagccatcttggacgtccaaaaggcgaagttgttgaagagttacgtctaaatgctgttgcagaacgtttacaagctcttcttggtaaagacgttgcaaaagctgacgaagcttttggcgaagaagtaaagaaaacaatcgacggcatgagcgaaggcgatgttttagtacttgaaaacgtacgtttttacccaggtgaagagaaaaacgatcctgaattagcaaaagcatttgctgaattagcagacgtgtacgtaaacgatgcattcggtgcagctcaccgtgcgcatgcttcaacagaaggaattgcacaacatattccagcagtagcaggtttcttaatggaaaaagagcttgatgtgctttcaaaagcattatcaaacccagaacgtccatttactgcaatcgttggtggagcaaaagttaaagacaaaatcggtgtaattgaccacttgcttgataaagtagataacttaatcatcggtggaggactttcttacacatttattaaggcactaggccatgaagtaggtaaatcacttcttgaagaagacaagattgaacttgcaaaatctttcatggaaaaagctaagaaaaacggagtaaacttctacatgccagtggacgtggtagtagcagatgacttctcaaatgatgctaatattcaagttgtatcaattgaagatattccaagcgattgggaaggcttagacgcaggaccgaaaacgcgtgaaatctatgctgacgtaatcaaaaactctaagttagttatttggaacggaccaatgggtgtatttgaattagacgcatttgctaacggaacaaaagcagtagctgaagctttagcagaagcaactgacacatattcagtaatcggcggaggagactctgcagcagctgttgaaaaattcaacttagctgataaaatgagccatatttctacaggtggcggtgcgtcactagagtttatggaaggtaaagaacttccaggcgtagttgcattaaacgataagtaa

SEQ ID NO: 90614 - protein, 394 aa, Bacillus megaterium
MNKKTLKDIDVKGKRVFCRVDFNVPMKDGKVTDETRIRAAIPTIQYLVEQGAKVILASHLGRPKGEVVEELRLNAVAERLQALLGKDVAKADEAFGEEVKKTIDGMSEGDVLVLENVRFYPGEEKNDPELAKAFAELADVYVNDAFGAAHRAHASTEGIAQHIPAVAGFLMEKELDVLSKALSNPERPFTAIVGGAKVKDKIGVIDHLLDKVDNLIIGGGLSYTFIKALGHEVGKSLLEEDKIELAKSFMEKAKKNGVNFYMPVDVVVADDFSNDANIQVVSIEDIPSDWEGLDAGPKTREIYADVIKNSKLVIWNGPMGVFELDAFANGTKAVAEALAEATDTYSVIGGGDSAAAVEKFNLADKMSHISTGGGASLEFMEGKELPGVVALNDK

SEQ ID NO: 90615 - DNA, 1185 bp, Bacillus stearothermophilus
  CDS (1)..(1185): transl_table=11
atgaacaagaagacgatccgcgacgttgatgtgaggggaaagcgcgtcttttgccgcgtcgatttcaacgttccgatggagcaaggcgctatcaccgatgacacgcgcattcgcgccgcactcccgacgatccgctatttgatcgagcacggggcgaaagtcattttggcgagccacctcggccgcccgaaaggaaaagtggtcgaagaattgcgtttggatgccgttgcgaagcggctcggcgagctgcttgaacggccggttgccaaaacgaatgaagcggtcggcgatgaggtgaaagcggcggtcgaccgtttgaacgaaggcgatgtgctcttgcttgagaacgtccgtttttaccctggcgaagagaaaaatgatcccgagctcgccaaagcgtttgcggagcttgcggatctatatgtcaacgatgcgttcggcgccgcccatcgcgctcatgcgtcgacggaaggcatcgcccattacttgccggcggtggccggatttttgatggaaaaagaacttgaagtgcttggcaaggcgctttcgaatccggaccgcccgtttacagcgatcatcggcggggcgaaagtgaaagacaaaatcggcgtcatcgacaatttgcttgaaaaagtcgacaacttgatcatcggcggcggactggcgtatacgttcgtcaaagcgctcggccatgacgtcggcaagtcgctgcttgaggaggacaaaatcgaactcgccaaatcgtttatggaaaaggcgaaagaaaaaggcgtccgtttttatatgccggtggacgtggtcgtcgccgaccggtttgcgaacgacgccaacacgaaagtcgtgccgattgacgcgattccagccgattggtcggcgcttgacatcggcccgaaaacgcgcgaattgtaccgcgatgtcattcgcgagtcgaagctcgttgtctggaacggcccgatgggcgtctttgaaatggacgcgttcgcccacgggacaaaagcgatcgccgaagcactggcggaagcgctcgacacctattcggtcatcggcggcggggattcggcggcggcggttgagaaattcggcttggccgacaaaatggatcatatctccaccggcggcggcgcttcgctcgagtttatggaaggaaaacagctgccgggtgtcgtcgcactcgaagacaaatga

SEQ ID NO: 90616 - protein, 394 aa, Bacillus stearothermophilus
MNKKTIRDVDVRGKRVFCRVDFNVPMEQGAITDDTRIRAALPTIRYLIEHGAKVILASHLGRPKGKVVEELRLDAVAKRLGELLERPVAKTNEAVGDEVKAAVDRLNEGDVLLLENVRFYPGEEKNDPELAKAFAELADLYVNDAFGAAHRAHASTEGIAHYLPAVAGFLMEKELEVLGKALSNPDRPFTAIIGGAKVKDKIGVIDNLLEKVDNLIIGGGLAYTFVKALGHDVGKSLLEEDKIELAKSFMEKAKEKGVRFYMPVDVVVADRFANDANTKVVPIDAIPADWSALDIGPKTRELYRDVIRESKLVVWNGPMGVFEMDAFAHGTKAIAEALAEALDTYSVIGGGDSAAAVEKFGLADKMDHISTGGGASLEFMEGKQLPGVVALEDK

SEQ ID NO: 90617 - DNA, 1185 bp, Bacillus subtilis
  CDS (1)..(1185): transl_table=11
atgaataaaaaaactctcaaagacatcgacgtaaaaggcaaagttgtattctgccgcgttgactttaacgttccaatgaaagacggggaagtaacagacgatacacgtatccgtgctgcgcttccaacaatcaaacaccttgcagaccaaggcgcaaaagtccttcttgcgagccacttaggccgcccgaaaggcgaagtggttgaggagcttcgtttaactcctgtcgctgcacgtctcggcgaactgcttggcaaagaagtgaaaaaagcggatgaagcatacggcgatgctgtaaaagcacaaatttctgagatgaaggacggagacgttcttgtattggaaaacgtacgtttctatcctggtgaagagaaaaatgatcctgagcttgcaaaagcatttgctgagcttgcagatgtatatgtaaatgacgcattcggtgctgcccaccgtgctcacgcatctacagctggaattgccgagcatctgccagcagttgcaggtttcttaatggaaaaagagcttgatgtacttggaaaagcggtttccaatcctgaccgcccgttcacagcgatcatcggcggagcgaaagtaaaagacaaaatcggtgtaatcgaaagtcttcttgataaagtagacaacctgatcatcggcggaggtcttgcttatactttcgtaaaagcgcttggctatgaagtcgggaaatctcttcttgaagaggataaaatcgagcttgcgaaatcatttatggaccgcgctaaagaaaaaggcgttaacttctacatgcctgaagatgtactcgttgcagatgatttctctaacgatgcaaacgtgaaaattgtgccgatctctgaaatccctagtgatttagaagcaatcgacattggtacgaaaacacgcgaaacgtatgctgacgtcatcaaaaacagcaaacttgtcgtgtggaacggaccaatgggcgtattcgaaatcgacttgttcgctcaaggaacaaaagcggttgcggaagcattggcagaggcgaaagatacatactctgtcatcggcggaggagactctgcggcagcggttgaaaaattcggccttgctgacaaaatgagccacatctcaacaggcggcggcgcatcccttgagtttatggaaggcaaagagcttccaggggtagctgcactgaacgataaataa

SEQ ID NO: 90618 - protein, 394 aa, Bacillus subtilis
MNKKTLKDIDVKGKVVFCRVDFNVPMKDGEVTDDTRIRAALPTIKHLADQGAKVLLASHLGRPKGEVVEELRLTPVAARLGELLGKEVKKADEAYGDAVKAQISEMKDGDVLVLENVRFYPGEEKNDPELAKAFAELADVYVNDAFGAAHRAHASTAGIAEHLPAVAGFLMEKELDVLGKAVSNPDRPFTAIIGGAKVKDKIGVIESLLDKVDNLIIGGGLAYTFVKALGYEVGKSLLEEDKIELAKSFMDRAKEKGVNFYMPEDVLVADDFSNDANVKIVPISEIPSDLEAIDIGTKTRETYADVIKNSKLVVWNGPMGVFEIDLFAQGTKAVAEALAEAKDTYSVIGGGDSAAAVEKFGLADKMSHISTGGGASLEFMEGKELPGVAALNDK

SEQ ID NO: 90619 - DNA, 1260 bp, Bacteroides thetaiotaomicron
  CDS (1)..(1260): transl_table=11
atgcagacaattgacaaattcaattttgccggtaaaaaggcatttgttcgcgtggacttcaatgtacccctggacgaaaacttcaacattacagatgacactcgtatgcgtgcagctcttcctactttgaagaagattttggctgacggcggtagcatcatcatcggttctcacctgggccgtccgaaaggcgttgccgacaaattctctttgaaacatatcatcaaacatctgtctgaactgctgggcgttgaagttcagtttgctaacgactgcatgggcgaagaagccgctgtaaaagctgctgctctgcaaccgggagaagttctgttgctcgaaaaccttcgcttctatgctgaggaagaaggcaaaccaagaggtttggctgaagatgccacagacgaagaaaaggctgctgcaaagaaggctgtcaaagaaagccagaaagaattcaccaagaaattggcttcttacgctgactgctacgtaaacgacgcattcggtacagctcaccgtgcacacgcttctacagctctgatcgctaaatacttcgacactgacaacaagatgttcggttacctgatggagaaagaagtaaaagctgttgataaagtattgaacgacatccaacgtccgttcactgctatcatgggtggttctaaagtttcttctaaaatcgaaatcatcgaaaacctgttgaataaggtagacaacctgatcatcgcaggtggtatgacttatacattcaccaaagcaatgggtggtaaaatcggtatctctatctgtgaggacgacaaacttgacctggctttggatctgatcaagaaagcaaaagaaaagggtgtaaaccttgtactggctgttgacgctaagatcgctgacgctttctctaacgacgctaacactcagttctgcgctgttgatgaaattcctgacggatgggaaggtcttgacatcggtcctaagactgaagaaatcttcgctaacgtaatcaaagaatccaaaactattctttggaacggtcctacaggtgtattcgaatttgaaaacttcactcacggttcacgtacagtaggtgaagctatcgttgaagcaactaagaacggtgcattctcacttgtggggggtggtgactctgtagcttgtgttaacaagttcggtctggctagcggcgtatcttatgtttctacaggtggtggcgcattgctcgaagcaatcgaaggaaaagttcttccgggtatcgctgccattaatgaataa

SEQ ID NO: 90620 - protein, 419 aa, Bacteroides thetaiotaomicron
MQTIDKFNFAGKKAFVRVDFNVPLDENFNITDDTRMRAALPTLKKILADGGSIIIGSHLGRPKGVADKFSLKHIIKHLSELLGVEVQFANDCMGEEAAVKAAALQPGEVLLLENLRFYAEEEGKPRGLAEDATDEEKAAAKKAVKESQKEFTKKLASYADCYVNDAFGTAHRAHASTALIAKYFDTDNKMFGYLMEKEVKAVDKVLNDIQRPFTAIMGGSKVSSKIEIIENLLNKVDNLIIAGGMTYTFTKAMGGKIGISICEDDKLDLALDLIKKAKEKGVNLVLAVDAKIADAFSNDANTQFCAVDEIPDGWEGLDIGPKTEEIFANVIKESKTILWNGPTGVFEFENFTHGSRTVGEAIVEATKNGAFSLVGGGDSVACVNKFGLASGVSYVSTGGGALLEAIEGKVLPGIAAINE

SEQ ID NO: 90621 - DNA, 1194 bp, Bartonella henselae
  CDS (1)..(1194): transl_table=11
atgggttttcgtacacttgatgatgttgatgtcacaggaaaacgtgttcttgtgcgggtggattttaatgtaccaatggcgcaaggaaaagtttgtgatgatacgcgtcttaaacgacataaagaaacgctccttgaattgcaaaagcgtggtgctaagcttattcttctttcccattgtgggcgccctaaaggacaagtggagccagaattttcactccatcctgttgtgcaagtgctggaaaaaataatcaaccaacccgtgaattttgcatcagattgtattggtgtagctgtacagacagcggttgaagcattgcaaaatggtggtattttactgcttgaaaatgttcgttttcattcaggtgaagaaaagaatgcgggctcttttgctgaggctctagcccataatggagatctctatgtcaatgatgctttttcagtctctcatcgtgcccatgcttcggtagaggggataacacattttttgccttcctatgcggggcgttctttacaatgtgagttgcaagcattggaaaaagggcttggtaagccagagcgtccggtgatcgcaattgttggaggggcgaaggtttccagtaagctttttgtgctcaatcatttggttaaaaaggtcgattatttggtcattggtggtggcatggccaatagttttttagcagcgcaaggtgtgtgtgttggaaagtcattgtgtgaacatgcgctgatcgaaacggtaaaaaaagttattgaaaaagcacgggagtgccaatgtacgcttctgctccctgtggatgcaatcgttggatttcgctttgaaaaagatgcgccacatcgtctctatgatattggagatattcctgaggatgggatgattttggatgttggtacgcgctccattgcgcatatcaatgccgtgatcgataaagccgctacccttgtgtggaatggacctcttggtgtttttgagatgtctccttttgatcaaggaacgattgcagtggcacgccatgcagcagaacttagtttgacagggaaattggtttcaattgctggagggggagatacggtgtttgcacttaatcatgctggtgttgctgatgattttacttatctttcaaccgcgggtggagcctttttggaatggatggaaggcaagatgctgcctggtattctagccctcacgcaggcttga

SEQ ID NO: 90622 - protein, 397 aa, Bartonella henselae
MGFRTLDDVDVTGKRVLVRVDFNVPMAQGKVCDDTRLKRHKETLLELQKRGAKLILLSHCGRPKGQVEPEFSLHPVVQVLEKIINQPVNFASDCIGVAVQTAVEALQNGGILLLENVRFHSGEEKNAGSFAEALAHNGDLYVNDAFSVSHRAHASVEGITHFLPSYAGRSLQCELQALEKGLGKPERPVIAIVGGAKVSSKLFVLNHLVKKVDYLVIGGGMANSFLAAQGVCVGKSLCEHALIETVKKVIEKARECQCTLLLPVDAIVGFRFEKDAPHRLYDIGDIPEDGMILDVGTRSIAHINAVIDKAATLVWNGPLGVFEMSPFDQGTIAVARHAAELSLTGKLVSIAGGGDTVFALNHAGVADDFTYLSTAGGAFLEWMEGKMLPGILALTQA

SEQ ID NO: 90623 - DNA, 1206 bp, Bdellovibrio bacteriovorus
  CDS (1)..(1206): transl_table=11
atggctaacggtcttaaaggcatcaagacagttcgtgatttcgagttggcgggaaaagttgttttcctgcgcttggatttgaacgttccaatggagaacggcaagatcacggatgaaaatcgcatcacggcatctttgccgacaatcaagtattgcatggagcagggagcgaagctggtaatggcttctcacctgggccgtccaaaaaccaaagacgacacagagttttctttggagccagtggcaaaacgcctgcaggaccttttgaatgccgaagtgattctggtggaagaaccggactctgacgctccaaaacacctgcttccatctttgaagcctcatcagctgatccttcttgaaaacgtgcgttttgaagaaggggagacgaaggactctgttgagttcgcgcaaaagatcgccaactacagcgacatttacatcaatgacgctttcggcgcttctcaccgcgctcacgcgaccattcacgctttgccttcagtgatgaaggacaaaggtatcggcttcctgattgaaaaggaaatcacgatgctggattcccttctgcaaaacccaaaacgcccgtacatcgcggtgatgggtggcgcgaaggtttctgacaagatcgcggttattgaacgccttatggacgttgttgacggtttcatcgtgggtggcgcgatggcgtacactttcctgaaagctcaaggcctgccagttggtaagtctttggttgaaaatgacaaattgaaatacgccaaagaaatgatcgagcgtatcgaagcccgcaacaaaaccattttgttgccggtggatcacgtggcgaccaaaggcatcacagacacagcgcacgcgcatgtgaccaatgatgtggcgattgcggaagacgaattgggtgtggacatcggtcctaaatccatcaagaacttctctgcggctttgcgtgaagcaggcactattttctggaacggtcctatgggcatctttgaaaatccggcttttgcaaaaggcaccttcggcgtggctcaggccattgctgacagcgaagcgatcaaaatcgtgggtggtggtgattctgcagcggcagcggaagcttccggctttgcaggtaaaatgacccacatctccactggtggtggcgcatccttggaatacttgcagggcgataaattgccaggacttgaaattttaagaactcgcatccgctaa

SEQ ID NO: 90624 - protein, 401 aa, Bdellovibrio bacteriovorus
MANGLKGIKTVRDFELAGKVVFLRLDLNVPMENGKITDENRITASLPTIKYCMEQGAKLVMASHLGRPKTKDDTEFSLEPVAKRLQDLLNAEVILVEEPDSDAPKHLLPSLKPHQLILLENVRFEEGETKDSVEFAQKIANYSDIYINDAFGASHRAHATIHALPSVMKDKGIGFLIEKEITMLDSLLQNPKRPYIAVMGGAKVSDKIAVIERLMDVVDGFIVGGAMAYTFLKAQGLPVGKSLVENDKLKYAKEMIERIEARNKTILLPVDHVATKGITDTAHAHVTNDVAIAEDELGVDIGPKSIKNFSAALREAGTIFWNGPMGIFENPAFAKGTFGVAQAIADSEAIKIVGGGDSAAAAEASGFAGKMTHISTGGGASLEYLQGDKLPGLEILRTRIR

SEQ ID NO: 90625 - DNA, 1182 bp, Borrelia burgdorferi
  CDS (1)..(1182): transl_table=11
atgtcaataaaaacagtaaaagactttagtagctttgcgggcaagcgagctttagtaagatgtgattttaatgttcccctaaaagaggggagcattagcgatgatactagaattagggcagcattgtctacaatagagtatctaaaagaaagaggagctaggattgtgcttgtaagtcatttgggtagaccagatggaaagaaaaatcctaaatattctcttaagccggttgccaataggttgtcagagcttttaggccaagatgtcaagatgctttctgattgtattggaagtgaggttgtaaatagtaccttgcaaatgaaggatggggatgttgtattgcttgaaaatgtaaggttttatgcagaagaagagaaaaacgataaaaattttgcaaaaaaactttctgaaaatggagatgtttttgtaaatgatgcttttggcgcagctcatagagctcatgcttcaactgtgggagttgctgattatttgccgtctgttggtggatttttaatggaaaaagaagataaatttcttggtggaatattaaaaaatcccgaaaggccatttgtttcaattattggtggttctaaggtttcttcaaagattgcggtactagaatcacttttgtcaaagtctaatgtagttgtgattggcggtggaatggcttatacttttttgcattccgaaggatattctataggcaaatctcttttagaggacgaatatattggtatagcatcttcttttttaaagaaagcaaaagagctgggcgttaaagtaattttaccacttgatcatattgtagctgatgattttaacaaaaattcaattcctgagtatattgactcctttaatattcctgaaaacaagattggcatggatattggagctaatactttaaaagaaattgaaaatgttgtgaaaactgccaaaactataatttggaatggtcctcttggtgtatttgaatttgattcattttcaaaagggactgctaaggttgccgaaatggtagcatcttgctcaggtttaaccgttgttggtggtggagattctgttgcagctgttaataaatttaatttatctgataagattactcatgtttcaacgggcggtggtgcatcgcttgaatatcttgaagggagaattttgccgggtattaaggttttggagaattaa

SEQ ID NO: 90626 - protein, 393 aa, Borrelia burgdorferi
MSIKTVKDFSSFAGKRALVRCDFNVPLKEGSISDDTRIRAALSTIEYLKERGARIVLVSHLGRPDGKKNPKYSLKPVANRLSELLGQDVKMLSDCIGSEVVNSTLQMKDGDVVLLENVRFYAEEEKNDKNFAKKLSENGDVFVNDAFGAAHRAHASTVGVADYLPSVGGFLMEKEDKFLGGILKNPERPFVSIIGGSKVSSKIAVLESLLSKSNVVVIGGGMAYTFLHSEGYSIGKSLLEDEYIGIASSFLKKAKELGVKVILPLDHIVADDFNKNSIPEYIDSFNIPENKIGMDIGANTLKEIENVVKTAKTIIWNGPLGVFEFDSFSKGTAKVAEMVASCSGLTVVGGGDSVAAVNKFNLSDKITHVSTGGGASLEYLEGRILPGIKVLEN

SEQ ID NO: 90627 - DNA, 1197 bp, Bradyrhizobium japonicum
  CDS (1)..(1197)
atggcgaacaaattccgcaccctcgacgacgtcgacgtgaagggcaaacgcgtgctgctgcgcgtcgacctcaacgtgcccatggagaacgggcgcgtcaccgacgcaacccggctcgagcgcgtcgcgccgaccatcaccgagctcgccgacaagggcggcaaggtgatcctgctcgcgcatttcggccggccgaagggacgcgatgccaaggagtcgctcaagcccgtcaccgaggcgctgtcgaaggtcctgaacaagcccgtcgcgtttgccgacgactgcatcggcgagcccgcggccacggccgtggcggcactcaaggacggcgacatcctgtgcctggaaaacacccgcttccacaaggaagaggaaaagaacgatcccgccttcgtcgcggaattggccaagctcggcgacatctgggtcaatgacgcgttctcggccgcgcaccgcgcccacgcctcgaccgaaggcctcggccacaagctgccggcctatgccggccgcaccatgcaggccgagctcgatgcgctggagaaggcgctgggctcgccgaccaagccggtcatcgcgatcatcggcggcgccaaggtctcgaccaagatcgacctgctcgaaaacctcgtcagcaaggtcgacgcgctggtgatcggcggcggcatggccaacaccttcctgcacgcccagggcgtcggcatcggcaagtcgctggccgagaaggatctcgcgccgaccgcgctgcgcatcatcgagaaggcggaagccgccaactgcgccatcatcctgccggtcgacgccaccgtcgcctatcatttcgcggccaacgcgccgtcccacgcctacggcctcgatgcgatcccggccgacggcatgatcctcgacgtcggcccgcaatcggtcgcgcgcgtgcacgcggcgatcgacgacgcggcgacgctggtctggaacgggccgctcggcgccttcgagatgcagccgttcgaccgcggcacggtcgcggccgccaagcacgccgccgagcgcaccaaggcgaaaaagttgatctcgatcgcgggcggcggcgacaccgtcgcggccctcaaccaggcccacgtggccggtgacttcacctatgtctcgaccgccggtggcgcatttcttgaatggatggaaggcaagccactgcccggcgtcgaggtcctgcgcatcaagtag

SEQ ID NO: 90628 - protein, 398 aa, Bradyrhizobium japonicum
MANKFRTLDDVDVKGKRVLLRVDLNVPMENGRVTDATRLERVAPTITELADKGGKVILLAHFGRPKGRDAKESLKPVTEALSKVLNKPVAFADDCIGEPAATAVAALKDGDILCLENTRFHKEEEKNDPAFVAELAKLGDIWVNDAFSAAHRAHASTEGLGHKLPAYAGRTMQAELDALEKALGSPTKPVIAIIGGAKVSTKIDLLENLVSKVDALVIGGGMANTFLHAQGVGIGKSLAEKDLAPTALRIIEKAEAANCAIILPVDATVAYHFAANAPSHAYGLDAIPADGMILDVGPQSVARVHAAIDDAATLVWNGPLGAFEMQPFDRGTVAAAKHAAERTKAKKLISIAGGGDTVAALNQAHVAGDFTYVSTAGGAFLEWMEGKPLPGVEVLRIK

SEQ ID NO: 90629 - DNA, 1188 bp, Brucella suis
  CDS (1)..(1188)
atgttccgcacccttgacgatgccaatgtccaatccaagcgcgtgctggtccgtattgacctcaacgtgccgatggcaaacggcgaagtcaccgaccttacccgcatcgaacgcatcgttccgaccatcgcggaactgtcaaggaagggcgcgaaggtcatcctgctcgcccatttcggtcgcccgaagggggttgcctcggatgaaaattcgctgaagcatgtcgtgaagccgctctccaaggttctggatcacagtgttcattttgccgaagactgcatcggcgacaaggcgaaagcggccgtcgatgcgctgaaggacggcgacgtcctgcttctggaaaatacccgtttccacaagggcgaggaaaagaacgatcctgaattcgtgcaggcgctggccgccaatggcgatctctatgtgaacgatgccttttccgccgctcaccgcgcccatgcctcgactgaaggtctggcccatgtcctgcctgccttcgcgggccgcgccatgcaggctgagcttgaagcacttgaaaagggcctcggcaatccggcccgcccggtggtcgccatcgtcggcggtgcaaaggtttcgaccaagctcgacctcctgtccaacctgatcgaaaaggtcgatgcgcttgtcatcggcggcggcatggccaacacgttccttgcagccaagggtcttgatgtcggcaaatcgctctgcgagcatgagctggcctcgaccgcacgcgaaatcatggccaaggccgaaaccaccaaatgcgccatcatcctgccggtggacgcggtcgtgggctggcacttcgccgccgatacgccacaccagacctatggcgtggattcggttccgggcgacgccatgatccttgacgcaggcgagctttcgaccgacctcattgcttcggccatcgatgatgccgcaacattggtctggaacggcccgcttggggctttcgagttgcgcccctttgacacagcaacggtgaaggtcgcaaggcatgtcgcaaagcgcacaaaggaaggcaagcttgtttcggtcggcggcggcggcgatacggtggcagccctcaaccatgcgggcgtggtcgacgacttcacctatatctcaaccgctggcggcgctttcctcgaatggatggaaggcaaaccgcttccgagcgtcgatgtattgaagaagtga

SEQ ID NO: 90630 - protein, 395 aa, Brucella suis
MFRTLDDANVQSKRVLVRIDLNVPMANGEVTDLTRIERIVPTIAELSRKGAKVILLAHFGRPKGVASDENSLKHVVKPLSKVLDHSVHFAEDCIGDKAKAAVDALKDGDVLLLENTRFHKGEEKNDPEFVQALAANGDLYVNDAFSAAHRAHASTEGLAHVLPAFAGRAMQAELEALEKGLGNPARPVVAIVGGAKVSTKLDLLSNLIEKVDALVIGGGMANTFLAAKGLDVGKSLCEHELASTAREIMAKAETTKCAIILPVDAVVGWHFAADTPHQTYGVDSVPGDAMILDAGELSTDLIASAIDDAATLVWNGPLGAFELRPFDTATVKVARHVAKRTKEGKLVSVGGGGDTVAALNHAGVVDDFTYISTAGGAFLEWMEGKPLPSVDVLKK

SEQ ID NO: 90631 - DNA, 1254 bp, Caenorhabditis elegans
  CDS (1)..(1254)
atgagctccctcaacaagttggctatcgaccagttgaacctcgccggaaagcgagttttgatccgtgttgacttcaatgtcccactcaaggatggcaaaatcaccaacaatcaacgtattgctgccgctgttccaaccattcagcatgctcttagcaacggagccaaatctgtcgttttaatgtcacatttgggacgtccagatggcagacgccaagacaagtacaccttgaaaccagttgctgaagagttgaaggctctcttgaaaaaagatgttctcttcctcgacgactgtgtcggatcagaagtggaggctgcatgcgccgatccagctcctggatcagtcattctccttgaaaatcttcgttatcatctggaagaggagggcaaaggagtcgatgcatccggtgccaaggttaaggctgattcagcagccgtaaagaaattccgcgagtctctcaccaagcttggcgatatttatgtcaatgatgctttcggaaccgctcacagagcccatagctccatggttggagtcgagcactcacaacgtgcaagtggattcttgctcaagaacgagctctcctactttagcaaggccctcgacaacccagctcgtccattcctggccatccttggaggagctaaggtcgctgacaagattcagttgatcaagaacttgttagacaaggttaatgagatgatcatcggcggaggaatggcctataccttcttgaaagttgcccagggagtcaagatcggaaactctttgtacgacgaagaaggagcgaaaattgtgaacgagcttcttgaggctgccaaggcaaagggagttcaaatccatctcccagtggatttcgtcattgctgacaagttcgccgaggacgcaacctcgaagaccgtcaccgccgaggaaggtgttccagatggccacatgggacttgatgttgggccggaatcttctaagatcttcgccgctgccattcaacgcgccaaaacgattgtctggaacggtccagcaggagtattcgagtttgataaattcgccacaggcaccaagtcattgatggatgaagttgtcaaggccaccgctgccggagccatcacaatcattggaggaggtgacactgcgaccgccgccaagaagtataacacggaagataaggtgtctcacgtctcaactggaggtggagccagtttggaattgctcgaaggaaaagttctgccaggagttgatgctctttcgccagctcaataa

SEQ ID NO: 90632 - protein, 417 aa, Caenorhabditis elegans
MSSLNKLAIDQLNLAGKRVLIRVDFNVPLKDGKITNNQRIAAAVPTIQHALSNGAKSVVLMSHLGRPDGRRQDKYTLKPVAEELKALLKKDVLFLDDCVGSEVEAACADPAPGSVILLENLRYHLEEEGKGVDASGAKVKADSAAVKKFRESLTKLGDIYVNDAFGTAHRAHSSMVGVEHSQRASGFLLKNELSYFSKALDNPARPFLAILGGAKVADKIQLIKNLLDKVNEMIIGGGMAYTFLKVAQGVKIGNSLYDEEGAKIVNELLEAAKAKGVQIHLPVDFVIADKFAEDATSKTVTAEEGVPDGHMGLDVGPESSKIFAAAIQRAKTIVWNGPAGVFEFDKFATGTKSLMDEVVKATAAGAITIIGGGDTATAAKKYNTEDKVSHVSTGGGASLELLEGKVLPGVDALSPAQ

SEQ ID NO: 90633 - DNA, 1203 bp, Campylobacter jejuni
  CDS (1)..(1203): transl_table=11
atgagtgatattatttctataaaagacattgatttagctaagaaaaaagtttttataagatgtgattttaatgttcctcaagatgattttttaaatatcactgatgatagacgcataagatcagctattcctacgataagatattgtttggataatggttgtagtgtgattttagcctctcatttagggcgtccaaaagaaattagctctaaatattctttagaacctgtggctaagcgtcttgctagacttttagataaagaaattgttatggcaaaagatgttatcggcgaagatgcaaaaaccaaagctatgaatttaaaagcgggtgaaattttacttcttgaaaatttgcgttttgaaaaaggcgaaactaaaaatgatgaaaatttagccaaagaacttgcttctatggttcaagtttatatcaatgatgcttttggagtatgccatagagcacattctagtgtagaggcgattactaaattttttgatgaaaaacacaaaggcgcaggatttttactccaaaaagaaattgattttgcaagcaatcttatcaaacatccagcacgtccttttgtcgctgttgttggaggttcaaaggtaagtggaaaacttcaagcattgacaaatttattaccaaaggtagataaattaatcataggcggaggtatggcatttacttttttaaaagctttaggttatgatataggaaattcacttttagaagaagaacttttagaagaagctaataaaattcttaccaagggtaaaaatttaggagtgaaaatttatcttccagtagatgttgtagccgctcctgcgtgctcacaagatgtgccgatgaaatttgttccagcgcaagaaattccaaatggttggatgggtttagatataggacctgcgagtgtgagactttttaaggaggtgatttctgatgcgcaaacgatttggtggaatggacctatgggtgtttttgaaattgataaattttcaaaaggtagcattaaaatgagtcattatatcagcgaaggacatgcaacttctgttgttggaggcggtgatacggctgatgtggttgcgcgtgcaggtgatgcagatgaaatgacttttatttctactggaggtggtgcttctcttgaacttatagaaggcaaagaacttccaggtgtaaaagctttaagatctaaggaaaatgaatga

SEQ ID NO: 90634 - protein, 400 aa, Campylobacter jejuni
MSDIISIKDIDLAKKKVFIRCDFNVPQDDFLNITDDRRIRSAIPTIRYCLDNGCSVILASHLGRPKEISSKYSLEPVAKRLARLLDKEIVMAKDVIGEDAKTKAMNLKAGEILLLENLRFEKGETKNDENLAKELASMVQVYINDAFGVCHRAHSSVEAITKFFDEKHKGAGFLLQKEIDFASNLIKHPARPFVAVVGGSKVSGKLQALTNLLPKVDKLIIGGGMAFTFLKALGYDIGNSLLEEELLEEANKILTKGKNLGVKIYLPVDVVAAPACSQDVPMKFVPAQEIPNGWMGLDIGPASVRLFKEVISDAQTIWWNGPMGVFEIDKFSKGSIKMSHYISEGHATSVVGGGDTADVVARAGDADEMTFISTGGGASLELIEGKELPGVKALRSKENE

SEQ ID NO: 90635 - DNA, 1254 bp, Candida albicans
  CDS (1)..(1254): transl_table=12
atgtcattatctaacaaattatcagtcaaagacttagacgttgctggaaagagagtctttatcagagttgacttcaacgtcccattggacggtaagactatcaccaacaaccaaagaattgttgctgctttgccaaccatcaaatacgttgaagaacataaaccaaaatacattgtcttggcttcccacttgggtagaccaaacggtgaaagaaacgacaaatactcattagctccagttgctactgaattggaaaaattgttgggtcaaaaagtcaccttcttgaacgattgtgttggtccagaagtcaccaaggctgttgaaaacgccaaagatggtgaaatctttttgttggaaaacttgagataccacattgaagaagaaggttcttccaaagacaaggatggtaagaaagtcaaggctgatccagaagccgttaagaaattcagacaagaattgacttcattggctgatgtctacattaacgatgcctttggtactgctcacagagcccactcctctatggttggtctcgaagttccacagagagctgctggtttcttaatgtccaaagaattggaatactttgctaaggctttggaaaacccagaaagaccattcttggccattttgggtggtgctaaagtttctgacaagattcaattgattgacaacttgttggacaaggttgatatgttgattgttggtggtggtatggccttcactttcaagaaaatcttgaacaaaatgccaattggtgattctcttttcgatgaagccggtgctaaaaacgttgaacacttggttgaaaaagctaagaaaaacaatgttgaattgatcttgccagttgattttgtcactgctgataaattcgacaaagatgccaaaacttcttctgctactgatgctgaaggtattccagacaactggatgggtttggactgtggtccaaaatctgtcgaattgttccaacaagctgttgccaaagctaagaccattgtttggaacggtccaccaggtgttttcgaatttgaaaaattcgccaacggtactaaatccttattggatgctgctgtcaaatctgctgaaaatggtaacattgttatcattggtggtggtgatactgctactgttgctaagaaatacggtgtcgttgaaaaattatcgcacgtttctactggtggtggtgcttcattggaattattagaaggtaaagacttgccaggtgtagttgctctttccaacaaaaactaa

SEQ ID NO: 90636 - protein, 417 aa, Candida albicans
MSLSNKLSVKDLDVAGKRVFIRVDFNVPLDGKTITNNQRIVAALPTIKYVEEHKPKYIVLASHLGRPNGERNDKYSLAPVATELEKLLGQKVTFLNDCVGPEVTKAVENAKDGEIFLLENLRYHIEEEGSSKDKDGKKVKADPEAVKKFRQELTSLADVYINDAFGTAHRAHSSMVGLEVPQRAAGFLMSKELEYFAKALENPERPFLAILGGAKVSDKIQLIDNLLDKVDMLIVGGGMAFTFKKILNKMPIGDSLFDEAGAKNVEHLVEKAKKNNVELILPVDFVTADKFDKDAKTSSATDAEGIPDNWMGLDCGPKSVELFQQAVAKAKTIVWNGPPGVFEFEKFANGTKSLLDAAVKSAENGNIVIIGGGDTATVAKKYGVVEKLSHVSTGGGASLELLEGKDLPGVVALSNKN

SEQ ID NO: 90637 - DNA, 1251 bp, Candida glabrata
  CDS (1)..(1251)
atgtctctatcctctaagctaactgttcaagaccttgaattgaaggacaagcgtgtcttcatcagagttgacttcaacgtcccattggatggtaagaagatcacttctaaccaaagaattgttgctgctttgccaaccatcaagtatgttttggagcacaacccacgttacgttgtcttggcctcccacttgggtagaccaaacggtgaaagaaacgagaaatactccttggctccagttgctgaagagctacaatccttgttgggtaagccagttactttcttgaacgactgtgtcggtagcgaagttgactccgctgtcaaggcttccgccccaggctccgttatcctattggaaaacttgagataccacatcgaagaagaaggttccagaaaggtcgacggccaaaaggtcaaggcctccgctgaagacgtcgccaagttcagaaaggagctgtgctctctagctgatgtttacatcaacgacgctttcggtaccgcccacagagctcactcctccatggtcggtttcgacttgccacaacgtgctgctggtttccttttgaccaaggaattgcaatacttcggtaaggctttggaaaacccaaccagaccattcttggctatcctaggtggtgctaaggtcgctgacaagatccaattgatcgacaacttgttggacaaggtcgactccatcatcatcggtggtggtatggctttcaccttcaagaaggttttggaaaacgctgaaatcggtgactccatcttcgacaaggctggtgctgaaatcgttccaaagttgatggaaaaggctaaggctaagggtgtcgaagtcgtcctaccagttgacttcgtcattgctgacgctttctccgctgacgctaacaccaagatcgtctccgacaaggaaggtatcccagccggctggcaaggtttggacaatggtccagagtccagaaagttgttcgctgcaactatcgctaaggctaagaccattgtctggaacggtcctccaggtgtcttcgaattcgagaagttcgcttccggtaccaaggctatgttggacgaagttgtcaagtcctccacttccggtaacaccgtcatcatcggtggtggtgacactgctaccgtcgctaagaagtacggtgtcactgacaagatctcccacgtttccactggtggtggtgcctccttggaattgttggaaggtaaggaattgccaggtgtcgctttcctatctgaaaagaactaa

SEQ ID NO: 90638 - protein, 416 aa, Candida glabrata
MSLSSKLTVQDLELKDKRVFIRVDFNVPLDGKKITSNQRIVAALPTIKYVLEHNPRYVVLASHLGRPNGERNEKYSLAPVAEELQSLLGKPVTFLNDCVGSEVDSAVKASAPGSVILLENLRYHIEEEGSRKVDGQKVKASAEDVAKFRKELCSLADVYINDAFGTAHRAHSSMVGFDLPQRAAGFLLTKELQYFGKALENPTRPFLAILGGAKVADKIQLIDNLLDKVDSIIIGGGMAFTFKKVLENAEIGDSIFDKAGAEIVPKLMEKAKAKGVEVVLPVDFVIADAFSADANTKIVSDKEGIPAGWQGLDNGPESRKLFAATIAKAKTIVWNGPPGVFEFEKFASGTKAMLDEVVKSSTSGNTVIIGGGDTATVAKKYGVTDKISHVSTGGGASLELLEGKELPGVAFLSEKN

SEQ ID NO: 90639 - DNA, 1254 bp, Candida maltosa
  CDS (1)..(1254)
atgtcattatccaacaaattatctgtcaaagacttaaacgtcactggtaaaagagtttttatcagagttgatttcaacgttccattggacggtaaaaccatcaccaacaaccaaagaattgttgctgctttaccaactatcaaatatgttgaagaacaaaaaccaaaatgtatcattttagcttctcacttgggtagaccaaacggtgaaagaaatgaaaaatactctttggccccagttgctgctgaattggaaaaattattgggtcaaaaagtcaccttcttggatgactgtgttggtccagaagtcaccaaagctgttgactctgctactgaaggtcaaatcttcttgttggaaaacttgagattccacattgaagaagaaggttctgctaaagacaaggatggtaaaaaaactaaagctgacccagaagctgtcaagaaattcagagaacaattgacttctttagctgatgtttacgtcaatgatgctttcggtactgcccacagagcccactcttctatggttggtttggaagttccagaaagagctgctggtttcttgatgtccaaagaattggaatactttgctaaagctttggaaaacccacaaagaccattcttggctatcttgggtggtgctaaagtttctgacaaaatccaattgattgacaacttgttggacaaagttgatatgttgattgttggtggtggtatggctttcaccttcaaaaaagtcttgaacaacatgccaattggtgactctcttttcgacgaagctggtgctaaaaacgttgaaaacttggttgctaaagccaagaagaacaatgttgaattgatcttgccagttgatttcgtcactgccgacaaattcgacaaagatgctgaagtctctactgccgatgatgttactggtatcccagacaaatggatgggtttagactgtggtccaaaatccagaaaattatttgctgatgccgttgctaaagctaaaaccattgtttggaacggtccaccaggtgttttcgaatttgacaaattcgctgaaggtactaaatctttattggatgacgctgtcaaatccgctgaagttggtaacattgtcatcattggtggtggtgataccgctactgttgctaagaaatacggtgttgttgacaaattatcccacgtttctactggtggtggtgcttctttggaattattagaaggtaaagaattaccaggtgtaactgctctttctaacaaagcctaa

SEQ ID NO: 90640 - protein, 417 aa, Candida maltosa
MSLSNKLSVKDLNVTGKRVFIRVDFNVPLDGKTITNNQRIVAALPTIKYVEEQKPKCIILASHLGRPNGERNEKYSLAPVAAELEKLLGQKVTFLDDCVGPEVTKAVDSATEGQIFLLENLRFHIEEEGSAKDKDGKKTKADPEAVKKFREQLTSLADVYVNDAFGTAHRAHSSMVGLEVPERAAGFLMSKELEYFAKALENPQRPFLAILGGAKVSDKIQLIDNLLDKVDMLIVGGGMAFTFKKVLNNMPIGDSLFDEAGAKNVENLVAKAKKNNVELILPVDFVTADKFDKDAEVSTADDVTGIPDKWMGLDCGPKSRKLFADAVAKAKTIVWNGPPGVFEFDKFAEGTKSLLDDAVKSAEVGNIVIIGGGDTATVAKKYGVVDKLSHVSTGGGASLELLEGKELPGVTALSNKA

SEQ ID NO: 90641 - DNA, 1191 bp, Caulobacter crescentus
  CDS (1)..(1191): transl_table=11
atgaccttccgcaccctcgacaccgccgatctcgccggcaagcgcgctctggtccgcgtggacttcaacgtcccggtcgacggtggcaaggtcgccgacgacacccggctgaaggcggccctgccgaccatccgcttcctggccgacaagggcgccaaggtcgtgctgctggcccacttcgaccgtcccaagggcaaggtcgtgccggagatgagtctcgccttcgtggccgagccgctggcggccctgctgggcgcgccggtcgccttcgtcggtgactgcgtcggcccggccgccgctgaggtcgtgaacggcctcgccgatggcggcgtcgccttgctggagaacgtccgcttccacgccggcgaagagaagaacgacgccgagttcgccaaggccctggccgccaatggcgacgtttatgtcaacgacgccttcagcgccgcccaccgcgcccacgcctcgaccgaaggcctggccaagctgctgcccgcctatccgggcgtgtcgatgcagcgcgagctggaagccctggacgcggcgctgggcaatccgaagaagccggtgatcggcatcgtcggcggctccaaggtctcgaccaagctcgacctcttgaacaacctggtcgccaagctggatcgcctggcgatcggcggcggcatggccaacaccttcctgttcgcccagggccacgatgtcggcggctcgctgtgcgaaaaggacctggccgacaccgcccgcgagatcatggaaaaggccaaggccgccggctgcgaactgctgctgccggtcgacgtcgtggtcgccaagaaggtcgcgccgggcgttgagacggcggttcgttcgctgagcgaagtccaggctgacgacctgatcctggacgcgggcccggaaagcgccaagcgtctgctggccgccatggaccagagcctgaccttgatctggaacggccctctgggtgttttcgaggtgcctccgttcgatgaagcgaccgtttccgcagcgaaacatgccgcttcgctcgccaaatcgggtaaaatcgtagccgtggccggtggtggtgatacagtcgccgctctgaaccacgcaggcgtgtcggccgacttcaccttcgtttcgacggcgggcggcgcgttcctggaatggatggagggcaagacgctcccgggcgtcgcggcgctcgaatcctga

SEQ ID NO: 90642 - protein, 396 aa, Caulobacter crescentus
MTFRTLDTADLAGKRALVRVDFNVPVDGGKVADDTRLKAALPTIRFLADKGAKVVLLAHFDRPKGKVVPEMSLAFVAEPLAALLGAPVAFVGDCVGPAAAEVVNGLADGGVALLENVRFHAGEEKNDAEFAKALAANGDVYVNDAFSAAHRAHASTEGLAKLLPAYPGVSMQRELEALDAALGNPKKPVIGIVGGSKVSTKLDLLNNLVAKLDRLAIGGGMANTFLFAQGHDVGGSLCEKDLADTAREIMEKAKAAGCELLLPVDVVVAKKVAPGVETAVRSLSEVQADDLILDAGPESAKRLLAAMDQSLTLIWNGPLGVFEVPPFDEATVSAAKHAASLAKSGKIVAVAGGGDTVAALNHAGVSADFTFVSTAGGAFLEWMEGKTLPGVAALES

SEQ ID NO: 90643 - DNA, 1212 bp, Chlamydophila caviae
  CDS (1)..(1212): transl_table=11
atggatagattgacagtcagggaactttccccagaagaaaacaaggttttagttcgtgtagattttaatgttcctataaaagatgggaagattcttgatgatattcgcattcgtagtgctatgccaacaattaactatctgttgcaaaaacgcgctgctgtaattttaatgagtcatttaggccgccctaagggaacggggtttgaagagaagtattccctccagcctgttgttgaagttttagaaggctacttaggccatcacgttcctttagctcccgattgtattggggaggttgctcgtcaggcagtagcgcagctatctccagggcgcgtattgctattagaaaatctccgtttccataggggtgaagaacatcccgaagaagatcctacatttgctgctgaactttcttcttatggagatttttatgtgaatgatgcttttgggacttctcatagaaaacatgcttctgtttatcatgtgccccaagctttccctggaagatctgcagcaggccttcttatggagaaagaactcgagtttttagggcagcaccttctgcattctcctaaacgtccttttactgctatccttggtggggctaaagtatcttcaaaaatcggggtaatagaagccttactatcgcaagtgaacaacttactcttagcaggaggcatgggattcaccttcttaaaggcactaggtaagtccgtagggaattccctagttgaagaatcgggaatagagcttgctcgtcgtgttttgaaacttgcagagcagcgtaatgtgcgtatcgttctccctatagatgtaaaagttgccaaggcgtgcgagcctggagtcagctggtcagaaacacttatagatcaggggattcctgcagatcttgaaggtttagatatcggaaccaaaacgattcaagagttttgtaagatcattgatgcttcagcaacagtattttggaacggccccgtcggtgtttatgaagttcctccttttgatcaaggttctatggctatcgccaactgtctagcacgacattcttctgcaactaccgtcgtgggtggtggtgacgccgctgctgttgttgctttagccggatgtacctctcaagtctcacacgtatcgacaggcgggggagcttctttagagtttttagaaaacggctttttaccaggcacagaagttctctctccagcgcaagattaa

SEQ ID NO: 90644 - protein, 403 aa, Chlamydophila caviae
MDRLTVRELSPEENKVLVRVDFNVPIKDGKILDDIRIRSAMPTINYLLQKRAAVILMSHLGRPKGTGFEEKYSLQPVVEVLEGYLGHHVPLAPDCIGEVARQAVAQLSPGRVLLLENLRFHRGEEHPEEDPTFAAELSSYGDFYVNDAFGTSHRKHASVYHVPQAFPGRSAAGLLMEKELEFLGQHLLHSPKRPFTAILGGAKVSSKIGVIEALLSQVNNLLLAGGMGFTFLKALGKSVGNSLVEESGIELARRVLKLAEQRNVRIVLPIDVKVAKACEPGVSWSETLIDQGIPADLEGLDIGTKTIQEFCKIIDASATVFWNGPVGVYEVPPFDQGSMAIANCLARHSSATTVVGGGDAAAVVALAGCTSQVSHVSTGGGASLEFLENGFLPGTEVLSPAQD

SEQ ID NO: 90645 - DNA, 1212 bp, Chlamydia muridarum
  CDS (1)..(1212): transl_table=11
atggataaactatcaataaaagacctttccccagaagggaaaaaggtactagttcgtgtagattttaatgttcctattaaggacggaaaaattttagatgatgtccgtattcgtagtgctatgcctacgatcaattacctattgaagagagatgctgcgatcattttagtcagtcatttagggcgtcctaagggagatatgttcgaagaagcgtattcgttagctcctattgtgcctgtattagaaggatatttggggcatcatgtgcctctatctccagattgtgttggagaagttgcacggcaggctgttgcgcagttgtctcctggaagagtgcttcttcttgaaaatgtacgttttcatagaggggaagagcatcctgaggaggatcctagttttgctgttgagcttgctgcttacgccgatttttatgtaaatgatgccttcggaacctctcatcggaagcatgcttctgtgtatcgagttcctcaaatgttccccgatcgtgctgctgcgggatttctaatggaaaaagagcttgaatttttgggacagcatttattagtggagcctaagcgtccctttacggccatcctaggtggtgctaaggtatcttcaaaaataggggtaatcgaagctttactctcgagagttgataatttagtgttagctggaggtatggggtatacttttctaaaagctatgaatcagcaagttgggaattcattggtggaagagacaggcattcctttagcgaaaagggttttggaaaaagctcggacacaaggggttaagatttatcttccggtagatgccaaagttgcaagacgttgcgaaactggggaagattggcaagagttgtcaatacaggaggggattcctgagggtttctctggtttcgatattgggtctaagacgatagctctattttctgaggtgatccaagattccgcaacggtattttggaatggccctgttggggtttatgaagttcctcctttcgatcaaggatcaaaagccatcgctcagtgtcttgcaagtcattcttctgcagtgacggttgttggtgggggtgatgccgctgccgtagttgctttagcaggatgtacctcgcagatttcccatgtatccacaggaggaggagcttctttggaattcttagagaagggctatcttccagggacagaaattctctcccctgctcgcagttaa

SEQ ID NO: 90646 - protein, 403 aa, Chlamydia muridarum
MDKLSIKDLSPEGKKVLVRVDFNVPIKDGKILDDVRIRSAMPTINYLLKRDAAIILVSHLGRPKGDMFEEAYSLAPIVPVLEGYLGHHVPLSPDCVGEVARQAVAQLSPGRVLLLENVRFHRGEEHPEEDPSFAVELAAYADFYVNDAFGTSHRKHASVYRVPQMFPDRAAAGFLMEKELEFLGQHLLVEPKRPFTAILGGAKVSSKIGVIEALLSRVDNLVLAGGMGYTFLKAMNQQVGNSLVEETGIPLAKRVLEKARTQGVKIYLPVDAKVARRCETGEDWQELSIQEGIPEGFSGFDIGSKTIALFSEVIQDSATVFWNGPVGVYEVPPFDQGSKAIAQCLASHSSAVTVVGGGDAAAVVALAGCTSQISHVSTGGGASLEFLEKGYLPGTEILSPARS

SEQ ID NO: 90647 - DNA, 1209 bp, Chlamydia pneumoniae
  CDS (1)..(1209): transl_table=11
atggataagctaacagtacaagatctttctccagaagaaaaaaaagtcctcgtacgtgtagatttcaatgtccccatgcaagatggcaagatactcgatgacattcgtattcgcagtgcgatgcctacaatcaactatctacttaagaaacatgctgcagtgattttaatgagtcatttagggcgacctaaaggacaggggttccaagaggaatattctctgcaacccgttgtggatgttctcgaaggatacttaggacatcatgtgcctctagctccagattgtgtgggtgaggttgcacgtcaagctgtagctcagctttctcctggtcgcgttttgcttcttgagaacttgcgtttccatataggagaagaacatccagaaaaagacccgacgttcgccgcagaactctcttcctacggggatttctatgtcaacgatgctttcggaacttcgcatagaaaacatgcttcagtctatgtagtgccgcaggctttcccaggtagagccgcagcaggcctgcttatggaaaaagaattggaatttttaggaagacatctattgacctcccctaagaggcctttcactgccatccttggaggagctaagatttcttctaaaattggagttatagaggctctactgaatcaagtagactacctcttattagctggaggtatgggatttactttcctacaagccttgggaaaatccctagggaactctcttgtggagaaatctgccttggatcttgctagaaatgtattgaaaattgctaaaagtcgtaatgttaccatagttttgcctagcgatgtgaaagcagccgaaaatctccaatctaaggaatattctgtgatttctatagatcaaggcattcctccgcatcttcaaggctttgatattggacctagaacaaccgaagaatttatccgtattataaaccaatcagcgactgtgttttggaatggtcctgtgggtgtttatgaggtccctccttttgactctggatctattgctatagcgaatgccttaggcaatcacccttcagctgttactgtcgtgggtggaggagatgcggcagctgtggttgctttggcaggctgctctacaaaagtttcccatgtttctactggaggaggggcttctttagagtttctagagcagggcttcctcccaggtacagaagttttatctccatccaaaagctaa

SEQ ID NO: 90648 - protein, 402 aa, Chlamydia pneumoniae
MDKLTVQDLSPEEKKVLVRVDFNVPMQDGKILDDIRIRSAMPTINYLLKKHAAVILMSHLGRPKGQGFQEEYSLQPVVDVLEGYLGHHVPLAPDCVGEVARQAVAQLSPGRVLLLENLRFHIGEEHPEKDPTFAAELSSYGDFYVNDAFGTSHRKHASVYVVPQAFPGRAAAGLLMEKELEFLGRHLLTSPKRPFTAILGGAKISSKIGVIEALLNQVDYLLLAGGMGFTFLQALGKSLGNSLVEKSALDLARNVLKIAKSRNVTIVLPSDVKAAENLQSKEYSVISIDQGIPPHLQGFDIGPRTTEEFIRIINQSATVFWNGPVGVYEVPPFDSGSIAIANALGNHPSAVTVVGGGDAAAVVALAGCSTKVSHVSTGGGASLEFLEQGFLPGTEVLSPSKS

SEQ ID NO: 90649 - DNA, 1194 bp, Chlorobium tepidum
  CDS (1)..(1194): transl_table=11
atgcagaaaaagacattgtctgacatatcgttacaaggaaaacgcgtcctgatgcgagtcgatttcaacgtgccgctcgaccaggacaggaacatcactgacgagaaaaggatcgtggaggcactgccttcaatccgcaaggtcatcgacaatggcggcaggctgattctgatgtcgcacctcggaagaccgaaaggcaaggtcaacccggcattctccctttcaccggtcgcaaagcgcctctccgagctgcttgattgcccggtgacgatggctggtgactgcatcggcaccgaggtgatgcagcaggtgctcgccttgcaggacggtgacgtgctcatgctcgaaaacctccgcttccaccccgaagaggaggctaatgatcctgacttcgccagggagctggcttcgctgggcgaaatctacgtcaacgacgcattcggtacggcgcaccgcgcccacgcctcgaccgagggcatcacccacttcatgcagaccgccgttgcgggctacctcatcgaaaaggagctgcgctatctcggtacggcgctcaacgatgcacagcgtccgttcgtggccattctcggcggcgcgaagatttcaggcaagatcgacgtgctcgaaagcctcttcgagaaagtcgataccgttcttgtcggcggcgcgatggtcttcaccttctttaaggctcagggcctcgacgttggcaactcgcttgtcgaagaaaacaagctcgaactggctgtttccctgcttgaaaaagccaaagcgaaaaacgtgcgcttgcttcttccggaagacgtggtcgtggccggagagatttccgccgacgcgccttcgcgtgtcgagccggtcagcgccatctccgcaggcatgattggtctcgacatcggcccggcaaccatcgaaacctaccgcaaggaaattctcgacgcgaaaaccgtgctctggaatggcccgatgggtgtgttcgagatcgaccagttcgccaggggcaccttcgccgtcgcccaggcgcttgccgacgcaaccgcagagggcgcgatcaccatcatcggcggcggcgactcggcggcggccatcgcaaaggctggcctctccgacaaggtgacgcacgtttcgaccggcggtggcgccagcctcgaattcctcgaaggcaaggagctgccgggcatcgcagccctgaacgattag

SEQ ID NO: 90650 - protein, 397 aa, Chlorobium tepidum
MQKKTLSDISLQGKRVLMRVDFNVPLDQDRNITDEKRIVEALPSIRKVIDNGGRLILMSHLGRPKGKVNPAFSLSPVAKRLSELLDCPVTMAGDCIGTEVMQQVLALQDGDVLMLENLRFHPEEEANDPDFARELASLGEIYVNDAFGTAHRAHASTEGITHFMQTAVAGYLIEKELRYLGTALNDAQRPFVAILGGAKISGKIDVLESLFEKVDTVLVGGAMVFTFFKAQGLDVGNSLVEENKLELAVSLLEKAKAKNVRLLLPEDVVVAGEISADAPSRVEPVSAISAGMIGLDIGPATIETYRKEILDAKTVLWNGPMGVFEIDQFARGTFAVAQALADATAEGAITIIGGGDSAAAIAKAGLSDKVTHVSTGGGASLEFLEGKELPGIAALND

SEQ ID NO: 90651 - DNA, 1212 bp, Chlamydia trachomatis
  CDS (1)..(1212)
atggataaattatcgataagagacctttctcttgaagggaaaaaggtactagttcgtgtagattttaatgttcctattaaagatggaaagattttagatgatgtgcgtattcatagcgcaatgcctacgatccattatcttttgaaacaagatgcagcagtcattttggtaagccatgtaggacgcccaaagggaggcgtatttgaagaggcatattcattagctcccattgttcctgtgctagaggggtatttagggcatcatgtgcctctttctccagattgtataggagaagtcgcgcgacaggcggtcgcgcaactttctcctggtagagttcttcttttagagaatgtacgtttccataagggggaagaacattctgacgaggatcctagttttgctattgagcttgctgcttatgcagatttttatgtgaatgatgctttcgggacatctcatcgtaagcatgcttctgtatatcgggtgccacaactattccctgaccgggcagccgcaggcttccttatggaaaaagaattagaatttttgggccagcatctattagttgagcctaaacgtcctttcactgctattttaggaggcgcgaaaatgtcttcgaaaataggagtaatcgaggcgctactttcgtgcgtggatcatctcgtattagctgggggtatggggtacacctttttaagggctatgaatcgccaggtagggaattcattagtggaagaatcagggatccctttagcgaaaaaagtattagagaaagctcaagctctgggggtgaagatccatcttccagtggatgcgaaggtcgctaaacagtgtgactctggagaggattggagggagctgtctatacaggaaggaatccctgaaggattagcaggttttgatattggggcacagacaatagaactattttctaaggtgattcaggagtcggcaacgatattttggaatggtcctgtcggggtatacgaagtccctccttttgatcaaggatcgaaggcaatagcacaatgtctcgcgagccattcttctgctgtgactgtggttgggggaggcgatgcggctgctgtagtagctcttgcagggtgtgcttcacagatctcccacgtatctacagggggaggcgcttccttagaattcttagaaaaaggtagtcttcctggtacggaaatactatctccagctcaaagctaa

SEQ ID NO: 90652 - protein, 403 aa, Chlamydia trachomatis
MDKLSIRDLSLEGKKVLVRVDFNVPIKDGKILDDVRIHSAMPTIHYLLKQDAAVILVSHVGRPKGGVFEEAYSLAPIVPVLEGYLGHHVPLSPDCIGEVARQAVAQLSPGRVLLLENVRFHKGEEHSDEDPSFAIELAAYADFYVNDAFGTSHRKHASVYRVPQLFPDRAAAGFLMEKELEFLGQHLLVEPKRPFTAILGGAKMSSKIGVIEALLSCVDHLVLAGGMGYTFLRAMNRQVGNSLVEESGIPLAKKVLEKAQALGVKIHLPVDAKVAKQCDSGEDWRELSIQEGIPEGLAGFDIGAQTIELFSKVIQESATIFWNGPVGVYEVPPFDQGSKAIAQCLASHSSAVTVVGGGDAAAVVALAGCASQISHVSTGGGASLEFLEKGSLPGTEILSPAQS

SEQ ID NO: 90653 - DNA, 1176 bp, Chromobacterium violaceum
  CDS (1)..(1176): transl_table=11
atgaaattcaacaaactctccgaacagaatctttccggcaagcgcgcgctgatccgcgtggacatgaacgtgccgctgaagaacggcgtgatcggcgacgacacccgcatccgcgccagcctgcccaccatcgaacactgcctgaaggccggcgccgccgtgctgctgatgacccatctcggccgtccgaccgagggcgagcccaagccggaggacagcctggcgccggtggtggcccgcctgtccgagctgctgggcaagccggtgcgcctgatcgccgacttccacgccggcgtcgagcttgcgccgggcgaagtggcgatgctggagaacgtgcgcctgaacaagggcgagaagaagaacaacgacgagctgggccgcgcttacgccgcgctgtgcgacgtcttcgtccacgacgccttcggcaccgcgcaccgcgccgaggcctccacccacgcggtggccaagttcgcgccggtcgcctgcgccggcctgctgctgtcggccgagctcgacgcgctgggcaaagcgctgcaggcgccggcccgcccgctggtggccatcgtcgccggctccaaagtgtcgaccaagctgaccatcctggaagcgctggccgacaaggtggaccagctgatcgtcggcggcggcatcgccaacaccttcctgctggccgagggcaaggccatcggcaaatcgctggccgaggccgatctggtggaagacgcccgccgcgtgatcgccaagatccgcgcccgcggcggcgacgtgccgctgccggccgacgtggtgtgcgccaaggaattcgccgaaaccgccgccgcggccaccaagaacgtggcggaagtggtcgccgacgacatgatcctcgacatcggcccggacgctgccaaacagctggccgccatcatcgcccaggccggcaccgtggtgtggaacggcccggtcggcgtgttcgagttcgaccagttcggcaacggcaccaagacgctggcccaagccatcgcccagtccaaggcgttttcgatcgccggcggcggcgatacgctggcggcgatcgccaagtacggcatcaccgacgacatcagctacatctcgaccggcggcggcgccttcctggagttcctggaaggcaaggagctgccggcggtggccatcctggccgagcgcgcgcagtaa

SEQ ID NO: 90654 - protein, 391 aa, Chromobacterium violaceum
MKFNKLSEQNLSGKRALIRVDMNVPLKNGVIGDDTRIRASLPTIEHCLKAGAAVLLMTHLGRPTEGEPKPEDSLAPVVARLSELLGKPVRLIADFHAGVELAPGEVAMLENVRLNKGEKKNNDELGRAYAALCDVFVHDAFGTAHRAEASTHAVAKFAPVACAGLLLSAELDALGKALQAPARPLVAIVAGSKVSTKLTILEALADKVDQLIVGGGIANTFLLAEGKAIGKSLAEADLVEDARRVIAKIRARGGDVPLPADVVCAKEFAETAAAATKNVAEVVADDMILDIGPDAAKQLAAIIAQAGTVVWNGPVGVFEFDQFGNGTKTLAQAIAQSKAFSIAGGGDTLAAIAKYGITDDISYISTGGGAFLEFLEGKELPAVAILAERAQ

SEQ ID NO: 90655 - DNA, 1194 bp, Clostridium perfringens
  CDS (1)..(1194)
atgaacttcaataaaaagactatagaagacgttcaagtaaaaggtaaaaaagtattagtaagatgcgactttaacgttccattaaaagatggtgttataactgatgaaaacagattaaacggagctatgccaactataaaatacttagttgataatggcgctaaagtaatcctttgctcacatatgggtaaaccaaaaggagaagctaaaccagaattctcattagcacctgtagctaaaagattaagcgaaatgcttggtaaagaagtagtatttgctgctgacgacaacgttgttggagaaaatgctaaaaaagctgtagctgaaatgaaagatggagacgtagttttacttcaaaatacaagatacagaaaagaagaaactaaaaatggtgaagagttatcaaaagaattagctagcttagctgaaatgtttgttaacgatgcattcggtactgctcacagagctcactgctcaacagttggagtaactgaatacttaaaaccagcagtatgtggatacttaatccaaaaagagcttaagttcttaggagatgctgtagaaactccagaaagaccattcgttgctatcttaggtggagctaaagtttcagataagataaacgttataaacaaccttttagaaaaagttgatactttaataataggtggaggaatggcttacacattcttaaaagctcaaggatatactgtaggaagttcattagtagaagaagataaagttgaatacgctaaagaaatgttagctaaagctgaggaaaaaggtgttaaattattattacctgtagaccacagagtagctaaagaattcaaagatgttgaagctgtagttacagaagatcaaaacatcgctgaaggattcatgggattagatatcggaccaaaaactgaagctatctacgctgaagctataaaagatgctaaaacagttatctggaacggaccaatgggagtattcgaattcgaaaacttcaacaaaggaacaatagctgttgctaaagctatggctgaagcagatgctactactataatcggtggtggagattcagctgctgctgtaaacatcttaggattcggtgacaaaatgtctcacatctcaactggtggtggagcttcattagaattcttagaaggaaaagtattaccaggaatagctgctttaaacgataaataa

SEQ ID NO: 90656 - protein, 397 aa, Clostridium perfringens
MNFNKKTIEDVQVKGKKVLVRCDFNVPLKDGVITDENRLNGAMPTIKYLVDNGAKVILCSHMGKPKGEAKPEFSLAPVAKRLSEMLGKEVVFAADDNVVGENAKKAVAEMKDGDVVLLQNTRYRKEETKNGEELSKELASLAEMFVNDAFGTAHRAHCSTVGVTEYLKPAVCGYLIQKELKFLGDAVETPERPFVAILGGAKVSDKINVINNLLEKVDTLIIGGGMAYTFLKAQGYTVGSSLVEEDKVEYAKEMLAKAEEKGVKLLLPVDHRVAKEFKDVEAVVTEDQNIAEGFMGLDIGPKTEAIYAEAIKDAKTVIWNGPMGVFEFENFNKGTIAVAKAMAEADATTIIGGGDSAAAVNILGFGDKMSHISTGGGASLEFLEGKVLPGIAALNDK

SEQ ID NO: 90657 - DNA, 1206 bp, Clostridium tetani
  CDS (1)..(1206): transl_table=11
gtggtttatgtggcatttaataaaaaaaccattgaagacattgatgttaaaggaagaaaagttttagtaagatgtgattttaatgtacctttaaaagatggaaaaataacagatgaaaatagattaatgggagcactaccaactattaaatatattatggaaaagggcggtaaagttattttatgttctcaccttggtaaaccaaaaggagagcctaaacaggaattatctctagcaccagtagctaaaagattatctgagcttttaaataaggaagttttatttccagcagataatgaagtagttggagaaaatgctaaaaaagcagtagaaaatatgaaagatggagatgtaatcctattacaaaatacaagatatagaaaagaagaaactaagaatgaagaaaccttttcaaaagaattagcatctcttgcagatatatttgtaaatgatgcttttggaacagcacatagagcacattgctctacagttggagtaacagaatttgttgcaacatcagtatgtggatacttaatccaaaaagaattaaagtttttaggtaatgctgttgaaaatccacaaagaccttttatatcaattcttggaggagctaaagtatctgataaaataaatgtaataaataatttattagaaaaagttgatactctaattataggtggaggaatgagctatactttccaaaaggctcaagggtacacaataggaagctctcttttagaagaagacaaaatagattatgcaaaagaaatgatagaaaaggcaaaagaaaagggagtaaaattacttctacctgtagataatgtagcagctgaaaaatttgcagaagatgcagaagctattataacagaagatcaaaatattaaagaaggatatatgggacttgatataggacctaaaacttcaaaactttattcacaagaggttcaaagcgctaagactgtagtttggaatggacctatgggtgtatttgaatttgaaaaatttgcaaaaggtactatagaagtagcgaaggccatggctgaatcacaagctacaaccataataggtggaggagatagtgctgcggctgtaaatcaacttggatttggggataaaatgacccatatatctacaggtggaggagcttcattagaatttttagaaggaaaagagcttccaggaatagcagcacttaacgataaatag

SEQ ID NO: 90658 - protein, 401 aa, Clostridium tetani
MVYVAFNKKTIEDIDVKGRKVLVRCDFNVPLKDGKITDENRLMGALPTIKYIMEKGGKVILCSHLGKPKGEPKQELSLAPVAKRLSELLNKEVLFPADNEVVGENAKKAVENMKDGDVILLQNTRYRKEETKNEETFSKELASLADIFVNDAFGTAHRAHCSTVGVTEFVATSVCGYLIQKELKFLGNAVENPQRPFISILGGAKVSDKINVINNLLEKVDTLIIGGGMSYTFQKAQGYTIGSSLLEEDKIDYAKEMIEKAKEKGVKLLLPVDNVAAEKFAEDAEAIITEDQNIKEGYMGLDIGPKTSKLYSQEVQSAKTVVWNGPMGVFEFEKFAKGTIEVAKAMAESQATTIIGGGDSAAAVNQLGFGDKMTHISTGGGASLEFLEGKELPGIAALNDK

SEQ ID NO: 90659 - DNA, 1218 bp, Corynebacterium diphtheriae
  CDS (1)..(1218): transl_table=11
atggctattaaaactcttaaagatctcttggcagaaggcgttgaaggacgccacgtgcttgttcgttcagatttcaatgtaccgctgaacgatgatcgtgaaattactgatgctggacgtattaccgcctcgctcccaacgatcaaagcattagttgacaacggtgctcgagtaatcttgatggctcacttgggccgccccaagggagaagtaaatgaaaaattctcactggctcctgtagcggaggcattgtctgaagcccttggacagtatgtcgcactcgcaggcgacgtcgttggtgaagatgctcatgaacgcgcgaacggtctcaatgacggtgacgttctgctccttgaaaacgttcgctttgatccacgcgagacctcgaaggaagaagctgagcgtggcgaatttgcggatcagcttgtcgcactcaccgctgaaaatggtgctttcgtatccgatggctttggcgttgttcaccgagctcaggcatcagtatttgatgttgcgcagagattgccgcattatgcgggaacactcgtggaaaaagagctagaagttcttggaaacaaggttgcctctgctccagaacgtccttatgcggtcattctaggtggcgcaaaggtgtctgacaagcttggcgtgatcgaagcgctagcaacaaaggctgacaaacttattattggtggcggaatgtgctacaccttcttggcagccaaaggtatcaacgtgcaaaagtcgctgttgcaagaagaacaaatcaacaagtgcaaagaacttctagaagcatacgctgataagatcgttcttccagttgatctggtagcagctgcagagttcgccagcgatgcagaaaataagatcgttgcaattgacgaaatccccgaaggctggatgtctcttgatgtcgggcctaagactgttgagaagtttgctgaggttctagcgacatcaaagaccgtattctggaatgggcctatgggcgtttttgagtttgaaaacttctcagccggtacccgtggcgtagcagaagctattatcgcagctacggctaatggtgcattctctgttgtcggcggtggcgattcggctgctgctgttcgacttcttggtctagacgaggatggattcagccatatctctactggtggcggagcatcacttgaactcctcgaaggcaaaaaccttcctggcgtttcggtgctcgaaagctaa

SEQ ID NO: 90660 - protein, 405 aa, Corynebacterium diphtheriae
MAIKTLKDLLAEGVEGRHVLVRSDFNVPLNDDREITDAGRITASLPTIKALVDNGARVILMAHLGRPKGEVNEKFSLAPVAEALSEALGQYVALAGDVVGEDAHERANGLNDGDVLLLENVRFDPRETSKEEAERGEFADQLVALTAENGAFVSDGFGVVHRAQASVFDVAQRLPHYAGTLVEKELEVLGNKVASAPERPYAVILGGAKVSDKLGVIEALATKADKLIIGGGMCYTFLAAKGINVQKSLLQEEQINKCKELLEAYADKIVLPVDLVAAAEFASDAENKIVAIDEIPEGWMSLDVGPKTVEKFAEVLATSKTVFWNGPMGVFEFENFSAGTRGVAEAIIAATANGAFSVVGGGDSAAAVRLLGLDEDGFSHISTGGGASLELLEGKNLPGVSVLES

SEQ ID NO: 90661 - DNA, 1218 bp, Corynebacterium glutamicum
  CDS (1)..(1218): transl_table=11
atggctgttaagaccctcaaggacttgctcgacgaaggcgtagacggacgccacgtcatcgttcgatctgacttcaatgttcccctcaacgatgaccgcgagatcaccgataagggccgaatcattgcctccctaccaacccttaaagcactgagcgaaggtggcgcaaaggtcatcgtcatggctcaccttggccgcccaaagggcgaggtcaacgagaagtactccctcgcacctgtcgctgaggcactctccgatgagcttggccagtacgttgcacttgccgcagacgttgttggcgaagacgcacacgagcgcgcaaacggcctgaccgagggcgacatcctgctcctggagaacgtgcgcttcgacccacgcgaaacctccaaggacgaggcagagcgcaccgctttcgctcaggagctcgcagctcttgcagcagacaacggcgcattcgtttctgacggcttcggtgttgtccaccgcgcacagacctccgtctacgacattgcaaagttgctgccacactacgctggcggactggtagagaccgagatttccgttctggaaaagatcgcagaatcaccagaggcaccatacgtagtggttctcggtggatccaaggtctctgacaagatcggtgttattgaggcgctggctgccaaggctgacaagatcatcgtcggtggcggcatgtgctacaccttcctcgcagctcagggacacaacgttcagcagtccctcctgcaggaagaaatgaaggctacctgcaccgacctgctcgcacgcttcggtgacaagatcgttctcccagttgacctggttgcagcatccgaatttaacaaggacgcagagaagcagatcgttgacctggactccatcccagaaggctggatgtctcttgacatcggaccagagtccgtcaagaacttcggtgaggttctcagcaccgctaagaccatcttctggaacggcccaatgggcgtgttcgagttcgcagcattctctgaaggcacccgcggcatcgcccaggccatcatcgatgcaactgcaggcaacgacgcattctccgttgttggcggtggcgactccgcagcatccgttcgcgtgctcggcctgaacgaagacggcttctcccacatctccaccggtggtggcgcatccctcgagtaccttgaaggcaaggaactcccaggcgttgcaattctcgctcagtaa

SEQ ID NO: 90662 - protein, 405 aa, Corynebacterium glutamicum
MAVKTLKDLLDEGVDGRHVIVRSDFNVPLNDDREITDKGRIIASLPTLKALSEGGAKVIVMAHLGRPKGEVNEKYSLAPVAEALSDELGQYVALAADVVGEDAHERANGLTEGDILLLENVRFDPRETSKDEAERTAFAQELAALAADNGAFVSDGFGVVHRAQTSVYDIAKLLPHYAGGLVETEISVLEKIAESPEAPYVVVLGGSKVSDKIGVIEALAAKADKIIVGGGMCYTFLAAQGHNVQQSLLQEEMKATCTDLLARFGDKIVLPVDLVAASEFNKDAEKQIVDLDSIPEGWMSLDIGPESVKNFGEVLSTAKTIFWNGPMGVFEFAAFSEGTRGIAQAIIDATAGNDAFSVVGGGDSAASVRVLGLNEDGFSHISTGGGASLEYLEGKELPGVAILAQ

SEQ ID NO: 90663 - DNA, 1176 bp, Coxiella burnetii
  CDS (1)..(1176): transl_table=11
atgtccaatctcaatcttcacaacaaacgcgtgatgattcgtgaagacctgaacgtgccaatgaaaaatggaaaaattacgaatgatgaacggatcgtgcgcgcattgccgacgattcaaaaagccatagaacaaaaagcacgagtgatgattttatcgcatttgggaagacccgaagaagggaaattcgaaaaagaattttctttagccccggtagcgcgattgctgagtaaaaaattaaatcaaaaagtgccgctaatcaatgattggctcaaaggagtcgcggttgaaccgggtcaggccattctttgtgaaaatgtgcggtttaataaaggtgaaaacgaaaataataccgaactcgctaaacggatggcggagttgtgcgatatttttgttatggatgcttttgcaacggcacatcgtgcccaggcatccacggctggcgtcgctgcatacgcaaaattagcctgcgccggtcctttgctcatttccgaagtcgaagctttatcgcgcgccttagaaaatcctcaaaaaccattggtcgctgtggtaggcggctcaaaagtttcaaccaaaattcatttgttagaaaatttattagataaagtcgatcaattaatcgtaggcggtggtattgcaaatacctttttaaaagcgcagggctattcaattggaaaatcgctctgtgaaaatgaatggttggacgcggctcagcaattttgggaaaaagccgccgaaaaaaacgtttctctccccttgccggtggatgttattgtggcggatgaattgtcagaagatgcgaaagcaacggtgaaaaatatcgatgccgtaaccagtaacgaatctattttcgatgtagggccaaacacttcggcaacctacgccaagttaatggcgcaagcgggcacgatcgtttggaacgggcccatcggcgttttcgaaatagaagcatttagtcaaggaacacgcgcgttggcacaagccgttgcaaaaagtaccgcttattctatagtggggggtggagacaccctggctgctttggataaattcaatctgaccgatcaaatgtcttacgtcagtacagccggaggcgcatttttagagtttttggaaggaaaaatactacctgctattaaaattttaacgcaacgagcaaaagagtatgagcaaaaataa

SEQ ID NO: 90664 - protein, 391 aa, Coxiella burnetii
MSNLNLHNKRVMIREDLNVPMKNGKITNDERIVRALPTIQKAIEQKARVMILSHLGRPEEGKFEKEFSLAPVARLLSKKLNQKVPLINDWLKGVAVEPGQAILCENVRFNKGENENNTELAKRMAELCDIFVMDAFATAHRAQASTAGVAAYAKLACAGPLLISEVEALSRALENPQKPLVAVVGGSKVSTKIHLLENLLDKVDQLIVGGGIANTFLKAQGYSIGKSLCENEWLDAAQQFWEKAAEKNVSLPLPVDVIVADELSEDAKATVKNIDAVTSNESIFDVGPNTSATYAKLMAQAGTIVWNGPIGVFEIEAFSQGTRALAQAVAKSTAYSIVGGGDTLAALDKFNLTDQMSYVSTAGGAFLEFLEGKILPAIKILTQRAKEYEQK

SEQ ID NO: 90665 - DNA, 1251 bp, Debaryomyces hansenii
  CDS (1)..(1251)
atgtctttatctaacaagttatctgtcaaggacttagatgtctccggtaagagagttttcatcagagtggatttcaatgttccattagatggtaaaaccatcaccaacaaccaaagaattgttgctgctttaccaactatcaagtatgtgttagaaaacaagcctaaggctgttatcttggcttctcacttaggaagaccaaacggtgaaaaagttgacaagttctctttagctccagttgccagtgaattggaaaagttgttgggtaagaaggttaacttcttagacgactgtgttggtgacaatgttgaaaaagctgtgaacggtggtagtgacggtgaagttttcttattagaaaacttgagattccacatcgaagaagaaggttcgcaaaagaaggacggtgaaaaggtcaaggcttccggcgaagatgtcaagaaattcagacaacaattgaccaacttggccgatgtctacgttaatgatgctttcggtactgcccacagagcccactcttctatggttggtttagaattaccacaaaaagctgctggtttcttaatggccaaggaattagaatactttgctaaggccttagaaaacccagtcagaccattcttagccatcttaggtggtgccaaggtttctgacaagatccaattgatcgacaacttgttagacaaggtcgatttattgattgttggtggtggtatgtctttcaccttcaagaaggtcttagacaacatgccaattggtgactccttgttcgacgaagctggtgctaagaacgtcgaaaacttagttgctaaggctaagaagaacaacgtcaagattgtcttgccggttgatttcattactgccgacaaattcgacaaggatgctaagacctccactgccactgaagacgaaggtatcccagacaattggatgggtttagatgctggtccaaagtccaacgaattgtttgctaagactgttgctgaagctaagactattgtctggaatggtccaccaggtgttttcgaattcgacaacttcgctaaaggtactaagtctttattagatgctgctgtcaagtctgctgaatctggtaacactgttatcatcggtggtggtgacactgctactgttgctaagaagtacggtgttgttgacaagttgtcccatgtctctaccggtggtggtgcttctttagaattattggaaggtaaggaattgccaggtgttgttgctatttccgataagaaataa

SEQ ID NO: 90666 - protein, 416 aa, Debaryomyces hansenii
MSLSNKLSVKDLDVSGKRVFIRVDFNVPLDGKTITNNQRIVAALPTIKYVLENKPKAVILASHLGRPNGEKVDKFSLAPVASELEKLLGKKVNFLDDCVGDNVEKAVNGGSDGEVFLLENLRFHIEEEGSQKKDGEKVKASGEDVKKFRQQLTNLADVYVNDAFGTAHRAHSSMVGLELPQKAAGFLMAKELEYFAKALENPVRPFLAILGGAKVSDKIQLIDNLLDKVDLLIVGGGMSFTFKKVLDNMPIGDSLFDEAGAKNVENLVAKAKKNNVKIVLPVDFITADKFDKDAKTSTATEDEGIPDNWMGLDAGPKSNELFAKTVAEAKTIVWNGPPGVFEFDNFAKGTKSLLDAAVKSAESGNTVIIGGGDTATVAKKYGVVDKLSHVSTGGGASLELLEGKELPGVVAISDKK

SEQ ID NO: 90667 - DNA, 1236 bp, Deinococcus radiodurans
  CDS (1)..(1236): transl_table=11
ttgacgggtttgtgcccgctccatcaaccatcacctcttgaccatccacattccggaggaacacccatgcaaaacctcagtcaattggatgtcaagggcaagcgcgtcctggtgcgcgtggactacaacgtgccggttggggacggcgtggtacaggacgacacccgcatcacggcgagcgtgccgaccatcaagaagctgcttgacggcggcgccagcgtcgtgctgatgagccacttcggacggcccaagaatggccccgaggacaagtacagcctgaagccggtggctgaggccgtcagccgcgcactcgggcaggacgtgaagttcattcccagcctgccaggcagcgacgaaaccctccaggccgtgcaggcgctcaggcccggtgaagtcgcgctgctggaaaacgtgcgcttcgaggcgggcgaggaaaagaacgatgcggcgctgaacgacaagctggccaagctgggtgacgccttcgtcctcgacgcgtttggctcggcgcaccgggcgcactcgtcggtcagcggcgtggccggcaagctaccgcacgcggcgggcgggctgctccagagcgaagtggacgcgctcggcaagttgctgcacgcgccggagcatccctacgtggtcatcatcggcggggcgaaagtcagcgacaagatcaaggtgatcgagaacctgctgcccaaagtggaccgcatgctgatcggcggcggaatgatgttcaccttcatcaaggcgcgcggcgggcagatcggcaacagtctggtggaagacgaccagcttgacctggcgaaggggttgctggagaagtacggtgacaagctgctgcttccgaccgacgcggtggccgccgacaaattcgccgccgatgctcagagcaaagtcgtccctgccgaccagattcctgacggctggatgggcctcgatatcgggcctgacacgcagcgggcgtatgccgacgccttgcagggcgccaaaactgtcttctggaacggtccgatgggcgtgttcgagttcgaccagttcgcggcaggcaccaacgcggtggcggcggcggtggggagcctgaaagaccaggcctacaccgtggtcggcggcggcgactcggtgagcgccatcaacaagagcggcaaggccgaccagatcgaccacatctccaccggcggcggtgcgagcctggaactgctggaaggcaaggagctgcccggcgtcgtggcgatggcgtga

SEQ ID NO: 90668 - protein, 411 aa, Deinococcus radiodurans
MTGLCPLHQPSPLDHPHSGGTPMQNLSQLDVKGKRVLVRVDYNVPVGDGVVQDDTRITASVPTIKKLLDGGASVVLMSHFGRPKNGPEDKYSLKPVAEAVSRALGQDVKFIPSLPGSDETLQAVQALRPGEVALLENVRFEAGEEKNDAALNDKLAKLGDAFVLDAFGSAHRAHSSVSGVAGKLPHAAGGLLQSEVDALGKLLHAPEHPYVVIIGGAKVSDKIKVIENLLPKVDRMLIGGGMMFTFIKARGGQIGNSLVEDDQLDLAKGLLEKYGDKLLLPTDAVAADKFAADAQSKVVPADQIPDGWMGLDIGPDTQRAYADALQGAKTVFWNGPMGVFEFDQFAAGTNAVAAAVGSLKDQAYTVVGGGDSVSAINKSGKADQIDHISTGGGASLELLEGKELPGVVAMA

SEQ ID NO: 90669 - DNA, 1182 bp, Desulfovibrio vulgaris
  CDS (1)..(1182): transl_table=11
atggccgttatcaagatgaccgatctcgacctcaagggaaaacgggttcttctgcgtgaagacctcaacgtgcccctcaaggaggggcgcatcaccagcgacaagcgcatacgcgccgctctgccgtccattcgcatggcgatggaggcgggggcccgtgtgcttatcgtctcgcatctgggtcgccccgtagagggcgagttcgatgaggctttttcgctcgcccctgtggccgcacatctttcgcgcgaactcgggcgtgatgtgcgtcttgtgaaggactacatcgacggtgtggatgtcgccgagggcgattgcgtcctgtgcgagaacgtccgctttctcaagggtgagaagaagaacaccgaggaactgggcagaaggcttgccgctctgtgcgacatcttcgtcatggacgcgttcggtgccgcacaccgggcgcaggcttctacccacgccgtggcgcgcttcgcccctgttgcctgcgcggggccgctgctggctgcagaacttgacgcgctggaacgcgcccttgacgccccgaagcacccgcttgtgggcatcatcggcggttcgaaggtctcgaccaagctgacgcttctcgacaacctgtcacaccgtgtcgaccgcctcatcgtgggcggcggcatcgccaataatttcatcaaggccgccggttacgaagtgggcaagtccctctatgagcccgaactcgtggaagaggccgcacgcctcatggccgcagccagggcagctggcggtgagattcccgtgccgctggacgtggtggtcggccccgagttggccgatggtgcccctgccacggtgcggaaggtctccgaagtcggccctgacgagatgattctcgacatcggccccgcgacggcgacacgttaccgcgagattctgctcgccgccggaaccatcgtctggaacggcccggtgggtgctttcgagtgggaacagttcggggcaggaacccgcgccctgtgcgaggctgtcgccgacagtcctgccttttcgatagccggcggtggcgataccgtcgccgccgtcgagaagtatggcgttgccagccgtgtgggatacatctccacgggtggtggagccttcctcgagttccttgaaggcaaggaacttccggctgtcgccatactgcaggaaagggccgcgcaatcgtga

SEQ ID NO: 90670 - protein, 393 aa, Desulfovibrio vulgaris
MAVIKMTDLDLKGKRVLLREDLNVPLKEGRITSDKRIRAALPSIRMAMEAGARVLIVSHLGRPVEGEFDEAFSLAPVAAHLSRELGRDVRLVKDYIDGVDVAEGDCVLCENVRFLKGEKKNTEELGRRLAALCDIFVMDAFGAAHRAQASTHAVARFAPVACAGPLLAAELDALERALDAPKHPLVGIIGGSKVSTKLTLLDNLSHRVDRLIVGGGIANNFIKAAGYEVGKSLYEPELVEEAARLMAAARAAGGEIPVPLDVVVGPELADGAPATVRKVSEVGPDEMILDIGPATATRYREILLAAGTIVWNGPVGAFEWEQFGAGTRALCEAVADSPAFSIAGGGDTVAAVEKYGVASRVGYISTGGGAFLEFLEGKELPAVAILQERAAQS

SEQ ID NO: 90671 - DNA, 1248 bp, Drosophila melanogaster
  CDS (1)..(1248)
atggccttcaataagctgagcatcgaaaacctggacttggcgggcaagcgggtgttgatgcgcgtcgacttcaatgtgcccatcaaggagggcaagatcaccagcaaccagagaattgtcgctgccttggatagtatcaagttggccctttccaagaaagccaagtcggtggtgctgatgtcccacttgggtcgtcccgatggcaacaagaacatcaagtacaccctggcacccgtggccgctgagctgaagaccctgcttggccaggatgtgatcttcctaagtgactgcgtcggcagcgaagtggaggccgcttgcaaggatcccgcaccgggatccgtcattctgctggagaacgtccgcttctacgtggaggaggagggcaagggcttggatgccagcggcggcaaggtcaaggccgatcctgccaaggtcaaggagttccgtgccagcctggccaagctgggcgatgtctatgtcaacgacgccttcggcactgcccatcgcgcccacagttccatgatgggcgatggcttcgagcagcgcgcagctggtctgttgctgaacaaggagctgaagtacttctcgcaggccctggacaagccaccaaatcccttcctggcaattctcggtggcgccaaggtggccgacaagatccagctgattgagaaccttctggacaaggtcaacgagatgatcatcggtggcggcatggccttcaccttcctgaaggtcctcaacaacatgaagatcggcggttccctgttcgacgaggagggctccaagatcgtcgagaaactggtggagaaggccaagaagaataacgtgcagttgcatctgccagtggactttgtctgcggcgacaagttcgccgagaacgctgccgtcagcgaggccaccgtggaggccggaattcccgatggacacatgggtctggatgtgggtcccaagacccgtgagctcttcgcggcacccatcgcacgcgccaagctcatcgtgtggaacggaccccccggtgtctttgagttccccaacttcgccaacggcaccaagtccatcatggacggcgtggtggccgccaccaagaacggcaccgtctccatcatcggcggcggcgacactgcctcttgctgcgccaagtggaacacggaggcactcgtctcgcacgtctccaccggaggcggcgcttcgctggagctcctggagggcaagacactgccaggcgtggctgcattgaccagcgcctaa

SEQ ID NO: 90672 - protein, 415 aa, Drosophila melanogaster
MAFNKLSIENLDLAGKRVLMRVDFNVPIKEGKITSNQRIVAALDSIKLALSKKAKSVVLMSHLGRPDGNKNIKYTLAPVAAELKTLLGQDVIFLSDCVGSEVEAACKDPAPGSVILLENVRFYVEEEGKGLDASGGKVKADPAKVKEFRASLAKLGDVYVNDAFGTAHRAHSSMMGDGFEQRAAGLLLNKELKYFSQALDKPPNPFLAILGGAKVADKIQLIENLLDKVNEMIIGGGMAFTFLKVLNNMKIGGSLFDEEGSKIVEKLVEKAKKNNVQLHLPVDFVCGDKFAENAAVSEATVEAGIPDGHMGLDVGPKTRELFAAPIARAKLIVWNGPPGVFEFPNFANGTKSIMDGVVAATKNGTVSIIGGGDTASCCAKWNTEALVSHVSTGGGASLELLEGKTLPGVAALTSA

SEQ ID NO: 90673 - DNA, 1266 bp, Emericella nidulans
  CDS (1)..(1266)
atgtctctcaccagcaagctttccatcacagatgtggatctcaaggacaagcgtgtcctgatccgagttgacttcaatgtgcccctcgacaagaacgacaacaccacaatcaccaaccctcagcgtatcgtcggtgctctgcctaccatcaagtatgccatcgataacggcgccaaggccgtcatcctcatgtcccaccttggccgtcctgatggcaagaagaaccccaagtacagcttgaagcccgttgtgcccaagctcaaggaactgctcggccgcgacgtcatctttactgaggactgcgttggcccagaggtcgaggagactgttaacaaggcctccggtggccaggtcatccttcttgagaacctgcgcttccacgccgaggaggaaggaagctctaaggatgcagacggcaacaaggtcaaggccgacaaggacgcggttgcgcagttccgtaagggattgactgctttgggtgacatttacatcaacgatgcctttggtaccgcccaccgtgctcacagctccatggtcggtgtcgaccttccccagaaggcctccggattcctcgtcaagaaggagctcgaatacttcgcgaaggccctcgaggagccccagcggcccttcctcgccatccttggtggctctaaggtttccgacaagatccagctaattgacaacctccttcccaaggtcaacagcctcatcattaccggaggcatggctttcaccttcaagaagactctcgagaacgtcaagattggaagcagtctcttcgatgaggccggcagcaagatcgtcggtaacatcatcgaaaaggccaagaagcacaacgtcaaggttgttcttcccgtcgactacgtcactgccgataagtttgccgccgatgcgaagactggctacgccactgatgagcagggtatccctgatggttacatgggcttagacgttggcgagaagagtgtcgagtcctacaagcagaccattgccgagtccaagactattctgtggaacggaccccccggtgtctttgagatggagcccttcgctaaggctaccaaggctactcttgacgctgctgtggcggctgttcagaacggtgctaccgtcattattggtggtggtgacactgctaccgttgccgccaagtacggcgctgaggacaagattagccacgtttctaccggtggtggtgcctcgctggagctcctggagggcaaggaactgcctggtgttgctgctctctctgagaaaagtaagtaa

SEQ ID NO: 90674 - protein, 421 aa, Emericella nidulans
MSLTSKLSITDVDLKDKRVLIRVDFNVPLDKNDNTTITNPQRIVGALPTIKYAIDNGAKAVILMSHLGRPDGKKNPKYSLKPVVPKLKELLGRDVIFTEDCVGPEVEETVNKASGGQVILLENLRFHAEEEGSSKDADGNKVKADKDAVAQFRKGLTALGDIYINDAFGTAHRAHSSMVGVDLPQKASGFLVKKELEYFAKALEEPQRPFLAILGGSKVSDKIQLIDNLLPKVNSLIITGGMAFTFKKTLENVKIGSSLFDEAGSKIVGNIIEKAKKHNVKVVLPVDYVTADKFAADAKTGYATDEQGIPDGYMGLDVGEKSVESYKQTIAESKTILWNGPPGVFEMEPFAKATKATLDAAVAAVQNGATVIIGGGDTATVAAKYGAEDKISHVSTGGGASLELLEGKELPGVAALSEKSK

SEQ ID NO: 90675 - DNA, 1194 bp, Enterococcus faecalis
  CDS (1)..(1194): transl_table=11
atggctaaaaagacaattaaagatgtagatttaaaagacaaaaaagtccttgtccgtgttgactttaacgttccgttaaaagatggcgtgatcacaaacgataatcgtatcgtagcggctttaccaacaatcaaatacgtgattgaaaatggcggaaaagcaattcttttctctcatttaggtcgtgtaaaaacagaagaagacaaagctggcaaatcattaaaaccagtggctgaacgtttaagcgaattactaggtcaaccagttacttttgttccagaaacacgtggtaaagaattagaagacgctgttaacaatatgaaagatggcgacgttttagtatttgaaaacactcgttttgaagatgttgacggcaaaaaagaaagcggcaatgacgctgaattgggtaaatactgggcttctttaggcgatgtatttgtcaatgatgcttttggtactgcacaccgtgcacatgcctcaaacgttggaattgcttcaactggtatcccaacagttgctggtttcttaatggaaaaagaaattaaattcatcggcgaagctgttgaaaatccaaaacgtccattcgtagcaatcttgggtggcgcaaaagtttctgacaaaatcgctgtcattgaaaacctaattgaaaaagccgataaaattttaatcggtggcggtatggcttacacattcatgaaagcacaaggctatagtgttggtttatctttacttgaagaagataaagtggacttagcgaaaagcttaatggaaaaagctggcgacaaattagttttaccggttgatacagttgtctctaaagagttcagcaatgacgctcctttccacacggttccttcaactgaaatcccagatgatgaagaaggcttggatattggtgaaaaaacaattgaattattcgctaacgaattacaaggtgcgaaaacagttgtttggaatggaccaatgggcgtatttgaaatgagtaactttgccaaaggaacaattggtgtttgtgaagcgattgctaatttagaagacgcaacaacaatcatcggtggcggggactctgctgctgcagcaattcaattaggctacgaaaacaaattctctcacatctcaacaggtggcggagcaagtttagaattattagaaggcaaaactttaccaggtttagcttctattaacgataaataa

SEQ ID NO: 90676 - protein, 397 aa, Enterococcus faecalis
MAKKTIKDVDLKDKKVLVRVDFNVPLKDGVITNDNRIVAALPTIKYVIENGGKAILFSHLGRVKTEEDKAGKSLKPVAERLSELLGQPVTFVPETRGKELEDAVNNMKDGDVLVFENTRFEDVDGKKESGNDAELGKYWASLGDVFVNDAFGTAHRAHASNVGIASTGIPTVAGFLMEKEIKFIGEAVENPKRPFVAILGGAKVSDKIAVIENLIEKADKILIGGGMAYTFMKAQGYSVGLSLLEEDKVDLAKSLMEKAGDKLVLPVDTVVSKEFSNDAPFHTVPSTEIPDDEEGLDIGEKTIELFANELQGAKTVVWNGPMGVFEMSNFAKGTIGVCEAIANLEDATTIIGGGDSAAAAIQLGYENKFSHISTGGGASLELLEGKTLPGLASINDK

SEQ ID NO: 90677 - DNA, 1257 bp, Euplotes crassus
  CDS (1)..(1257): transl_table=10
atgctatctaagaaattgactgttgataagatcccccacatgattaagaacaagagagtcttagtcagagtagactttaatgttccaattaaggatggaaaggttgccgatcctacaagaattgtatctactcttgatacaatcaacttcttaaaggaaaatggtgctaaatccattgtgttgatgagtcatttgggtagaccaaaaggagttagacaagaacaattctcattagctcctgttgtcccagcgcttgaagacattattggccagaaagttaactttttaaacgactgtattggtactgaagttgaaggagaagtggcaaatactaaagatggaaatatcctgcttttggagaatctcagattctacttggaagaggaaggaaaaggagtcataaatggagagaaagtcaaagctgatccaaccaaggttgagtctttcagatcccaactcactagacttggagatctttatgtaaatgatgcttttggaacttgccacagagctcattcctcaatggttggtgtcaatgtggacaccagagctgccggatttttgttaaagaaggaacttgattacttctcaaaagttttagaagatcctaaaagacctctcaccgttattcttggaggagctaaagttgcagataaaattcaactgatcaacaatttgctagacttggcagatgaaatgatcattggtggaggaatggctttcacattcaacaaagtcctgaacaataccccaatcggagcatccctctatgatgaagaaggagctaagactgttcatggcattatggaaaaggcaaaagaaaagggagtaaagattcatattccaagtgattttgtttgtgctgagagctttgcagaagatgctaaatttgcctacaaactgaagatgaaggagtcccaagatggatggttaggtctggacattggagataaaactattcgcagctttgatgaggttattagaagatctaacacccttttctggaatggaccttcaggagtttttgaatggaaaaactttgctaaaggatctcatgcaatgcttcaagctgttactgaatcaaccaagaatggaacagtttctgtatgtggaggaggagataccctcaatcttttgaagcaagtagatggagccaaagagaatatttctcatgttagtactggaggaggtgcctccttagaacttgttgaaggaaaagaacttccaggaatcaaggctttgtctgatatcaactag

SEQ ID NO: 90678 - protein, 418 aa, Euplotes crassus
MLSKKLTVDKIPHMIKNKRVLVRVDFNVPIKDGKVADPTRIVSTLDTINFLKENGAKSIVLMSHLGRPKGVRQEQFSLAPVVPALEDIIGQKVNFLNDCIGTEVEGEVANTKDGNILLLENLRFYLEEEGKGVINGEKVKADPTKVESFRSQLTRLGDLYVNDAFGTCHRAHSSMVGVNVDTRAAGFLLKKELDYFSKVLEDPKRPLTVILGGAKVADKIQLINNLLDLADEMIIGGGMAFTFNKVLNNTPIGASLYDEEGAKTVHGIMEKAKEKGVKIHIPSDFVCAESFAEDAKFAYKLKMKESQDGWLGLDIGDKTIRSFDEVIRRSNTLFWNGPSGVFEWKNFAKGSHAMLQAVTESTKNGTVSVCGGGDTLNLLKQVDGAKENISHVSTGGGASLELVEGKELPGIKALSDIN

SEQ ID NO: 90679 - DNA, 1197 bp, Fusobacterium nucleatum
  CDS (1)..(1197): transl_table=11
atgaaaaaaattataactgatttagatttaaataataaaaaagttcttatgagagtagattttaatgttcctatgaaagatggaaaaattactgatgaaaatagaattgttcaagcattgcctacaataaaatatgttttagaacataatgctaaacttattttattttcacatttaggaaaagttaaaatagaagaagataaggctacaaaaagtttaaaagctgttgctgaaaaattatcagaacttttaggaaaaaatgtaacttttattcctgaaacaagaggagaaaaattagaatctgctattaataatttaaaatctggtgaagtattgatgtttgaaaatacaagatttgaagatttagatggtaaaaaggaatctaaaaatgattctgaattaggtaaatattgggcatcactaggggatgtttttgtaaatgatgcttttggaactgctcatagagctcatgcttctaatgtaggaattgcagaaaatattggaaatggaaattcagctgttggtttcttagttgaaaaagaattaaaatttattggtgaagcagtaaataatccaaaaagaccattaattgctattttaggaggagcaaaagtttctgataaaataggggttattgaaaatctattgactaaggctgataaaattctaattggtggagctatgatgtttactttcctaaaagcagaagggaaaaatattggaacttcattggttgaagatgataaattagacttggctaaagatttattagctaaatcaaatggaaaaatagttttacctgttgatacagttattgcaagtgaatttaaaaatgatattgaattttctactgttgatgtagataatattccaaataataaaatgggacttgacattggtgaaaaaactgttacactatttgatagttacataaaaactgctaagactgttgtatggaatggacctatgggagtatttgaaatgtctaactttgcaaaaggaacaataggagtatgtgagtcaatagcaaatttaactgacgcagtaacaataataggtggaggggattctgctgctgctgcaattagtttgggctatgcagataaatttactcatatttctactggtggaggagcatctttagaattcttagaaggaaaagttttaccaggagtcgaagctatatcaaataaataa

SEQ ID NO: 90680 - protein, 398 aa, Fusobacterium nucleatum
MKKIITDLDLNNKKVLMRVDFNVPMKDGKITDENRIVQALPTIKYVLEHNAKLILFSHLGKVKIEEDKATKSLKAVAEKLSELLGKNVTFIPETRGEKLESAINNLKSGEVLMFENTRFEDLDGKKESKNDSELGKYWASLGDVFVNDAFGTAHRAHASNVGIAENIGNGNSAVGFLVEKELKFIGEAVNNPKRPLIAILGGAKVSDKIGVIENLLTKADKILIGGAMMFTFLKAEGKNIGTSLVEDDKLDLAKDLLAKSNGKIVLPVDTVIASEFKNDIEFSTVDVDNIPNNKMGLDIGEKTVTLFDSYIKTAKTVVWNGPMGVFEMSNFAKGTIGVCESIANLTDAVTIIGGGDSAAAAISLGYADKFTHISTGGGASLEFLEGKVLPGVEAISNK

SEQ ID NO: 90681 - DNA, 1251 bp, Glomus mosseae
  CDS (1)..(1251)
atgtcactttcaaacaaattatcaatacgagacttaaacgtcaaagacaaacgagtcttaatacgagtcgacttcaacgtccccctcgatggcacaaccataaccaacaaccaacgcatcgtcgcagcccttccaacaatcaagtatgcactagaacagaaagccaaaaccgtcgtgttaatgtcacatcttggccgtcctgacggaaagaaggtcgacaagtattcacttgcgccagtggcgaaggaggtcgagagactgcttgggaagaaggtgacgtttttggaggattgcgttggggagggtgtggagaattatgtgaagaatgcctgtgatggggaggttattctcttggagaatttgaggtttcacgctgaggaggaggggagctccaaggggcctgatggcaagaaagttaaggcggatctggaaaaagttaaggagtttagaaggtctttgacggctcttggtgatgtttacatcaatgatgcttttggaaccgcacatcgagcacacagttccatggttggcgtcgaattacctcaaaaagcagccggtttcctcgtcaagaaagaattagagtactttgccaaagcgctcgaatcccccgaacgacctttcctagctattctcggcggtgcaaaggtgtccgataagatccagctcattgataacttgatcgccaaggtagatagtttgatcatttgtggtggtatggcgttcacgttcaagaagacgcttgagaacgtcaagattgggaactcgctatttgacgcggacggcgcgaagaccgttggagaggtcatggagaaggcgaagaagcatgacgttgaggtcgtcttgcctgttgactacattaccgcggataagtttgccaaggacgcgcaagttgggtatgctactgatcaagagggaattcctgatgggtggatgggattggactgcggcgagaagtctgttgagttgtataagcagactattgctaaggcgaagactatcctttggaatgggcctgctggggttttcgagtttgataactttgctaaggggacgaaggctactttggactgcgcagttgaggcagcacaatctggaaagattgtcatcatcggtggtggtgataccgcaactgttgctgcgaaatatggcgttgaggacaagctgagccatgtctcgactggcggtggagcttctttggagttgctcgaaggcaaggatcttcctggtgtctctgctctctcgagtaagtaa

SEQ ID NO: 90682 - protein, 416 aa, Glomus mosseae
MSLSNKLSIRDLNVKDKRVLIRVDFNVPLDGTTITNNQRIVAALPTIKYALEQKAKTVVLMSHLGRPDGKKVDKYSLAPVAKEVERLLGKKVTFLEDCVGEGVENYVKNACDGEVILLENLRFHAEEEGSSKGPDGKKVKADLEKVKEFRRSLTALGDVYINDAFGTAHRAHSSMVGVELPQKAAGFLVKKELEYFAKALESPERPFLAILGGAKVSDKIQLIDNLIAKVDSLIICGGMAFTFKKTLENVKIGNSLFDADGAKTVGEVMEKAKKHDVEVVLPVDYITADKFAKDAQVGYATDQEGIPDGWMGLDCGEKSVELYKQTIAKAKTILWNGPAGVFEFDNFAKGTKATLDCAVEAAQSGKIVIIGGGDTATVAAKYGVEDKLSHVSTGGGASLELLEGKDLPGVSALSSK

SEQ ID NO: 90683 - DNA, 1224 bp, Gloeobacter violaceus
  CDS (1)..(1224)
atggcgaagaaaacggttgaggccctgggggcggcggacctcaagggtaagcgggctctggtgcgggttgattttaatgttcccctcgacgagagcggccagatcacagacgatacgcgcattcgcgctgcgttgcccaccattggaatgttgaccggtgggggggcgcgggtaatcctggtgagccacctggggcgtcccaagggttttgacgatcagttgcgcctcacgccggtggccaagcgcctgggcgaactgctcggccagacggtctacaaagccgacgacgtgattggcccggaagtcgaagaagcggtcaagaagctcgaagacggcgatgtgctgctgttggagaacgtgcgcttctacccggaagaagaaaaaaacaaccccgaatttgcccagaagctcgcgggcctcgccgaactttatgtcaacgacgccttcggcaccgcccaccgcgcccacgcctccaccgaaggcgtggcgcgctacttgcgcccggcggtggcggggctgcttttgcaaaaagaactcgaatacctgggcaaagccctcgaaagcccggaacggccggtgcttgccatcatgggcggcgccaaagtgagcgacaagattcagcttatccagaacatgctcaccaaggtcgattcgatcttgatcggcggggcgatggcctacacgttcctcaaagcccaaggcgtggatgtgggagcttcccgctgcgagacgagcaccaccaaaaaggacggcacgaccgtcgatttgctccagctggccctcgacctgcttgccgaggcgaaggaacggggcgtcaccttcttgctgccggtcgaccaccgcaccaacgataagtttggtgaccttgccgacccgccggtcacccccgatgccaacatcccggagggccagatggccctggacatcggtcccaagaccgaggaactctacgtggccgaagtccaaaaatcgggcacggtgatctggaacggtccgatgggcgtcttcgaactgccgggattcagcaaaggcaccttcgcggtggcccatgccctggctgagagcgacaacctctcgatcgtgggcggcggcgacagcgcctcggcggccgagaaagccggtgtggtcgacaagctcagccacgtgagcaccggtggcggtgcctcgctcgaatttctcgaaggcaagaccctgcccggggtagcggccctcgacgaagcctga

SEQ ID NO: 90684 - protein, 407 aa, Gloeobacter violaceus
MAKKTVEALGAADLKGKRALVRVDFNVPLDESGQITDDTRIRAALPTIGMLTGGGARVILVSHLGRPKGFDDQLRLTPVAKRLGELLGQTVYKADDVIGPEVEEAVKKLEDGDVLLLENVRFYPEEEKNNPEFAQKLAGLAELYVNDAFGTAHRAHASTEGVARYLRPAVAGLLLQKELEYLGKALESPERPVLAIMGGAKVSDKIQLIQNMLTKVDSILIGGAMAYTFLKAQGVDVGASRCETSTTKKDGTTVDLLQLALDLLAEAKERGVTFLLPVDHRTNDKFGDLADPPVTPDANIPEGQMALDIGPKTEELYVAEVQKSGTVIWNGPMGVFELPGFSKGTFAVAHALAESDNLSIVGGGDSASAAEKAGVVDKLSHVSTGGGASLEFLEGKTLPGVAALDEA

SEQ ID NO: 90685 - DNA, 1176 bp, Haemophilus ducreyi
  CDS (1)..(1176): transl_table=11
atgtccgttaaaaaaatggctgaccttgatttaactggtaaacgtttattcattcgtgctgatcttaacgtccccgtaaaggaaggtaaaatcacctcagatgctcgtattcgagctacaatcccgacgttaaaattagccttacaaaaaggtgcgaaagtgatggtgacatcacacttaggtcgtccaactgaaggcgtatttgaagaagcaaattcattacaacctgtagttgattacttaaatgcatctgatttaggtgtgcctgtacggctagtgcgtgactatttagatggtgtagaagtcaaccaaaatgaaattgttgtccttgaaaatgtgcgcataaataaaggcgagaaaaaaaatgatgctgaactagcaaaaaaatatgctgccttatgcgatatttttgttatggacgcatttggtactgcacaccgcgcagaatgctcaacctatggcatagcagaatttgcacctatagcttgtgcagggccattattggcagccgagcttgaagcattaggtaaagcattaaaagaaccacagcgcccaatgttagcaattgtaggtggttcaaaagtgtcaaccaaactaaccgttttagatagcctctcaaaaattgctgatcaactgattgtcggggggggcattgccaacatattcattgcggcagaagggcataatgtaggtaaatccttatatgaagctgatttaatcccagaagcaaaacgattagcgtcaaccactcatattcctgttcctgttgatgtgcgtgtaggtacagaattttctgaaacagccacagcaaccgaaaaattagtatcagaagtgaccgccgatgaatctatcttcgatattggcgacaaatccgctgaagaattagctcatattattaaatccgcgaaaacgattttttggaatggccctgtaggggtctttgaattcgcgaacttccgtaaaggaacggaaattatctcaaatgcaattgcagaagccactgcaaatggggcattttctatcgcaggtggtggcgatacattggctgcaattgatttatttggcattgccgataaaatttcttatatctcaaccggcggcggtgctttcttagaatttgtagaaggcaaagtattacctgctgttgaaattttagaaaaacgtgcaaacagctaa

SEQ ID NO: 90686 - protein, 391 aa, Haemophilus ducreyi
MSVKKMADLDLTGKRLFIRADLNVPVKEGKITSDARIRATIPTLKLALQKGAKVMVTSHLGRPTEGVFEEANSLQPVVDYLNASDLGVPVRLVRDYLDGVEVNQNEIVVLENVRINKGEKKNDAELAKKYAALCDIFVMDAFGTAHRAECSTYGIAEFAPIACAGPLLAAELEALGKALKEPQRPMLAIVGGSKVSTKLTVLDSLSKIADQLIVGGGIANIFIAAEGHNVGKSLYEADLIPEAKRLASTTHIPVPVDVRVGTEFSETATATEKLVSEVTADESIFDIGDKSAEELAHIIKSAKTIFWNGPVGVFEFANFRKGTEIISNAIAEATANGAFSIAGGGDTLAAIDLFGIADKISYISTGGGAFLEFVEGKVLPAVEILEKRANS

SEQ ID NO: 90687 - DNA, 1197 bp, Halobacterium sp
  CDS (1)..(1197): transl_table=11
atggcgatacggaccctcgacgacctggcggcggccaaccgcgcgatcggggtgcgcgtcgacatcaacagcccgctgacggccgccggcgggctggccgacgacgctcgcctgcgcgcgcacgtcgacacgctcgccgaactgctggctgcggacgcgcgcgtcgccgtgctcgcccaccagggccgaccgggcggcgacgagttcgcgcgcctcgaacgccatgccgaccgcctcgacgcgcttctcgatgcgcccgtctcctactgcgacgcgacgttctccacgggggcacgcgacgccgtcgccgacctcgcacccggcgaggcggtcgtgcttgagaacacccgcttctacagcgaggagtacatggcgttcgcccccgagcgcgcggccgacaccgcgctcgtcgatggcctcgcgccggcgctggacgcgtacgtgaacgacgcgttcgccgccgcccaccgctcacaaccctccctggtcgggttcccggaagtcctcccgtcctacgcggggcgcgtgatggaggccgaactggacgcactcagcggcgtcgccgacacgccaacgccacgcacgtacgtcgtcggtggcgcgaaagtgccggactccgtggaagtcgcggcacacgccctctcccacgggctcgccgacaacgtactcgtgaccggcgtggtggcgaacgtcttcctggcggccaccggtgtcgatctcggccgggcgtcgaccgacttcatccacgagcgcgactacgggacggagatcgcgcgcgcagccgacctgctcgcggcgcacaacgacgccctccacctgcccgtcgacgtggccgtcgagcgcgacggcgcgcggtgtgaactctccaccgacgccttgcccccggccggcgacgaagccgtctgtgacatcggcagtgacaccgtcgacgcgtacgccgacgtgctggcggactccgaaaccgtcgtggtaaacgggccggccggcgtcttcgaggacgacctgttcgccgacgggacgcgtggcgtcttcgacgcggcgtcggaagtcgagcacagcatcgtgggtggcggcgacaccgcggccgcgatccggcgcttcgacatcaccggcttcgaccacgtgagcacgggcggcggtgccgcgatcaacctcctgaccgacgccgacctgcccgcggtggcggcgctgcgatga

SEQ ID NO: 90688 - protein, 398 aa, Halobacterium sp
MAIRTLDDLAAANRAIGVRVDINSPLTAAGGLADDARLRAHVDTLAELLAADARVAVLAHQGRPGGDEFARLERHADRLDALLDAPVSYCDATFSTGARDAVADLAPGEAVVLENTRFYSEEYMAFAPERAADTALVDGLAPALDAYVNDAFAAAHRSQPSLVGFPEVLPSYAGRVMEAELDALSGVADTPTPRTYVVGGAKVPDSVEVAAHALSHGLADNVLVTGVVANVFLAATGVDLGRASTDFIHERDYGTEIARAADLLAAHNDALHLPVDVAVERDGARCELSTDALPPAGDEAVCDIGSDTVDAYADVLADSETVVVNGPAGVFEDDLFADGTRGVFDAASEVEHSIVGGGDTAAAIRRFDITGFDHVSTGGGAAINLLTDADLPAVAALR

SEQ ID NO: 90689 - DNA, 1206 bp, Haloarcula vallismortis
  CDS (1)..(1206): transl_table=11
atgatgactttccagacgctcgatgacctcgacgatggacagcgcgtcctcgtccgactcgacctcaactcaccggtcgaggacggcacagtacaggacaatcgacggttcgaccgccacgcggagactgtcaaggaactcgctgaccgggggttcgaggtcgcagtgctggcccatcagggccgcccgggccgcgacgacttcgtctcgctcgaccagcacgccgacatcctcgccgaccacatcgaccgcgacgtggatttcgtcgacgagacctacgggccacaggcgattcacgatatcgccgacctcgatagtggcgacgtgctcgttctggagaacacgcggatgtgtgacgacgaactgcccgaggaagaccccgaagtgaaggcccagacggagttcgtcaagacgctggccggggagttcgacgcctacatcaacgacgcctactccgcggcccaccgctcgcacgcctcgctcgtgggcttcccgctcgtgatggatgcctacgccggtcgcgtgatggagaccgagtacgaggccaacaccgccatcgccgagaaggagttcgacgggcaggtgacgatggtcgtcggcgggacgaaggccaccgacgtcatcgacgtgatgacccacttagacgagaaggtcgacgacttcttgcttggcggtatcgcgggaactgttcctgcggcagccggccacccagtcggctacgacatcgacgacgcgaacctctacgacgagcagtgggaggcaaacagtgagaagatcgagtccatgctcgaagaccaccgggaccagattaccctcgcggtcgacctggcctacgaggacgagaacgacgaccgcgccgagcaggccgtcgacgacatcgacgagaaaaggctctcgtacctcgacgtgggcagcgagaccctcatggagtactcgccgatcatccgcgagtccgaggccgtcttcggtgaagggcgcgctgggatgttcgaagacgaacggttctcggtcgggactgccggtgtgctcgaagccatcgccgacaccgactgtttctccgtcgtcggcggcggcgacacctcacgcgctatcgagatgtacgggatggaagaagacgagttcggccacgtctccatcgctggcggggcctacatccgggcgttgacgcgcgcacaactggtcggcgtcgaagtcctccagcgctaa

SEQ ID NO: 90690 - protein, 401 aa, Haloarcula vallismortis
MMTFQTLDDLDDGQRVLVRLDLNSPVEDGTVQDNRRFDRHAETVKELADRGFEVAVLAHQGRPGRDDFVSLDQHADILADHIDRDVDFVDETYGPQAIHDIADLDSGDVLVLENTRMCDDELPEEDPEVKAQTEFVKTLAGEFDAYINDAYSAAHRSHASLVGFPLVMDAYAGRVMETEYEANTAIAEKEFDGQVTMVVGGTKATDVIDVMTHLDEKVDDFLLGGIAGTVPAAAGHPVGYDIDDANLYDEQWEANSEKIESMLEDHRDQITLAVDLAYEDENDDRAEQAVDDIDEKRLSYLDVGSETLMEYSPIIRESEAVFGEGRAGMFEDERFSVGTAGVLEAIADTDCFSVVGGGDTSRAIEMYGMEEDEFGHVSIAGGAYIRALTRAQLVGVEVLQR

SEQ ID NO: 90691 - DNA, 1209 bp, Helicobacter hepaticus
  CDS (1)..(1209): transl_table=11
atgaaggaaactggaatcgaattaatgaaaaatacaaaaagtgtgcgtgatattgacgtcaaagacaaaagagtgcttattcgcgtggattttaatgtgccaatggacgaggattttgatatttcagatgatacgcgtatccgcgaagcactacccactattaattattgcattgataatcacgcacaaaatatagtgcttgtcagccatttagggcgtcccaaaggacgcaatgcagagttttcactcaaacacgtgcttaaacgtgtagagcgacttttaggacgcgatatagctttcgcagagacaatagaaaatgtagaaaatcttcaacaacaaagcaagagtggaagtgtgattttacttgaaaatattagattctatgagggagaggaaaaaaatgatgaggaactctctactaaactcgcctctatttgtgatgtgtatatcaatgatgcctttggcacaagccatcgcgcacattcaagcacctgtggcattgctaaatatgccaaagagtgtgtagcaggattattgctcaaaaaagaaattgattcatttgctaaagcaatggcaaatccacttaaaccggtgttacttatcgttggcggaagcaaggtaagctctaaactcgcactcttatataatatccttgatgtggtggataaaatcatcattggtggtgcgatgagcaatactttccttaaagcacgaggttttgatatgcaaaaatcccttgtggaagatgatttagtgagtgaagcacgtaagattttggataaagcaaaagaaaaaaaagtcaaaatctaccttcctgtagatgttgtaagcactgatgatattaaagaacatcgccatatcaaaatcacgcctgcacaagatataccagagggctttatggcagtagatatgggacctgcaacaagtaagctctttagtgaagtggtaagggattctcaaacaattatttggaatggaccgcttggcatttatgaaatacaagctttttcacgcggcacttttaaccttgcccacgctgtgagcgatacttatgcctttagtcttattggtggtggcgatactgctgatgcaatagacaaggcaggagagcgagacaatatgagctttatttccacgggtggtggagcaagtttggagctacttgaagggaaaattcttcctgcatttgaggtgcttgagcgcaaataa

SEQ ID NO: 90692 - protein, 402 aa, Helicobacter hepaticus
MKETGIELMKNTKSVRDIDVKDKRVLIRVDFNVPMDEDFDISDDTRIREALPTINYCIDNHAQNIVLVSHLGRPKGRNAEFSLKHVLKRVERLLGRDIAFAETIENVENLQQQSKSGSVILLENIRFYEGEEKNDEELSTKLASICDVYINDAFGTSHRAHSSTCGIAKYAKECVAGLLLKKEIDSFAKAMANPLKPVLLIVGGSKVSSKLALLYNILDVVDKIIIGGAMSNTFLKARGFDMQKSLVEDDLVSEARKILDKAKEKKVKIYLPVDVVSTDDIKEHRHIKITPAQDIPEGFMAVDMGPATSKLFSEVVRDSQTIIWNGPLGIYEIQAFSRGTFNLAHAVSDTYAFSLIGGGDTADAIDKAGERDNMSFISTGGGASLELLEGKILPAFEVLERK

SEQ ID NO: 90693 - DNA, 1209 bp, Helicobacter pylori J99
  CDS (1)..(1209): transl_table=11
atgttagctaaaatgtcgtttatgcaaaacgttaaaaacattcaagaggtggatgtcaatcataaaagggtgcttattagagtggattttaacgtgcctttagatgaaaatttgaatatcactgatgacacacgcattagagagagcttgcccaccatccaattttgtattgacaataaggctaaagatattattttagtgagccatttgggccgccctaaaggggttgaagaaaaattgagcttgaagccctttttaaaacgccttgaaagactcttaaatcatgaagtggttttttctcaaaatatcgcgcaactcaagcaagccttaaacgaaaacgcgcccacaaggatttttcttttagaaaacatccgctttttaaaaggcgaagaagaaaatgatgaaaatctggctaaagatttagcgagcttgtgcgatgtgtttgtgaatgacgcttttggcacgagccacagaaaacatgccagcacttatggcaccgccaaattcgctcccataaaagtgagcgggtttttgcttaaaaaagaaattgattcgttttatcaagcgtttaaccaccctttacgccctttattgttgattgtggggggggctaaggtcagctccaaactcactttattaaaaaacattttagatctcattgacaagctcatcattgccggggcgatgagcaacaccttcttaaaagccttaggctatgatgtgcaggattcttctgtggaagacgccctaatcaatgacgccctagaattattgcaaagcgcgaaagaaaaaaaagtcaaagtctatttgcctatagacgccgtaaccactgatgacattcttaaccccaaacacatcaaaatttcacccgtccaagacattgagcctaaacacaaaatcgctgatatagggcctgcgagcctgaaattattttctgaggtcatagagagcgcgcccaccattttatggaatggccccttaggcgtgcatgaaaagcaagaattcgctagaggcacaacctttttagcccacaagatcgctaacacttacgctttctcgctcattggggggggcgacaccattgatgcgatcaatcgcgcgggcgaaaaggataacatgagctttatctctaccggtgggggggcgagcttggaactattagagggcaaaattttaccttgttttgaggttttggacaaacgccattaa

SEQ ID NO: 90694 - protein, 402 aa, Helicobacter pylori J99
MLAKMSFMQNVKNIQEVDVNHKRVLIRVDFNVPLDENLNITDDTRIRESLPTIQFCIDNKAKDIILVSHLGRPKGVEEKLSLKPFLKRLERLLNHEVVFSQNIAQLKQALNENAPTRIFLLENIRFLKGEEENDENLAKDLASLCDVFVNDAFGTSHRKHASTYGTAKFAPIKVSGFLLKKEIDSFYQAFNHPLRPLLLIVGGAKVSSKLTLLKNILDLIDKLIIAGAMSNTFLKALGYDVQDSSVEDALINDALELLQSAKEKKVKVYLPIDAVTTDDILNPKHIKISPVQDIEPKHKIADIGPASLKLFSEVIESAPTILWNGPLGVHEKQEFARGTTFLAHKIANTYAFSLIGGGDTIDAINRAGEKDNMSFISTGGGASLELLEGKILPCFEVLDKRH

SEQ ID NO: 90695 - DNA, 1251 bp, Kluyveromyces lactis
  CDS (1)..(1251)
atgtctttgagttcaaaattgactgtcaaggatttggatgtcactggtaaaagagtgttcatcagagttgatttcaacgtcccattggacggtaagaagatcacttccaaccaaagaattgtagcagctctgcctactattcaatacgttttggaaaagaagccaaaggccattgtcttggcctctcatttgggtagaccaaacggtgaagttaacgacaaatactcattggctccagttgccgatgaattgtctagactattgcaaaagccagttactttcttgcatgactgtgttggtgaagaagtcaccaatgccgttaacaacgctaaggacggtgaagttttcctattggaaaacttgagattccacatcgaagaagaaggttccagaaaggtggatggtaacaaggttaaggctgacaaggctgctgttaccaaattcagagaacaattgagttctttggccgatgtttacgttaacgatgccttcggtaccgctcacagagctcactcttccattgtcggtttcgacttgccaaacagagctgccggtttcttgttgtccaaggaattgcaatactttgctaaggctttggaaaacccaaccagaccattcttggctatcttgggtggtgctaaggttgcagacaagattcaattgatcgacaatttgttggacaaggtcgattctttgatcattggtggtggtatggctttcaccttcaagaaggtcttggaaaacactgaaatcggtgactccatctacgatgctgctggtgccgaattggttccaaagttggtcgaaaaggctaagaagaacaacgtcaagatcgtcttgccaactgacttcgtcattggtgacaagttctctgctgatgctaacacaaaggttgtcaccgacaaggaaggtattccaagcggctggcaagggttggacaacggtccagaatctagaaaggctttcgctgccactgttgctgaagctaagactatcgtctggaacggtccaccaggtgtcttcgaatttgctcctttcgctaagggtaccgaagctctattggacgccgttgtcgcctcctctcaagctggtaacaccgtcatcatcggtggtggtgacaccgctaccgtcgccaagaagtacggtgtcgtcgacaagatctctcacgtctccactggtggtggtgcttctttggaattgttggaaggtaaagaattgcctggtgtcactttcttgtccaacaagcaataa

SEQ ID NO: 90696 - protein, 416 aa, Kluyveromyces lactis
MSLSSKLTVKDLDVTGKRVFIRVDFNVPLDGKKITSNQRIVAALPTIQYVLEKKPKAIVLASHLGRPNGEVNDKYSLAPVADELSRLLQKPVTFLHDCVGEEVTNAVNNAKDGEVFLLENLRFHIEEEGSRKVDGNKVKADKAAVTKFREQLSSLADVYVNDAFGTAHRAHSSIVGFDLPNRAAGFLLSKELQYFAKALENPTRPFLAILGGAKVADKIQLIDNLLDKVDSLIIGGGMAFTFKKVLENTEIGDSIYDAAGAELVPKLVEKAKKNNVKIVLPTDFVIGDKFSADANTKVVTDKEGIPSGWQGLDNGPESRKAFAATVAEAKTIVWNGPPGVFEFAPFAKGTEALLDAVVASSQAGNTVIIGGGDTATVAKKYGVVDKISHVSTGGGASLELLEGKELPGVTFLSNKQ

SEQ ID NO: 90697 - DNA, 1212 bp, Lactobacillus delbrueckii
  CDS (1)..(1212): transl_table=11
atggctaaattgattgtttctgacgtagacgttaaggacaagaaggttttggttcgcgttgacttcaacgtgccgattaaggacggcgttatcggcgacgacaaccgtatcgtggctgctttgccaactatcaagtacatcatcgaaaacggcggcaaggctatcttgctttcccaccttggccggatcaagagcgatgaagacaagaagagcttgagcttggctccagttgccaaacgtttgggcgaattgcttgaaaagcctgtaactttcgtaccttcaaacgaaggcaaggaagttgaagacgccatcaacaacatgaaggacggcgacgtagttgttttggaaaacacccgtttccaagacatcgacaacgacttcggcaagcgtgaatcaaagaacgaccctaagctgggcgaatactgggcatcattgggtgacgttttcgtaaacgacgccttcggtactgctcacagaagccacgcttcaaacgttggtatcgctacggccatgaaggctgccggcaagccagcagctgctggtttcctgcttgaaaaggaaatcaagttcctgggcaacgctgttgctaacccagttcacccattcgtaactattcttggcggggctaaggtttctgacaagatcggcgttatcaccaacttgattccaaaggctgaccacatcatcatcggtggtggtatggcttacaccttccttaaggctcaaggccacaatatcggcaagtccctggttgaagacgacaaggttgaatttgccaaggaattgctggaaaaggctggcgacaagctggttctgccaatcgacaacgtagccgcaactgaattcaacaacgatgctgcttcagaagttgttggccaagacatcccagacaacgaaatgggcttggacatcggtcctaagactattgaactcttcaagaagactcttgaaggtgccaagactgttgtttggaacgggccaatgggcgtcttcgaaatgccaaacttcgccaagggtactttggaagttggccgtgctttggctgacttgccagacgctactactattgtcggcggtggtgactcaactgctgctgctaagcaattggggatcgctcctaagttgactcacatctcaactggtggtggtgcatctcttgaataccttgaaggtaaggaattgccaggtatcgcttgcgtttcagacaagtag

SEQ ID NO: 90698 - protein, 403 aa, Lactobacillus delbrueckii
MAKLIVSDVDVKDKKVLVRVDFNVPIKDGVIGDDNRIVAALPTIKYIIENGGKAILLSHLGRIKSDEDKKSLSLAPVAKRLGELLEKPVTFVPSNEGKEVEDAINNMKDGDVVVLENTRFQDIDNDFGKRESKNDPKLGEYWASLGDVFVNDAFGTAHRSHASNVGIATAMKAAGKPAAAGFLLEKEIKFLGNAVANPVHPFVTILGGAKVSDKIGVITNLIPKADHIIIGGGMAYTFLKAQGHNIGKSLVEDDKVEFAKELLEKAGDKLVLPIDNVAATEFNNDAASEVVGQDIPDNEMGLDIGPKTIELFKKTLEGAKTVVWNGPMGVFEMPNFAKGTLEVGRALADLPDATTIVGGGDSTAAAKQLGIAPKLTHISTGGGASLEYLEGKELPGIACVSDK

SEQ ID NO: 90699 - DNA, 1197 bp, Lactococcus lactis
  CDS (1)..(1197): transl_table=11
atggcaaaattgactgtaaaagacgttgaacttaaaggcaaaaaagtcctcgtacgtgttgactttaatgttccaattaaagatggcgtaatcacaaatgataaccgtatcactgctgcgcttccaacaattaaatacatccttgaacaaggtggacgtgcagtcctcttctctcacttgggacgtgttaaagaagaagctgacaaagctggtaaatcacttgcaccagtagctaaagctctttctgaaaaacttggtcaagatgttgttttcccaggaactactcgtggcgcagaacttgaagcagcaatcaacgaacttaaagatggagaaatccttctcgttgaaaacactcgttttgaagacatcgacggtaaaaaagaatctaaaaacgacccagaacttggtaaatactgggcttcacttggtgacggaatcttcgttaatgacgcatttggtacagctcaccgtgctcatgcatcaaacgttggtatctcagcaaacgttgataaagccgttgctggtttccttcttgaaaacgaaattgcttatatccaagaagcagttgaagctccagaacgtccattcgtagcaatccttggtggttcaaaagtttcagataaaatcggtgttatcgaaaaccttctttcaaaagctgataaagttatcatcggtggtgggatggcttacacattcttgaaagctcaaggttacgaaatcggaacttcactcgttgaagatgacaaacttgatcttgctaaagaattgcttgaaaaagcagctggaaaattgattttgccacttgaccacaaagttgctaacgcatttgctggttacacagaagttaaagaaactgctgaccaaaatattcctgcaggcttcatgggacttgacgtagcaagcaaaacaattgctgactacaacacacaacttgaaggtgctaaaacagttgtttggaatggtccagttggtgtatttgaaaacacagacttccaagcaggtactgttggattgatggaagctatcgttaaacaaccaggtgttaaatcaatcatcggtggtggtgactcagcagcagcagcaatcaaccttggttatgcagataaattctcatggatttcaactggtggtggagcttcaatggaactcctcgaaggtaaagtacttccaggacttgcagctttgactgaaaaataa

SEQ ID NO: 90700 - protein, 398 aa, Lactococcus lactis
MAKLTVKDVELKGKKVLVRVDFNVPIKDGVITNDNRITAALPTIKYILEQGGRAVLFSHLGRVKEEADKAGKSLAPVAKALSEKLGQDVVFPGTTRGAELEAAINELKDGEILLVENTRFEDIDGKKESKNDPELGKYWASLGDGIFVNDAFGTAHRAHASNVGISANVDKAVAGFLLENEIAYIQEAVEAPERPFVAILGGSKVSDKIGVIENLLSKADKVIIGGGMAYTFLKAQGYEIGTSLVEDDKLDLAKELLEKAAGKLILPLDHKVANAFAGYTEVKETADQNIPAGFMGLDVASKTIADYNTQLEGAKTVVWNGPVGVFENTDFQAGTVGLMEAIVKQPGVKSIIGGGDSAAAAINLGYADKFSWISTGGGASMELLEGKVLPGLAALTEK

SEQ ID NO: 90701 - DNA, 1203 bp, Lactobacillus plantarum
  CDS (1)..(1203): transl_table=11
ttggctaaattaatcgtttcagatttagatgttaaagataaaaaagttttaattcgtgtcgactttaatgttccaattaaagacggcaaaattggtgacgacaaccggatcgtcgctgccttaccaacgatcaaatacgtgattgaacatgatggcaaagccatcttattctcacatttaggtcggattaagagcgaagacgacaagaagggcttaagcttacgtcctgttgcagaacgtctttcaaacttattaaacaagcctgttaccttcgtccctgttactgaaggcgaacaacttgaaactgccatcaacaacatgaacgacggtgacgtcttagttgttgaaaacactcgttttgaagacgttgttaacggcgaacaagttaagcgcgaatctggtaacgatcctgaattaggcaagtactgggcttcacttggtgatgtctacgtcaacgatgctttcgggactgctcaccggagccatgcttctaacgttgggattgcttcaaacatggatcaagttgccgctggtttcttaatggaaaaggaaatcaagttcttaggtgacgcggttgacaatcctaagcacccattcgttgctatcttaggtggtgccaaggtttctgataagatcggtgttatcgatcacttaatcagcaaagctgacaagatcatcatcggtggtgggatgacttatacgttctatgctgctaaaggcatgggcattggtaactcacttgttgaaaaagacaagattgaattggctaagtcaatcatcgaaaaagctggcgacaagttagtcttacctagcgactcaatcgttgctgaaaagtttgataacgatgttcctagcaaggttgttgaaggttcaattcctgatggctacatggccttagatattggtcctaagtcaatcgaagaattcgaagatgttttacgcgacgctaagaccgttgtttggaacggaccaatgggtgtcttcgaaatgagcaactacgccaagggtacgcttgaaattggtaagttcttaggaaccttatcagacgcaacgaccatcgttggtggtggggactcaactgccgctgttaagcaacttggcgttggcgacaagttaacccacatttctactggtggcggtgcttcacttgaataccttgaaggtaaggaattacctggtattgctgctatttctgaaaaataa

SEQ ID NO: 90702 - protein, 400 aa, Lactobacillus plantarum
MAKLIVSDLDVKDKKVLIRVDFNVPIKDGKIGDDNRIVAALPTIKYVIEHDGKAILFSHLGRIKSEDDKKGLSLRPVAERLSNLLNKPVTFVPVTEGEQLETAINNMNDGDVLVVENTRFEDVVNGEQVKRESGNDPELGKYWASLGDVYVNDAFGTAHRSHASNVGIASNMDQVAAGFLMEKEIKFLGDAVDNPKHPFVAILGGAKVSDKIGVIDHLISKADKIIIGGGMTYTFYAAKGMGIGNSLVEKDKIELAKSIIEKAGDKLVLPSDSIVAEKFDNDVPSKVVEGSIPDGYMALDIGPKSIEEFEDVLRDAKTVVWNGPMGVFEMSNYAKGTLEIGKFLGTLSDATTIVGGGDSTAAVKQLGVGDKLTHISTGGGASLEYLEGKELPGIAAISEK

SEQ ID NO: 90703 - DNA, 1191 bp, Leptospira interrogans
  CDS (1)..(1191): transl_table=11
atggaattacctagacttgaaaatgtagatctctcaggaaagagagttttcctgagagtagattttaacgttccagtagaaaatggaaaagttacagacaaaactagaattgaaaagactcttcctacaatcgaacttctgattaaaaaaggcgcaaggataattattgcgagtcacttaggaagacccaaaggacaagtaaatcctgaattttctttggcgccagtagttgaaactttccaaagtcttgtaaaatctaaggtttatttttctaagacagtaatcggagaagacgcgattaaactttctaaagaacttaaaaacggcgaaattttagtaattgaaaacgttcgttttcataaagaagaagaggaaaatgatcctggtttttccaaaaaacttgctgcgttagccgacatctatgtgaacgacgcttttggggcagcccacagagcgcactcttccaccgaaggaattgcacgtctacttcctgcatatgcaggtcttctaatgcacaaagagatcttagaactttctgcgcttctgcataaaccggctcgtccatttgtggcgatcataggaggttccaaagtttccactaagatcaaggtcctaaccaatctattcgacaaggtaaatcatcttctcattggtggtggaatggcttatacgtttttaaagtccagagcgatccctattggaaattcactcgtggaaaaagaattcgaagttcaagcctttcagttaatcgaaaaagcaggcgtcgctggtatcgatttacaacttccggtagatcacatcattggagatcagtttaacgaaaaggcaaagaccaagtccgtagataagatgggaattttagacggttggatgggaatggatataggctctaaaacggtttctaactacgaaaagattattaaaaacgctggtacgattttttggaacgggccaatgggtgtttttgaaatggataaatttgcgagtgggactatggcaatcgccaaagcagtcgctaaatccaaggcaaaaacagttgtaggtggaggagattccatcgctgcaatcaacaaagctagagttgcagataaaattactcatatctcaactggcggtggagcttccctcgaatttatggaaggtagaaaacttccaggagtagaagcccttaagaaaaaaacttccgagtaa

SEQ ID NO: 90704 - protein, 396 aa, Leptospira interrogans
MELPRLENVDLSGKRVFLRVDFNVPVENGKVTDKTRIEKTLPTIELLIKKGARIIIASHLGRPKGQVNPEFSLAPVVETFQSLVKSKVYFSKTVIGEDAIKLSKELKNGEILVIENVRFHKEEEENDPGFSKKLAALADIYVNDAFGAAHRAHSSTEGIARLLPAYAGLLMHKEILELSALLHKPARPFVAIIGGSKVSTKIKVLTNLFDKVNHLLIGGGMAYTFLKSRAIPIGNSLVEKEFEVQAFQLIEKAGVAGIDLQLPVDHIIGDQFNEKAKTKSVDKMGILDGWMGMDIGSKTVSNYEKIIKNAGTIFWNGPMGVFEMDKFASGTMAIAKAVAKSKAKTVVGGGDSIAAINKARVADKITHISTGGGASLEFMEGRKLPGVEALKKKTSE

SEQ ID NO: 90705 - DNA, 1191 bp, Leptospira interrogans
  CDS (1)..(1191): transl_table=11
atggaattacctagacttgaaaatgtagatctctcaggaaagagagttttcctgagagtagattttaacgttccagtagaaaatggaaaagttacagacaaaactagaattgaaaagactcttcctacaatcgaacttctgattaaaaaaggcgcaaggataattattgcgagtcacttaggaagacccaaaggacaagtaaatcctgaattttctttggcgccagtagttgaaactttccaaagtcttgtaaaatctaaagtttatttttctaagacagtaatcggagaagacgcgattaaactttctaaagaacttaaaaacggcgaaattttagtaattgaaaacgttcgttttcataaagaagaagaggaaaatgatcctggtttttccaaaaaactctctgcgttagccgacatctatgtgaacgacgcttttggcgcggctcacagagcgcattcctccaccgaaggaatcgcacgtctacttcctgcatatgcaggtcttctaatgcacaaagagatcttagaactttctgcgcttctgcataaaccggctcgtccatttgtggcgatcataggaggttccaaagtttccactaagatcaaggtcctaaccaatctattcgacaaggtaaatcatcttctcattggtggtggaatggcttatacgtttttaaagtccagagcgatccctattggaaattcactcgtggaaaaagaattcgaagttcaagcctttcagttaatcgaaaaagcaggcgtcgccggtatcgatttacaacttccggtagatcacatcattggagatcagtttaacgaaaaggcaaagaccaagtccgtagataagatgggaattttagacggttggatgggaatggatataggttctaaaacggtttctaactacgaaaagattattaaaaacgctggtacgattttttggaacgggcccatgggtgtttttgaaatggataaatttgcgagtgggactatggcaatcgccaaagcagtcgctaaatccaaggcaaaaacagttgtaggtggaggagattccatcgctgcaatcaacaaagctggagttgcagataaaattactcatatctcaactggcggtggagcttccctcgaatttatggaaggtagaaaacttccaggagtagaagcccttaagaaaaaaacttccgagtaa

SEQ ID NO: 90706 - protein, 396 aa, Leptospira interrogans
MELPRLENVDLSGKRVFLRVDFNVPVENGKVTDKTRIEKTLPTIELLIKKGARIIIASHLGRPKGQVNPEFSLAPVVETFQSLVKSKVYFSKTVIGEDAIKLSKELKNGEILVIENVRFHKEEEENDPGFSKKLSALADIYVNDAFGAAHRAHSSTEGIARLLPAYAGLLMHKEILELSALLHKPARPFVAIIGGSKVSTKIKVLTNLFDKVNHLLIGGGMAYTFLKSRAIPIGNSLVEKEFEVQAFQLIEKAGVAGIDLQLPVDHIIGDQFNEKAKTKSVDKMGILDGWMGMDIGSKTVSNYEKIIKNAGTIFWNGPMGVFEMDKFASGTMAIAKAVAKSKAKTVVGGGDSIAAINKAGVADKITHISTGGGASLEFMEGRKLPGVEALKKKTSE

SEQ ID NO: 90707 - DNA, 1230 bp, Methanobacterium bryantii
  CDS (1)..(1230): transl_table=11
atgtcccttccattttataccatagatgactttaatttagaagataagactgttcttgtgagagttgatataaattcgcctgtagatccaagtacaggttctattttagatgacacaaaaataaaattacacgccgaaaccatagatgaaatttcaaagaagggtgcaaaaacagttgtgctggctcatcaaagtaggcctggaaaaaaggactttactacgctccaacagcatgcaaaagcactttcaaacattttaaatcgtcctgtggattatattgatgatattttcggcactgctgcaagggaagaaataaagagactgaaaaaaggagatattctcctccttgaaaatgtcagattttatcctgaagaaatcttaaaaagagatccccaccagcaggctgaaacacacatggttcgtaaattatatcccattatcgacatctttataaacgatgcatttgcagctgcccatagatcacaaccttcactggttggttttgcagtgaagctgccgtcaggtgcaggtagaataatggaaaaagaacttaagtcactttatggggctgttgataatgctgaaaagccttgcgtttatgtactaggcggagtgaaagtagacgactccataatggtcctggaaaacgttttaagaaatggcagtgccgattatgtacttacaacaggtcttgttgccaacattttcctgtgggcttcaggaataaatctaggaaaatataatgaagactttattataaataaaggatacattgactttgtggaaaaaggcaaacagctgcttgaagaatttgatgggcagattaagatgcctgatgatgttgcggtttgtgtagataatgcaagagtagaatactgtactaaaaatattccaaacaaaccaatatatgatattggaaccaataccatcacagagtatgctaaatttataagagatgccaaaactatatttgcaaatggacctgcaggtgtttttgagcaagaaggttttagcattggtacggaagacattctaaatacaatagcatcatctaatggatactccataattggaggaggccatttagctgctgcagctaatcaaatgggtttatcatcaggaataacccatataagtagtggtggtggagcatctataaatttacttgctggtgaaaaacttcctgttgttgaaatactcactgaagtaaaaatgaaaggtagaaaatag

SEQ ID NO: 90708 - protein, 409 aa, Methanobacterium bryantii
MSLPFYTIDDFNLEDKTVLVRVDINSPVDPSTGSILDDTKIKLHAETIDEISKKGAKTVVLAHQSRPGKKDFTTLQQHAKALSNILNRPVDYIDDIFGTAAREEIKRLKKGDILLLENVRFYPEEILKRDPHQQAETHMVRKLYPIIDIFINDAFAAAHRSQPSLVGFAVKLPSGAGRIMEKELKSLYGAVDNAEKPCVYVLGGVKVDDSIMVLENVLRNGSADYVLTTGLVANIFLWASGINLGKYNEDFIINKGYIDFVEKGKQLLEEFDGQIKMPDDVAVCVDNARVEYCTKNIPNKPIYDIGTNTITEYAKFIRDAKTIFANGPAGVFEQEGFSIGTEDILNTIASSNGYSIIGGGHLAAAANQMGLSSGITHISSGGGASINLLAGEKLPVVEILTEVKMKGRK

SEQ ID NO: 90709 - DNA, 1233 bp, Methanothermus fervidus
  CDS (1)..(1233): transl_table=11
ttgttcaaattctatacgatggatgattttgattattctgggagcagagtgcttgtaagagtagacattaattctccagtagatcctcatactggacgtatacttgatgatacgagaatgagactacattcaaaaacactcaaagaactagtagatgaaaatgcaaaggtagctattttagcacatcaaagtaggccaggaaaaagagatttcacaacaatggaagagcatagtaaagtattatccaatatattagatatgcctgttacatatgttgaggatatatttggttgtgctgcacgagaatcaataagaaatatggaaaatggagatatcatccttttagaaaatgtacgtttttattcagaagaagttttaaaaagagatcccaaagttcaggcagaaacacaccttgtaagaaaattatcaagtgttgttgattattatataaatgatgcttttgcagctgctcatagatcacaaccatcattagttggatttccgcttaaactaccttctgctgcaggaagattaatggaaagagaagttaaaacattgtataaaataattaaaaacgttgaaaagccatgtgtttatattcttggaggtgttaaaattgatgattcaataatgataatgaaaaatattttaaaaaatggttctgctgattatattctaacatctggtttggtggcaaatgtatttttagaggcttctgggatagatattaaagaaaagaacagaaaaatattgtatagaaaaaattataaaaaatttataaaaatggcaaaaaaacttaaagataaatatggggagaagatacttacccctgttgatgttgccataaataaaaatggaaagagaattgatgtacctattgatgatattcctaactttccaatatatgatataggcatggaaactataaaaatatatgcagaaaaaataagagaggcaaaaacaatttttgctaatggaccagcgggtgttttcgaagaacaacaatttagtataggaactgaagatttgttaaatgcaatagcatcatccaacgcattttcagttatagcaggaggtcatttagcagcggctgcagaaaaaatgggtatttcaaataaaataaatcatattagtagtggaggcggggcttgtatagcatttctttctggcgaagagctccctgcaattaaagttcttgaagaagctagaaaaaggagcgataaatatatatag

SEQ ID NO: 90710 - protein, 410 aa, Methanothermus fervidus
MFKFYTMDDFDYSGSRVLVRVDINSPVDPHTGRILDDTRMRLHSKTLKELVDENAKVAILAHQSRPGKRDFTTMEEHSKVLSNILDMPVTYVEDIFGCAARESIRNMENGDIILLENVRFYSEEVLKRDPKVQAETHLVRKLSSVVDYYINDAFAAAHRSQPSLVGFPLKLPSAAGRLMEREVKTLYKIIKNVEKPCVYILGGVKIDDSIMIMKNILKNGSADYILTSGLVANVFLEASGIDIKEKNRKILYRKNYKKFIKMAKKLKDKYGEKILTPVDVAINKNGKRIDVPIDDIPNFPIYDIGMETIKIYAEKIREAKTIFANGPAGVFEEQQFSIGTEDLLNAIASSNAFSVIAGGHLAAAAEKMGISNKINHISSGGGACIAFLSGEELPAIKVLEEARKRSDKYI

SEQ ID NO: 90711 - DNA, 1254 bp, Methanococcus jannaschii
  CDS (1)..(1254): transl_table=11
atgattatgtttttgacgttggatgactttaattttgaagataagagggtagttttgagagtagatataaactgtccaatagacccaaacactggagagattttagatgataagaggattagagaaataaaaagcacaattacagagcttataaacaaaggtgctaaggttgttatcttagctcaccaaagtaggccagggaagaaagattttactacattaaaaaaccatgcaaaggttttatcagatgttattggtaaagaagtagagtatattgatgaagttataggctctacagcaagagaggcaataatcaatatgaaatgtggagatgtcattttattggagaatgttaggttttattctgaggaggttttaagtgattggaaaaaatgggaaaatataactccaaaaaaacaggcagagacaaatttaattaaaagattagccccattatttgactattttgttaatgatgcctttgcagctgcacacagggctcagccatcattagttggtttctcttactatatgccaatgattgctggaagattgatggagagagaggttggggttttatcaaaggttttagaaaatccagaaaagccctgtgtttatgttttgggaggagctaaggcagatgattcaataagagttatgaaaaacgtcttagaaaatggaactgctgataaggttttaacttcaggaattgttgctaacatcttccttgtagctatgggatatgatttaggcgtaaatatggatattattgaaaatcttggattaaaaagccaaatagagattgctaaagagttgttaaataaatttgaagataaaatcgttgtccctgttgatgtagccctaaatattaatgaagagagggttgaagctgatttaaataaggatgaaaaagtagaacatttaattaatgatattggggagaaaactatcgaactttacagtgaaataattaatgaagcaaaaaccattgttgccaatggtccagcgggagtgtttgaaaaagaggcatttgcaaaaggaactgaagagctgttgaaagcgatagctaactcaaaagggttttcagttattggaggagggcatttatctgcagctgctgaattatttggaattgctgataagattgaccatgttagtacgggaggtggagcaaccttagatttcttagctggagaaaaattgccagtaatagagatgcttaaggaatcatataagaaatataagggacaataa

SEQ ID NO: 90712 - protein, 417 aa, Methanococcus jannaschii
MIMFLTLDDFNFEDKRVVLRVDINCPIDPNTGEILDDKRIREIKSTITELINKGAKVVILAHQSRPGKKDFTTLKNHAKVLSDVIGKEVEYIDEVIGSTAREAIINMKCGDVILLENVRFYSEEVLSDWKKWENITPKKQAETNLIKRLAPLFDYFVNDAFAAAHRAQPSLVGFSYYMPMIAGRLMEREVGVLSKVLENPEKPCVYVLGGAKADDSIRVMKNVLENGTADKVLTSGIVANIFLVAMGYDLGVNMDIIENLGLKSQIEIAKELLNKFEDKIVVPVDVALNINEERVEADLNKDEKVEHLINDIGEKTIELYSEIINEAKTIVANGPAGVFEKEAFAKGTEELLKAIANSKGFSVIGGGHLSAAAELFGIADKIDHVSTGGGATLDFLAGEKLPVIEMLKESYKKYKGQ

SEQ ID NO: 90713 - DNA, 1221 bp, Methanopyrus kandleri
  CDS (1)..(1221): transl_table=11
atgtacgaaaacatatctactatggacgatttcgagttcgaaaataaatgggtcttgttacgaattgatataaattcgacggttatcgatggtaaaattgaggacgatgaacgtattaaaagacatctcgggacgatcaaggagttaatggaacacgacgccagggtggccattctagcacaccaaggaagaccgggtgaggatgacttcacgacactggaaccacatgcggaaatcatgtccgaagaactcgacaacttcgagtacgtgcccgacgtgttcggacccaccgcgaagaagaagattcggtcgttggagcccggcgaagttatcctgctggagaacgtgcggttctattccgaggaacgtatcaaccgggacccggagtggcacgcacgccgacatttggtgcggaacctggccccgctgttcgacattttcgtgaacgacgccttcgctgcggcccatcgctcgaacgcttcactggtcgggttcactcgaagacttccgtcttgcgtcggccgtgtgatggagcgcgagatcgaagtcctcgaaaccatggtcagagacgagatggaggacggcgtcttcgtgatcggagggtccaagatcgaggatgctatcaaggtcatacgccgagccatcgagatggacaacgtacgtcgcgtgttactgggaggtctcgtgggcaatctcttcctttgggcctccggagtggatctagggaaaccttcacggaaattcctggatatgaagggttacacgggctacttggacgaggcacgggagctcctcgaggaaggtgacgacgtgatcctcgtacccgaagacgtggctctcaaccgcggtggagagcgcgaggaggtagacgtggacgaactgccagcggacgctcccgtcttcgacatcggtaccggaacgatcgaacggtatcgcaaggaggtcgaaagcgcgggtatggtggtcgcgaacgggccgatgggcgtgtacgaggaacccggattcgagaagggaacgtacgaggtcctcaatgctatcgccgattcggaggctttctccgtgatcggaggaggccacataattgcggcggcgaaagcctgtggtgcttatgacagcatagatcacgtcagcacgggtggcggagcgatgctccgaatgctcgccggggagcgactaccggccatagatgccatcctcacttgcccgttctcggggtgctga

SEQ ID NO: 90714 - protein, 406 aa, Methanopyrus kandleri
MYENISTMDDFEFENKWVLLRIDINSTVIDGKIEDDERIKRHLGTIKELMEHDARVAILAHQGRPGEDDFTTLEPHAEIMSEELDNFEYVPDVFGPTAKKKIRSLEPGEVILLENVRFYSEERINRDPEWHARRHLVRNLAPLFDIFVNDAFAAAHRSNASLVGFTRRLPSCVGRVMEREIEVLETMVRDEMEDGVFVIGGSKIEDAIKVIRRAIEMDNVRRVLLGGLVGNLFLWASGVDLGKPSRKFLDMKGYTGYLDEARELLEEGDDVILVPEDVALNRGGEREEVDVDELPADAPVFDIGTGTIERYRKEVESAGMVVANGPMGVYEEPGFEKGTYEVLNAIADSEAFSVIGGGHIIAAAKACGAYDSIDHVSTGGGAMLRMLAGERLPAIDAILTCPFSGC

SEQ ID NO: 90715 - DNA, 1251 bp, Methanosarcina mazei
  CDS (1)..(1251): transl_table=11
gtgctgagggtaatgacttccagaaactttcttacgatcgatgattttgacatacgcggaaagacgattcttttaagggtcgacatgaactctcctatggacactcagggtcacattctggacgatatgaggatcaggagtcatattgccactcttaaagaccttgagagtgcaaaagtcgttgtgcttgcgcaccagagccggcctgggaaaaaagacttcaccactatgaaacctcatgctcacctgctgtccaggtatctgggcaggcaagttacttatgtggacgacatcttcgggacttttgcgaagactcagatcgcttctatggaagacggggacgtcatcatgctcgaaaacgtcaggttctattctgaagagagcctcgagaggactacagccgagcaggccaatacttttatggttaaaaaactggcaccctttgttgatattttccttaatgacgcgtttgcggtatctcacaggtctcatctctctgttgtaggctttaccgaagtcctcccttccggagcaggcagggtaatggaaaaagaacttatttccctggaaaaaggagttaaaagtggagagaggccaagcgttttcgtgctggggggggcaaaagtggacgactcacttagagtaaccgaaaatgtcctcacaaacgggggagctgacagagtcctccttacaggggtagttgcaaacgttgcccttgccgcttccggagtaaatataggaaaagccaatctggatttcattaaatcccagggctacgaagaccagatagaaagggcgagaggtttgcttgcgaagttcgaagataaaatcggacttccgaaagacgttgctttaaatgataacaaaaagcgtgttgaagctcctatttccgaacttaattccgattctctgcccattaacgatataggtcttgaaaccattgtggactacaccaatgaaatccagaatgccaaaacagttgtcctgaacggccctgccggggtttcagagattgaggactttgccctcggaacccatgaaattataaaagctgctattaaatccgatttctctatcattggcggcgggcatatctctgtggaagttgcacacctcgggcttgaacaccgcttttcacacataagcactggaggaggagcctgtattgatttccttgcaggggaaaagctgccaggcgtcgaagctctcaaggctgcttacaataagtatcaggaagctaaaaagctttaa

SEQ ID NO: 90716 - protein, 416 aa, Methanosarcina mazei
MLRVMTSRNFLTIDDFDIRGKTILLRVDMNSPMDTQGHILDDMRIRSHIATLKDLESAKVVVLAHQSRPGKKDFTTMKPHAHLLSRYLGRQVTYVDDIFGTFAKTQIASMEDGDVIMLENVRFYSEESLERTTAEQANTFMVKKLAPFVDIFLNDAFAVSHRSHLSVVGFTEVLPSGAGRVMEKELISLEKGVKSGERPSVFVLGGAKVDDSLRVTENVLTNGGADRVLLTGVVANVALAASGVNIGKANLDFIKSQGYEDQIERARGLLAKFEDKIGLPKDVALNDNKKRVEAPISELNSDSLPINDIGLETIVDYTNEIQNAKTVVLNGPAGVSEIEDFALGTHEIIKAAIKSDFSIIGGGHISVEVAHLGLEHRFSHISTGGGACIDFLAGEKLPGVEALKAAYNKYQEAKKL

SEQ ID NO: 90717 - DNA, 1236 bp, Methanobacterium thermoautotrophicum
  CDS (1)..(1236): transl_table=11
ttgatggtgatcccggtgtcctttaaatttaaaaccatggatgacattgaagtcacaggaaagacagtccttgtccgcgtggacataaattcgcctgtggaccccaatgatgggacaatactcgatgatacaaggatgaggctccatgcagagaccataagggaactctcagataggggtgccaggacagttgtgatggcccaccagagcagacccgggaagaatgacttcacaacactggagcagcatgccagggcgctctccgggatactcaggaggcccgttaagtacgttgaggatatattcggatccgctgcaagggagaacatctcaggactgggtgatggtgagataatcctccttgagaacgtccgcttctactccgaggaggtgctcaagcgagaccctgaggaacaggcggagacacaccttgttaggaagctggcgcccctcctggactacttcatcaacgacgccttcgcggcagcccacaggtcccagccctcccttgttggcttcgccctgagggtaccgtcagctgcgggtcgtgtgatggagagggaacttcgaacacttcagggtgcccttgagaatgttgaaaggccctgtgtctatgttctcggcggggtgaaggttgatgactccatcatggtcatgaagaacgtccttgaaaacggtagcgcagaccttgtactgacaacgggccttgttgccaacatattcctggcgggatgcggggttaagatcggtaaggtgaacatggacttcatcaagagcaggggatactgtgacttcatcaaggtggcgaagaaactgaagaagcgcttccctgaaaggatagttgtacccgttgatgttgcagtatgcagggacggcaagagggttgatgttcctgtgaaaaagatacccaaccatccgatacaggatatcggaatggaaaccataaagctctacgccaggaggatacgtgaggcaaggaccctctttgccaatggaccggcaggcgtatttgagaaccctgatttcagcataggaaccgaggacatactgaatgcaatatcctcttcagaaggtttctcaataatcggcgggggtcaccttgctgctgcagcagtgaagatgggctttgaggacagcataaaccatatcagcagtggaggcggtgccagcataagcctccttgcaggtgaggagcttcccgcagtcagggtgcttgaggaatccaggcacccataa

SEQ ID NO: 90718 - protein, 411 aa, Methanobacterium thermoautotrophicum
MMVIPVSFKFKTMDDIEVTGKTVLVRVDINSPVDPNDGTILDDTRMRLHAETIRELSDRGARTVVMAHQSRPGKNDFTTLEQHARALSGILRRPVKYVEDIFGSAARENISGLGDGEIILLENVRFYSEEVLKRDPEEQAETHLVRKLAPLLDYFINDAFAAAHRSQPSLVGFALRVPSAAGRVMERELRTLQGALENVERPCVYVLGGVKVDDSIMVMKNVLENGSADLVLTTGLVANIFLAGCGVKIGKVNMDFIKSRGYCDFIKVAKKLKKRFPERIVVPVDVAVCRDGKRVDVPVKKIPNHPIQDIGMETIKLYARRIREARTLFANGPAGVFENPDFSIGTEDILNAISSSEGFSIIGGGHLAAAAVKMGFEDSINHISSGGGASISLLAGEELPAVRVLEESRHP

SEQ ID NO: 90719 - DNA, 1242 bp, Mycoplasma gallisepticum
  CDS (1)..(1242): transl_table=4
atgattaactacaataagaagaccttaaaggatgttgatctaaaagataaaacagtaattgtacgtgttgattttaacgtaccaattaaagacaataaggttatagatgatacaagaattgttcaagcattagatacgattaaatatctaatcgaacaaaactgtaagatcgttttattaagtcacttaagccgaattaagtcattagaagatattagttctaaaaagaagagcttaagaccagtttatgaaaacttaaaaaccaaacttaacaacgttaagtttttagaagaaaacgttggttatgacgttgttgaagcggttaaacaattaaaacaccaagaagttttattattggaaaacactcgttataacgatgtcgacaatcaaggtgaagttgttaaaaaagaatctaaaaacagtccagaactaggacgtttctgagctagtttagctgatgtttttgtcaacgacgcatttggtacttcacaccgtgcgcatgcttcaaacgttgggattgctgcaaatatctcgcaatcttgtattggtttcttagttcaaaaagaactagaagcattatcaaaattaacaaacaacccacaacgtccgtttgttgtgatcttaggtggtgctaaggtatcagataaattaaaagtaatcgaatcattactaaaatctgctgatcaaattctaatcggtgggggaatggttaatacctttaataaggctaaaggttatcatattggtaaatcattattcgaacctgagatgttagaaactgctaagaagatcttagctgaagataaggataataagatcattttagcgactgatcagatggtaactaaagctagtacgatcactgatattaaaactgcacctgctggtaagtgtgtgtttgccaaagatgaagcagaaaacgaagattttgaagctttagatatcggtgatgaatcaatcaaaactttcaaatcttatatagctaaagctaaatcaatcttctgaaacggtcctttaggtgtttttgaaaaccctaattacgaacgtggatcttatgagattgctaaagcgatcagtgaatctgatagttatagtgtgatcggtggcggtgatagtgctgctgctgcaaaccaatttaaattagccgacaaatttagctttgtctcaactggtggtggtgcttcattaacatttatggaacaaactgttctaccagggattgaagcgatccaatcaaaataa

SEQ ID NO: 90720 - protein, 413 aa, Mycoplasma gallisepticum
MINYNKKTLKDVDLKDKTVIVRVDFNVPIKDNKVIDDTRIVQALDTIKYLIEQNCKIVLLSHLSRIKSLEDISSKKKSLRPVYENLKTKLNNVKFLEENVGYDVVEAVKQLKHQEVLLLENTRYNDVDNQGEVVKKESKNSPELGRFWASLADVFVNDAFGTSHRAHASNVGIAANISQSCIGFLVQKELEALSKLTNNPQRPFVVILGGAKVSDKLKVIESLLKSADQILIGGGMVNTFNKAKGYHIGKSLFEPEMLETAKKILAEDKDNKIILATDQMVTKASTITDIKTAPAGKCVFAKDEAENEDFEALDIGDESIKTFKSYIAKAKSIFWNGPLGVFENPNYERGSYEIAKAISESDSYSVIGGGDSAAAANQFKLADKFSFVSTGGGASLTFMEQTVLPGIEAIQSK

SEQ ID NO: 90721 - DNA, 1251 bp, Mycoplasma genitalium
  CDS (1)..(1251): transl_table=4
gtgctaagctctaatatgcttaatttcaaaacactccaagcaattgattttcaaaacaaaaccgttgttttaagaagtgattttaatgtcccaatgatcaatggggttattagtgatagtgaaagaattttagctggtttggatactattaagttcttagttaaaaagaactgcaagatagtgctactatcacacctttcaaggattaagagtttagaagataaactaaacaacaaaaaatctttaaagccggttgctgaattactccaacaactcttaccaactgtaaaggttcaattttcttgtaaaaacactggtgctgaagttaaacaaaaagtgcaagcattagcattcggtgaaatccttctccttgaaaacactcgctattgtgatgtaaacgataaaggagaaattgttaaattagaaagtaaaaatgatcctgaactagcgaaattctgggctagtttaggggaaatttttgttaatgatgcatttggtactgcccatagaaaacatgcttctaatgcaggaattgcaaagtatgttgcaaaatcctgtattgggtttttaatggaaaaagaactaaagaacctctcttacctaattcaaagcccacaaaaaccctttgttgttgttttgggtggtgcgaaagtatcagataaactaaaggtagttgaaaacttactaaaacttgctgataatatcttaattggcggagggatggtaaatacctttcttaaagcaaaaggcaaagctactgctaattccctagttgaaaaagagttaattgatgttgctaagcaaatcttggataaagatactcataataagattgtgctggcaattgatcaggtaatgggttctgaatttaaagatcaaactggcattactttagatgttagtgacaaaattcaagaacaatatcaatcctatatgtctctagatgttggatctaaaacaattgctttatttgaaagttatttaaaaacagccaaaactatcttttgaaacggtccccttggagtttttgaatttactaactttgctaaaggaacttcaaaaatcggtgagattattgctaaaaataaaactgcttttagcgttattggtggtggggattcagctgcagcagttaagcaaatgcaactatctgatcagtttagttttatctccactggtggtggtgcttctttagcactaattggtggggaagagttagtaggtattagcgatattcaaaaaaattcttaa

SEQ ID NO: 90722 - protein, 416 aa, Mycoplasma genitalium
MLSSNMLNFKTLQAIDFQNKTVVLRSDFNVPMINGVISDSERILAGLDTIKFLVKKNCKIVLLSHLSRIKSLEDKLNNKKSLKPVAELLQQLLPTVKVQFSCKNTGAEVKQKVQALAFGEILLLENTRYCDVNDKGEIVKLESKNDPELAKFWASLGEIFVNDAFGTAHRKHASNAGIAKYVAKSCIGFLMEKELKNLSYLIQSPQKPFVVVLGGAKVSDKLKVVENLLKLADNILIGGGMVNTFLKAKGKATANSLVEKELIDVAKQILDKDTHNKIVLAIDQVMGSEFKDQTGITLDVSDKIQEQYQSYMSLDVGSKTIALFESYLKTAKTIFWNGPLGVFEFTNFAKGTSKIGEIIAKNKTAFSVIGGGDSAAAVKQMQLSDQFSFISTGGGASLALIGGEELVGISDIQKNS

SEQ ID NO: 90723 - DNA, 1215 bp, Mycoplasma hyopneumoniae
  CDS (1)..(1215): transl_table=4
atgcagccaacctacaaaaataaaaagtttattgatgatattgattttttaaataaaactgtaattctccgtgttgattttaatgtgccgatcaaaaatggagaaattagttctataaaaagaatcattgcaagtcttaaaactattaaaaaaattgtaaataatggcggtaaattagtgattttatcccatcttggccggataaaatccaaagaagatcttccaaaaaaatcccttagaatagtagctgaaaaattagctgaaattttaggtcaggaaattaaatttatccctgaaaaccgtggtcctaaagtcgaaaatgcaattagccaacttgaaaaaggtgaaattttagtacttgaaaatacaagatttcaggacctaaataataaagctgagtccaaaaacgatgctgaattaggcagatattgagcctcccttggtgatgtttttatcaatgatgccttcggaactcttcatcgggctcatggatcaaatgtcggaattgcaacttatattaaagaatcagcaattggatatttagtaaaagaagaattagatgccctttcaaaactaattttttccccgcaaagaccattttatgcaattatcggcggggcaaaaatatccgataaaatcgggataatttcaactttattagaaaaagctgataaagttttaatcggtggcggaatggcttatactttcaaaaaagcacttggttataaaattggtctttcgatttatgaagatgacaaacttgaacttgctgctagtctagtcaaaaaatatccagataaattaattttagctcttgatgcggctctagccccagaatttgccgatcttgaacctttatataatcaggaaaatccccttgaaatccctgatcatttagaaggaatggatattggtcctttaacaattgagttattcaaggatcatctaaaagatggaaaaactatcctttgaaatggaactttaggcgtagccgaatttaaaaattttgcccgtggaaccaaggaagttgccaaaattattgccaatctaaaagaatgttatagtatcattggcgggggagattcaatcgctgcaattgaagccgaaggtcttagtaattcattttcccatatttctacaggcggaggcgcttcaattagttttattgaaaacggtgatttaattggacttggcccaatccaggaaaaagactaa

SEQ ID NO: 90724 - protein, 404 aa, Mycoplasma hyopneumoniae
MQPTYKNKKFIDDIDFLNKTVILRVDFNVPIKNGEISSIKRIIASLKTIKKIVNNGGKLVILSHLGRIKSKEDLPKKSLRIVAEKLAEILGQEIKFIPENRGPKVENAISQLEKGEILVLENTRFQDLNNKAESKNDAELGRYWASLGDVFINDAFGTLHRAHGSNVGIATYIKESAIGYLVKEELDALSKLIFSPQRPFYAIIGGAKISDKIGIISTLLEKADKVLIGGGMAYTFKKALGYKIGLSIYEDDKLELAASLVKKYPDKLILALDAALAPEFADLEPLYNQENPLEIPDHLEGMDIGPLTIELFKDHLKDGKTILWNGTLGVAEFKNFARGTKEVAKIIANLKECYSIIGGGDSIAAIEAEGLSNSFSHISTGGGASISFIENGDLIGLGPIQEKD

SEQ ID NO: 90725 - DNA, 1251 bp, Mycobacterium leprae
  CDS (1)..(1251): transl_table=11
gtgcgcattcctaatcttaaagatcttcttgaggaaggtgtttctggtcgctgcgtgttggtgcgctgcgatctgaacgtcccgctgggggatgatggcgccatcaccgacctcggtcgggtcaccgcgtcggtgcctacgttgaaagcgctgcttgaggccggagccaagattgtggttgccgcccatctgggccgccccaagaacgggccagacccaaagctgtcactggagccggtcgccgcggcgctcggtgagcagctgggccaaaacgtccagttggtctgcagcaccgatcgttcccctgtcgggggtgatgcgctcgcctgtgttgagaggctgaccgacggcgacctcctactgctgcagaacatccgcttcgatccgcgcgagaccagcaaagtcgacgacgaacgactcgctctggccaagcaattggttgaattggtcgggtcagcaggagcttttgtttcggatggattcggtgtggtgcatcgcaggcaggcttcggtgtatgacgtcgctacgctattgccgcactacgccggcatactggttgctgacgagataaggatactcgagcaattgactagttcggccaaacgcccctacgcagtggtgctcggcgggtcgaaggtatccgacaagctcggcgtcatcgagtcgctggcgacaaaagccgatagcatcgtactcggaggtggaatgtgctttacatttcttgctgcacaaggattttcagtaggtaaatcgttattggaaaccgagatgatcgagacctgtcgtagtctgttggacacctacgctgacgtgcttcggcttcctatggacattgtggtgacagagaagttcgtcgctgattcgccgccgcagaccgtcgccgccgacgctatcccagatggattgatgggactggatatcgggccggaatcggtcaagcggttcgctacgttgttatccaacgcctcgaccattttctggaacggaccgatgggcgtgttcgaattccctgcgtacgccgcgggcaccagaggtgttgctgaagcaatcgtggctgttactggcaagggagctttcagcgtggtcggcggcggtgactctgcggctgcgatgcgggcgctcagcctacccgaaggcagtgtctcgcacctttccaccggtggcggcgcgtcgttggaataccttgagggcaagacgctacccgggatcgaggtactaggtcgtgagcagccaaggggaggagactcgtga

SEQ ID NO: 90726 - protein, 416 aa, Mycobacterium leprae
MRIPNLKDLLEEGVSGRCVLVRCDLNVPLGDDGAITDLGRVTASVPTLKALLEAGAKIVVAAHLGRPKNGPDPKLSLEPVAAALGEQLGQNVQLVCSTDRSPVGGDALACVERLTDGDLLLLQNIRFDPRETSKVDDERLALAKQLVELVGSAGAFVSDGFGVVHRRQASVYDVATLLPHYAGILVADEIRILEQLTSSAKRPYAVVLGGSKVSDKLGVIESLATKADSIVLGGGMCFTFLAAQGFSVGKSLLETEMIETCRSLLDTYADVLRLPMDIVVTEKFVADSPPQTVAADAIPDGLMGLDIGPESVKRFATLLSNASTIFWNGPMGVFEFPAYAAGTRGVAEAIVAVTGKGAFSVVGGGDSAAAMRALSLPEGSVSHLSTGGGASLEYLEGKTLPGIEVLGREQPRGGDS

SEQ ID NO: 90727 - DNA, 1215 bp, Mycoplasma mycoides
  CDS (1)..(1215): transl_table=4
atgaattacaataacaaaaaaacattaaaagacatagatgttaaaaataaaactgtattagttcgtgtggattttaatgtaccaattcaaaatggagttattactgatgataatcgtataattgctgcttttcctactataaattacttacttgaaaatgatgcaaaaattgttttattttcacacttatcaagaattaaatcaaaagaagataaactaaaaaaatctttagccccagttgctaaaagattagaagaattattaaataaacaagttaaatttattaatcaaactagaggacaagaactagaaaaagctattagttcattacaatctaaagaaattattttagttgaaaacactagatttgaagatgttttagatgatcaagttgttaagtatgaatcaaaaaacaattctgaattaggaaaatattgagctagtttgggagaagtttttgtaaatgatgcttttggaactgcacatagggcacacgcttcaaatgttggaattgcttcaaatattaaagtttcagctattggatttttagttgaaaaagaactaaaaatgttatttcaagcagtcaatgaacctaaaaaaccatttattgctattttagggggagctaaagtttcagataaaattggtgttattgaaaatttattaccaaaagtagataaattattaattggtggaggaatgagttatacattcttaaaagcattaggaaaaactattggtaaatcattattagaagaagataaaattgatttagcaaaacattatttagaaattggtaaagataaaattgtagtacctgttgatactgcttgtgcaaaagaatttgcagatgttagtccaactatttttgaaggaaatattcctgacgaatgagatggattagatgccggaccaaaaacaattgaattatttaaacaagaaattaaaaaagctaaaactattgtttgaaatggacctgttggagtatttgaatttaaaaactttgaaaacggtacaaaatcagtctgtcaagccattgctgaacaaacacaaaatggtgcatttactttaattggtggtggagatagtgcttcagctgcaattaatatgggatttaaagataaattttcatgaatttcaactggtggaggagcttcacttgaatttatggaaggaaaagaattactaggaatttctgcaattcaagataaataa

SEQ ID NO: 90728 - protein, 404 aa, Mycoplasma mycoides
MNYNNKKTLKDIDVKNKTVLVRVDFNVPIQNGVITDDNRIIAAFPTINYLLENDAKIVLFSHLSRIKSKEDKLKKSLAPVAKRLEELLNKQVKFINQTRGQELEKAISSLQSKEIILVENTRFEDVLDDQVVKYESKNNSELGKYWASLGEVFVNDAFGTAHRAHASNVGIASNIKVSAIGFLVEKELKMLFQAVNEPKKPFIAILGGAKVSDKIGVIENLLPKVDKLLIGGGMSYTFLKALGKTIGKSLLEEDKIDLAKHYLEIGKDKIVVPVDTACAKEFADVSPTIFEGNIPDEWDGLDAGPKTIELFKQEIKKAKTIVWNGPVGVFEFKNFENGTKSVCQAIAEQTQNGAFTLIGGGDSASAAINMGFKDKFSWISTGGGASLEFMEGKELLGISAIQDK

SEQ ID NO: 90729 - DNA, 1230 bp, Mycoplasma pneumoniae
  CDS (1)..(1230): transl_table=4
atggttgactttaaaacagtccaagcgtttgactttcagggtaaaaccgtagtcttacgtgctgacctcaatgtgccgatgaaggacggggtcattaccgacaacgaacgcatactagctagcttagacacgattaagtacctcttgggtcacaattgcaaaattgtgttactgtcccatttgtcacgagtcaaatcgctcgatgacaaaaagggtaagaagtcactccaaccagtagctagtgctttacaaaatttattaaagaacaccaaggttcacttttgtccggaaaacacgggtgacaaggtcaaagtcgcagtcaatcaactcccattaggggaaattttggtgttggaaaacacgcgttactgtgatgtgaatgaggctggtgaagtggttaaacacgaaagcaagaataacgctgagttagcacagttctgagcatcattgggtgacatctttgtcaatgacgcctttggcaccgcccaccgccgtcacgcttccaacgctggcattgccaagtacatcaaaaactcctgcattggtcttttaatggagcgggaattgatcaacctctaccgcttaattaataacccacccaaaccgtttgtggttgtgttgggtggcgctaaggtttctgataagttacaggtagtaaataacctgttcaagattgcggatcatattttaataggtgggggcatggtcaacaccttcctcaaagctctgggtaacgaagttggcacttccttagtggaggaagacttagtccaaaccgccaagcaaatccttgacagtgacaaggacaagaaaattgtcttgggggtagaccaaatgcttcatgctagctttaaggatgaaccaggcgtggagtgtgttgtagccccccaatgaccagcagaacttcagggctttatgtccttggatgttggtagcaaaacagtggccctgtttagcagttacctcgccaaggccaaaacaatcttttggaatggtcccatgggcgtatttgaatttagcaactatgctcagggtaccttagcaattggtaaagcgattgcgcaaaaccaacaagcctttagtgtcattggcggtggtgattctgcagccgctgctaaacaactccagattgctgatcaatttagttttatttccactggtggtggtgcatctttagcactaataggtggggaagagctagtgggaattagcgatattcaaaaaaagtaa

SEQ ID NO: 90730 - protein, 409 aa, Mycoplasma pneumoniae
MVDFKTVQAFDFQGKTVVLRADLNVPMKDGVITDNERILASLDTIKYLLGHNCKIVLLSHLSRVKSLDDKKGKKSLQPVASALQNLLKNTKVHFCPENTGDKVKVAVNQLPLGEILVLENTRYCDVNEAGEVVKHESKNNAELAQFWASLGDIFVNDAFGTAHRRHASNAGIAKYIKNSCIGLLMERELINLYRLINNPPKPFVVVLGGAKVSDKLQVVNNLFKIADHILIGGGMVNTFLKALGNEVGTSLVEEDLVQTAKQILDSDKDKKIVLGVDQMLHASFKDEPGVECVVAPQWPAELQGFMSLDVGSKTVALFSSYLAKAKTIFWNGPMGVFEFSNYAQGTLAIGKAIAQNQQAFSVIGGGDSAAAAKQLQIADQFSFISTGGGASLALIGGEELVGISDIQKK

SEQ ID NO: 90731 - DNA, 2316 bp, Mycoplasma pulmonis
  CDS (1)..(2316): transl_table=4
atgaaaaaacttataactgacttgaacttaaatgataaaaaggttttgattagactagacttaaatgttcctttaaaaggtaaaaaaataacttctttaaagagaattgaagaatctattccaacaattaaatatgttcaagagcgcggtggaaaaattatattattatctcacttaggtagagtaaaaacaaaagaagacaaagagaaaaaatcattatctattgttgtagaagctctagcttcacttttaaactcacctgtaaaatttgtagatcaaacaagaggaaaaaaattagaaagtgcaattgaaaaattaaaacctggagatgtattattaattgaaaatacaagatttgaagatctaaataataacgctgagtctaacaacgatcctgagcttggaaaatattgagcttctctaggtgatgtttttattaatgatgcttttggaactgctcatagagcacatgcttcaaatgttggtattgcaagtaacattaaagaatcagctcttggtattttggtacaaaaagaagttaatgccttatggaaattaatggaacaacaagaaaaaccatttgtggctattttaggtggatcaaaagtttcagacaaaataaatgttttagaaaaaataattgataaagttgatagattaattattggtggagctatggcttatacattcctaaaagctcaaggtattggaattggtgattctatttatgaacaagataaaattgaatttgccacagaatttctaaaaaaatacaaccacaaaattattttacctattgaccatgctcttgctaaaaaattcaaaaatgcaaaaccaattttcaacaatgaaaacccactagaaatacctcaaacatttattggtatggatgttggacctaaaacaattgaactaattcacaaatacatcaaaggtgatactaaactaggaataagccctgctaaaacaattttttgaaatggacctatgggtgtaactgaatttgaagaattccaaagtggtagtttagctgttgttgaagctatttctcaattagtaggagcttactcagttgttggtggaggagactcaattgctattattgaaaaattaaatgcacaaatgcttttctcacacatttcaacaggtggtggagctagcttagaatttattgaatcaaaagttcttccaggtattgatgcaattcaaaactatgaacaaacatatgagcaatatgactcacaagttcaaagccaagattttagccaaaactttgactcaccattggttgaagaaacattttcacaaagcacatctgaaaactttagtgattttgcaagttctactcaagaacactttgctacaagcgaaaatcaaaatactttaatcaataattacgaaaatccgggatttgattctcaagatatgtttaaaacagaagaacaaaatgattcaactagttcatttttaacttcaacaaatccattttcttctgagttttcaaatgaatttaaaacaagtgattttcaagatttaaaacaaactcaagaaacagaaactcaagaaactttaattccacatacttttgaatatacaactgatgatctaagacatactttagagcaatatgttagagaaactagttttcaaacaagagaatctactttcccaacagaagaggctagcttcgaaacattagaagaaactagttttcaaacactagaagagagcttccctactcaaagttttgaacaagtagaacaaactagtgaaaaaaatatggaagtttcaacagaaaattttgaaaatgcttcttctcaaaccaatagctttacagtttctgatattcctaaaacaacaagcacttttgaagatttagaaactccagaaactcaaaacacaactttagaagaagtagctttagaaacatcaaattttgaagctcaaaacttggaaactccaaacttgcaaacatcaaattttgagacttcaaatttagaaacatcgaattttgaaacttcaaactttgaaacgtcaacttttgaaagtttcaacacaggaaattttagtactccaagttcaacttttgaagatttagatttacaaagcgcaactttccagacaaacgacgaaagtgaaagatcaactcaagaaaattttgaaccaacagaagttattgaaagtgatttattagctatgaaaacaactgaattagaacaagaaatcacaaataacacttcaagagatatcttaagcgaagatgaagttgctgcacctcacaaaaaaagattttgattctttggtagaaaaagataa

SEQ ID NO: 90732 - protein, 771 aa, Mycoplasma pulmonis
MKKLITDLNLNDKKVLIRLDLNVPLKGKKITSLKRIEESIPTIKYVQERGGKIILLSHLGRVKTKEDKEKKSLSIVVEALASLLNSPVKFVDQTRGKKLESAIEKLKPGDVLLIENTRFEDLNNNAESNNDPELGKYWASLGDVFINDAFGTAHRAHASNVGIASNIKESALGILVQKEVNALWKLMEQQEKPFVAILGGSKVSDKINVLEKIIDKVDRLIIGGAMAYTFLKAQGIGIGDSIYEQDKIEFATEFLKKYNHKIILPIDHALAKKFKNAKPIFNNENPLEIPQTFIGMDVGPKTIELIHKYIKGDTKLGISPAKTIFWNGPMGVTEFEEFQSGSLAVVEAISQLVGAYSVVGGGDSIAIIEKLNAQMLFSHISTGGGASLEFIESKVLPGIDAIQNYEQTYEQYDSQVQSQDFSQNFDSPLVEETFSQSTSENFSDFASSTQEHFATSENQNTLINNYENPGFDSQDMFKTEEQNDSTSSFLTSTNPFSSEFSNEFKTSDFQDLKQTQETETQETLIPHTFEYTTDDLRHTLEQYVRETSFQTRESTFPTEEASFETLEETSFQTLEESFPTQSFEQVEQTSEKNMEVSTENFENASSQTNSFTVSDIPKTTSTFEDLETPETQNTTLEEVALETSNFEAQNLETPNLQTSNFETSNLETSNFETSNFETSTFESFNTGNFSTPSSTFEDLDLQSATFQTNDESERSTQENFEPTEVIESDLLAMKTTELEQEITNNTSRDILSEDEVAAPHKKRFWFFGRKR

SEQ ID NO: 90733 - DNA, 1179 bp, Neisseria meningitidis
  CDS (1)..(1179): transl_table=11
atggcatttttaaaactgaccgaacaaaacgtgcagggcaaaaccgtcctcatccgcgccgatatgaacgtgccgttcaaagacggcaaaatcagcgacgacacccgtatccgcgcctcgattgcgtccgttaaatactgcgtggacaacggcgcgtccgtcattgtgatgacccacttgggccgcccgaccgaaggcgaattccatcccgaagacgacgttgcgcccgttgccgcacacttgggcagcctgttgggcaaagacgtgaaagtattgaacgactggcgcgaaaacaaaccggctttgaacgcgggcgatgtcgtgatgctgcaaaacgtgcgtatcaacaaaggcgagaagaaaaacgatttggaactgggcaaagcctacgcttctttgtgcgacgtgttcgtcaatgacgcgttcggcaccgcgcaccgcgcccaagcctcgaccgaagccgtcgctcaagccgcgcccgttgcctgcgccggcgtattgatggcgggcgaactcgacgctttgggcaaagccctgaaacagcctgcacgcccgatggttgccatcgttgccggcagcaaagtgtccaccaagttgaccattctcgaatcgctggcggacaaagtcgaccaactcatcgtcggcggcggcatcgccaacaccttcctgttggcagaaggcaaagccatcggcaaatctttggcggaacacgatttggtggaagaatccaaaaaaattatggcgaaaatggcggctaaaggcggctccgtaccgctgccgaccgatgtcgtcgttgccaaagcctttgccgccgatgccgaagcggtcgtgaaagacattgccgacgttgccgaagacgatatgattttggacatcggcccgaaatccgccgccgcgcttgccgatttgcttaaagccgccgacacggtcgtttggaacgggccggtcggcgtgttcgagtttgaccaattcgcaggcggtacgaaagcccttgccgaagccattgcccaaagcaaagcgttctcgattgcgggcggcggcgacacgctggcagcgattgccaaattcggcgttaccgaacaaatcggctacatctccaccggaggcggcgcgttccttgagttcttggaaggcaaagagctgcctgccgtagctgctttggaaaaacgcggcgcgtaa

SEQ ID NO: 90734 - protein, 392 aa, Neisseria meningitidis
MAFLKLTEQNVQGKTVLIRADMNVPFKDGKISDDTRIRASIASVKYCVDNGASVIVMTHLGRPTEGEFHPEDDVAPVAAHLGSLLGKDVKVLNDWRENKPALNAGDVVMLQNVRINKGEKKNDLELGKAYASLCDVFVNDAFGTAHRAQASTEAVAQAAPVACAGVLMAGELDALGKALKQPARPMVAIVAGSKVSTKLTILESLADKVDQLIVGGGIANTFLLAEGKAIGKSLAEHDLVEESKKIMAKMAAKGGSVPLPTDVVVAKAFAADAEAVVKDIADVAEDDMILDIGPKSAAALADLLKAADTVVWNGPVGVFEFDQFAGGTKALAEAIAQSKAFSIAGGGDTLAAIAKFGVTEQIGYISTGGGAFLEFLEGKELPAVAALEKRGA

SEQ ID NO: 90735 - DNA, 1257 bp, Neurospora crassa
  CDS (1)..(1257)
atgtctctctccaacaagctctccatcgaggacgtcgacctcaagggcaagcgcgtcctcatccgtgtcgacttcaacgtcccccttgacgccgagaagaaggtcaccaacccccagcgcatcgccggtgccattcccaccatcaagtatgcgctcgaccatggcgccaaggccgttgtcctcatgtctcaccttggccgtcccgacggcaagcccaaccccaagtactccctgaagcccgttgttcctgagctcgagaagctcctcggcaagaaggtcaccttcgcccccgactgcgttggtcccgaggttgaggagatcgtcaacaaggccgacaacggtgaagttattctccttgagaacctccgcttccacattgaggaggagggcaagggcaccgatgccgagggcaacaaggtcaaggccgacaaggccaaggttgaggagttccgcaagaacctcaccaagctcggtgatgtgtacatcaacgatgctttcggcactgcccaccgcgcccactcctccatggtcggcattgacctccccgtcaaggccgccggtttcctcatgaagaaggagctccagtactttgccaaggttctcgagtcgccccagcgccccttcctctccatcctcggcggtgccaaggtttccgacaagatccagctgatcgacaacctgctcgacaaggtcaacaccctcatcgtctgcggtggtatggccttcaccttcaagaagaccctccagaacatgcccatcggcaactcgctcttcgatgaggccggcgccaagattgtccctgaccttgtcaagaaggccgagaagaacaacgtcaagctcgtgctccccgtcgacttcaccattgccgacaagttcgacaaggacgccaacactggctacgccacagacaaggacggcattcccgacggctggatgggtctcgactgcggcgaggagtcggtcaagctcttcacccaggccatcaacgagtcccagaccatcctctggaacggccccgccggtgtcttcgagttcgacaagttcgccaagggcaccaaggccaccctcgacgcttgcgtcaaggctgccgaggaaggccgcaccgtcatcattggcggtggtgacaccgctaccgtcgctgccaagtacggcgttgaggacaagctcagccacgtctccactggcggtggtgcttctcttgagctccttgagggcaaggctctccctggtgttgttgctcttagcgagcgtcagtaa

SEQ ID NO: 90736 - protein, 418 aa, Neurospora crassa
MSLSNKLSIEDVDLKGKRVLIRVDFNVPLDAEKKVTNPQRIAGAIPTIKYALDHGAKAVVLMSHLGRPDGKPNPKYSLKPVVPELEKLLGKKVTFAPDCVGPEVEEIVNKADNGEVILLENLRFHIEEEGKGTDAEGNKVKADKAKVEEFRKNLTKLGDVYINDAFGTAHRAHSSMVGIDLPVKAAGFLMKKELQYFAKVLESPQRPFLSILGGAKVSDKIQLIDNLLDKVNTLIVCGGMAFTFKKTLQNMPIGNSLFDEAGAKIVPDLVKKAEKNNVKLVLPVDFTIADKFDKDANTGYATDKDGIPDGWMGLDCGEESVKLFTQAINESQTILWNGPAGVFEFDKFAKGTKATLDACVKAAEEGRTVIIGGGDTATVAAKYGVEDKLSHVSTGGGASLELLEGKALPGVVALSERQ

SEQ ID NO: 90737 - DNA, 1179 bp, Nitrosomonas europaea
  CDS (1)..(1179): transl_table=11
gtgtccgttattaaacttgtcgatcttgatctgaagaacaaacgcgtctttatccgcgctgatttgaatgttcctgtaaaagacgggaaagtgacatcagatgcgcgcattactgcctcgatggcaacgatcaaccactgcctgaaacaaggcgcaaaagtcatggtgacctctcatcttggacggccggaagaaggggtatggacagaagaaaattctctccagccggttgccgatgatattgcccggagactgggaaagcctgtccggttgatcaaagactgggtagagggtggatttgaagttgcatctggagagttggtagtcctggaaaattgtcggatcaataaaggtgaaaaaaagaacctcgaagaaaccgccaagaaatatgccagtttgtgtgatgtattcgtcatggatgcttttggtacagcacaccgtgcagaagcttcgacacatggtatcgccaaatatgcaccgattgcctgtgcaggtattttgcttaccgaagaactcgatgcgctgacaaaagccctgcatcagccagcacatccgctggtggcaatcgtaggcggatcaaaagtttccaccaaactgaccgtgctggaatcgcttgctgaaaaagttgatcagctcgtagtcggcgggggaattgccaacacttttctcaaggccgcagggaacaacattggaaaatccctgtgcgaggatgaactggtacccgttgcaaaatccctgatggataaaatgaacaagcgtaatgcaacgattcccatcgcagtagatgtcgtcgtcggaaagaaattcgctgaagatgaagctgctgttctaaaagcagccaacgctgtttctgatgacgacatgatctttgatatcgggcctgagagtgctcaagaattggtcgacatcatcatgaaagccggtacggtagtctggaatggcccggtcggtgtattcgaattcgatcaatttggagaaggaacacgcgccatagccaaggcaattgctgaaacggatgccttcaccctggcggggggcggtgacacaatcgctgccatccaaaagtacgacatctacgataaagtttcctatatatccactgccggaggagcattcctggagtttctggaagggaagaaattacctgctgtcgagattctggaattacgtgcgaagtga

SEQ ID NO: 90738 - protein, 392 aa, Nitrosomonas europaea
MSVIKLVDLDLKNKRVFIRADLNVPVKDGKVTSDARITASMATINHCLKQGAKVMVTSHLGRPEEGVWTEENSLQPVADDIARRLGKPVRLIKDWVEGGFEVASGELVVLENCRINKGEKKNLEETAKKYASLCDVFVMDAFGTAHRAEASTHGIAKYAPIACAGILLTEELDALTKALHQPAHPLVAIVGGSKVSTKLTVLESLAEKVDQLVVGGGIANTFLKAAGNNIGKSLCEDELVPVAKSLMDKMNKRNATIPIAVDVVVGKKFAEDEAAVLKAANAVSDDDMIFDIGPESAQELVDIIMKAGTVVWNGPVGVFEFDQFGEGTRAIAKAIAETDAFTLAGGGDTIAAIQKYDIYDKVSYISTAGGAFLEFLEGKKLPAVEILELRAK

SEQ ID NO: 90739 - DNA, 1182 bp, Oceanobacillus iheyensis
  CDS (1)..(1182)
atgaacaaaaaaacaattaacgatctacaagttgaaggaaagcgagtatttacacgcgtagactttaatgttcctttaaaagatggtgagattacagatgatacacgtattcgcgccgcactaccgacaattgaacaattaacagcacaaggtgcaaaagtgattttagctagtcatctaggacgacctaaaggaacagttgtagaagaactacgtttagaccctgttgctgatagacttagtgatctattaggtaaagaagtattgaaaacagatcaagtttatggtgaagaagttgatcaggctatcagtgagctagaaaacggtggagttcttttaatagagaacgttcgctttgaagctggagaagaaaaaaatgatcctgaattagtggaagcattcgctaacatggctgacctttatgtcaatgatgcttttggtgctgctcatcgtgcacatgcatctacaactggcgtagcagagaaattaccagcagctgcaggtaaattaatggagaaagaaattgaagcactaggcaacgctctagaaaatccggaacgaccgtttacagcaattgttggtggagcgaaagtaaaagataaaattagtgtgatcgataatctgttagataaagtagataatttgattattggtggcggtctagcttacacgttcatcaaagcacaaggtcatgagattggaaaatcacttctagaagaagataaaattgatttggctaaagaatttatgaacaaagcgaaagaaaaaggtgttaactttgtattgccagtcgacgctattgtggccgatgatttctcagaagaggctaataccaaaattgtagatatagataaaattccttctgactgggaagcgttagatataggcacgaagacaagagaaaaatatagtagtatcgtgaaagattcaaaacttgttatatggaatggaccaatgggagtatttgaattaaatgcattcgcaggtggtacaaaagctgtagcagaagcattagcatctacagaaggctactctataataggtggtggcgattctgcggcagctgttgaaaagttcggccttgcagaagaaatggatcatgtatctacaggtggaggagcatcattagaattcatggaaggaaaagttcttcctggactagctgctctaaatgataaataa

SEQ ID NO: 90740 - protein, 393 aa, Oceanobacillus iheyensis
MNKKTINDLQVEGKRVFTRVDFNVPLKDGEITDDTRIRAALPTIEQLTAQGAKVILASHLGRPKGTVVEELRLDPVADRLSDLLGKEVLKTDQVYGEEVDQAISELENGGVLLIENVRFEAGEEKNDPELVEAFANMADLYVNDAFGAAHRAHASTTGVAEKLPAAAGKLMEKEIEALGNALENPERPFTAIVGGAKVKDKISVIDNLLDKVDNLIIGGGLAYTFIKAQGHEIGKSLLEEDKIDLAKEFMNKAKEKGVNFVLPVDAIVADDFSEEANTKIVDIDKIPSDWEALDIGTKTREKYSSIVKDSKLVIWNGPMGVFELNAFAGGTKAVAEALASTEGYSIIGGGDSAAAVEKFGLAEEMDHVSTGGGASLEFMEGKVLPGLAALNDK

SEQ ID NO: 90741 - DNA, 1197 bp, Onion yellows phytoplasma
  CDS (1)..(1197): transl_table=11
atgacaaaatccttaactaatatgaatattacaaataaaaaagttttattgcgagcagacctaaatgttcctttagaaaacagcgttatcacagatgacaacagaattaaggctattttacctactttaaaatatttagttcagcaaaaagctaaagttattattttttctcatttgggacgcgttaaaactgaagctgataaagcccattttagcttgcaagtggtagctgaaaaaattgctttttatttgcaacaaaaattaaagtttgttccagaaacccaaggcaacaccttaaatcaagctgttggccagatgcttccaggggatgttttagtagtccaaaatactcgttttgaagatgttcctttcaaaaaagaaagtaaaaacgaccccgaattaggcaaatattgggcatctttaggtgatgtttttgtcaatgatgcttttggtacatgccatcgcacccacgcttctaatgtaggcattgcaacatatatcaaagaaaaatgctttggttttttggtcgaaaaagaaatatcttttctcaaaaaaattgtccaaactcctcaaagacctttggttgctgttttgggtggctccaaagtatctgacaaaattggagttattcgtagtcttttgcaaaaagttgatgttcttttgataggtggaggaatgagctatacttgtcttaaagccaaatgttttaacataggaactagcttgttagaagcagacaaaatccctttagtaaaagaattattagcttctccagaaggcaaaaaaatcgttttacctaaagattttgtttgtggcaaagaattttcgccaacaacacaagcagctgtttatagttatgataatatttctgatgatgtaatgggacttgatatcggacctcaaacaattgaacttttcaaaacgtatttacaaacggctcaaacagttgtttggaatggtcctgtaggagtgtttgaatttgaacaattttctaaaggaaccaaagctttagccgaaacaataagcaatctttcgcccaatacaactaccattattggtggtggcgatagcgctgctgcagtctttaaattcggtctagatcaaaatttcagccatatttctacgggtggaggcgcttttttagaatttttagaaggaaaaccaatgccagggcttgcatgtatggagaaactgtaa

SEQ ID NO: 90742 - protein, 398 aa, Onion yellows phytoplasma
MTKSLTNMNITNKKVLLRADLNVPLENSVITDDNRIKAILPTLKYLVQQKAKVIIFSHLGRVKTEADKAHFSLQVVAEKIAFYLQQKLKFVPETQGNTLNQAVGQMLPGDVLVVQNTRFEDVPFKKESKNDPELGKYWASLGDVFVNDAFGTCHRTHASNVGIATYIKEKCFGFLVEKEISFLKKIVQTPQRPLVAVLGGSKVSDKIGVIRSLLQKVDVLLIGGGMSYTCLKAKCFNIGTSLLEADKIPLVKELLASPEGKKIVLPKDFVCGKEFSPTTQAAVYSYDNISDDVMGLDIGPQTIELFKTYLQTAQTVVWNGPVGVFEFEQFSKGTKALAETISNLSPNTTTIIGGGDSAAAVFKFGLDQNFSHISTGGGAFLEFLEGKPMPGLACMEKL

SEQ ID NO: 90743 - DNA, 1248 bp, Opisthorchis sinensis
  CDS (1)..(1248)
atggggcttcgcaaattgagcatagccaatgttgacctcaaagataagcgggtgcttatgcgagttgattttaatgttccaatgaaagatggcaaggtgacaaacacccaaagaattgttggggcatcaccaaccatcaagtatgcacttgataagggggccaaaagtatcgtcctaatgtcccatcttggaggtcgggtcggtaacaaagtcgccagatattccctcaacccggtgggagaagaagtgtccaaactccttgggaaaccagtgaaattcttacctgattgtgtcggcccagaaacaacagaaggcatgtgccaatcctctgcaggatccgtgttcctgttagaaaatctacgtttccatgttgaggaggaagggaaaggcgtttcccccactggagaaaagatcaaagccactccagagcaagtcaaggccttcagtgaaaacttgaccaagttgggtgacgtttacctaaacgacgcatttggtacagctcacagagctcacgcttccatggttggctgcagacttacgcaaagggcatgtgggtttctcatggacaaggaattgacctacttctccaagctgttggatcagcctcagcatcctttcttggcgatcattggtggagctaaagtcagtgacaaaattcaactgatcaagaacatgttggacaaagtggacgaactgattataacaggaggcatggctttcactttcctcaagaaactccacaatatgaagattggaaagagtctttacgatgaacccggggctgcaattgtcgacgaatggatgcagttggccaaatccaagaacgttaagattcatctacctgttgatttcataaccggggacaagtttgcggaggatgccaatactggcactgccacagtcgagcctggcatccgggacacgcatatgggcttggatggtggtccgaaaaccatggaagagttctgcaaggtaattagtcgagcaaaaaccattgtttggaacggtccaatgggtgtgttcgaaatggagaagtttgctggcggtacgaaggcagcaatggatgcagtggtggctgctacaaccaagggagttacgaacaataatggtggtggtgacacagctacctgctgtccaaaatggaaaacagaggcacaggtcagtcacgtgagtactggagtaggggctagcttggagctgcttgaaggcaagcaactaccaggtattctcgccctgagtgacgcataa

SEQ ID NO: 90744 - protein, 415 aa, Opisthorchis sinensis
MGLRKLSIANVDLKDKRVLMRVDFNVPMKDGKVTNTQRIVGASPTIKYALDKGAKSIVLMSHLGGRVGNKVARYSLNPVGEEVSKLLGKPVKFLPDCVGPETTEGMCQSSAGSVFLLENLRFHVEEEGKGVSPTGEKIKATPEQVKAFSENLTKLGDVYLNDAFGTAHRAHASMVGCRLTQRACGFLMDKELTYFSKLLDQPQHPFLAIIGGAKVSDKIQLIKNMLDKVDELIITGGMAFTFLKKLHNMKIGKSLYDEPGAAIVDEWMQLAKSKNVKIHLPVDFITGDKFAEDANTGTATVEPGIRDTHMGLDGGPKTMEEFCKVISRAKTIVWNGPMGVFEMEKFAGGTKAAMDAVVAATTKGVTNNNGGGDTATCCPKWKTEAQVSHVSTGVGASLELLEGKQLPGILALSDA

SEQ ID NO: 90745 - DNA, 1260 bp, Oxytricha nova
  CDS (1)..(1260): transl_table=6
atgctttccaaaaagctagccatcgatcacatcccccacctcatcaaaggaaagagagtcctcatgagagttgatttcaatgttcccatcaaggagggcaagatcaaggatcttaccagaattcaaggagcactcccttcaatcaactactgcctagagaatggagctgagtctgttgttctcatgagtcacttaggcagacctgatggccagagagtagagaagcactccctcaagcctgtgctcccagccatcgaagacctactcaagaaaaaggtacagttcctcgatgattgcgttggctccgaggtggagagagagtgcaagtcagcttccaagggaaaggtcattcttcttgaaaacctgagattccatcttgcagaggagggcaaaggagtaatcaatggagagaaggttaaggcaaccaaagaagacattgctgctttcagaaagtcacttaccagccttggagagctctatgttaacgatggcttcggtactgctcacagagctcactcttcaatggtaggagttaacgttgataccagagctgctggcttcttgctcaagaaggaacttcagtatttctccaagattcttgagactcctgagagacccctcactgttgtgatgggaggagccaaggtcgctgataagatccaactcatcatgaagcttctcgagttagctgacgagttgatcattggtggaggtatggccttcactttcaacaaggtgctagacggctcaaacatcggtaaatctcttttcgattaggaaggtgccaagattgttccagacatcattaaaaaggctaaggagagaggagtaaagatccacttgccagttgatgcagttgctgctgataagtttgaagagtctgctgctacttagcttgttgacctcaagactggagctattcctgacggatggatgggacttgatatcggccccaagaccattgagcaaaacagcagagttatcttaagagctaagactgtgttctggaacggaccccaaggagtttttgaaatggctcctttctcaaagggatctctatcaatgctagacgacatcattaaggctacctagaccggagctacctcagttgctggtggcggtgatactgtctctctccttggaaaggttaagggcaccactgacaagttctctcacgtcagcactggaggtggtgcatctcttgagcttctttaaggcaaacaacttccaggtgttgttgctctttcagacagacaatga

SEQ ID NO: 90746 - protein, 419 aa, Oxytricha nova
MLSKKLAIDHIPHLIKGKRVLMRVDFNVPIKEGKIKDLTRIQGALPSINYCLENGAESVVLMSHLGRPDGQRVEKHSLKPVLPAIEDLLKKKVQFLDDCVGSEVERECKSASKGKVILLENLRFHLAEEGKGVINGEKVKATKEDIAAFRKSLTSLGELYVNDGFGTAHRAHSSMVGVNVDTRAAGFLLKKELQYFSKILETPERPLTVVMGGAKVADKIQLIMKLLELADELIIGGGMAFTFNKVLDGSNIGKSLFDQEGAKIVPDIIKKAKERGVKIHLPVDAVAADKFEESAATQLVDLKTGAIPDGWMGLDIGPKTIEQNSRVILRAKTVFWNGPQGVFEMAPFSKGSLSMLDDIIKATQTGATSVAGGGDTVSLLGKVKGTTDKFSHVSTGGGASLELLQGKQLPGVVALSDRQ

SEQ ID NO: 90747 - DNA, 1164 bp, Pasteurella multocida
  CDS (1)..(1164): transl_table=11
atgtcagtaatcaaaatgacagacttggatttgagcggcaaacgtgtgtttattcgtgctgatttaaatgtgccagtcaaagatggcaaagtgacttctgatgcacgtatccgtgcgaccatccctaccttgaaacttgcgcttgaaaaaggcgcaaaagtgatggtgacttcacacttaggtcgcccaacagaaggcgaatttgatgaagcaaactcactgaaacctgtagttgattacttaaatgcaaatttagatgtgcctgttcgtttagtacgcgattatttagacggtgtggacgttaaccaaggcgaaatcgtggtattagaaaacgtgcgcattaacaaaggtgagaagaaaaacgatcctgaattaggcaaaaaatatgccgcactttgcgatgtctttgtgatggatgcctttggtactgcacaccgtgcgcaagcctcgacttacggtgtggctgaatatgcgccagtggcttgtgcaggtccattattagcggctgaattagatgctttaggcaaagccttaaaagaacctgcgcgtccaatggtggcgattgtaggggggtcgaaagtctcaaccaaattagaagtgttaaattccttatctaaaattgcggaccaaattattgtgggcgggggtatcgccaataccttcattgctgcagcaggtcataacgtcggtaaatccttatatgaagaagatttaattcctgtggcgaaaaacttagcagcaagcacagatattcctgtacccgttgatgttcgcgttgggttagaattctctgaaactgcagcagcaacagaaaaagccgtcaatgaagtgaaagatgatgaatccatttttgatattggtgataaatcagcagaacaactcgcggaaatcatcaaaaatgcgaaaacgattctttggaatggtccagtgggcgtgtttgagttcccgaatttccgtaaagggactgaaatcatttctcacgcaatcgctaatagcgaaggtttctcaattgcaggtggtggtgacacattagcggcgattgacctattcggtatcaaagataaaatttcttatatttcaacaggtggtggtgcattcttagaattcgttgaaggtaaagtattaccagcagtagaaatcttagaaaaacgtgcaaatggttaa

SEQ ID NO: 90748 - protein, 387 aa, Pasteurella multocida
MSVIKMTDLDLSGKRVFIRADLNVPVKDGKVTSDARIRATIPTLKLALEKGAKVMVTSHLGRPTEGEFDEANSLKPVVDYLNANLDVPVRLVRDYLDGVDVNQGEIVVLENVRINKGEKKNDPELGKKYAALCDVFVMDAFGTAHRAQASTYGVAEYAPVACAGPLLAAELDALGKALKEPARPMVAIVGGSKVSTKLEVLNSLSKIADQIIVGGGIANTFIAAAGHNVGKSLYEEDLIPVAKNLAASTDIPVPVDVRVGLEFSETAAATEKAVNEVKDDESIFDIGDKSAEQLAEIIKNAKTILWNGPVGVFEFPNFRKGTEIISHAIANSEGFSIAGGGDTLAAIDLFGIKDKISYISTGGGAFLEFVEGKVLPAVEILEKRANG

SEQ ID NO: 90749 - DNA, 1248 bp, Penicillium chrysogenum
  CDS (1)..(1248)
atgtctctctccaacaagctccccgttactgatgtcgacctcaagggcaagcgtgtcttgatccgggttgacttcaatgtccccctcgatgagaacgagaacgttaccaacccccagcgtatcgtcggtgccctgcccaccatcaagtatgccatcgacaacggtcgcaaggccgttgtgctcatgtcccacctgggtcgccccgatggcaaggtcaaccccaagtacagcttgaagcccgttgttcccgtgcttgaggagctcctcggcaagagcgtcactttcaccgaggactgcattggcccccagaccgaggagaccgtgaacaaggcttccgatggccaggtcattctgctcgagaacctgcgtttccacgccgaggaggagggcagctccaaggatgccgagggcaagaaggtcaaggccgacaaggccgatgttgatcgttccgcaagcctcactgccctcggtgacgtttacgtcaacgatgctttcggtaccgcacagcgcgctcacagctccatggtcggcgtggacctcccccagaaggctgccggtttcctcgtgaagaaggagctggagtacttcgccaaggctcttgagagccctgcccgccccttcctcgccatcctcggcggtgctaaggtgtctgacaagattccagtgattgacaacctcctgcccaaggtcaacagcctcatcatcatcggcggcatggctttgaccttcaagaagactcttgagaacgtcaagatcggcaacagtctcttcgacgaggccggcagcaagatcctcggcgagatcgtcgagaaggccaagaagcacaacgtcgagatcgttctccccgttgactacgtcaccgccgacaagttctccgccgatgccaccgttgggtccgccacgacgcagcgtatccctgacggctacatgggttcggatgtcggccccgagagtgtcaagctctaccagaagaccatcgccgaggccaagaccatcctctggaacggtccccctggtgtcttcgaactcaagccttcgccaaggcccaccgaggctaccctcgatgccgctgtcaaggctgctgaatccggttccattgtcatcattggtggtggtgataccgctaccgtggccgccaagtacaaggccgaggacaagatctcccacgtctcgaccggtggcggtgcctcgctcgagcttctcgagggcaaggagctgcccggtgttgctgctctgtccagtaagtaa

SEQ ID NO: 90750 - protein, 415 aa, Penicillium chrysogenum
MSLSNKLPVTDVDLKGKRVLIRVDFNVPLDENENVTNPQRIVGALPTIKYAIDNGRKAVVLMSHLGRPDGKVNPKYSLKPVVPVLEELLGKSVTFTEDCIGPQTEETVNKASDGQVILLENLRFHAEEEGSSKDAEGKKVKADKADVDRSASLTALGDVYVNDAFGTAQRAHSSMVGVDLPQKAAGFLVKKELEYFAKALESPARPFLAILGGAKVSDKIPVIDNLLPKVNSLIIIGGMALTFKKTLENVKIGNSLFDEAGSKILGEIVEKAKKHNVEIVLPVDYVTADKFSADATVGSATTQRIPDGYMGSDVGPESVKLYQKTIAEAKTILWNGPPGVFELKPSPRPTEATLDAAVKAAESGSIVIIGGGDTATVAAKYKAEDKISHVSTGGGASLELLEGKELPGVAALSSK

SEQ ID NO: 90751 - DNA, 1254 bp, Penicillium citrinum
  CDS (1)..(1254)
atgtctctctccaacaagctccccgttactgatgtcgacctcaagggcaagcgtgtcttgatccgggttgacttcaatgtccccctcgatgagaacaagaacgttaccaacccccagcgtatcgttggtgctctgcccaccatcaagtatgctatcgacaacggtgccaaggctgttgtgctcatgtcccacctcggccgccccgatggcaaggtcaaccccaagtacagcctgaagcccgttgttcccgtgcttgagaagcttctcggcaagagcgtcaccttcgctgaggactgcgttggtccccagaccgaggagaccgtgaacaaggcttccgatggccaggtcattctgcttgagaacctgcgtttccacgctgaggaggagggcagctccaaggatgctgagggcaagaaggtcaaggccgacaaggccgatgttgatgcgttccgcaagggcctcactgccctcggtgacgtttacgttaacgatgctttcggtaccgcacaccgcgctcacagctccatggtcggcgtggacctcccccagaaggccgccggtttcctcgtgaagaaggagctggagtacttcgccaaggctcttgagagccctgcccgtcccttcctcgccatcctcggtggtgccaaggtgtccgacaagatccagctgatcgataacctcctgcccaaggttaacagcctcatcatcaccggtggaatggctttcaccttcaagaagactcttgagaacgtcaagatcggtaacagtctcttcgacgaggccggcagcaagatcgtcggcgagatcgtcgagaaggccaagaagtacaacgtcgagatcgtcctccccgttgactacgtcaccgccgataagttctccgccgatgctaccgttggtgccgctaccgacgccaccggtatccccgacggctacatgggtctggatgttggccccgagagtgtcaagctctaccagaagaccatcgccgaggccaagaccatcctctggaacggtccccccggtgtcttcgagcttaagcccttcgccagcgccaccgaggctaccctcgatgccgctgtcaaggctgccgagtccggctccatcgtcatcatcggtggtggtgataccgctaccgtggccgctaagtacaaggtcgaggacaagatctcccacgtctcaactggtggcggtgcttcgctcgagcttctcgagggcaaggagcttcccggtgttgctgctctgtccagtaagtaa

SEQ ID NO: 90752 - protein, 417 aa, Penicillium citrinum
MSLSNKLPVTDVDLKGKRVLIRVDFNVPLDENKNVTNPQRIVGALPTIKYAIDNGAKAVVLMSHLGRPDGKVNPKYSLKPVVPVLEKLLGKSVTFAEDCVGPQTEETVNKASDGQVILLENLRFHAEEEGSSKDAEGKKVKADKADVDAFRKGLTALGDVYVNDAFGTAHRAHSSMVGVDLPQKAAGFLVKKELEYFAKALESPARPFLAILGGAKVSDKIQLIDNLLPKVNSLIITGGMAFTFKKTLENVKIGNSLFDEAGSKIVGEIVEKAKKYNVEIVLPVDYVTADKFSADATVGAATDATGIPDGYMGLDVGPESVKLYQKTIAEAKTILWNGPPGVFELKPFASATEATLDAAVKAAESGSIVIIGGGDTATVAAKYKVEDKISHVSTGGGASLELLEGKELPGVAALSSK

SEQ ID NO: 90753 - DNA, 1164 bp, Photorhabdus luminescens
  CDS (1)..(1164): transl_table=11
atgtctgtaattaagatgaccgatttagatctggcgggtaagcgtattttgatccgcgctgacctgaacgttccggtaaaagatggcaaagtcacctctgatgcgcgtatccgtgcttccttaccgaccattgaggcagcattaaaacagggcgctaaagtgatgatcacttctcaccttggccgccctactgaaggcgaatacagtgaagaattctcgctgaaaccagtagtagactatctagaagagaaattatcttcccccgttcgactggaaaaagagtatctggaaggcgtggatgtcgcggaaggtgaactggttgtgctggagaatgttcgctttaataaaggtgagaagaaagacgacgaaaccttagccaaaaaatatgcttccctgtgtgatatttatgtcatggatgcattcggtactgctcatcgtgcacaagcttctactcacggtgtggctaagtttgctccagtggcctgtgccggtcctttgttgtccgcagagttagaggcattgggtaaagcgttagataatccagcccgtccaatggtggctatcgttgggggctctaaagtttcaaccaagctgaccgttctggatacgctgtctaaaattgctgaccaattgattgtcggtggtggtatcgcgaatacctttgttgctgcggaaggccataatgtcggtcgttctctctatgaagacgacttgctcccggaagcgaagaaattgctgataagctgtgatattccggtgccaaccgatgttcgtgtggcaacagaattctctgaaacagccgaagcaatcttgaaatctacccacgatattaaagatgatgagcagatcctcgatctgggggatgaatctgctcaacggctggcggatattctgaaaaacgccaaaacgattctatggaatggcccggttggtgtatttgaattccctaatttccgtcaaggaactgaaattgtcgcgcgcgccattgctgatagtgatgccttctctatcgccggtggcggcgatacgctggcagcgatcgacttgttcggtattgctgacaaaatttcttatatctctacgggtggtggtgctttccttgagttcgtggaagggaaaaaactgcctgcggttgtgatgttggaagaacgtgcaaaacagtaa

SEQ ID NO: 90754 - protein, 387 aa, Photorhabdus luminescens
MSVIKMTDLDLAGKRILIRADLNVPVKDGKVTSDARIRASLPTIEAALKQGAKVMITSHLGRPTEGEYSEEFSLKPVVDYLEEKLSSPVRLEKEYLEGVDVAEGELVVLENVRFNKGEKKDDETLAKKYASLCDIYVMDAFGTAHRAQASTHGVAKFAPVACAGPLLSAELEALGKALDNPARPMVAIVGGSKVSTKLTVLDTLSKIADQLIVGGGIANTFVAAEGHNVGRSLYEDDLLPEAKKLLISCDIPVPTDVRVATEFSETAEAILKSTHDIKDDEQILDLGDESAQRLADILKNAKTILWNGPVGVFEFPNFRQGTEIVARAIADSDAFSIAGGGDTLAAIDLFGIADKISYISTGGGAFLEFVEGKKLPAVVMLEERAKQ

SEQ ID NO: 90755 - DNA, 1179 bp, Photobacterium profundum
  CDS (1)..(1179): transl_table=11
ttgagaggacgaacaatgtctgtaatcaagatgactgatctggaacttgctggtaagcgcgtatttattcgtgcagatctaaacgtaccagttaaagacggtaaagtaacttctgatgcacgtatccttgcatctctaccaactattaagcgttgcttagaagctggcgctaaagtaatggttacttctcaccttggtcgtccaacggaaggcgagtacaacgaagagttctctctggctccagtagttaactacttaaatgacgcactagattgtgacgttaaactagcgaaagattacctagatggaattgaattaaacgctggtgagctagttgttcttgaaaacgttcgctttaacaaaggcgaaaagaagaacgatgaagcactttctaagaagtatgcagcattatgtgacatcttcgtgatggacgcatttggtacggctcaccgtgcacaagcatcgactcacggtgttggcatgaacgcagctatcgcgtgtgctggtcctctactcgctaacgagcttgaagcacttggtaaagcaatggacaaccctgctcgtccacttgttgcaatcgttggtggttctaaagtatcaactaagctgactgttcttgagtcgctatctaaaattgctgaccaactagttgttggtggtggtatcgcgaacacattcatcgcagctgaaggccacaatgttggtaaatcactgtacgaagcagatttagttgaaacagctaagaaactaatgaaagactgtgcgattcctgttgcaactgacgttgcatgtgcaaaagcattcgatgagaacgcagaagcggtaatcaagcacgtgtctgaagttcaagacgacgacatgatcttcgacctaggtccagattcaactgccgttcttgctgaaatcattagcaatgcaaagacgattctttggaatggccctgttggcgtatttgaattcaaaaactttgaagcgggtactgctggtattgctaaagcaattgcagattctgaaggtttctctgttgcaggcggcggtgacacattagcagctatcgataaattcggtatcaaggctgacgtttcttacatttctactggcggcggcgcgttccttgagttcgttgaaggtaaagtattacctgcagttgctatgctagaagagcgtgcaaaagcataa

SEQ ID NO: 90756 - protein, 392 aa, Photobacterium profundum
MRGRTMSVIKMTDLELAGKRVFIRADLNVPVKDGKVTSDARILASLPTIKRCLEAGAKVMVTSHLGRPTEGEYNEEFSLAPVVNYLNDALDCDVKLAKDYLDGIELNAGELVVLENVRFNKGEKKNDEALSKKYAALCDIFVMDAFGTAHRAQASTHGVGMNAAIACAGPLLANELEALGKAMDNPARPLVAIVGGSKVSTKLTVLESLSKIADQLVVGGGIANTFIAAEGHNVGKSLYEADLVETAKKLMKDCAIPVATDVACAKAFDENAEAVIKHVSEVQDDDMIFDLGPDSTAVLAEIISNAKTILWNGPVGVFEFKNFEAGTAGIAKAIADSEGFSVAGGGDTLAAIDKFGIKADVSYISTGGGAFLEFVEGKVLPAVAMLEERAKA

SEQ ID NO: 90757 - DNA, 1251 bp, Pichia pastoris
  CDS (1)..(1251)
atgtctctttcaaataaactttcagtcaaagatctcgatgttgccggaaagcgtgtcttcatccgtgtcgacttcaacgttcctctggatggtgacaagatcaccaacaaccagcgtatcgttgctgctttgccaactatccaatatgttttggatcacaagccaaaggtcgtcgttctggcttctcatttaggccgtccaaacggagaggtcaacccaaaattctctttaaaaccagttgctgctgaattgtcctccctactaggtaagaaggtgactttcttgaacgatagtgttggaccagaggttgagaaggctgtcaactctgcctccaatggagaggttattcttttggagaacttgcgtttccacattgaagaagaaggatctcaaaagaaagatggtcaaaagatcaaggccgacaaggaggctgttgccaggttcagaaagcaattgaccgcattggccgatgtctacgttaacgacgccttcggtaccgctcacagagcccactcttccatggttggatttgaattggagcaaagagctgctggtttcttgatggctaaggagttgacatacttcgctaaggccctggaaaaccctgtcagaccattcttggccatccttggtggtgctaaggtttctgacaagattcaattgattgacaatttgctggacaaggtcgattccatcatcattggtggaggaatggctttcacttttatcaaggttttggataacgttgccattggtaactctttgttcgacgaggctggtgccaagttagttcccggcttagttgagaaagccaagaagaacaatgtcaaactggttcttccagtcgacttcgtcactgccgacgccttctccaaggatgcaaaggtcggtgaagccacggttgagtctggtattccagacggattgcaaggattggacgctggtccaaaatccagagaattgttcgcagctaccatcgctgaggctaagacaatcgtctggaacggtcctccaggtgttttcgagtttgacaagtttgctgaaggtaccaagtctatgttggcagctgccatcaagaacgctcagaacggtggaactgtcatcgttggtggtggtgacacggctaccgttgctaagaagttcggtggtgctgacaagctatcccacgtttccactggaggaggagcttctttggaattattggagggaaaggagcttccaggtgtagtttacttgtccaaaaaggcttaa

SEQ ID NO: 90758 - protein, 416 aa, Pichia pastoris
MSLSNKLSVKDLDVAGKRVFIRVDFNVPLDGDKITNNQRIVAALPTIQYVLDHKPKVVVLASHLGRPNGEVNPKFSLKPVAAELSSLLGKKVTFLNDSVGPEVEKAVNSASNGEVILLENLRFHIEEEGSQKKDGQKIKADKEAVARFRKQLTALADVYVNDAFGTAHRAHSSMVGFELEQRAAGFLMAKELTYFAKALENPVRPFLAILGGAKVSDKIQLIDNLLDKVDSIIIGGGMAFTFIKVLDNVAIGNSLFDEAGAKLVPGLVEKAKKNNVKLVLPVDFVTADAFSKDAKVGEATVESGIPDGLQGLDAGPKSRELFAATIAEAKTIVWNGPPGVFEFDKFAEGTKSMLAAAIKNAQNGGTVIVGGGDTATVAKKFGGADKLSHVSTGGGASLELLEGKELPGVVYLSKKA

SEQ ID NO: 90759 - DNA, 1251 bp, Plasmodium falciparum
  CDS (1)..(1251)
atgttaggcaacaaattaagcattagtgacctaaaggatattaagaacaagaaggttttagtaagagttgattttaatgtacctattgaaaatggaataattaaagatacgaacagaattactgctacattacccacaattaaccatttaaagaaagaaggagcttcaaaaattatattaatatcccattgtggtagaccagatggtttaagaaatgagaaatataccttaaagccagtagctgaaactttaaaaggattattaggagaagaagtattatttttaaatgattgtgtaggtaaagaagttgaagataaaataaatgctgctaaagaaaattcagtaattctcttagaaaatttaagatttcatattgaagaagaaggtaaaggtgttgatgctaatggaaacaaagtaaaagcaaataaagaagatgttgagaagttccaaaatgatttaacaaaattagctgatgtttttattaatgatgctttcggtactgctcatcgtgctcatagtagtatggtaggtgttaaattaaatgttaaagcttcaggattcttaatgaaaaaagaattagaatattttagtaaagccttagaaaacccacaaagaccactactagccattttaggtggtgctaaagtatcagataaaattcagttaatcaaaaatttattagataaagttgatcgtatgattattggaggtggtatggcttatacttttaaaaaagtcttaaacaatatgaaaattggtacctctctttttgatgaagcaggtagtaaaattgttggagaaattatggaaaaggcaaaagctaaaaatgttcaaatatttttacctgtagattttaaaattgcagataattttgataataatgctaataccaaattcgttactgatgaagaaggtatcccagataattggatgggtcttgatgctggtccaaaaagtattgaaaattataaagatgttattttaacatcaaaaactgttatttggaacggaccacaaggtgttttcgaaatgccaaactttgcaaaaggtagtatcgaatgtctcaatttagttgttgaagttaccaaaaaaggagctatcaccattgttggaggtggagatacagcttcattagttgaacaacaaaataagaaaaacgaaattagtcatgtatctacaggtggaggagcctcacttgaacttttagaaggaaaagaattaccaggtgtattagcactttcaaacaaataa

SEQ ID NO: 90760 - protein, 416 aa, Plasmodium falciparum
MLGNKLSISDLKDIKNKKVLVRVDFNVPIENGIIKDTNRITATLPTINHLKKEGASKIILISHCGRPDGLRNEKYTLKPVAETLKGLLGEEVLFLNDCVGKEVEDKINAAKENSVILLENLRFHIEEEGKGVDANGNKVKANKEDVEKFQNDLTKLADVFINDAFGTAHRAHSSMVGVKLNVKASGFLMKKELEYFSKALENPQRPLLAILGGAKVSDKIQLIKNLLDKVDRMIIGGGMAYTFKKVLNNMKIGTSLFDEAGSKIVGEIMEKAKAKNVQIFLPVDFKIADNFDNNANTKFVTDEEGIPDNWMGLDAGPKSIENYKDVILTSKTVIWNGPQGVFEMPNFAKGSIECLNLVVEVTKKGAITIVGGGDTASLVEQQNKKNEISHVSTGGGASLELLEGKELPGVLALSNK

SEQ ID NO: 90761 - DNA, 1257 bp, Porphyromonas gingivalis
  CDS (1)..(1257): transl_table=11
atgacgatagaacaattcaatttcgccggcaagaaagccttcgtgcgcgtcgatttcaacgttcccctcgatgacaactttaagatcaccgacgacacccgcatccgcgcagccctccccactctccgcaagatcatagccgacggcggtatgaccatcatcggctctcatctgggacgccccaaaggcgtagcaccggagttctccctccggcatatcctgccgcacgtatccgaactgctcggcgtggatgtcctctttgccgatgactgcatcggagccgatgccatggacaaagcggccaagctcaaagccggccaagtgctgctgctcgaaaatctccgcttctatgccgaggaggaaggtaagccgcgcggactctccgacgatgcttcggacgaagaaaaagccgcagcgaagaaagccgtcaaggctgctcagaaagagtttacgcaaaagctggcttccatggccgactgctacgtgaacgatgctttcggcacagcgcatcgggcacatgcttccacagcactgatcgctgactacttcgaccgagaccacaaaatgttcggctatctgatggagaaagaagtaaaagccgtagaaagagtgctgcacgacatcaagcggccgttcaccgccatcatgggaggctccaaggtatcgaccaagatagaaatcatcgagaacctactcaacaaagtggataacctgatcctgaccggcggaatgacctatactttcaccaaagcggcaggcggtcggataggcctctccatcgtggaagacgacaagctggatttggctcgcgacatcgtgaagaaagcagccgaaaagggcgtcaatctgatactctccgtggatacgaaagtagccgacaggttcgacaacgatgcagccacccaagtatgcagcaatatggagatacccgacgactggatgggtatggacataggcccccggtcgatcgagaaattccgcaaagtaatactcgaatccaaaacgatcctttggaacggtcccacgggagtattcgaatttgacaacttctccataggctcgaaagccgtcggcgaagccatcgtggaagctacggccaatggagccttctcgctggtcggaggaggagacagcgttgcctgcgtgaacaaattcggtcttgccgataaggtatcctacgtctccacgggtggcggagccttgctcgaagccatcgagggcaaaaccctccccggcattgcagccatccaaggataa

SEQ ID NO: 90762 - protein, 418 aa, Porphyromonas gingivalis
MTIEQFNFAGKKAFVRVDFNVPLDDNFKITDDTRIRAALPTLRKIIADGGMTIIGSHLGRPKGVAPEFSLRHILPHVSELLGVDVLFADDCIGADAMDKAAKLKAGQVLLLENLRFYAEEEGKPRGLSDDASDEEKAAAKKAVKAAQKEFTQKLASMADCYVNDAFGTAHRAHASTALIADYFDRDHKMFGYLMEKEVKAVERVLHDIKRPFTAIMGGSKVSTKIEIIENLLNKVDNLILTGGMTYTFTKAAGGRIGLSIVEDDKLDLARDIVKKAAEKGVNLILSVDTKVADRFDNDAATQVCSNMEIPDDWMGMDIGPRSIEKFRKVILESKTILWNGPTGVFEFDNFSIGSKAVGEAIVEATANGAFSLVGGGDSVACVNKFGLADKVSYVSTGGGALLEAIEGKTLPGIAAIQG

SEQ ID NO: 90763 - DNA, 1206 bp, Prochlorococcus marinus
  CDS (1)..(1206): transl_table=11
atggcgaagcgttcactgtccaatctcagcgcagcggacctacgcagtaagcgtgtgctggttcgggttgatttcaacgtgcctctcaacgagaacggcgccattaccgatgacacccgcatccgcgccgccctgcccaccatcaatgacctgatcgacaaaggtgctcgggtgatcctctcagcccactttggccgaccaaagggtcaaatcaacgaaggaatgcggctcacaccagtagcaaaacgcctcagcgaactgctgggtaaaaacgtgacaaaaaccgaaagctgcgttggtagcgacgccgaagcaaaggttaatgccatggccgatggagatgtcgtactgctcgagaatgtgcgctttttctcagaagaagaaaaaaacgacgccaacttcgcccaaaagctcgcagcacttgctgacgcttatgtcaatgacgccttcggtgctgcacaccgcgcccacgcctctacagaaggggtcaccaaattcctcaaccccagtgtggcaggccacctgatggagaaggaactgcaatacctgcaaggtgccatcgacgacccgaagcgaccccttgcagcgatcgtgggtgggtccaaggtcagcagcaagatcggcgtgttggaagccttgatcgacaagtgcgacaaggtgctgatcggcggcggcatgatcttcacgttctacaaagcgcgtggcctttcagtcggcaagagcctggtggaagaagacaagttagagctggccaaggagctagaggccaaggcgaaggccaagggggttcaactgcttctgcccactgacgttgtgctagccgatgacttcgcccccgccgccaatagccagaccgtatccatcgacgccattcccgatggttggatgggactggacattggccccgactcaatcaatctcttccaagacgcactggctgactgccaaaccgtgatctggaacggccccatgggcgtgttcgagttcgataagtttgccgccggcaccaacgccatcgccacaaccttggcggacctcagtggcaagggttgctgcacaattattggtggtggtgactccgtagctgctgttgagaaggccggcctcgccgagaagatgtcccacatctccaccggtggtggcgccagccttgagctgctggaaggcaaggtgttgccaggtgtcgccgctctcgacgacgcctaa

SEQ ID NO: 90764 - protein, 401 aa, Prochlorococcus marinus
MAKRSLSNLSAADLRSKRVLVRVDFNVPLNENGAITDDTRIRAALPTINDLIDKGARVILSAHFGRPKGQINEGMRLTPVAKRLSELLGKNVTKTESCVGSDAEAKVNAMADGDVVLLENVRFFSEEEKNDANFAQKLAALADAYVNDAFGAAHRAHASTEGVTKFLNPSVAGHLMEKELQYLQGAIDDPKRPLAAIVGGSKVSSKIGVLEALIDKCDKVLIGGGMIFTFYKARGLSVGKSLVEEDKLELAKELEAKAKAKGVQLLLPTDVVLADDFAPAANSQTVSIDAIPDGWMGLDIGPDSINLFQDALADCQTVIWNGPMGVFEFDKFAAGTNAIATTLADLSGKGCCTIIGGGDSVAAVEKAGLAEKMSHISTGGGASLELLEGKVLPGVAALDDA

SEQ ID NO: 90765 - DNA, 1164 bp, Pseudomonas aeruginosa
  CDS (1)..(1164): transl_table=11
atgaccgtgttgaagatgactgacctcgacctcaaaggtaagcgcgtgctgatccgcgaggacctcaacgtgcccgtgaaggacggccaggtgcagagcgatgcacggatcaaggccgccctgccgaccctcaagctggccctggagaagggcgcggcggtgatggtctgctcgcacctgggccgtccgaccgagggcgagttctccgccgagaacagcctgaagccggtggccgagtacctgtccaaggccctgggccgcgaagtgccgctgctggccgactacctcgacggcgtcgaggtcaaggcgggcgacctggtgctgttcgagaacgtgcgcttcaacaagggcgagaagaagaacgccgacgagctggcgcagaagtacgccgcgctgtgcgacgtgttcgtgatggatgccttcggtaccgcccaccgcgccgaggggtcgacccacggcgtggccaggttcgccaaggtcgccgccgccggcccgctgctggccgccgaactggacgcgctgggcaaggcgctgggcaacccggcgcggccgatggcggcgatcgtcgccggctccaaggtttccaccaagctcgacgtgctgaacagcctggccggcatctgcgaccaactgatcgtcggcggcggcatcgccaacaccttcctcgccgcggccggacacaaggtcggcaagtcactgtacgaggccgacctggtcgagaccgccaaggccatcgccgccaaggtcaaggtgccgctgccggtggacgtggtggtggccaaggaattcgccgagagcgccgtggcgaccgtcaaggccatcgccgaggtcgccgacgacgacatgatcctcgacatcggcccgcagaccgccgcgcagttcgccgagctgctgaagacctcgaagaccatcctgtggaacggtccggtcggggtgttcgagttcgaccagttcggcgagggcacccgtaccctggccaatgccatcgccgatagcgcggcgttctccatcgccggcggcggcgataccctggcggcgatcgacaagtacggcatcgccgagcggatctcctatatttccaccggtggcggcgcgttcctcgagttcgtcgagggcaaggtcctgccggccgtggaaatcctggagcagcgcgccaagggctga

SEQ ID NO: 90766 - protein, 387 aa, Pseudomonas aeruginosa
MTVLKMTDLDLKGKRVLIREDLNVPVKDGQVQSDARIKAALPTLKLALEKGAAVMVCSHLGRPTEGEFSAENSLKPVAEYLSKALGREVPLLADYLDGVEVKAGDLVLFENVRFNKGEKKNADELAQKYAALCDVFVMDAFGTAHRAEGSTHGVARFAKVAAAGPLLAAELDALGKALGNPARPMAAIVAGSKVSTKLDVLNSLAGICDQLIVGGGIANTFLAAAGHKVGKSLYEADLVETAKAIAAKVKVPLPVDVVVAKEFAESAVATVKAIAEVADDDMILDIGPQTAAQFAELLKTSKTILWNGPVGVFEFDQFGEGTRTLANAIADSAAFSIAGGGDTLAAIDKYGIAERISYISTGGGAFLEFVEGKVLPAVEILEQRAKG

SEQ ID NO: 90767 - DNA, 1164 bp, Pseudomonas putida
  CDS (1)..(1164): transl_table=11
atgaccgtgttgaagatgaccgacctcgacctgcaaggtaagcgcgtactgatccgcgaagacctcaacgtgcctgtgaaggacggtgtggtagccagcgatgcgcgtatcctggcagcgctgccgaccatcaagctggccctggagaagggcgcagcggtaatggtctgctcgcacttgggccgcccgaccgaaggcgaattctctgccgagaacagcctcaagccggtcgccgattacctgagcaaggccctgggccgcgacgtgccgctggttgccgactacctggacggtgtcgcggtacaggccggtgaactggtgctgttcgagaacgtgcgcttcaacaagggcgagaaaaagaacgccgacgagctggcgcagaaatacgcagccctgtgcgacgtattcgtcatggacgctttcggcaccgcacaccgcgccgaaggctcgacccatggcgtcgccaagttcgccaaggtggccgctgccggcccactgctggcagccgaactggatgccttgggcaaggccctgaaagccccggccaagccaatggcggccatcgttgccggctccaaggtttccaccaagctggacgtgctgaacagcctcagcagtgtttgcgaccagctgatcgtcggtggcggtattgccaacactttcctggccgctgccggccacccggtgggcaagtcgctgtacgagcctgacctggtggacaccgccaaggccattgccgccaaggtcagcgtgccgctgccagtcgacgtggtggttgccaaggagtttgccgagagcgccgaagccaccgtcaaggccattgccgacgtagctgccgacgacatgatcctggacatcggcccgcaaaccgcggccaatttcgccgagctgctgaaatcgtcgaaaaccattctttggaatggcccggttggcgtgttcgaattcgatcagttcggcaacggcaccaaggtactggccaaggccatcgccgacagcgccgcgttctccatcgccggtggcggtgacaccctggcagccatcgacaaatatggcgtcagcaaggaaatctcctacatttctaccggtggtggcgccttcctcgagttcgtcgagggcaaggtcctgccagctgtggcaattctggaagagcgggccaaggcctga

SEQ ID NO: 90768 - protein, 387 aa, Pseudomonas putida
MTVLKMTDLDLQGKRVLIREDLNVPVKDGVVASDARILAALPTIKLALEKGAAVMVCSHLGRPTEGEFSAENSLKPVADYLSKALGRDVPLVADYLDGVAVQAGELVLFENVRFNKGEKKNADELAQKYAALCDVFVMDAFGTAHRAEGSTHGVAKFAKVAAAGPLLAAELDALGKALKAPAKPMAAIVAGSKVSTKLDVLNSLSSVCDQLIVGGGIANTFLAAAGHPVGKSLYEPDLVDTAKAIAAKVSVPLPVDVVVAKEFAESAEATVKAIADVAADDMILDIGPQTAANFAELLKSSKTILWNGPVGVFEFDQFGNGTKVLAKAIADSAAFSIAGGGDTLAAIDKYGVSKEISYISTGGGAFLEFVEGKVLPAVAILEERAKA

SEQ ID NO: 90769 - DNA, 1227 bp, Pyrobaculum aerophilum
  CDS (1)..(1227): transl_table=11
atgttacttaatgaaattattgacttaataccaaatataaataagtgcctaaaaaagggaaaaacgttaattataagaattgatataaattcgcccattgtaaatggtaaaataattgatgattttagaataagggctcactcgtacaccttgcgcctggcttctgacgcgggggccagggctgtggtgttggcccatcaagggagacctggacaagacgattttacctcacttgagatccataagccgtatatagaaaaatacctagagaggcctataaaatttgtagacgatataataggcccggaggcgaggcgccagataaaagagttgaaagacggcgaaatactgttgctggaaaacgtgaggattctctccgaggaggtaatagaaaaggtgccggaggctcaggcagaaactcttctagtccgcaaactagcccctctagccgactactacgtattcgacggtttcgcggtggctcacagatcgcagccaagcgtagtgggctttccaattgttttgccctcttgcgccggccccgtctttgagagggagctaagggcgttgggagcggtgtttgaaaaacgcggcagaggcgtgacgttaatagcgggaggcgccaaaatgccggacactcttaaggcagtagagcagttgttaaaaaacggctttgtggaaaaagtggccgttggaggcctcgtgggctttgtgtttgccttgggcaaatatggcgtgttaaacagcgcgttaaaacaagaggtagagaagggcggcttcctcccatatatagagagagcccgccaattattggctaaatacggcgcgcagatatacacgcctgtggacttcgcagttaatcaaaacgggaggctagacgttgatatatattcactggcgcaacctccgctagatattgggagatctacgacaattgcgtttaaagaagtgattgaacagagcgagattgtaattttcagcgggcccatgggctatatcgaggacgagagattcgcgacaggaacaatagaactgttaaaagcggcgtcaaacagacggttaatactaggcggggggcacacgattatggccgcggagaaggccggcgtgcttgataaagcataccacgtgtcgactggcgggcgcgcttttattcagacaataggcggcgaggaaatgccggcagtgaaagcgttattaacctctgctaaaaaatttagcctatga

SEQ ID NO: 90770 - protein, 408 aa, Pyrobaculum aerophilum
MLLNEIIDLIPNINKCLKKGKTLIIRIDINSPIVNGKIIDDFRIRAHSYTLRLASDAGARAVVLAHQGRPGQDDFTSLEIHKPYIEKYLERPIKFVDDIIGPEARRQIKELKDGEILLLENVRILSEEVIEKVPEAQAETLLVRKLAPLADYYVFDGFAVAHRSQPSVVGFPIVLPSCAGPVFERELRALGAVFEKRGRGVTLIAGGAKMPDTLKAVEQLLKNGFVEKVAVGGLVGFVFALGKYGVLNSALKQEVEKGGFLPYIERARQLLAKYGAQIYTPVDFAVNQNGRLDVDIYSLAQPPLDIGRSTTIAFKEVIEQSEIVIFSGPMGYIEDERFATGTIELLKAASNRRLILGGGHTIMAAEKAGVLDKAYHVSTGGRAFIQTIGGEEMPAVKALLTSAKKFSL

SEQ ID NO: 90771 - DNA, 1233 bp, Pyrococcus furiosus
  CDS (1)..(1233): transl_table=11
atgttcaggttgagagattttgaatactacaacagaaccgtgtttcttcgagttgacttaaactcaccaatgagtaatggaaaaataataagtgacgcgagatttcgagcagtccttccaacgataaagtacctaatagagagtggagcaaaagtagttgttggcactcatcaaggaaaaccctacagcgaagagtattcgactactgaagagcatgcgagaattctctctgagctcctaaatatgcatgttgaatacgttgaagacatttttggaaagtatgcaagggagagaataaaggctatgaaacctggggaagttatagtcctcgaaaacctcaggttctctgcagaagaagtaaaaaacgcaactattgaggaatgcgaaaagacgttttttgttaggaagctctcccaggtaatagacctcgttgttaacgatgcctttgctgccgctcatagaagtcagccatctctcgttggttttgcaagaataaagcctatgataatgggattccttatggaaaaagaagttgatgctttaacaaaagcttatgaaagtgaagaaaagccgagagtttatgttcttggtggtgcaaaagttgatgactcattaaaagttgccgaaaacgttcttaggaaagaaaaggctgatctcatactgacagggggattggttggccaattattcactctagctaagggctttgacctgggaagagaaaacattaaattcttagaaaagaagggaattttaaaatacgtagactgggcagaaaagattcttgacgaattttatccctacgttagaactcccgtagactttgccattgacttcaagggagaaagagtagagatagatttgctcagcgacgagaaaaggctctttgacgaatatccaatccttgacatcggttctagaacagttgaaaagtatagggagatactcttaaaggccaggataatagtagccaacggtcctatgggagtgttcgaaagggaagaatttgccgtgggaacaattggggtattcaaggccatcggagagagtccagcctttagcgtcattggtggtggtcattcaatagcaagcatatacaagtacaacataactgggataagccatatctctaccggtgggggagctatgctaacattttttgctggagaaaagttgccagttcttgaagcgctaaagattagttacgaaaagttctctaacttactttcttaa

SEQ ID NO: 90772 - protein, 410 aa, Pyrococcus furiosus
MFRLRDFEYYNRTVFLRVDLNSPMSNGKIISDARFRAVLPTIKYLIESGAKVVVGTHQGKPYSEEYSTTEEHARILSELLNMHVEYVEDIFGKYARERIKAMKPGEVIVLENLRFSAEEVKNATIEECEKTFFVRKLSQVIDLVVNDAFAAAHRSQPSLVGFARIKPMIMGFLMEKEVDALTKAYESEEKPRVYVLGGAKVDDSLKVAENVLRKEKADLILTGGLVGQLFTLAKGFDLGRENIKFLEKKGILKYVDWAEKILDEFYPYVRTPVDFAIDFKGERVEIDLLSDEKRLFDEYPILDIGSRTVEKYREILLKARIIVANGPMGVFEREEFAVGTIGVFKAIGESPAFSVIGGGHSIASIYKYNITGISHISTGGGAMLTFFAGEKLPVLEALKISYEKFSNLLS

SEQ ID NO: 90773 - DNA, 1233 bp, Pyrococcus horikoshii
  CDS (1)..(1233)
atgttcaggttggaggattttaactttcacaataaaacggtattcttaagggtagacttaaactcacccatgaaggatggaaagataataagcgatgccaggtttaaagccgttttaccaactataagatacctcatcgagagtggagcaaaagttgtcattggaacgcatcaagggaaaccctacagtgaagattacactaccacagaggagcatgcgagggttctttcagagttattggatcaacacgttgaatatatcgaagacatatttggtaggtatgccagggaaaagataaaagagcttaaatcaggtgaagttgcaattttagagaatcttagattttccgccgaagaagttaagaacaaacccattgaggagtgtgaaaagactttcctcgttaaaaaactatcgaaagttattgattatgtcgttaacgatgcctttgcaactgcacacagaagtcaaccttctttagtaggtttcgcaaggataaagccaatgataatggggttcttgatggaaaaggagatagaggctttaatgagggcttattacagcaaagacagccctaaaatttatgtacttggaggcgccaaggttgaggattcgcttaaagtagttgaaaacgttctaagaagagagagagctgatctagtgctaaccggaggcttggtggccaatgtatttacgcttgctaagggatttgacttgggaaggaaaaacgtagagttcatgaagaaaaaaggcttgctagattatgtaaagcatgcagaggagatattagatgaattttatccctatataagaactcccgtagacttcgcagtagattacaaaggggaaagagtcgaaatagatctgctaagtgaaaataggggattacttcatcaatatcaaattatggatatcggtaagagaaccgcggagaagtacagggaaatattaatgaaagcaaggattatagttgctaacggaccaatgggagtctttgagagggaagaattcgcgatagggacagtagaggtgttcaaggccatagccgatagcccagcgtttagcgttttgggaggagggcattcgatagctagcatacagaaatacggtataactggaataactcatatctccacaggcggtggagcaatgctctctttcttcgctggagaggagttgcctgtcctgagagctcttcagattagttacgaaaaattcaaggaggtggtgaagtga

SEQ ID NO: 90774 - protein, 410 aa, Pyrococcus horikoshii
MFRLEDFNFHNKTVFLRVDLNSPMKDGKIISDARFKAVLPTIRYLIESGAKVVIGTHQGKPYSEDYTTTEEHARVLSELLDQHVEYIEDIFGRYAREKIKELKSGEVAILENLRFSAEEVKNKPIEECEKTFLVKKLSKVIDYVVNDAFATAHRSQPSLVGFARIKPMIMGFLMEKEIEALMRAYYSKDSPKIYVLGGAKVEDSLKVVENVLRRERADLVLTGGLVANVFTLAKGFDLGRKNVEFMKKKGLLDYVKHAEEILDEFYPYIRTPVDFAVDYKGERVEIDLLSENRGLLHQYQIMDIGKRTAEKYREILMKARIIVANGPMGVFEREEFAIGTVEVFKAIADSPAFSVLGGGHSIASIQKYGITGITHISTGGGAMLSFFAGEELPVLRALQISYEKFKEVVK

SEQ ID NO: 90775 - DNA, 1260 bp, Ralstonia solanacearum
  CDS (1)..(1260): transl_table=11
gtggcatcgggtaaaatcgccgctttccgtgatttctccgctgctgccatgcccaacgtcctgcgtctgaccgatctcatctccgaaggcaagcttgccggcaagcgtgtcttcatccgcgccgatctcaacgtgccgcaagacgatgccggcaacatcaccgaagacacgcgcatccgcgcttcggtgccggccatccgcgccgcgctcgacgccggtgccgccgtgatggtcacctcgcatctgggccgtccgaccgaaggcgagttcaagccggaagattcgctggccccggtggccgtgcgcctgtccgagttgctcggctgtgaggtgaagctggtgcagaactgggtcgacggcgtggatgtcgcgcccggccaggtggtgctgctggaaaactgccgcgtcaacaagggcgagaagaagaacagcgacgaactggcccagaagatggccaagctgtgcgacgtctacgtcaacgacgccttcggcaccgcccaccgcgccgaggccaccacgcacggcatcgccaagtttgcccccatcgcctgcgccggcccgctgctgggcgccgagctggacgcgctgggcaaggcgctgggccaaccggcccgtccgctggtcgccatcgtggccggctccaaggtgtcgaccaagctgaccatcctgaaatcgctggccgacaaggtggacaacctgatcgtcggcggcggcatcgccaacacgttcatgctggccgcgggcctgaagatcggcaagtcgctggccgaggcggatctggtgggcgatgccaaggcgatcatcgacctgatggctgcccgtggcgcctcggtgcccattcctgtcgatgtggtctgcgccaaggaattcagcgccaccgctgccgccaccgtcaaggacgtgaaggacgtggcggatgacgacatgattctcgacatcggcccgaagaccgccgcgcaactggccgaccagctcaaggcctccggcaccatcgtgtggaacggcccggtcggcgtgttcgagttcgaccagttcggcaacggcaccaaggtgctggccgaggcgatcgcggcctcgtcgggcttctcgatcgccggtggcggcgatacgctggcggcgatcgccaagtacggcatcgccgaccgcgtgggctacatctccaccggcggcggcgcattcctggaattcctggaaggcaagacgctgccggccgtggagatcctggagcagcgtgcccagcgccaggaagcgctggcctga

SEQ ID NO: 90776 - protein, 419 aa, Ralstonia solanacearum
MASGKIAAFRDFSAAAMPNVLRLTDLISEGKLAGKRVFIRADLNVPQDDAGNITEDTRIRASVPAIRAALDAGAAVMVTSHLGRPTEGEFKPEDSLAPVAVRLSELLGCEVKLVQNWVDGVDVAPGQVVLLENCRVNKGEKKNSDELAQKMAKLCDVYVNDAFGTAHRAEATTHGIAKFAPIACAGPLLGAELDALGKALGQPARPLVAIVAGSKVSTKLTILKSLADKVDNLIVGGGIANTFMLAAGLKIGKSLAEADLVGDAKAIIDLMAARGASVPIPVDVVCAKEFSATAAATVKDVKDVADDDMILDIGPKTAAQLADQLKASGTIVWNGPVGVFEFDQFGNGTKVLAEAIAASSGFSIAGGGDTLAAIAKYGIADRVGYISTGGGAFLEFLEGKTLPAVEILEQRAQRQEALA

SEQ ID NO: 90777 - DNA, 1197 bp, Rhizobium loti
  CDS (1)..(1197)
atggccgccttcaagacactggacgatatcggcaacatcagcggcaagcgcgtgctggtgcgcgtcgacctcaacgttcccgtcgccgacggcaaggtcaccgacgccacccgcatcgaacgcatcgcgccgaccatcgccgaactgtcgggcaagggcgccaaggtcatcctgctcgcccatttcggccggcccaaggatgggccatccccggaattctcgctggagccgatcgccagggcgacggccgaggtgctcggccgtcccgtcggctttgcctcggattgcgtcggcgacatggcgggaagtgctgtcgcggccatgaacaagggtgacgtgctgctcttcgaaaatacccgtttctacaaggccgaggagaagaacgacccggccttcagcgagcggctcgccgccaatggcgacattttcgtcaacgacgccttttccgcggcgcaccgcgcccactcttccacagaggggctggcgcgtctgttgccttcctttgctggccgcaccatgcaggccgagctcgaagcgctggagaagggcctgggcaacccggtccgcccggtcgtggcgatcgtcggcggcgccaaggtctcgaccaagatcgacctgctgatgaacctggtgaagaaggtcgacgcgctggtcatcggcggcggcatggccaacaccttccttgccgcgcgcggcaccgatgtcggcaagtcgctgtgcgagcatgatcttgcccccaccgccaagcagatcatgatcgaggccgccgaggccggctgcgccatcatcctgccggtcgacggtgtcgtcgccaaggaattcaaggcgggcgccgcctgcgagaccgtcgccatctccgacgtgccggccgatggcatgatcctggatgtcggcgaaaagaccgtgaagacgatcggcgaatggatcgaccgcgccgcgacactggtctggaacggcccgcttggcgccttcgagatcgagccgttcgatcacgccacggtggcggcggcaaaacacgcggccgcgcgcaccaaggccggcaagctggtctccgttgcgggtggcggcgacacggtggcggcgctcaaccacgccggcgtcgccgacgacttcacctatgtctctaccgccggcggcgccttcctggaatggatggaaggcaagcctctgccaggcgtcgacgtgctgaagcgctga

SEQ ID NO: 90778 - protein, 398 aa, Rhizobium loti
MAAFKTLDDIGNISGKRVLVRVDLNVPVADGKVTDATRIERIAPTIAELSGKGAKVILLAHFGRPKDGPSPEFSLEPIARATAEVLGRPVGFASDCVGDMAGSAVAAMNKGDVLLFENTRFYKAEEKNDPAFSERLAANGDIFVNDAFSAAHRAHSSTEGLARLLPSFAGRTMQAELEALEKGLGNPVRPVVAIVGGAKVSTKIDLLMNLVKKVDALVIGGGMANTFLAARGTDVGKSLCEHDLAPTAKQIMIEAAEAGCAIILPVDGVVAKEFKAGAACETVAISDVPADGMILDVGEKTVKTIGEWIDRAATLVWNGPLGAFEIEPFDHATVAAAKHAAARTKAGKLVSVAGGGDTVAALNHAGVADDFTYVSTAGGAFLEWMEGKPLPGVDVLKR

SEQ ID NO: 90779 - DNA, 1200 bp, Rhizobium meliloti
  CDS (1)..(1200): transl_table=11
atgactttcaagactctcgacgatctgaccgacatcgccggcaagcgcgttctcgtgcgcgtcgatctgaacgtgcctgtcaaggacggccaggtgaccgacaccacccgcatcgagcgcgtggcgccgaccattcgcgaactctccgagaagggcgcgaaagtcgttctgctcgcgcatttcggccggccgaagggcgagcccgtcgccgacatgtcgctgaaggcgatcgcctccgccgtcgaggagatcctcgaccagcgcgtctatttcgctgccgactgcatcggcgacaaggccgccaacgccattgccgaattgaacgacggcgaagtgctgctgctcgagaatacccgcttccacaagggcgaggagaagaacgattcggacttcgtgacggcgctcgccgccaatggcgacatctatgtcaacgacgccttctccgccgcccatcgcgcccacgcctcgaccgaggggcttgcccatcaccttcccgcctatgccggccgcaccatgcaggcggagctcgaagcgcttgaaaaggggctcggcaatccgaagcgcccggtcgtcgcgatcgtcggcggcgccaaggtctcgaccaagatcgaccttctgcagaacctcgtgaagaaggtcgacgcgctggtcatcggcggcggcatggccaacaccttcctcgcggcgcaaggcgtcgatgtcggaaagtcgctctgcgagcacgatcttgcggagaccgccaaggccatcctcgcggccgcctcggaagcgggatgcgcaatcgtgcttccggtcgacggcgtcgttgcccgtgagttcaaggccggtgccgacaacgaggtcgtcgatatcaaggccatccctgccgacgccatggtgcttgacgtcgggccgaaatcgatcgaggccatcaacgaatggatctcgcgcgccgaaaccctcgtgtggaatggcccgctcggcgcgttcgagatcgcgcccttcgacagggcgaccgtggcggcggcgaaacacgcggcagcccgcacccgcgccggctcgctcgtctccgtcgccggcggcggcgacacggtcgcagcactcaaccatgccgaggtcgcggacgatttcacctatgtctcgaccgccggcggcgccttcctcgaatggatggaaggcaagcccttgccgggcgtagatgttctccggcagcggaactga

SEQ ID NO: 90780 - protein, 399 aa, Rhizobium meliloti
MTFKTLDDLTDIAGKRVLVRVDLNVPVKDGQVTDTTRIERVAPTIRELSEKGAKVVLLAHFGRPKGEPVADMSLKAIASAVEEILDQRVYFAADCIGDKAANAIAELNDGEVLLLENTRFHKGEEKNDSDFVTALAANGDIYVNDAFSAAHRAHASTEGLAHHLPAYAGRTMQAELEALEKGLGNPKRPVVAIVGGAKVSTKIDLLQNLVKKVDALVIGGGMANTFLAAQGVDVGKSLCEHDLAETAKAILAAASEAGCAIVLPVDGVVAREFKAGADNEVVDIKAIPADAMVLDVGPKSIEAINEWISRAETLVWNGPLGAFEIAPFDRATVAAAKHAAARTRAGSLVSVAGGGDTVAALNHAEVADDFTYVSTAGGAFLEWMEGKPLPGVDVLRQRN

SEQ ID NO: 90781 - DNA, 1194 bp, Rhodopirellula baltica
  CDS (1)..(1194): transl_table=11
atggccaagaaaaccattgatcaaatcgacgttcaagacaaaaccgttctcatgcgagtcgacttcaacgtgccgttggacgaatcgctcgccatcaccgatgaccgccgtattcgcatggcgttgcccagcatcaagagcgtcatcgaccgcggtggcaaagtgatcctgatgagccacctgggacgaccgactggtggtgaaggcgacgagaagtattccttggctccggccgcgaaacgtttgggtgaattgctcggcagcaccgttcacttcgcgaccgacactgtcggagacgacgcatcgagcaaagcaagctcgttggccgctggcgaagttttggtgctggaaaacttgcgtttcaatccaggcgagaagaaaggcgactcagagttcgctggcaagttggccgcgatggccgacgcctactgcaacgacgcattcggcacctgtcaccgcaaagacgcatcgatggtcgccgtccccgaagcgatggctggcaagcctcgcgtggttgggcatttggtcgccaaagaaatccagtacctcaccgatgcgatcagcaaacccgagcgacctttcgttgcgatcctgggtggagccaaggtcagcgacaagatcaacgtgatcaacaacttgctcggcatctgtgatgcggtcttgatcggtggtgcgatggcttacacgttttcgttagccagtggcggtaaagtcggcaagtcattggtcgagaaagacaaggtcgagttggcaaaggagttgatggcaaagggtggcgacaagctacagcttcccgtcgacacgcactgcggtgacgacttcggaaacatcgctggttgcaacaaaaaggttgttgctgcaggtgaaattcctgacgacatggaaggtttggacatcggtcctgaaacggcgaagaagtacgcagaggtcatcaagtcggccaagaccatcgtctggaacggaccgatgggcgtgtttgaaaaaccaccaatggatgaaggcaccaaagccgtcgctcaagcaatcgccgatggcgatgccgtcagcatcatcggtggtggtgacagcgctgctgctgttgatcaactcgggttcgccgacgatgtcagccacgtcagcaccggtggcggagccagcttggcaatgttggaaggccaagccttcgcagccgtcgatttgctcgacgaagcttga

SEQ ID NO: 90782 - protein, 397 aa, Rhodopirellula baltica
MAKKTIDQIDVQDKTVLMRVDFNVPLDESLAITDDRRIRMALPSIKSVIDRGGKVILMSHLGRPTGGEGDEKYSLAPAAKRLGELLGSTVHFATDTVGDDASSKASSLAAGEVLVLENLRFNPGEKKGDSEFAGKLAAMADAYCNDAFGTCHRKDASMVAVPEAMAGKPRVVGHLVAKEIQYLTDAISKPERPFVAILGGAKVSDKINVINNLLGICDAVLIGGAMAYTFSLASGGKVGKSLVEKDKVELAKELMAKGGDKLQLPVDTHCGDDFGNIAGCNKKVVAAGEIPDDMEGLDIGPETAKKYAEVIKSAKTIVWNGPMGVFEKPPMDEGTKAVAQAIADGDAVSIIGGGDSAAAVDQLGFADDVSHVSTGGGASLAMLEGQAFAAVDLLDEA

SEQ ID NO: 90783 - DNA, 1197 bp, Rhodopseudomonas palustris
  CDS (1)..(1197): transl_table=11
atgacaaagacattccgcaccctcgacgacgtcgatgtgaagggcaagcgcgtgctgctgcgcgtcgatctcaacgtgccgatggacgccggcaaggtgaccgacaccacccggctcgaacgcgtgatgccgaccatcaccgagctgtcgggcaagggcgccaaggtgatcctgctggcgcatttcggccggccgaagggccgcgacgacaagaactcgctcaagccggtcgctgctgcgctggccgacgtcatcaagaagccggtcggcttcgccgacgactgcatcggcgagcccgccgccaaggcgatcgccgcgatggccgacggcgacatcctgtgcctggaaaacacccgcttccatcccgaggaagagaagaacgatccggcgttcgtcgccaagctcgccgagctcggcgacatctgggtcaacgacgcgttctcggccgcgcaccgcgcccacgccaccaccgaaggcctcggccacaagctgccggcttacgcgggccgcaccatgcaggccgagctcgtcgcgctgaacaaggcgctggaagcgccggtgaagccggtgatcgcgatcgtcggcggcgccaaggtgtcgaccaagatcgacctgctcgaaaacctggtcaccaaggtgcaggcgctggtgatcggcggcggcatggccaacaccttcctgcacgcccagggcgtcaaggtcggaaagtctctgtgcgagaaggacctggctccgactgcgctgcgcatcctcgataaggccgaagctgccaactgcgccatcatcctgccggtcgacgccaccgtggcctatcacttcgaggccaacgcgccgtcgttcgcctacgggctcgacgccatcccggacgatgccatgatcctcgacgtcggcccgcgctcgatcgagcgcattcacgccgcgatcgacgatgccgcgaccctggtgtggaacggcccggtcggcgcgttcgagctgacgccgttcgacaagggcacggtcgaagccgccaagcacgccgccaagcgcaccaaggccggcaagctggtgtcggtcgccggcggcggcgacaccgtcgcggcgctcaaccatgccggcgtggccgacgacttcacctacatctcgaccgccggcggcgccttcctggaatggatggaaggcaagccgctgccgggcgtcgaagtgctccaggtcaagtga

SEQ ID NO: 90784 - protein, 398 aa, Rhodopseudomonas palustris
MTKTFRTLDDVDVKGKRVLLRVDLNVPMDAGKVTDTTRLERVMPTITELSGKGAKVILLAHFGRPKGRDDKNSLKPVAAALADVIKKPVGFADDCIGEPAAKAIAAMADGDILCLENTRFHPEEEKNDPAFVAKLAELGDIWVNDAFSAAHRAHATTEGLGHKLPAYAGRTMQAELVALNKALEAPVKPVIAIVGGAKVSTKIDLLENLVTKVQALVIGGGMANTFLHAQGVKVGKSLCEKDLAPTALRILDKAEAANCAIILPVDATVAYHFEANAPSFAYGLDAIPDDAMILDVGPRSIERIHAAIDDAATLVWNGPVGAFELTPFDKGTVEAAKHAAKRTKAGKLVSVAGGGDTVAALNHAGVADDFTYISTAGGAFLEWMEGKPLPGVEVLQVK

SEQ ID NO: 90785 - DNA, 1251 bp, Schistosoma mansoni
  CDS (1)..(1251)
atgggtttgtcgaagcttagtatttcagatgttgaccttaaaggaaaacgtgttcttattcgagttgattttaacgtccctatgaaagatgggaaagtcactaacactcaaagaatagcagctgccataccaactattaaatatgctttggataagggggccaaaagtgtcgtcttaatgtcccatttaggtcggccagatgggcacaaagttgataagtattctctaaagcctgtgtgccctgaagtgtcaaagttgttaggcaaagaagttacgttcctcaatgattgtgttgggcctgacgtagttaacgcatgtgccaatcctgctcccggaagcgtttttttgctagagaatctacgctttcacgttgaagaggaaggaaaaggtgtctcaccaaccggcgaaaaaacaaaagccactgctgaccaaatcaaggctttcagtgagagtctaacaaaacttggtgatgtctacgtcaacgatgcctttgggacggcacatagagctcatgcttctatggtcggctgccaactaccacaaaaagcctgtggatttctcatgaataaagaattgacatacttcgccaaagctctggaaaatccagaacgccctttcttagctattttaggaggtgccaaggttagcgacaagatccagttgatcaataatatgcttgacaaagttaatgaattaatcatcggtggtgggatggcgtatacatttcttaagcaaatacacaatatgcatataggaaatagtttatttgatgcaccgggtgcagaaattgttcataaagtaatggaaactgcaaaggctaaaaatgttgcaattcacttaccggttgatttcgtaactgccgataaatttgctgatgatgcgaacaccgaaataagaactatacaatccggaattgccgatggttggatgggattagatattggtccaaaaacaattgaagaattcagtaaagtgattagtcgtgccaaaactattgtttggaacggtccgatgggtgtttttgaaatggacaaatttgcaacaggaacaaaagcagcaatggatgaagtagtcaaagctactaaaaatggtgctacaactattattggtggtggtgacaccgcaacatgctgcgccaaatgggacacagaagacaaagttagtcatgtcagtactggtggtggtgctagtcttgaacttctcgaaggtaaacaattacccggagttgttgcacttacggatgctcattaa

SEQ ID NO: 90786 - protein, 416 aa, Schistosoma mansoni
MGLSKLSISDVDLKGKRVLIRVDFNVPMKDGKVTNTQRIAAAIPTIKYALDKGAKSVVLMSHLGRPDGHKVDKYSLKPVCPEVSKLLGKEVTFLNDCVGPDVVNACANPAPGSVFLLENLRFHVEEEGKGVSPTGEKTKATADQIKAFSESLTKLGDVYVNDAFGTAHRAHASMVGCQLPQKACGFLMNKELTYFAKALENPERPFLAILGGAKVSDKIQLINNMLDKVNELIIGGGMAYTFLKQIHNMHIGNSLFDAPGAEIVHKVMETAKAKNVAIHLPVDFVTADKFADDANTEIRTIQSGIADGWMGLDIGPKTIEEFSKVISRAKTIVWNGPMGVFEMDKFATGTKAAMDEVVKATKNGATTIIGGGDTATCCAKWDTEDKVSHVSTGGGASLELLEGKQLPGVVALTDAH

SEQ ID NO: 90787 - DNA, 1245 bp, Schizosaccharomyces pombe
  CDS (1)..(1245)
atgtctttgtctactaagctcgctatcaccgacgtcgacttgaagggcaagaacgtcttgatccgtgtcgacttcaacgtccctttggacggtgaccgtatcaccaacaatgcccgtatcgttggtgctctccccaccatcaagtacgctcttgagcaacaacccaaggctgtcatcttgatgtctcacttgggccgtcccaacggtgctcgtgttgccaagtactccttgaagcctgttgctgctgagctcagcaagcttttgggcaagcccgtcaagttccttgacgactgtgttggccctgaggtcgaaaaggcctgcaaggaagccaagggtggtgaggtcatccttttggagaacttgcgtttccacatcgaggaggagggttccgccaaggttgacggtaagaaggttaaggctgacgcttctgccgtcgaggctttccgtaagtctttgacttctctcggtgacatctttgtcaacgatgctttcggtaccgctcaccgtgctcactcctctatggtcggtgtcgatctcccccgtgtctccggtttccttatgaagaaggagctcgactacttctccaaggctttggagaaccccgctcgtcccttccttgccatcttgggtggtgccaaggttgctgacaagatccaacttattgacaaccttcttgacaaggtcaaccgccttatcatctgcggtggtatggctttcaccttcttgaaggtccttaacggtatgaagattggtgactctcttttcgatgaggctggttccaagaacgtcgaatccatgatggccaaggccaagaagaacaacgtcgaggtcttcctccccgttgacttcgtcactgccgacaagttcgacaaggacgccaaggttggctctgccaccgccgaggagggtatccccgacggatggatgggtttggactgtggacccaagtcctctgctaagtttgccgaggttatcaccacctccaagaccattgtctggaatggtcccgctggtgtctttgagtttgacaactttgccaagggtaccaagtctatgcttgatgcttgtgtcaagacctgtgaagctggtaacgttgttattgttggtggtggtgacactgctactgttgccaagaagtacggtaaggaggatgctctttcccacgtctctaccggtggtggtgcttctcttgaactcttggagggtaaggctcttcccggtgtcgttgctctttcttccaagtaa

SEQ ID NO: 90788 - protein, 414 aa, Schizosaccharomyces pombe
MSLSTKLAITDVDLKGKNVLIRVDFNVPLDGDRITNNARIVGALPTIKYALEQQPKAVILMSHLGRPNGARVAKYSLKPVAAELSKLLGKPVKFLDDCVGPEVEKACKEAKGGEVILLENLRFHIEEEGSAKVDGKKVKADASAVEAFRKSLTSLGDIFVNDAFGTAHRAHSSMVGVDLPRVSGFLMKKELDYFSKALENPARPFLAILGGAKVADKIQLIDNLLDKVNRLIICGGMAFTFLKVLNGMKIGDSLFDEAGSKNVESMMAKAKKNNVEVFLPVDFVTADKFDKDAKVGSATAEEGIPDGWMGLDCGPKSSAKFAEVITTSKTIVWNGPAGVFEFDNFAKGTKSMLDACVKTCEAGNVVIVGGGDTATVAKKYGKEDALSHVSTGGGASLELLEGKALPGVVALSSK

SEQ ID NO: 90789 - DNA, 1176 bp, Shewanella oneidensis
  CDS (1)..(1176): transl_table=11
atggcaattatcaatatgtcagatttagatctccaaggtaagcgagtgcttattcgtgaagatctcaatgtgcctgtcagcaatggcgtcgtcaccagtgatgcgcgccttagagcctctctccccactatcgagttagcccttgccaaaggcgcggcggtaatggtgatgtctcacttgggtcgtccaaccgaaggtgagtacaacagcgaattttccatgcaacctgtggtcgattacttggccaaagccctgtcttgtcctgtgcgcttagcgaccgactacttagacggcgttgaagtggctgtaggtgaagtggtggtgtttgaaaacgttcgcttcaataaaggcgagaagaaaaacgacgaagcgttatctaagaagatggcagcgttatgtgatgtgtatgtgatggatgctttcggcacggctcaccgcgcagaagcctcaacgaatggcgttggtttatacgcgccaattgcttgtgctggtccattactggcgcaagagttagatgctttaggtaaggcgttagataatccagcgcgtccattagtggcaatcgttggtggctctaaagtgtcgactaagctcaccgtattagaaagcttatcaggcattgtggatcaattagtggttggtggtggtatcgctaacacctttatcgctgcggcgggccacaacgtgggtaaatccttatacgaagcggatttaattgatgaagctaagcgcttagtggcgaacgcgcaaagccgcggtggcgatattcccgtacctaccgatgtggttgtggcgggtgagtttagcccaacggcagctgctaccttaaaagcagtgagtgatgttggcgatagcgatatgattttcgacatcggccccgacagtgccgaagcgttagcgaaaatcattgagtctgctggcactatcgtatggaacggcccagttggtgtgttcgagtttgaccaattcggtgaaggcactaagcgcatcgctcacgcgattgcggattccaaagccttctctatcgctggcggtggtgacaccttggcggcggtcgataaatacggtatcgccgataaagtttcttatatctctacgggcggtggcgctttcctcgagttcctcgaaggtaaagagttacctgctgtagctatgctaaaaaaacgtggtgcttaa

SEQ ID NO: 90790 - protein, 391 aa, Shewanella oneidensis
MAIINMSDLDLQGKRVLIREDLNVPVSNGVVTSDARLRASLPTIELALAKGAAVMVMSHLGRPTEGEYNSEFSMQPVVDYLAKALSCPVRLATDYLDGVEVAVGEVVVFENVRFNKGEKKNDEALSKKMAALCDVYVMDAFGTAHRAEASTNGVGLYAPIACAGPLLAQELDALGKALDNPARPLVAIVGGSKVSTKLTVLESLSGIVDQLVVGGGIANTFIAAAGHNVGKSLYEADLIDEAKRLVANAQSRGGDIPVPTDVVVAGEFSPTAAATLKAVSDVGDSDMIFDIGPDSAEALAKIIESAGTIVWNGPVGVFEFDQFGEGTKRIAHAIADSKAFSIAGGGDTLAAVDKYGIADKVSYISTGGGAFLEFLEGKELPAVAMLKKRGA

SEQ ID NO: 90791 - DNA, 1239 bp, Spiroplasma citri
  CDS (1)..(1239): transl_table=4
atgacaaacaaaaaagaattaaaagatgttcaagttaaaggaaaaaaagttttagtccgtgttgattttaatgtgccaatgaaggatggtcaagttactgatgataatcgtattattgcagctttaccaacaattaaatatttgatagcacaagaagcaaaagtaattttattttctcatttagggaaagttaaaacagctgatgatttagaaaaacgtgatatggctccagtagcaaaggtattagaacaaaaattaggacaaccagttaaatttattaatgcctttgaaggaaaacaattggaagaagctattaacgaaatgcacaataaagaggtcattttatttcaaaatacacgctttgctgacattattaatagtaatggtcaaattagtgttgatagtgagggcaaagcagcggcaaaacgagaaagtaaaaatgattctgctttagggaaatattgagcaagtttaggagatgtttttgttaatgatgcatttggaactgcacatcgtgctcatgcttcaaatgttggtattgcagaaaatattactgaatcatgtttaggctttttagtggaaaaagaagtaaaaatgttatcacaatgcgtagacaatccagttaaaccatttgttgctattattggtggtgcaaaagtttcagataaaattggggtaattgaacatttattaacaaaagcagataagattctaattggtggtggaatggcatatactttttttgctgcacaaggtcacaaaattggaaactcattattagaagttgataaagttgaaattgctaaaacctttttagcaaaaggacaagggaaaattattttaccaattgatgcgttagaagcaccagaatttgctgatgttccagcaaaagttacaacaggttttgatattgatgatggttatatgggattagatattggtcccaaaacaattgaattgtttaaaaaagaattagcagatgcaaaaacagttacttgaaatgggccaatgggagtttttgaatttaaaaattatagtattggaacaaaagctgtttgtgaagcaattgctgaactaaaaggagcctttactttaattggaggaggagattcagcggcagcagcaattcaattagggtataaagataagtttacgcatatatcaactggtggtggtgctagcttagaatatatggaaggtaaaccgctacctggaattgaagctgttcaaagtaaataa

SEQ ID NO: 90792 - protein, 412 aa, Spiroplasma citri
MTNKKELKDVQVKGKKVLVRVDFNVPMKDGQVTDDNRIIAALPTIKYLIAQEAKVILFSHLGKVKTADDLEKRDMAPVAKVLEQKLGQPVKFINAFEGKQLEEAINEMHNKEVILFQNTRFADIINSNGQISVDSEGKAAAKRESKNDSALGKYWASLGDVFVNDAFGTAHRAHASNVGIAENITESCLGFLVEKEVKMLSQCVDNPVKPFVAIIGGAKVSDKIGVIEHLLTKADKILIGGGMAYTFFAAQGHKIGNSLLEVDKVEIAKTFLAKGQGKIILPIDALEAPEFADVPAKVTTGFDIDDGYMGLDIGPKTIELFKKELADAKTVTWNGPMGVFEFKNYSIGTKAVCEAIAELKGAFTLIGGGDSAAAAIQLGYKDKFTHISTGGGASLEYMEGKPLPGIEAVQSK

SEQ ID NO: 90793 - DNA, 1191 bp, Staphylococcus aureus
  CDS (1)..(1191): transl_table=11
atggctaaaaaaattgtttctgatttagatcttaaaggtaaaacagtcctagtacgtgctgattttaacgtacctttaaaagacggtgaaattactaatgacaaccgtatcgttcaagctttacctacaattcaatacatcatcgaacaaggtggtaaaatcgtactattttcacatttaggtaaagtgaaagaagaaagtgataaagcaaaattaactttacgtccagttgctgaagacttatctaagaaattagataaagaagttgttttcgtaccagaaacacgcggcgaaaaacttgaagctgctattaaagaccttaaagaaggcgacgtattattagttgaaaatacacgttatgaagatttagacggtaaaaaagaatctaaaaatgatccagaattaggtaaatactgggcatctttaggtgatgtgtttgtaaatgatgcttttggtactgcgcatcgtgagcatgcatctaatgttggtatttctacacatttagaaactgcagctggattcttaatggataaagaaattaagtttattggtggcgtagttaacgatccacataaaccagttgttgctattttaggtggagcaaaagtatctgacaaaattaatgtcatcaaaaacttagttaacatagctgataaaattatcatcggcggaggtatggcttatactttcttaaaagcgcaaggtaaagaaattggtatttcattattagaagaagataaaatcgacttcgcaaaagatttattagaaaaacatggtgataaaattgtattaccagtagacactaaagttgctaaagaattttctaatgatgccaaaatcactgtagtaccatctgattcaattccagcagaccaagaaggtatggatattggaccaaacactgtaaaattatttgcagatgaattagaaggtgcgcacactgttgtatggaatggacctatgggtgtattcgagttcagtaactttgcacaaggtacaattggtgtatgtaaagcaattgcaaaccttaaagatgcaattacgattatcggtggcggtgattcagctgcagcagcaatctctttaggttttgaaaatgacttcactcatatttcaactggtggcggcgcgtcattagagtacctagaaggtaaagaattgcctggtatcaaagcaatcaataataaataa

SEQ ID NO: 90794 - protein, 396 aa, Staphylococcus aureus
MAKKIVSDLDLKGKTVLVRADFNVPLKDGEITNDNRIVQALPTIQYIIEQGGKIVLFSHLGKVKEESDKAKLTLRPVAEDLSKKLDKEVVFVPETRGEKLEAAIKDLKEGDVLLVENTRYEDLDGKKESKNDPELGKYWASLGDVFVNDAFGTAHREHASNVGISTHLETAAGFLMDKEIKFIGGVVNDPHKPVVAILGGAKVSDKINVIKNLVNIADKIIIGGGMAYTFLKAQGKEIGISLLEEDKIDFAKDLLEKHGDKIVLPVDTKVAKEFSNDAKITVVPSDSIPADQEGMDIGPNTVKLFADELEGAHTVVWNGPMGVFEFSNFAQGTIGVCKAIANLKDAITIIGGGDSAAAAISLGFENDFTHISTGGGASLEYLEGKELPGIKAINNK

SEQ ID NO: 90795 - DNA, 1197 bp, Streptococcus pneumoniae
  CDS (1)..(1197): transl_table=11
atggcaaaacttactgttaaagacgttgacttgaaaggtaaaaaagtcctcgttcgtgttgacttcaacgtaccattgaaagatggcgtaatcactaacgataaccgtatcacagcagctcttccaactattaagtacatcatcgaacaaggtggacgtgcaattcttttctctcaccttggacgtgtgaaagaagaagctgataaagctggtaaatcacttgctcctgtagcagctgacttggcagcaaaacttggtcaagatgttgttttcccaggtgtcactcgtggtgctgaattagaagcggcaatcaacgctcttgaagatggacaagttctcttggttgaaaacactcgttacgaagatgttgacggcaagaaagaatctaaaaacgatcctgaacttggtaaatactgggcatcacttggagatggtatcttcgtaaacgatgcattcggtacagctcaccgtgcacacgcatctaacgttggtatctcagcaaacgttgaaaaagcagttgctggtttccttcttgaaaacgaaattgcctacatccaagaagcagttgaaactccagaacgtccattcgtggctatccttggtggttcaaaagtttcagacaagatcggtgttatcgaaaacttgcttgaaaaagctgataacgtccttatcggtggtgggatgacttacacattctacaaagcacaaggtatcgaaatcggtaactcacttgtagaagaagacaaattggatgttgcgaaagctcttcttgaaaaagcaaatggtaaattgatcttgccagttgactcaaaagaagctaacgcatttgctggttacactgaagtgcgtgacactgaaggtgaagcagtttctgaaggcttccttggtcttgacatcggtccaaaatctatcgccaaatttgacgaagctttgactggtgccaaaacagtcgtatggaacggacctatgggtgtatttgaaaacccagatttccaagctggtacaatcggtgtgatggacgctatcgtgaaacaaccaggagttaaatcaatcatcggtggtggtgactcagctgccgcagcgattaaccttggccgtgcagacaagttctcatggattagtacgggtggtggagcatcaatggaacttcttgaaggtaaggttcttccaggacttgcagccttgacagaaaaataa

SEQ ID NO: 90796 - protein, 398 aa, Streptococcus pneumoniae
MAKLTVKDVDLKGKKVLVRVDFNVPLKDGVITNDNRITAALPTIKYIIEQGGRAILFSHLGRVKEEADKAGKSLAPVAADLAAKLGQDVVFPGVTRGAELEAAINALEDGQVLLVENTRYEDVDGKKESKNDPELGKYWASLGDGIFVNDAFGTAHRAHASNVGISANVEKAVAGFLLENEIAYIQEAVETPERPFVAILGGSKVSDKIGVIENLLEKADNVLIGGGMTYTFYKAQGIEIGNSLVEEDKLDVAKALLEKANGKLILPVDSKEANAFAGYTEVRDTEGEAVSEGFLGLDIGPKSIAKFDEALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 90797 - DNA, 1248 bp, Sulfolobus tokodaii
  CDS (1)..(1248)
atgataaaagtagctgatcttaatattcctgttatagaagatttcgacataaatgggagaaaagttttactaagaatagatataaattcacccgtagaccgaaaaactggaaaattattagatgattccagaattaaagcccatgctgaaacaattagagaattactcgataagcaaaattctgtagtaataatttcccaccaaggtagaccaggagatgatgattttatttctttagaagaacactctaaaatcctatctaaatatgttggtagggaaattgagttcgtcgatgatgttataggtccttatgctagagaaaaaatatctaaactaggtaaaggggaagccatcttattagagaatgttagaatcgtatctgaagaattaatagaggctcctccacaacagcaatctaaaacttttttagtaagaaaattagccccattagtcgatttttacattaacgatgctttcgcaacagcacatagaagccaaccaagtctagtaggatttcctttagtaaaaccttcagctgcaggaagaataatggagaaagaagtttctgcattatctaagatctttaacaaggaagactctccaaaaatatttgttttgggaggaagtaaggttagtgatacattaaagataattgaacacctagcaaaaaatagagttgctgatagaatattaactggcggtttagtagcagaactatttgctgttgcgaaaggtataaatttaggtaagcctaatatgcaagttttagagaataagggtcttctgagcctaattccgagagctagaaaaatcttgctatctggtgcacctatagaaatccctgttgactttacagtggaaaaacctagtggagaattaagcaatgatccggagaataatgtgagtggtattataaaagatatagggaatactaccattgaaatttattcctcttttattaaggaaggcaaagtcattacattaagaggacctatgggagttattgaagatgaaagattcagaattggtactaaaagcttactgaaagcctctattgaaagcccgggatatgtaattattggtggcggtcatatgataagtatgcttgataaagacgtagaaataaatccaaataaaattcatgtatctaccggaggaggagcgttgcttttatttttagccggtgataagttaccggcattagaagctttacatatgtcatgggtgatgcaaagtggaaaaagttaa

SEQ ID NO: 90798 - protein, 415 aa, Sulfolobus tokodaii
MIKVADLNIPVIEDFDINGRKVLLRIDINSPVDRKTGKLLDDSRIKAHAETIRELLDKQNSVVIISHQGRPGDDDFISLEEHSKILSKYVGREIEFVDDVIGPYAREKISKLGKGEAILLENVRIVSEELIEAPPQQQSKTFLVRKLAPLVDFYINDAFATAHRSQPSLVGFPLVKPSAAGRIMEKEVSALSKIFNKEDSPKIFVLGGSKVSDTLKIIEHLAKNRVADRILTGGLVAELFAVAKGINLGKPNMQVLENKGLLSLIPRARKILLSGAPIEIPVDFTVEKPSGELSNDPENNVSGIIKDIGNTTIEIYSSFIKEGKVITLRGPMGVIEDERFRIGTKSLLKASIESPGYVIIGGGHMISMLDKDVEINPNKIHVSTGGGALLLFLAGDKLPALEALHMSWVMQSGKS

SEQ ID NO: 90799 - DNA, 1203 bp, Synechococcus elongatus
  CDS (1)..(1203)
atgtctaaaaaatccgtagcgcaattatccgctgccgacttagaaggaaagcgtgtcctcgtgcgggtggattttaatgtccccgtcgatgaaaagggcgtcatcaccgatgagactcgtatccgtgcggccctgcccaccattcaagacctgatcagcaaaggtgcaaaagtcattctggtcagccactttggccgtcccaagggcgtggatgagaagttgcgcctcacccctgtggcccagcggctctcagaactgctccacaaacccgtggccaagctcgatgactgcattggcgatgcggtgatcgcccacacccaagccatggccaacggggatgtctgcctactggagaatgtgcgcttccatccgggggaagaaaaaaacgatcccgaatttgccaagcaactggccgcctgtgcagaagtctatgtcaatgatgcctttggcactgcccaccgcgcccatgcctcaaccgctggggtgactcagtacctcagtccttgcgtggcgggctttttgatggagaaagaactggaatatctgcaaaatgccatcgaacatccccgccgtcccctggcggctattgtcgggggatcaaaagtctcttctaagattggtgtcattgaagcccttttagaaaaagtggataaattgctcattggcggcggcatgatcttcactttctataaagcgcgggggctcaatgttggcaagtctctcgtggaagaagacaaattggaactagccaagcacctggaaaccaaggcccaggagaaaggggtggagttgctcttgccaacagatgttgtcgtggcggataactttgccaacgatgccaatagccaagtggtcagtatcgaagcgattcctgacgactggatggggctagatattgggcctgcttctgtcaagcgcttccaagaggcactccaagattgcaaaacggtgatctggaacggcccaatgggggtgtttgagtttgatcaatttgccaaggggacagaggcgatcgcccgctatttggctgagcttaccagtcagggggtctgcacaattattggcggcggcgattctgtggctgctgtggaaaaagttggcgtcgccgatcgcatgagccacatttccaccggtggcggggcgagtcttgaactcctcgaaggcaaacaactgccaggtattgctgcccttgatgatgcctag

SEQ ID NO: 90800 - protein, 400 aa, Synechococcus elongatus
MSKKSVAQLSAADLEGKRVLVRVDFNVPVDEKGVITDETRIRAALPTIQDLISKGAKVILVSHFGRPKGVDEKLRLTPVAQRLSELLHKPVAKLDDCIGDAVIAHTQAMANGDVCLLENVRFHPGEEKNDPEFAKQLAACAEVYVNDAFGTAHRAHASTAGVTQYLSPCVAGFLMEKELEYLQNAIEHPRRPLAAIVGGSKVSSKIGVIEALLEKVDKLLIGGGMIFTFYKARGLNVGKSLVEEDKLELAKHLETKAQEKGVELLLPTDVVVADNFANDANSQVVSIEAIPDDWMGLDIGPASVKRFQEALQDCKTVIWNGPMGVFEFDQFAKGTEAIARYLAELTSQGVCTIIGGGDSVAAVEKVGVADRMSHISTGGGASLELLEGKQLPGIAALDDA

SEQ ID NO: 90801 - DNA, 1209 bp, Synechococcus sp
  CDS (1)..(1209): transl_table=11
atggcgaagcgttccctggccagccttaacgccggcgacctgagcggcaaacgcgttctcgtgcgggttgatttcaacgtgcccctgaacgaggccggtgcgatcaccgacgacacccgcatccgcgccgccctgcccacgatcaacgacctgatcggcaagggcgccaaggtcattctttctgctcacttcggccgccccaagggtcaggtgaacgacgccatgcgactcacccccgtggccgcccgcctgagcgaactgctgggcaagcccgtggccaagaccgacagctgcatcggccctgatgctgaagccaaggtgaacgccatggccgatggcgatgtggtgctgctggagaacgtgcgcttcttcgccgaggaggagaagaacgacgctgggttcgccgagaagcttgctggcttggctgaggtgtacgtgaacgatgccttcggcgccgcccaccgcgcccacgcctccaccgagggcgtgaccaagttcctcaagcccgcagtcgctggcttcctgatggaaaaggagcttcagtacctgcagggtgctgtggatgagcccaagcgtcctctcgctgccatcgtcggtggctccaaggtgagctccaagatcggcgtgctcgaggccctgatcgacaagtgcgacaaggtgctgatcggcggtggcatgatcttcaccttctacaaagcccgtggcctctcggtgggcaagagcctggtggaagaggacaagcttgaactggccaaggagctggaagccaaggccaaggccaagggcgttgagctgctgctgcccaccgatgtggtgctggccgacaacttcgcccccgatgccaacagccaggtggctgatgtcaccgccatccccgacggctggatgggtctggacatcggccctgatgcggtgaaggtgttccaggacgcccttggcgattgtcagaccgtgatctggaacggccccatgggcgtgttcgaattcgagaagttcgccaccggcaccaacgccatcgccacaaccctggcggagctcagcggcaagggctgctgcacgatcatcggcggtggtgactccgtggctgctgtggagaaggctggtctggccgacaagatgtcccacatctccaccggtggcggcgccagccttgaacttctagaaggcaaggtgctgcctggtgttgccgccctcaacgacgccgcctga

SEQ ID NO: 90802 - protein, 402 aa, Synechococcus sp
MAKRSLASLNAGDLSGKRVLVRVDFNVPLNEAGAITDDTRIRAALPTINDLIGKGAKVILSAHFGRPKGQVNDAMRLTPVAARLSELLGKPVAKTDSCIGPDAEAKVNAMADGDVVLLENVRFFAEEEKNDAGFAEKLAGLAEVYVNDAFGAAHRAHASTEGVTKFLKPAVAGFLMEKELQYLQGAVDEPKRPLAAIVGGSKVSSKIGVLEALIDKCDKVLIGGGMIFTFYKARGLSVGKSLVEEDKLELAKELEAKAKAKGVELLLPTDVVLADNFAPDANSQVADVTAIPDGWMGLDIGPDAVKVFQDALGDCQTVIWNGPMGVFEFEKFATGTNAIATTLAELSGKGCCTIIGGGDSVAAVEKAGLADKMSHISTGGGASLELLEGKVLPGVAALNDAA

SEQ ID NO: 90803 - DNA, 1206 bp, Synechocystis sp
  CDS (1)..(1206)
atgttgtctaagcaatcgatcgccaatttgacggaggcagacctcgcagggaaacgggtttttgtccgggtagattttaatgtgcccctagataacggcagcatcaccgacgacaccaggattcgggcagccttacccaccatcaaagacctgttgagcaaaggcgccaaagttattttgggcagtcattttggccgtcccaagggcaaagtagtggacagcatgcgcctcacccccgttggcgatcgcctaggggaattattgggccagccggtggtcaaatgcgacgattgcattggtgctgaagttacagccaaaattgctagcctacccaatggtggtgtggccctgttggaaaatctccgcttccatgccggggaagaaggtaacgatgctgaatttgccaaagctttagcggccaacgccgacctctacgttaacgatgcctttggtactgcccaccgggcccacgcttccaccgaaggggtcacccatttcctcagccccaacgttgctggttacctaatcgaaaaggaattacagttcctccaaggagccatcgaagcccccaaacgtcccctagtggcgatcgtgggaggttccaaagtgtccagtaaaatcggtgtgatcgaaaccctattggacaagtgcgataagttgatcatcggcggcggcatgattttcaccttctacaaagcccaaggtttaaacaccggcaaatccctggtggaagaagacaaattggacttggccaaatccctcatggctaaagccaaagaaaaaggcgtggaatttctcctgcccacggacgtagtagtggccgacaactttgcccccgatgccaatgcccaaaccgttggtgtcgatgcaattcccgatggttggatgggtctagacattggtcccgactccgtcaaaaccttccaggatgccctcgctggttgtggcactgtcatctggaacggccccatgggggtatttgaatttgacaaatttgccgttggtaccgaggcgatcgcctgcagcttggctgaattgaccgccagtggcactgtcaccatcatcggtggtggagattctgtcgccgcagtggaaaaagtgggagtggccgaaaaaatgagccatatttccaccggtgggggcgctagcctggaattgctagaaggtaaagttctgcccggcattgccgctttagatgaccgataa

SEQ ID NO: 90804 - protein, 401 aa, Synechocystis sp
MLSKQSIANLTEADLAGKRVFVRVDFNVPLDNGSITDDTRIRAALPTIKDLLSKGAKVILGSHFGRPKGKVVDSMRLTPVGDRLGELLGQPVVKCDDCIGAEVTAKIASLPNGGVALLENLRFHAGEEGNDAEFAKALAANADLYVNDAFGTAHRAHASTEGVTHFLSPNVAGYLIEKELQFLQGAIEAPKRPLVAIVGGSKVSSKIGVIETLLDKCDKLIIGGGMIFTFYKAQGLNTGKSLVEEDKLDLAKSLMAKAKEKGVEFLLPTDVVVADNFAPDANAQTVGVDAIPDGWMGLDIGPDSVKTFQDALAGCGTVIWNGPMGVFEFDKFAVGTEAIACSLAELTASGTVTIIGGGDSVAAVEKVGVAEKMSHISTGGGASLELLEGKVLPGIAALDDR

SEQ ID NO: 90805 - DNA, 1263 bp, Tetrahymena thermophila
  CDS (1)..(1263): transl_table=6
atgttgtctcgtaagattggtattgatcacatcttgaaacatattgaaaacaagagagttttaatgagagtagacttcaacgttcctttgaaggaaggtaaggttaaagatcctactcgtatctaaggttctgttccttctatcaagaaaatcttagagtaaaatcctaaaggtcttgtcttgatgagtcacttgggtcgtcctgatggcaacagagttgaaaagcactcaatgaagcctgttgttcctaagcttgaagaattactcggcaccaaggtaaccttcttgaatgactgtgttggtaaggatgtagaagaagctgttaaatcaagcagaaacggtgaaatcattttacttgaaaacttgcgtttccatcctgaagaagaaggaaagtacatcgatgctgcaggaaacaaggttaaggctgactctaaggcagttaaggaattcagaaaatctttgactagtttgggtgacttattcgtcaacgatgctttcggtaccgctcacagagctcactcttccatggtcggtgttgatcacaaaatcagagctgctggttacctcttgaagagagaattagactacttcagtaaggctttggaatcccctaacagacctttcttagttgtcttaggtggtgctaaggtcaaggataaaatctaattgattgaaagtatgcttgacaaggtcgatgaaatgatcattggtggtggtatggccttcactttcttgaagaaaatccacaatattgaaattggtaactccctcttcgacgaagaaggttataagattgttgaccaattgttagaaaaggctaaagctaagaatgtcaagatccatttaccagttgatttcttgtgcggtgactcacttgaagccaacgctaacacccgtagctttgacttaaagagtggtatccctgctggatggattggtttagatgctggtcctaagactatggctgaaaacgctgaagctgttgcccgtgctaacactattgtctggaatggtccttaaggtagattcgaagttgataagtttaaagtaggatcttctgaccttctcaagcacgttgctactagaacttcctaaggagctacttctattattggtggtggtgacactgtcaatcttgttcaacaagaaaaggcaactcaaaaagtcagccacgtctctactggtggtggtgcatctcttgaacttcttgaaggtaaagtccttcctggtgttgcttatcttactgatattgactaactttga

SEQ ID NO: 90806 - protein, 420 aa, Tetrahymena thermophila
MLSRKIGIDHILKHIENKRVLMRVDFNVPLKEGKVKDPTRIQGSVPSIKKILEQNPKGLVLMSHLGRPDGNRVEKHSMKPVVPKLEELLGTKVTFLNDCVGKDVEEAVKSSRNGEIILLENLRFHPEEEGKYIDAAGNKVKADSKAVKEFRKSLTSLGDLFVNDAFGTAHRAHSSMVGVDHKIRAAGYLLKRELDYFSKALESPNRPFLVVLGGAKVKDKIQLIESMLDKVDEMIIGGGMAFTFLKKIHNIEIGNSLFDEEGYKIVDQLLEKAKAKNVKIHLPVDFLCGDSLEANANTRSFDLKSGIPAGWIGLDAGPKTMAENAEAVARANTIVWNGPQGRFEVDKFKVGSSDLLKHVATRTSQGATSIIGGGDTVNLVQQEKATQKVSHVSTGGGASLELLEGKVLPGVAYLTDIDQL

SEQ ID NO: 90807 - DNA, 1173 bp, Thermus thermophilus
  CDS (1)..(1173): transl_table=11
atgcggacccttttggacctggaccccaagggcaagagggtcctggtgcgggtggactacaacgtccccgtccaagacgggaaggtccaggacgagacccggatcctggagagcctccccaccctccgccacctcctcgccgggggggcttccctcgtcctcctctcccacctgggccgccccaagggtcccgaccccaggtactccctggcccccgtgggggaggccttgagggcccacctcccggaggcccgcttcgcccccttccctccgggctcggaggaggcgaggcgggaggcggaggccctgaggcccggggaggtcctcctcctggagaacgtccgctttgagccgggggaggagaagaacgacccggagctttccgcccgctacgccaggctcggggaggccttcgtcctggacgccttcgggagcgcccaccgggcccacgccagcgtggtgggggtggcgaggctcctccccgcctacgccggcttcctcatggagaaggaggtcagggccctttcccgcctcctcaaggacccggaaaggccctacgccgtggtgctgggcggggccaaggtctcggacaagatcggggtcattgagagcctccttccccgcatagaccgcctcctcatcggcggggccatggccttcaccttcctcaaggccctagggggggaggtggggaagagcctggtggaggaggaccggctggacctggccaaggacctcttggggcgggccgaggccttgggggtcagggtctacctccccgaggacgtggtggcggcggagcgcatagaggcgggggtggagacccgggtcttcccggcccgggccatccccgtcccctacatgggcctggacatcggccccaagacccgggaggcctttgcccgggccctggaaggggcgaggacggtcttctggaacgggcccatgggggtctttgaggtgcctccctttgacgaggggaccttggccgtggggcgggccatcgccgccctcgagggcgccttcaccgtggtgggcgggggcgactcggtggcggcggtgaaccgcctgggccttaaggaccgcttcggccacgtctccaccgggggcggggcgagcctggagttcctggaaaagggcaccctgcccggcctcgaggtcctggaaggctaa

SEQ ID NO: 90808 - protein, 390 aa, Thermus thermophilus
MRTLLDLDPKGKRVLVRVDYNVPVQDGKVQDETRILESLPTLRHLLAGGASLVLLSHLGRPKGPDPRYSLAPVGEALRAHLPEARFAPFPPGSEEARREAEALRPGEVLLLENVRFEPGEEKNDPELSARYARLGEAFVLDAFGSAHRAHASVVGVARLLPAYAGFLMEKEVRALSRLLKDPERPYAVVLGGAKVSDKIGVIESLLPRIDRLLIGGAMAFTFLKALGGEVGKSLVEEDRLDLAKDLLGRAEALGVRVYLPEDVVAAERIEAGVETRVFPARAIPVPYMGLDIGPKTREAFARALEGARTVFWNGPMGVFEVPPFDEGTLAVGRAIAALEGAFTVVGGGDSVAAVNRLGLKDRFGHVSTGGGASLEFLEKGTLPGLEVLEG

SEQ ID NO: 90809 - DNA, 1271 bp, Thermus thermophilus
  CDS (28)..(1200)
gagctcgtcctgaagaagggggtctagatgcggacccttttggacctggaccccaagggcaagcgggtcctggtgcgggtggactacaacgtccccgtccaagacgggaaggtccaggacgagacccggatcctggaaagcctccccaccctccgccacctcctcgccgggggggcttccctcgtcctcctctcccacctgggccgccccaagggcccggaccccaagtactccctggccccggtgggggaggccttgagggcccacctcccagaggcccgcttcgcccccttccctccgggctcggaggaggcgaggcgggaggcggaggccctgaggcccggggaggtcctcctcctggagaacgtccgctttgagccgggagaggagaagaacgaccccgagctttccgcccgctacgccaggctcggggaggccttcgtcctggacgccttcgggagcgcccaccgggcccacgccagcgtggtgggggtggcgaggctcctccccgcctacgccggcttcctcatggagaaggaggtgagggccctttcccgcctcctcaaggacccggaaaggccctacgccgtggtgctgggcggggccaaggtctcggacaagatcggggtcattgagagcctccttccccgcatagaccgcctcctcattggcggggccatggccttcaccttcctcaaggccctagggggagaggtggggaggagcctggtggaggaggaccggctggacctggccaaggacctcttggggcgggccgaggccttgggggtcagggtctacctccccgaagacgtggtggcggcggagcgcatagaggcgggggtggagacccgggtcttcccggcccgggccatccccgtcccctacatgggcctggacatcggccccaagacccgggaggccttcgcccgggccctggaaggggcgaggacggtcttctggaacgggcccatgggggtctttgaggtgcctccctttgacgaggggaccttggccgtggggcaggccatcgccgccctcgagggcgccttcaccgtggtgggcgggggcgactcggtggcggcggtgaaccgcctgggccttaaagagcgcttcggccacgtctccaccgggggcggggcgagcctggagttcctggaaaagggcaccctgcccggcctcgaggtcctggaaggctaaggcgcgggcgtttagaatgggcctggggcgtggagccccaggccatggcttacggcaaggcccacctcgag

SEQ ID NO: 90810 - protein, 390 aa, Thermus thermophilus; identical to SEQ ID NO: 90498

SEQ ID NO: 90811 - DNA, 1185 bp, Thermoanaerobacter tengcongensis
  CDS (1)..(1185): transl_table=11
gtgaaaaagaaaactgtgagagacatagacgttagcggaaaaagagttttagttagagtagattttaacgtgccgatggatgaaaataaaaacataacagatgacaggcgcataagagaagctcttcccaccattgagtatttaataaatcacaacgcaaaagtgatactggtatctcacctggggagacctaaggggaaattcaatccggattactctttaaagcctgttgcaaaaaggctgtctgagcttttgaaaaagcctgtaattatggcagaggatgtgattggagaagatgctaaggtaaaagctgctgccttaaaagaaggggaagttctccttttggaaaatgttagattccatgcagaagaggagaagaatgaccctgaatttgcaaaagagcttgcatctttagcagatatatacgtaaatgatgcttttggcactgctcacagggctcacgcttctactgcaggagttgccaagtatcttccagcagtggcaggttttttaattgaaaaagagctttctataatgggagaagcgttggagaatcctaagagaccttttgtggcgattttaggtggagctaaagtttctgataaaattggggttataacaaatcttctggaaaaagtggacagcctgttaattggcggtggaatggcttatacctttattaaggcgaagggctacgaaatagggaaatctcttttggaagaggataaaattgaactagcaaaggaaataatggaaaaagcaaagcagaagggcgtaaatttcatgcttcctgttgatacagttatcgcgaaagagttaaaatccggggtaccttatgaagtggttgacattgacaaaatgccagaagaccagataggagttgacattgggcctaaaacaatagaagagtattcaaaagtgataaagcatgccatgacagttgtatggaatggaccaatgggagtttttgaaatacctgaatttgccaaaggtacaaaagctatcgcaaaggctttgagcgagtgcaaaggtacaacaatagtaggaggaggagattctgcagctgccatagaacagcttggctatgctgataaagtcacccacatttcaactggaggcggtgcgtcactggaatttttagaggggaaagtcttgccgggaattgacattttgaatgataagtaa

SEQ ID NO: 90812 - protein, 394 aa, Thermoanaerobacter tengcongensis
MKKKTVRDIDVSGKRVLVRVDFNVPMDENKNITDDRRIREALPTIEYLINHNAKVILVSHLGRPKGKFNPDYSLKPVAKRLSELLKKPVIMAEDVIGEDAKVKAAALKEGEVLLLENVRFHAEEEKNDPEFAKELASLADIYVNDAFGTAHRAHASTAGVAKYLPAVAGFLIEKELSIMGEALENPKRPFVAILGGAKVSDKIGVITNLLEKVDSLLIGGGMAYTFIKAKGYEIGKSLLEEDKIELAKEIMEKAKQKGVNFMLPVDTVIAKELKSGVPYEVVDIDKMPEDQIGVDIGPKTIEEYSKVIKHAMTVVWNGPMGVFEIPEFAKGTKAIAKALSECKGTTIVGGGDSAAAIEQLGYADKVTHISTGGGASLEFLEGKVLPGIDILNDK

SEQ ID NO: 90813 - DNA, 1227 bp, Thermoplasma volcanium
  CDS (1)..(1227)
atggctgatttctttctcatggattctttcgatctcgcaggaaggactatatatctaagggttgatataaactcacctgtgaatccagtaactggagaaataatgggtacagataggtttagggcccatgtcgagactattaggaagctaagagattcaaaggtcgttattgtggcccatcagagccggcctggaaaggatgattttacgtcgctgaggcagcacgcgcaggtcatgtcgcgtattttgaacaagaaagtaatgtttgtagatcagctcttcggatcacttgtaaacaagactgttgaatcaatgaatgagggagatatagtaatgctagaaaacgctaggttctattcagaagaagttgaccttacgactttagaatcgatggaaaattcaaacatagttaagggtctctctactctcttcgattactatattatagatgcgtttgccgcaatacatagggcacagaccacccttgtaggtttcaggaggataaagccaaacatagcaggtgcgcttatagagaaagaggttacaatgatcgataggttcaggcatctaaacgaatctccaaaaatagccatactaggcggcgcaaagatcgacgattctatcgctgtatcagagaatttcctgaaatccggcttcgttgataaaatactcaccggcggtgttgttgcgaacgcattcctttgggccaaaggcatcgacattggaaagaagaacagggacttcataataaaaaataacggagattacgagaagttgatcgctaagtgtaagggtctgctctccgagtttggtgataggatactggtaccgtcggatttcattttaagtccttcaggagaaagggtctccgcaaacggaaagattcctgacgatcagatacttgctgacattggactcgataccgtggtcgaatactccgaaataattgataaggctaaggcaatatttatgaatggcccaatgggtatatatgagatcgaagcgtattcatctggtactagggagatattttcttctgtagcaaaatcagaggcctttagcatagcaggtggagggcatactcttagcgcactggacaagcttggtctgacaaacaggatagatcatgcgtcaacaggcggaggggcactcataagctatttaagtggtgaagctatgccagtactcgaagcattgaaggaaagcaaacgtttgtttgaggtgtag

SEQ ID NO: 90814 - protein, 408 aa, Thermoplasma volcanium
MADFFLMDSFDLAGRTIYLRVDINSPVNPVTGEIMGTDRFRAHVETIRKLRDSKVVIVAHQSRPGKDDFTSLRQHAQVMSRILNKKVMFVDQLFGSLVNKTVESMNEGDIVMLENARFYSEEVDLTTLESMENSNIVKGLSTLFDYYIIDAFAAIHRAQTTLVGFRRIKPNIAGALIEKEVTMIDRFRHLNESPKIAILGGAKIDDSIAVSENFLKSGFVDKILTGGVVANAFLWAKGIDIGKKNRDFIIKNNGDYEKLIAKCKGLLSEFGDRILVPSDFILSPSGERVSANGKIPDDQILADIGLDTVVEYSEIIDKAKAIFMNGPMGIYEIEAYSSGTREIFSSVAKSEAFSIAGGGHTLSALDKLGLTNRIDHASTGGGALISYLSGEAMPVLEALKESKRLFEV

SEQ ID NO: 90815 - DNA, 1260 bp, Treponema denticola
  CDS (1)..(1260): transl_table=11
atgattaagactgtaaaagatgtaaatttaaaggataaacgcataataatgcgtgtagattttaacgttcctatgaaggacggagtagtgcaggatgatacgcggattagggcggctcttcctacaataaaatatatattggaacaaggagcaagaagccttgttttgatgagccatttgggtgatccttcaaaagatgcaaaaaaagccaaggaaaaggccgaaaaagacggaaaaccctttgatgaggaagcttatattaacggaaagcataggatgaaacctgttgcagaatacttatccggccttcttaaacttcctgttgattttgctccctcctgcatgggacagcttgaaagggtaaaagctcttccacagggcggaattctaatgcttgaaaacacccgcttccacaaagaagaaacttcaaaggaaaaggccgagcagcaaatcttggcaaaagaactcagcttgtacggtgatatctatgtaaatgatgcttttggaacggctcaccgctctcatgcttctacagccgaaattgccaactttgtcaatacaagggtagccggctttcttatggaaaaggaaattaaataccttgagccaatgttaaataatcctgcaaagccaatgacggcaattataggaggagcaaaggtttcttccaaaattgcagttttggaaagtcttttaaaaaatgcatcttctttaattataggaggaggaatggcctacaccttcttaaaggttcaaggaaaaaagatcggtaaatccttatttgaagaagattttatggatactgctaaaaatcttttggataaggctgaaaaacagggtgtaaagataatccttcctgttgatcatatctgttccgaaaccttttctcccaatgccgaagccgttttagttgaaagcacagatattcccgataatcttatgggaatggatgtaggccctaagaccttggctctttataaagagattattttgtcgtcaaagtccattgtctggaacggccccgtaggcgtttttgagtttgaggctttttcaaagggaacggaagaaactgcccgccttgtagcagctgcaacggaaaaaggtgcacttacaatcgtaggcggaggtgattcggttgctgccgtaaataagttcaatcttgccgataagatgagtcatgtttctaccggcggcggagcttccctcgaattccttgaaggaaaagttctccccggcattgcctgtcttgatactatttaa

SEQ ID NO: 90816 - protein, 419 aa, Treponema denticola
MIKTVKDVNLKDKRIIMRVDFNVPMKDGVVQDDTRIRAALPTIKYILEQGARSLVLMSHLGDPSKDAKKAKEKAEKDGKPFDEEAYINGKHRMKPVAEYLSGLLKLPVDFAPSCMGQLERVKALPQGGILMLENTRFHKEETSKEKAEQQILAKELSLYGDIYVNDAFGTAHRSHASTAEIANFVNTRVAGFLMEKEIKYLEPMLNNPAKPMTAIIGGAKVSSKIAVLESLLKNASSLIIGGGMAYTFLKVQGKKIGKSLFEEDFMDTAKNLLDKAEKQGVKIILPVDHICSETFSPNAEAVLVESTDIPDNLMGMDVGPKTLALYKEIILSSKSIVWNGPVGVFEFEAFSKGTEETARLVAAATEKGALTIVGGGDSVAAVNKFNLADKMSHVSTGGGASLEFLEGKVLPGIACLDTI

SEQ ID NO: 90817 - DNA, 1260 bp, Treponema pallidum
  CDS (1)..(1260): transl_table=11
atgatgctgagaacttgtaaagatgtcacaatgcgaggtgagcgtgttgtcgtgcgtgttgattttaacgtaccgatgcgtgatggtatggtgcaagacgacacgcgcgtcactgcagcagttcctactctgcggtacatcatcgagcaggggccgcgacacgtagtgctcattagccatcttggagaccctacccgtgatgcggataaagcagaggggaacgctaagaaagatggttgtccctttgaccgccacgcattcattaacggcaaacaccggcttaagccggttgcggactgccttgcaaagaagttgggggtgccggtgcattttgcgccttcctgcgtcgggcagcgtgaatttattgaagggctgcccgacggttcggtagtgcttttggagaatgtgcgctttcaccccgaggaaacatctggtgatgcgaaggtgcaggagcaatttgcgcgggagcttgcccagtatggggacatttttgttaatgatgcgttcggcactgcgcaccgtgaacatgcatctacggtggtactcccgagacttatgcgtcgcagagtggccggtcttttgatagagcgggaagtgaggtacctggaacctatggtatgcaacccgaaggtgccaatggtggcggttgtcggtggtgccaaggtatcttctaagatagcagtcttggagagtctgcttcgaacatcgacggcgcttatcatcgggggagggatggcatacacctttttgaaagcgcaaggtgtgggtgtaggtacctccctagtggaggatgactttatcgacactgcacgtatgctgttgcaaaaggctcaaagcggtggtgtgtcggtggtattgccggtcgatcacgtatgtgcgtccacgttctgtgcggatgcgcagccggttgcggtggacgatgtgcatattcctatgcacttgatgggtatggatgttggtccgcgtacgcttgagcagtatcgtgcgcatttaaagggagtgagctccgtgttgtggaatggtccggtaggggtttttgagttcgatgcctttgcacacggtacacgggtgcttgcgcagttgatagcagaggcgacggatgcgggtgctacgtcggtagttggtggaggagactctattgcagcagtcagcaagtttgggcttgcaagtcgcatgagccatgtatctacggggggtggcgcatcgctgaagctctttgagggtaaagttttaccgggcatttcgtgtcttgaaacatag

SEQ ID NO: 90818 - protein, 419 aa, Treponema pallidum
MMLRTCKDVTMRGERVVVRVDFNVPMRDGMVQDDTRVTAAVPTLRYIIEQGPRHVVLISHLGDPTRDADKAEGNAKKDGCPFDRHAFINGKHRLKPVADCLAKKLGVPVHFAPSCVGQREFIEGLPDGSVVLLENVRFHPEETSGDAKVQEQFARELAQYGDIFVNDAFGTAHREHASTVVLPRLMRRRVAGLLIEREVRYLEPMVCNPKVPMVAVVGGAKVSSKIAVLESLLRTSTALIIGGGMAYTFLKAQGVGVGTSLVEDDFIDTARMLLQKAQSGGVSVVLPVDHVCASTFCADAQPVAVDDVHIPMHLMGMDVGPRTLEQYRAHLKGVSSVLWNGPVGVFEFDAFAHGTRVLAQLIAEATDAGATSVVGGGDSIAAVSKFGLASRMSHVSTGGGASLKLFEGKVLPGISCLET

SEQ ID NO: 90819 - DNA, 1188 bp, Tropheryma whipplei
  CDS (1)..(1188): transl_table=11
ttgagaactcttggcggtttcacctttccttgtgatgctcctgtttttgtccgggttgatttcaatgtgcctatggatgaggtcggcacaataacggatgatctgcgtataagagcttcccttccgactatagaaagcttgcttggccgtggcgcgccacttatattgatttctcatctcgggcgaccggttaaaaatgagcagcaaggattttccctaaaaccctgtgctgagcgactatcggaatatatcggagtcaatgtaccgcttgtggattttcttgatctagatacaaagctttatggtgaacttactaggcatctggacaagtctgggatagttctttttgaaaatatacgattttttgccgaggaaacttcaaaggcacaggctgatcgaaggattctggctgagcaacttgcgccttttgcgggtgcgtatgtcaatgatgcctttggtgcttcccacaggaggcatgctagtgtgtatgagcttgcacaggctttctcaaataaggcggcaggctttctcattgaatcagagatgcaggctttttcacatcttgccagcgaggccaagcgtccctataccgttattctcggcggggcaaaattatcggacaagctacggcttatagagaatatcctgccaacggttgatcgtctgttactgtgtggtggaatggcatttacatttctagcggcacaggggtgtgaaacaggcaaaagtctcctggaagagagttttatctcggaggcaaataaaatcattgattttgctaagcaaaataatgttgaacttatacttccggtagatgttattgaggcgcgaagcctaacttcaccccttggggttgtaagtaaagctgaatctatatcttatatgggtcttgatataggtcctgaaactcagagtatctttagaaatgtaatacaagattcgaaaactgttttttggaatggcccggctggtttatttgaaaacccaagcttttcaaacggaacacgtgcactgcttgatgcattgtcgtcttctagcgcgtttacatttatcggaggaggcgatacagcagcagctgtcagccttcttggttttgattatggagattttagtcatgtttcaacaggcggtggtgcctgccttgaactgctagagggaaaaatattgccagcattagaggttttgtaa

SEQ ID NO: 90820 - protein, 395 aa, Tropheryma whipplei
MRTLGGFTFPCDAPVFVRVDFNVPMDEVGTITDDLRIRASLPTIESLLGRGAPLILISHLGRPVKNEQQGFSLKPCAERLSEYIGVNVPLVDFLDLDTKLYGELTRHLDKSGIVLFENIRFFAEETSKAQADRRILAEQLAPFAGAYVNDAFGASHRRHASVYELAQAFSNKAAGFLIESEMQAFSHLASEAKRPYTVILGGAKLSDKLRLIENILPTVDRLLLCGGMAFTFLAAQGCETGKSLLEESFISEANKIIDFAKQNNVELILPVDVIEARSLTSPLGVVSKAESISYMGLDIGPETQSIFRNVIQDSKTVFWNGPAGLFENPSFSNGTRALLDALSSSSAFTFIGGGDTAAAVSLLGFDYGDFSHVSTGGGACLELLEGKILPALEVL

SEQ ID NO: 90821 - DNA, 1188 bp, Tropheryma whipplei
  CDS (1)..(1188): transl_table=11
ttgagaactcttggcggtttcacctttccttgtgatgctcctgtttttgtccgggttgatttcaatgtgcctatggatgaggtcggcacaataacggatgatctgcgtataagagcttcccttccgactatagaaagcttgcttggccgtggcgcgccacttatattgatttctcatctcgggcgaccggttaaaaatgagcagcaaggattttccctaaaaccctgtgctgagcgactatcggaatatatcggagtcaatgtaccgcttgtggattttcttgatctagatacaaagctttatggtgaacttactaggcatctggacaagtctgggatagttctttttgaaaatatacgattttttgccgaggaaacttcaaaggcacaggctgatcgaaggattctggctgagcaacttgcgccttttgcgggtgcgtatgtcaatgatgcctttggtgcttcccacaggaggcatgctagtgtgtatgagcttgcacaggctttctcaaataaggcggcaggctttttaattgaatcagagatgcaggctttttcacatcttgccagcgaggccaagcgtccctataccgttattctcggcggggcaaaattatcggacaagctacggcttatagagaatatcctgccaacggttgatcgtctgttactgtgtggtggaatggcatttacatttttagcggcacaggggtgtgaaacaggcaaaagtctcctggaagagagttttatcccggaggcaaataaaatcattgattttgctaagcaaaataatgttgaacttatacttccggtagatgttattgaggcgcgaagcctaacttcaccccttggggttgtaagtaaagctgaatctatatcttatatgggtcttgatataggtcctgaaactcagagtatctttagaaatgtaatacaagattcgaaaactgttttttggaatggcccggctggtttatttgaaaacccaagcttttcaaatggaacacgtgcactgcttgatgcattgtcgtcttctagtgcgtttacatttatcggaggaggcgatacagcagcagctgttagccttcttggttttgattatggagattttagtcatgtttcaacaggcggtggtgcctgccttgaactgctagagggaaaaatattgccagcattagaggttttataa

SEQ ID NO: 90822 - protein, 395 aa, Tropheryma whipplei
MRTLGGFTFPCDAPVFVRVDFNVPMDEVGTITDDLRIRASLPTIESLLGRGAPLILISHLGRPVKNEQQGFSLKPCAERLSEYIGVNVPLVDFLDLDTKLYGELTRHLDKSGIVLFENIRFFAEETSKAQADRRILAEQLAPFAGAYVNDAFGASHRRHASVYELAQAFSNKAAGFLIESEMQAFSHLASEAKRPYTVILGGAKLSDKLRLIENILPTVDRLLLCGGMAFTFLAAQGCETGKSLLEESFIPEANKIIDFAKQNNVELILPVDVIEARSLTSPLGVVSKAESISYMGLDIGPETQSIFRNVIQDSKTVFWNGPAGLFENPSFSNGTRALLDALSSSSAFTFIGGGDTAAAVSLLGFDYGDFSHVSTGGGACLELLEGKILPALEVL

SEQ ID NO: 90823 - DNA, 1269 bp, Ureaplasma parvum
  CDS (1)..(1269): transl_table=4
atgaatagtttaaataaaaaaagtataaaagatcttgatgtaaatggtaaaacaatagttttacatttagatttaaatgttgttgttgattatgaaaataaacgcatattaaatgatcgtaaattacgagcatcactaccaactattaattatttaattaatcataacgctaaaattgttattttaagtcatttaggtcgaattaaaaccttagcagataaacaaagtggtaaatatagtttagaaattattgttgatgaactccgtaatcgtgtatccaagaatgttaatcgtgttgtattttcacctttaaattatggagaaacggtcgtacaaatggttaatgatttagaagaaagagacattttaattttagaaaatacgcgttattgtgatattagtgatgaaggtgaatatgttgggcttgaatgagatggttcagagattttaggacagttttggggaatgctaggggatatttttattgatgatgcatatggagttgctcatcgacaattatcatcaaattatcaaacagctaaatttgctaaaaaaagtgcattaggttttttaattgttaatgaaattaaccatctagatattgctttagaagttcctaaaagtccgtatttagctttaataggtggtaaccgtgttgctgataaaattgcagcaattgaagtattatgtgaacgggctgatcaagttattattgggggaggattagtctatacatttttatatgctcaagggtataacgttggtttaaatttagtagaacgcaatatgattgatgattgcaataatatattagaaaaatacggtaaaaaaattttaatttgttttgattttttatgtaacaatgattttagtgatacaagaccgatttatcgtaaaatagatgaaggtcttgaagggttatatggtttagatattggtaaaagaagtttaaaatttattaaacatgaaatttatcgttctaaaactattttactaaatggtccctttggtgttattgaaaatattaagaattatgcacaaggtactactgaaatatgtaaatcaatggcaaaacaaacaacacgtggcgcttatacaattatatgtgatatcgatacttcgagtcatgctgaatacctaggattagataaatatattaattttatatctactggtgggggcgctagcttatcatatattgaagaaggagttcttgatggtcttgaaaccattgataatgttcctttaaatgttttaaagaaggagtaa

SEQ ID NO: 90824 - protein, 422 aa, Ureaplasma parvum
MNSLNKKSIKDLDVNGKTIVLHLDLNVVVDYENKRILNDRKLRASLPTINYLINHNAKIVILSHLGRIKTLADKQSGKYSLEIIVDELRNRVSKNVNRVVFSPLNYGETVVQMVNDLEERDILILENTRYCDISDEGEYVGLEWDGSEILGQFWGMLGDIFIDDAYGVAHRQLSSNYQTAKFAKKSALGFLIVNEINHLDIALEVPKSPYLALIGGNRVADKIAAIEVLCERADQVIIGGGLVYTFLYAQGYNVGLNLVERNMIDDCNNILEKYGKKILICFDFLCNNDFSDTRPIYRKIDEGLEGLYGLDIGKRSLKFIKHEIYRSKTILLNGPFGVIENIKNYAQGTTEICKSMAKQTTRGAYTIICDIDTSSHAEYLGLDKYINFISTGGGASLSYIEEGVLDGLETIDNVPLNVLKKE

SEQ ID NO: 90825 - DNA, 1164 bp, Vibrio cholerae
  CDS (1)..(1164)
atgtctgtaatcaagatgattgacctggatcttgcaggtaaacgcgtatttatccgtgctgacctgaacgtaccagtaaaagacggcaaagtgacttctgatgcacgtatccttgcatcactacctaccattaagcactgcttggaagcgggcgcgaaagtaatggtcacttctcacctaggtcgtccaacggaaggtgagtacgctgaagagttctctctactgcctgtggttaactacctgaacgatgctctcgattgcgaagttcgcctagtgaaagactacctagacggcgttgaactgaacgcaggtgaactggttgttctggaaaacgttcgtttcaacaaaggcgaaaagaaaaacgaagaagcgctgtctaagaaatacgcggcactgtgtgacgtattcgtgatggatgcgtttggtactgcgcaccgtgctcaagcttctactcacggtgttggtatgtttgctcctattgcgtgtgcaggccctctactggctgacgaacttgaagcgctaggcaaagcgatggacaaaccagctcgcccaatggtggctatcgttggtggttcaaaagtatcaactaagctgactgtacttgagtcactgtcaaaaattgctgaccaactggtggttggcggtggtattgcgaacactttcatcgctgcagcgggtcacaacgtaggtaagtctctgtatgaagctgaccttgttgaaacagcgaaaaaactgatggaagagtgcgcgattcctgtggcgactgacgtagcttgtgccaaagctttcgatgagaacgcagaagccgaaatcaaacacgtttctgaagttcaagatgacgacatgattttcgacttgggtccaaactcaacggctgaactggctgagatcctgaaaaacgcgaaaactatcctgtggaacggcccagtaggcgtattcgaattcaagaactttgaagcgggtactcgtggtatcgcagaagcgatcgcacaatcagaaggcttctctgttgctggtggcggtgacacgctagcggcgatcgacaagtttggcatcaaagccgatgtttcttacatctctactggtggcggcgcgttccttgagttcgttgaaggcaaaaaactgcctgcagtagaaatgctggaagcacgcgctaaagcgtaa

SEQ ID NO: 90826 - protein, 387 aa, Vibrio cholerae
MSVIKMIDLDLAGKRVFIRADLNVPVKDGKVTSDARILASLPTIKHCLEAGAKVMVTSHLGRPTEGEYAEEFSLLPVVNYLNDALDCEVRLVKDYLDGVELNAGELVVLENVRFNKGEKKNEEALSKKYAALCDVFVMDAFGTAHRAQASTHGVGMFAPIACAGPLLADELEALGKAMDKPARPMVAIVGGSKVSTKLTVLESLSKIADQLVVGGGIANTFIAAAGHNVGKSLYEADLVETAKKLMEECAIPVATDVACAKAFDENAEAEIKHVSEVQDDDMIFDLGPNSTAELAEILKNAKTILWNGPVGVFEFKNFEAGTRGIAEAIAQSEGFSVAGGGDTLAAIDKFGIKADVSYISTGGGAFLEFVEGKKLPAVEMLEARAKA

SEQ ID NO: 90827 - DNA, 1185 bp, Wigglesworthia glossinidia brevipalpis
  CDS (1)..(1185)
atgaaaataataaaagttacagatttaaatttaaaagacaaaaaagtgcttataaggtctgatcttaatgttcctattaaaaatggtaaaattatgtgtaatatgcgaataataaaatctttagaaactataaatttcgtaataaaaaatgaagctaaatgtgttattgtagcatcccaccttgggaatcctatagaagaaaagtacgactataatttttctctaacacacattgtaaatcatatgaaaaaaattataaaatatccaataagattaatacaaaattatttaaacggttttgaagcaaaagaaaaagaaattattgttttagaaaacgtaagattcaatccaggagaaagaaaaaatgacaaaaatttatcaaaaaaatatgctaatttatgtgatatattagtcatggattctttcggatcttctcatagatcagaatcatcaacaacaggtattattaagtttgcacctattagttgcataggacttctttttttaaaagaaataaaatatttaaaaaaagcattatttaattctaaaagaccaatagttacaatttttggaggatcaaaaatatcaactaaattaggagttatagaaaaattatctaacatttctgaaaatgttttagtaggaggaggaatagcaaatactattcttttttctaaaggacataatataggaaaatctttacacgataaaaataatataagtaaaattaaaaaatttttatataaaaaaaatataataattccaaaagattttatagttactgataatattaataaattttcttcgtacaaagaaaaatctataaaagaaataaaaaacgaggattatatagttgatatagggaaaaaatcctgcgaatgttttattaaaattataaaaaaagcaaaaacaatattttggaacgggcctctaggcttgatagagattaaacaatttagaaatggaactaaagaaatagctaattctgtaattcatagttcagcaaaatcaataataggaggaggagaaacagttcttgctatgagaatgttcaattttattgatcgtttttcatatatttctacaggaggaggagcatttttatcttttatagaaaaacaagaacttcctgttctatcagaattaaaaaaattcaaaaaatatacaaactttaaacaaaactaa

SEQ ID NO: 90828 - protein, 394 aa, Wigglesworthia glossinidia brevipalpis
MKIIKVTDLNLKDKKVLIRSDLNVPIKNGKIMCNMRIIKSLETINFVIKNEAKCVIVASHLGNPIEEKYDYNFSLTHIVNHMKKIIKYPIRLIQNYLNGFEAKEKEIIVLENVRFNPGERKNDKNLSKKYANLCDILVMDSFGSSHRSESSTTGIIKFAPISCIGLLFLKEIKYLKKALFNSKRPIVTIFGGSKISTKLGVIEKLSNISENVLVGGGIANTILFSKGHNIGKSLHDKNNISKIKKFLYKKNIIIPKDFIVTDNINKFSSYKEKSIKEIKNEDYIVDIGKKSCECFIKIIKKAKTIFWNGPLGLIEIKQFRNGTKEIANSVIHSSAKSIIGGGETVLAMRMFNFIDRFSYISTGGGAFLSFIEKQELPVLSELKKFKKYTNFKQN

SEQ ID NO: 90829 - DNA, 1197 bp, Wolbachia pipientis wMel
  CDS (1)..(1197): transl_table=11
atgaatatacctagtatagaaaattgtgatcttcacaataaaaccgtcttactcagagttgacttcaatgttcctataaaagatggagaaattcgtgacgtcactcgtattttgagagcattgcctactattcagtatttagtgaatgcgagtgcaaagattattattatatcacattttggacgcccaaaggccagagacaataatctgtcgctaaaaaatgtaattgacactttatcgcagttactaaataaaaaagtgaaattcattgacgattgctttggtgaaaaagtacaaagagcagtaagtgttatggatgcaggagatataatattactagagaatctaagattttataaagaggaagagcaaagtgactcaaattttgccaaacaactagcatctctagcggatatatatgtaaatgatgcattttcttgctctcacagagctcacgcttctatttcacgcattacagaatttttaccctcttatgcagggttttgcttgcaagatgagctaaagtatcttgaaaaagctgtatcgtttaaagctaaacctattactgcgatagttgggggagctaaaatatcaactaaaataaaagtgcttatgaagctaacagaaaaggttaattacctagttctaggtggtgcaatagccaataattttttgtcattcagcaaagtaaatatagggaaatctttctttcaaaatggtgttgacgaccttctgcataatattcttgaaacagcaaataaaaacaattgcaaaatagttgtgccagaagacgtgctggttgcagtaaactctgattacagcactagtatttcaagaagaactgagtccattttggacggtgatataattttggatatcggaccacaaactttgagtacaataagcagtataatagcaagcagtaagactctgctgtggaatggacctattggtgtttttgaacattcagcttttgcaagcggtacaataggggtaatgaaaatcgtaagtgacttaacgcacaaaggaaagttaaccagcataatagggggaggcgatagtctatctgcaataagcgctgcaggccttgccgataaggattttacatatgtttccactggtggaggagcatttttagattggttaagtggcgatgaaatgccgggagttgctgctctgcaaaaacgattagattaa

SEQ ID NO: 90830 - protein, 398 aa, Wolbachia pipientis wMel
MNIPSIENCDLHNKTVLLRVDFNVPIKDGEIRDVTRILRALPTIQYLVNASAKIIIISHFGRPKARDNNLSLKNVIDTLSQLLNKKVKFIDDCFGEKVQRAVSVMDAGDIILLENLRFYKEEEQSDSNFAKQLASLADIYVNDAFSCSHRAHASISRITEFLPSYAGFCLQDELKYLEKAVSFKAKPITAIVGGAKISTKIKVLMKLTEKVNYLVLGGAIANNFLSFSKVNIGKSFFQNGVDDLLHNILETANKNNCKIVVPEDVLVAVNSDYSTSISRRTESILDGDIILDIGPQTLSTISSIIASSKTLLWNGPIGVFEHSAFASGTIGVMKIVSDLTHKGKLTSIIGGGDSLSAISAAGLADKDFTYVSTGGGAFLDWLSGDEMPGVAALQKRLD

SEQ ID NO: 90831 - DNA, 1206 bp, Wolinella succinogenes
  CDS (1)..(1206): transl_table=11
atggtagcgggtatcaatttaatgcaggaaaccaaaagcatcagagatgttgagatcgaggggaagcgggtcttaatccgtgtcgatttcaacgtgcccatggatagtgattttaatatctccgacgacactcgaattagggaggcgattcctacgatcaatcattgcatcgacaatggcgccaaaagcattgtccttgtaagtcatctaggaagacccagaggaaaaagttcggagttttcactcaagcatatcctcaaacgcctagagcgcctgctcaatcgtagcgtgatttttgtcgagagccttgagggcgtctcttcggtaatggcaaccctgccccagaagagcgtgattttgcttgaaaatattcgattccttgagggggaagagaagaatgacgaaaagctctccaagaacctcgcatcgctttgtgacatctacatcaatgatgcttttggagcttcacaccgcaagcatgcttccacctatggtgtggcgaagtttgcccctgtgaaggtggcgggattgcttcttaaaaaggagatcgattcttttgccaaggcgctcgctagtccgcttaagcctgtgcttttgatcgtgggaggatccaaggtctcttctaaaatcactctccttagcaacatccttgatgtggtcgataagattgtgattggtggggcgatgagtaacaccttcttgaagtcgctaggctatgatatgcagcgatcactagtggaagatcctcttgttcctgaagcggccaaaatcctagggctcgccaagcaaaaaggggtgaaaatttatcttcccgtggatgtggtttgcaccgatgacattaaaaatcccaaagagattaaaatcacccccgcccaagatgttcctgaaaacttccttgccgcggatattggacctgcaagcgtgaagctctttggcgaggtgattagggattgcgagacgatcatctggaatggacctatgggggtctatgaggtgcaaaacttctctcgaggaaccttccaattggcgcatgtggtggctgacacctatgcctatagcgtcattggagggggagatacggccgatgcgattgatagggcaggtgagaaagacaatatgagtttcacctccacggggggtggggcgagtttggagcttcttgaagggaagattcttcctgcttttgaggtgctagagcgaaaatag

SEQ ID NO: 90832 - protein, 401 aa, Wolinella succinogenes
MVAGINLMQETKSIRDVEIEGKRVLIRVDFNVPMDSDFNISDDTRIREAIPTINHCIDNGAKSIVLVSHLGRPRGKSSEFSLKHILKRLERLLNRSVIFVESLEGVSSVMATLPQKSVILLENIRFLEGEEKNDEKLSKNLASLCDIYINDAFGASHRKHASTYGVAKFAPVKVAGLLLKKEIDSFAKALASPLKPVLLIVGGSKVSSKITLLSNILDVVDKIVIGGAMSNTFLKSLGYDMQRSLVEDPLVPEAAKILGLAKQKGVKIYLPVDVVCTDDIKNPKEIKITPAQDVPENFLAADIGPASVKLFGEVIRDCETIIWNGPMGVYEVQNFSRGTFQLAHVVADTYAYSVIGGGDTADAIDRAGEKDNMSFTSTGGGASLELLEGKILPAFEVLERK

SEQ ID NO: 90833 - DNA, 1176 bp, Xanthomonas axonopodis
  CDS (1)..(1176): transl_table=11
atgtccattgtccgcatgaccgacctcgatctctccggcaagcgcgtgctgatccgccaggatctcaacgtgccgatcgacaacggccagatcacctccgaacagcgcatcaccgcctcggtgcccaccatcaagctagcgctggaaaaaggtgcggccgtcatggtgacctcgcacctgggccgccccaaggaaggcagctggaccgaagaagattcgctggcgccggttgccacgcgtctggccgcattgctgggcgtggacgtgccgctggtgcgcgactgggtcgatggcgtggaggtcgcgccgggccaggtggtgctgctggaaaactgccgcatgaatgtcggcgagggcaaggacgatgagacgctggcgcgcaagtacgccgcgttgtgcgacgtgttcgtgatggatgccttcggcaccgcgcaccgcgcgcaggcctccacgcatggcgtgatccgtttcgcgccggtcgccgcaggcggcccgctgttgatggccgaactcgacgccctggccaaggcgctggacaaccccgccaagcccttgctggcgatcgtggccggcagcaaggtgtccaccaagctggagctgctgtccaacctggtcaacaaggtcgaccagctgatcgtcggcggcggcatcgccaacaccttcatcgccgcggccgggcatgccgtgggcaagtcgttgaacgagccggatttgatcccgaccgccaaccggatcgtggccgatgccaaggcgcgtggcgccgagatcccgctgcccaccgatgtggtcgttgccaagcagttcctgcccgatgcgcaagccagcgtgaagtcgttggacgcggtcgacgcggacgatctgatcctggatatcggcccgcaaaccgcgcagcgctacgccgaactgatcgccagtgccggtaccgtggtgtggaacggtccggtgggcgtgttcgaattcgagtccttcagccacggcaccgaaaccctggcgcgcgcgatcgccagctccaaggcgttctcgatcgctggcggtggcgacaccctggccgcagtggacaaatacgacatcgcccaggacgtcacctacatttccacgggcggcggtgcgttcctggagtttctggaaggcaagaccttgccggcggtggccgcactccaggcccgcggtcagtga

SEQ ID NO: 90834 - protein, 391 aa, Xanthomonas axonopodis
MSIVRMTDLDLSGKRVLIRQDLNVPIDNGQITSEQRITASVPTIKLALEKGAAVMVTSHLGRPKEGSWTEEDSLAPVATRLAALLGVDVPLVRDWVDGVEVAPGQVVLLENCRMNVGEGKDDETLARKYAALCDVFVMDAFGTAHRAQASTHGVIRFAPVAAGGPLLMAELDALAKALDNPAKPLLAIVAGSKVSTKLELLSNLVNKVDQLIVGGGIANTFIAAAGHAVGKSLNEPDLIPTANRIVADAKARGAEIPLPTDVVVAKQFLPDAQASVKSLDAVDADDLILDIGPQTAQRYAELIASAGTVVWNGPVGVFEFESFSHGTETLARAIASSKAFSIAGGGDTLAAVDKYDIAQDVTYISTGGGAFLEFLEGKTLPAVAALQARGQ

SEQ ID NO: 90835 - DNA, 1176 bp, Xanthomonas campestris
  CDS (1)..(1176): transl_table=11
atgtccattgtccgcatgaccgacctcgatctttccggcaagcgcgtgctgatccgccaggatctcaacgtgccgatcgacaacggccagatcacctccgaacagcgcatcaccgcctcggtgcccaccatcaagctggcgctggaaaagggcgccgcggtgatggtgacctcgcacctgggccgcccgaaggaaggcacctggagcgaggaagattcgctggcgccggtggccgcgcgactgaccaccctgctgggcttggacgtgccgctggtgcgtgactgggtcgatggcgtggacgtggcgccgggccaggtggtgctgctggaaaattgccgcatgaacgtgggcgagggcaaggatgacgaagcgctcgcgcgtaagtacgccgcgctgtgcgatgtgtttgtcatggacgccttcggcaccgcgcatcgtgcgcaggcctccacgcatggcgtgatccggttcgcgccggtggcagccggtggcccgctgctgatggccgagctcgacgcgctggccaaggcgctggacaacccggccaagccgctgctggcgatcgtggccggcagcaaggtttcgaccaagctggaactgctctccaacctggtcaacaaggtcgaccagttgatcgtgggcggcggcatcgccaataccttcatcgccgcggccggccacgacgtgggcaagtcgctcagcgagccggacctgatcccgaccgccaaccagatcgtcgccgatgccaaggcacgcggcgcggagattccgttgcccaccgacgtggtggtggccaagcagttcctgcccgatgccgaggcgagcgtgaagtcgctcgaccaggtggatgccgacgatctgatcctggacatcggcccgcagaccgcggcgcactatgccgaactgattgccaatgccggcaccgtggtctggaacggcccggtcggcgtgttcgagttcgagcccttcagccatggcaccgagaccctggcgcgtgccattgccgcgtccaaggcgttctcgatcgccggtggtggtgacacgttggcggccgtggacaaatacgccatcgccaaggacgtcacctacatctccaccggcggcggcgcgttcctggaatttctggaaggcaaaaccttgccggcggttgccgcgctcgaggcccgcgggcagtga

SEQ ID NO: 90836 - protein, 391 aa, Xanthomonas campestris
MSIVRMTDLDLSGKRVLIRQDLNVPIDNGQITSEQRITASVPTIKLALEKGAAVMVTSHLGRPKEGTWSEEDSLAPVAARLTTLLGLDVPLVRDWVDGVDVAPGQVVLLENCRMNVGEGKDDEALARKYAALCDVFVMDAFGTAHRAQASTHGVIRFAPVAAGGPLLMAELDALAKALDNPAKPLLAIVAGSKVSTKLELLSNLVNKVDQLIVGGGIANTFIAAAGHDVGKSLSEPDLIPTANQIVADAKARGAEIPLPTDVVVAKQFLPDAEASVKSLDQVDADDLILDIGPQTAAHYAELIANAGTVVWNGPVGVFEFEPFSHGTETLARAIAASKAFSIAGGGDTLAAVDKYAIAKDVTYISTGGGAFLEFLEGKTLPAVAALEARGQ

SEQ ID NO: 90837 - DNA, 1194 bp, Xanthobacter flavus
  CDS (1)..(1194): transl_table=11
atgatcgccttccgcaccctcgatgacgccgtggacctcgccgacaagcgggtcctcgtccgtgtcgacctcaacgttcccatggagagcgggcgcgtcaccgacgccacccgtctcaaggccatcctgcccaccattcgggacatcaccggcaagggcggcaaggccgtcctgctggcgcacttagggcggcccaagggccgcgacgaaagccagtcgctcgcccccgtcgccaaggccctcgagggtgaactcggccgcaaggtcgcgttcgcctctgattgcatcggcgacgaggcgaagagcgccgtctcccgcctcgcctccggcgaggtgatcgtgctggagaacacccgcttccatgcgggcgaggagaagaacgcgccggacttcatcgaagccctcgcgagcctcggcgatatctatgtcaacgatgccttttccaccgcccaccgcgcgcacgcctccaccgaggggctggcccgcaagctgccggcctatgccggccgctccatggaaagcgagatcgaggcgctgaccaaggccctcgaggcgccccagcgccccgtgctcgccgtggtcggcggctccaaggtgtccagcaagctcgaactgctcggcaacctcgtgaagaaggtggacatcctcgtcatcggcggcggcatggccaacaccttcctcgccgctctcggcaagaaggtgggcaagtcgctctgcgagcacgacctggccaacaccgcgcgggacatcctgaagaaggccgaggcggccggatgcgagatcgtcctgccggtggacgcggtggtcgccaccgagttcaaggccaatgccgcgcaccgcgtcaccagcgtcgatgacgtgaaggacgacgagatgatgctggacgccggtccggagacggtcggcatcgtcaagcagaagctcgacggggcgaagacggtggtctggaacgggccgttcggcgcgttcgagatgacgccgttcgatgcggcgacggtggccgtggcccgctatgtcggcgacctcacccacaaggggcggttgctgtcggttgcgggcggcggcgacacggtggccgcgctgaaccatgcggggacggcggagcgcttctcctacgtctcgacggccggcggtgccttcctcgagtggctcgagggcaaggcgcttccgggcgtggaggccctgcggcgctga

SEQ ID NO: 90838 - protein, 397 aa, Xanthobacter flavus
MIAFRTLDDAVDLADKRVLVRVDLNVPMESGRVTDATRLKAILPTIRDITGKGGKAVLLAHLGRPKGRDESQSLAPVAKALEGELGRKVAFASDCIGDEAKSAVSRLASGEVIVLENTRFHAGEEKNAPDFIEALASLGDIYVNDAFSTAHRAHASTEGLARKLPAYAGRSMESEIEALTKALEAPQRPVLAVVGGSKVSSKLELLGNLVKKVDILVIGGGMANTFLAALGKKVGKSLCEHDLANTARDILKKAEAAGCEIVLPVDAVVATEFKANAAHRVTSVDDVKDDEMMLDAGPETVGIVKQKLDGAKTVVWNGPFGAFEMTPFDAATVAVARYVGDLTHKGRLLSVAGGGDTVAALNHAGTAERFSYVSTAGGAFLEWLEGKALPGVEALRR

SEQ ID NO: 90839 - DNA, 1176 bp, Xylella fastidiosa
  CDS (1)..(1176)
atgtccatcgtccgcatgactgatctcgctttatccggtaaacgcgtactgattcgtcaggacttgaatgtaccgattgatcagggtcgtattacttccgagcagcgcattattgcttcgcttccgacgatccgtgtagcgctggagcgtggtgcggcggtcatggtgacttcgcatctgggccgtccgaaggagggcgtgtggagtgaggaggattcattggcacccgtggcgaagcgcttgtctcaattgttggggattgaggttccgttgcgtcgcgattgggtggatggcgtgcaggttgcgccagggcagttggtgttattggaaaactgccgaatgaatgtcggcgaagctgagaatgacgaggcgttggcaaggaagtatgcggcgttatgtgatgtgttcgtgatggatgcgtttggcactgcgcaccgtgcccaggcatcaacgcatggggtgatctgttgtgctgcgattgctgccggcggtccgttgttgatggctgagttggatgctttgagccggggattggagcatccggtgaagccgctgctggcgattgtggggggcagtaaggtatcgacgaaactggagttgctttccaatttggtgaataacgttgagcaattgattacggggggaggcattgccaatacgttccttgccgcagccggttactccatcggtaagtcactgtatgagggggatttgatcgagactgctcgggagattattactgcggcgaaagcgcgtggcgctgagattccgttacccacggatgtggttgttgccaagcagtttttgcctggagtcacggcaacggtgaagacggtggatgcaatcgttgcggatgatcttattttggacattggtccgcagacggcacggcactatgctgccttgattgaaacggcggcgacggtggtctggaatggtccagtgggtgtgtttgagttcgatgccttcagcaaggggaccgaggtgttagcgcgggccgttgctgcctcgtctgcgttttcgattgctggtggcggcgataccttggctgccattgataagtatggtgttgcggaccagatcagctacatctccacaggcggcggtgcttttctggagtttttggaaggtaagacgttgccggcggtggctgccttgcaggcgcgcagcggataa

SEQ ID NO: 90840 - protein, 391 aa, Xylella fastidiosa
MSIVRMTDLALSGKRVLIRQDLNVPIDQGRITSEQRIIASLPTIRVALERGAAVMVTSHLGRPKEGVWSEEDSLAPVAKRLSQLLGIEVPLRRDWVDGVQVAPGQLVLLENCRMNVGEAENDEALARKYAALCDVFVMDAFGTAHRAQASTHGVICCAAIAAGGPLLMAELDALSRGLEHPVKPLLAIVGGSKVSTKLELLSNLVNNVEQLITGGGIANTFLAAAGYSIGKSLYEGDLIETAREIITAAKARGAEIPLPTDVVVAKQFLPGVTATVKTVDAIVADDLILDIGPQTARHYAALIETAATVVWNGPVGVFEFDAFSKGTEVLARAVAASSAFSIAGGGDTLAAIDKYGVADQISYISTGGGAFLEFLEGKTLPAVAALQARSG

SEQ ID NO: 90841 - DNA, 1254 bp, Yarrowia lipolytica
  CDS (1)..(1254)
atgtctcttaccaacaagctctccatcaaggatctcgatctcaagaacaagcgagtcttcatccgagtcgactttaacgttcctctcgatggcaccaccatcaccaacaaccagcgaattgttgctgccctgccctccatcaagtatgccattgatcagggtgccaaggctgtgatccttgcttctcatctcggccggcccaacggccagcgagtcgagaagtactctctcaagcccgtccaggccgagctttcaaagctccttggcaagcccgtcaccttccttgacgactgcgtcggccccaaggttgaggaggaggtctccaaggccaaggacggtgaggtcattctcctcgagaacctgcgattccaccccgaggaggagggatcccacaaggacgccgacggcaagaagatcaaggctgaccccgccaaggttgaggagttccgaaagtctctgacttctctcgccgatgtctacgtcaacgacgctttcggaaccgcccaccgagcccactcctccatggtcggcattgagcttccccagcgagccgctggtttccttgtcgccaaggagctcgagttcttcgccaaggctctggagcaccccgagcgacccttccttgccatccttggtggtgccaaggtctccgacaagatccagctcatcgacaacctacttgacaaggtcaacgccctgatcattggtggtggtatggctttcaccttcaagaagacccttgagaacgtcaagattggaaactctctcttcgacgaggatggatccaagattgtcgccggcctcgttgagaaggccaagaagaacaacgtcaagcttgtcttccccgtcgactacgtcaccgccgacaagttctccaaggatgccaaggttggccacgcaaccgacgctgagggtatccccgacggatggcagggtctggactgtggtcccaagtctatcgaggagttccagaaggtcattggcgagtccaagaccatcctctggaacggaccccccggtgtctttgagttcgacaacttcgccaagggtaccaaggctgtgcttgacgcctgtgtcaaggccgttgacaacggtgctaccgtgatcattggtggtggagataccgccactgtcgccaagaagtacggtgccgaggacaagctctcccatgtttccactggaggaggagcttctcttgagcttctcgagggtaagacccttcccggtgtcgctgctctctccgagaagaagtaa

SEQ ID NO: 90842 - protein, 417 aa, Yarrowia lipolytica
MSLTNKLSIKDLDLKNKRVFIRVDFNVPLDGTTITNNQRIVAALPSIKYAIDQGAKAVILASHLGRPNGQRVEKYSLKPVQAELSKLLGKPVTFLDDCVGPKVEEEVSKAKDGEVILLENLRFHPEEEGSHKDADGKKIKADPAKVEEFRKSLTSLADVYVNDAFGTAHRAHSSMVGIELPQRAAGFLVAKELEFFAKALEHPERPFLAILGGAKVSDKIQLIDNLLDKVNALIIGGGMAFTFKKTLENVKIGNSLFDEDGSKIVAGLVEKAKKNNVKLVFPVDYVTADKFSKDAKVGHATDAEGIPDGWQGLDCGPKSIEEFQKVIGESKTILWNGPPGVFEFDNFAKGTKAVLDACVKAVDNGATVIIGGGDTATVAKKYGAEDKLSHVSTGGGASLELLEGKTLPGVAALSEKK

SEQ ID NO: 90843 - DNA, 1164 bp, Yersinia pestis
  CDS (1)..(1164): transl_table=11
atgtctgtaattaagatgaccgatctggatctggctggcaaacgtgttttgatccgtgcggacctcaatgttccggtaaaagaaggcaaagtgacttctgatgcgcgtatccgtgcctctctgccaactatcgaagcggcattgaagcaaggcgctaaagtaatggttacctctcacttgggtcgcccgaccgaaggcgagtacaacgaagagttctccttactgcccgtcgttaactacctgaaagagaagttatcttctccggtacgtctggcgaaggactatctggacggcgttgaaattgcagctggcgagttggttgttctggaaaacgttcgctttaacaaaggcgagaaaaaagacgacgaagccctgtccaagaaatatgccgcactgtgcgatgtttatgtgatggatgcttttggtaccgctcaccgcgctcaggcatcgactcacggtgtgggtaaatttgcccctatcgcttgcgccggcccgctgttgtcagcagagctggaagcattgggtaaagcgctgggtaacccagcgcgtccaatggttgctatcgttggtggctctaaagtttcaactaaactgaccgtgctgggcgcgttgtctaaaatcgcggataaactgattgttggcggtggtatcgctaataccttcgttgcggctcaaggccacaatgtcggtaaatctctgtacgaagctgatctgatcccagaagcgaaaagactgctagagacctgtgatatccctgttcctactgatgttcgtgttgccactgagttctctgaaacggcagccgcgacgctgaaacccgcgaacgaaattaaagatgacgaacaaattttggatctgggcgacgaatctgcggagcgtctggctgagatcctgaaaaatgccaaaaccattctgtggaatggtccggttggtgtgttcgagttccctaacttccgtaaagggaccgagatcgtggctcgcgccattgcagaaagcgaagcattttctatcgcaggcggtggtgatactttggcagcaatcgatctcttcggtattgctgaccaaatctcctacatttctactggcggtggtgctttcctggagttcgtcgaagggaaaaaactgcctgccgtagtgatgctggaagagcgcgctaagcagtaa

SEQ ID NO: 90844 - protein, 387 aa, Yersinia pestis
MSVIKMTDLDLAGKRVLIRADLNVPVKEGKVTSDARIRASLPTIEAALKQGAKVMVTSHLGRPTEGEYNEEFSLLPVVNYLKEKLSSPVRLAKDYLDGVEIAAGELVVLENVRFNKGEKKDDEALSKKYAALCDVYVMDAFGTAHRAQASTHGVGKFAPIACAGPLLSAELEALGKALGNPARPMVAIVGGSKVSTKLTVLGALSKIADKLIVGGGIANTFVAAQGHNVGKSLYEADLIPEAKRLLETCDIPVPTDVRVATEFSETAAATLKPANEIKDDEQILDLGDESAERLAEILKNAKTILWNGPVGVFEFPNFRKGTEIVARAIAESEAFSIAGGGDTLAAIDLFGIADQISYISTGGGAFLEFVEGKKLPAVVMLEERAKQ

SEQ ID NO: 90845 - DNA, 1194 bp, Zymomonas mobilis
  CDS (1)..(1194): transl_table=11
atggcttttcgtacattagatgatattggtgacgtcaaaggtaagcgcgttcttgttcgcgaagatctgaacgttcctatggatggcgatcgcgttacggatgatactcgtctgcgcgctgcaatcccgaccgttaatgaattggctgaaaagggcgccaaagtccttattctggctcacttcggtcgtccaaaaggtcagccgaatcctgaaatgtccttggctcgcatcaaagatgcgctggctggcgttctgggtcgtccggttcacttcatcaatgacatcaaaggtgaagctgcagcaaaagccgttgatgccctgaatcctggtgccgttgctcttcttgaaaacacccgcttttatgctggtgaagaaaagaatgatccggctctggcagcagaagtagctaagctcggcgatttctatgtcaatgatgctttctcggctgctcaccgcgcccatgtttcgaccgaaggtctggctcacaagctgcctgctttcgctggtcgtgccatgcagaaagaattagaagctcttgaagctgcccttggtaagccgacccacccggtcgcagccgttgtcggtggtgctaaagtttctaccaagctcgacgttctgaccaaccttgtttccaaggttgaccatctgatcatcggtggtggtatggctaataccttcctcgctgctcagggtgttgatgttggtaaatcgctttgtgagcatgagctgaaagataccgttaaaggtattttcgctgctgctgaaaaaacgggctgcaaaatccatcttccgagcgatgtcgttgtcgccaaggaattcaaagccaatccgccgatccgtaccattccggtcagcgacgttgctgctgacgaaatgatccttgacgttggcccgaaagccgtcgctgctttgaccgaagttctgaaagcttccaagaccttggtctggaatggcccgttgggcgctttcgaaattgaacctttcgataaagctacggttgctctcgctaaggaagccgctgctttgaccaaagccggttctttgatctctgttgctggtggtggtgacacggttgccgctcttaaccatgctggtgtggcaaaagactttagctttgtctcaacggctggtggtgctttcctcgaatggatggaaggtaaagagctgccgggtgttaaagccctcgaagcttaa

SEQ ID NO: 90846 - protein, 397 aa, Zymomonas mobilis
MAFRTLDDIGDVKGKRVLVREDLNVPMDGDRVTDDTRLRAAIPTVNELAEKGAKVLILAHFGRPKGQPNPEMSLARIKDALAGVLGRPVHFINDIKGEAAAKAVDALNPGAVALLENTRFYAGEEKNDPALAAEVAKLGDFYVNDAFSAAHRAHVSTEGLAHKLPAFAGRAMQKELEALEAALGKPTHPVAAVVGGAKVSTKLDVLTNLVSKVDHLIIGGGMANTFLAAQGVDVGKSLCEHELKDTVKGIFAAAEKTGCKIHLPSDVVVAKEFKANPPIRTIPVSDVAADEMILDVGPKAVAALTEVLKASKTLVWNGPLGAFEIEPFDKATVALAKEAAALTKAGSLISVAGGGDTVAALNHAGVAKDFSFVSTAGGAFLEWMEGKELPGVKALEA

SEQ ID NO: 90847 - DNA, 26 bp, Primer
atgtctttatcttcaaagttgtctgt

SEQ ID NO: 90848 - DNA, 27 bp, Primer
ttatttcttttcggataagaaagcaac

SEQ ID NO: 90849 - protein, 556 aa, consensus
  MISC_FEATURE (1)..(556): consensus for the disclosure of xaa see table XV
KXXXXXVXXRXDXNVPXXXXXXXXXXXXXRIXXXXPTXXXXXXXXXXXXXXXSHXGRPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXPXXXXLXXXLXXXXXXXVXXXXXXXXXXXXXXXXXXXXGXXXXLENXRFXXXEXXXXXXXXXXXXXXXXXXXXXXXXXXXXXXXXXXXXXXDXXXXXVXDAFGXAHRXXXSXXGXXXXXXXXXXXXXXGXLXXXEXXXXXXXXXXXPXXPXXXIXGGXKVXXKXXXXXXXXXXXXXXXXXXGGXXXXTFXXXXXXXXXXXXXXXXXXGXSLXXXXXXXXXXXXXXXXXXXXXXXXXPXDXXXXXXXXXXXXXXXXXXXXXXXXXXXXXXXXXXXXXXXDXGXXXXXXXXXXXXXXXXXXXXXXXXXXWNGPXGVFEXXXXFXXGTXXXXXXXXXXXXXXXXXXXXGGGDXXXXXXXXXXXXXXXXXXXXSTGGGAXLEXXEGKXLPXXXXL

SEQ ID NO: 90850 - protein, 51 aa, consensus
  MISC_FEATURE (1)..(51): consensus for the disclosure of xaa see table XV
XXXXXDXNXPXXXXXXXXXXXXXXXXXXXXXXXXXXXXXXXXXXXXXHXXX

SEQ ID NO: 90851 - protein, 147 aa, consensus
  MISC_FEATURE (1)..(147): consensus for the disclosure of xaa see table XV
XXXNXRXXXXXXXXXXXXXXXXXXXXXXXXXXXXXXXXXXXXXXXXXXXXXXXXXXXXXXXXXXRXXXXXXXXXXXXXXXXXXXXXGXXXXXXXXXXXXXXXXXXXXPXXXXXXXXXXXXXXXXXXXXXXXXXXXXXXXXGXXXXXX

SEQ ID NO: 90852 - protein, 113 aa, consensus
  MISC_FEATURE (1)..(113): consensus for the disclosure of xaa see table XV
DXXXXXXXXXXXXXXXXXXXXXXXXXXXXXXGPXGXXEXXXXXXXXXXXXXXXXXXXXXXXXXXXXXXGGXXXXXXXXXXXXXXXXXXXXXSXXXXXXXXXXXXXXXXXXXXX

SEQ ID NO: 90853 - DNA, 2850 bp, Saccharomyces cerevisiae
  CDS (296)..(2725)
gattgctagcttggttttctgcttttgagaagaatcgaaaacgaacacaactgtaatttacaataaatcatctattagactgaaatttcattttctttattccaagtagttcaacgaccaagaaaaaaaaaatttatcaaaaaagtgcgtggtcactctagacggccgcgtctgtacaaatgaaaaatttgacatcgcagggtataaagattgggattgatatgcttaaaagggatttgatgcttgttttaatgagaaaaaaatatcaggagtataataacgtcaatatattaaaatgtcttctgtagaagaattgactcagctgttttcacaggttgggtttgaagataaaaaggtgaaggagattgtcaagaataaaaaggtttctgattcactttacaaattgattaaggagactccttcggactatcaatggaacaaatctactagagcgctagtacacaacctggcatcttttgtcaaaggtacagatctacccaagtctgaattaattgttaacggcatcattaatggtgatttgaagacatctctgcaagtcgatgccgcatttaaatatgtaaaggctaatggcgaggcatccaccaaaatgggtatgaatgaaaactctggtgttggtattgagattacagaggatcaggttagaaattacgtcatgcagtacattcaagaaaacaaggaaagaattttaactgaacgctataaactggtgccaggtatttttgccgatgttaaaaacttaaaggagctgaagtgggccgatccacgtagtttcaagccaattatcgaccaagaagtcttaaaacttttgggtccaaaggatgagagagacttaatcaagaagaagaccaagaataatgaaaagaagaaaaccaattctgccaagaagagttctgataattctgcatcatccggtccaaagaggactatgttcaatgaaggtttcctaggtgatttgcataaagtgggtgaaaacccacaagcttacccagaattaatgaaggaacaccttgaggttactggtggcaaagttcgtacaaggttccctccggagcccaatggatatttgcatattggtcattctaaagctattatggttaattttggctatgctaaatatcacaatggtacctgttatttaagatttgacgataccaaccccgaaaaggaagctcctgaatattttgaatccattaagagaatggtttcttggttaggttttaaaccatggaaaattacttactcaagtgattattttgacgagctttatcgcctcgctgaagtgttgatcaaaaacggcaaagcttacgtttgtcattgtaccgccgaagaaattaaaagaggtcgtggtattaaagaagacggtactccaggtggggagagatatgcttgtaagcatcgtgatcagtcgatagaacaaaacctgcaagaattcagagatatgagagatggcaagtacaaacctggtgaagctatcttaagaatgaaacaggatctaaattcaccaagcccacaaatgtgggacttgattgcgtatagagttttaaatgctccacatccaagaacgggaacaaaatggagaatttatcctacttacgattttacacattgtttggtcgattcaatggaaaatattacacattctttatgtactactgaattctacctatctagagaaagctatgaatggttatgtgatcaggttcatgtgttcagacccgctcaaagagaatatggtcgtttgaatatcaccggtacagttttatccaaaagaaaaattgcgcaattggtggatgaaaaattcgttagaggctgggacgatcctagactattcacgcttgaagctatacgcagacgtggtgttcctcctggtgccattttatcctttatcaacacattaggtgttaccacaagtaccacaaacattcaagttgtgaggtttgagagcgctgttagaaagtacctagaagataccacaccgagattaatgtttgtgttggatcctgttgaagttgttgtcgataatttatctgacgattatgaagaattggcaactattccttacagacctggtactccagaatttggtgaaagaactgtaccatttacaaacaaattctacattgaaaggtcagatttctcagaaaacgttgatgataaggaatttttcagattaacaccaaaccaaccagttggtttaattaaagtctcacacacagtttctttcaaaagtttggaaaaagatgaagctggtaaaattataagaattcatgtcaactatgataacaaggttgaagaaggttcgaaaccaaagaaaccaaaaacttatattcaatgggttcctatctcttcaaaatataattctccattgagagttactgaaactagggtttacaaccaattgttcaaatctgaaaatccatcttctcatcctgaaggcttcttgaaggacatcaacccagaaagtgaagtcgtttataaagaatctgtcatggaacataacttcggggacgttgtcaagaacagtccatgggtcgttgattctgttaaaaactcggaattttatgttgaagaagataaggattccaaagaagtgtgtagattccaagctatgagagtaggttatttcactctggataaagagagtacgacttctaaggttattttgaatagaatagttagcttgaaggacgcaacttccaagtgaatgatttaatgtgcatatatgtatatatttatatatatatcctattggttgaaaatgatgtaatagtgtaaattttttaattatattagataataaagaccaactcataatattgttacgtatta

SEQ ID NO: 90854 - protein, 809 aa, Saccharomyces cerevisiae
MSSVEELTQLFSQVGFEDKKVKEIVKNKKVSDSLYKLIKETPSDYQWNKSTRALVHNLASFVKGTDLPKSELIVNGIINGDLKTSLQVDAAFKYVKANGEASTKMGMNENSGVGIEITEDQVRNYVMQYIQENKERILTERYKLVPGIFADVKNLKELKWADPRSFKPIIDQEVLKLLGPKDERDLIKKKTKNNEKKKTNSAKKSSDNSASSGPKRTMFNEGFLGDLHKVGENPQAYPELMKEHLEVTGGKVRTRFPPEPNGYLHIGHSKAIMVNFGYAKYHNGTCYLRFDDTNPEKEAPEYFESIKRMVSWLGFKPWKITYSSDYFDELYRLAEVLIKNGKAYVCHCTAEEIKRGRGIKEDGTPGGERYACKHRDQSIEQNLQEFRDMRDGKYKPGEAILRMKQDLNSPSPQMWDLIAYRVLNAPHPRTGTKWRIYPTYDFTHCLVDSMENITHSLCTTEFYLSRESYEWLCDQVHVFRPAQREYGRLNITGTVLSKRKIAQLVDEKFVRGWDDPRLFTLEAIRRRGVPPGAILSFINTLGVTTSTTNIQVVRFESAVRKYLEDTTPRLMFVLDPVEVVVDNLSDDYEELATIPYRPGTPEFGERTVPFTNKFYIERSDFSENVDDKEFFRLTPNQPVGLIKVSHTVSFKSLEKDEAGKIIRIHVNYDNKVEEGSKPKKPKTYIQWVPISSKYNSPLRVTETRVYNQLFKSENPSSHPEGFLKDINPESEVVYKESVMEHNFGDVVKNSPWVVDSVKNSEFYVEEDKDSKEVCRFQAMRVGYFTLDKESTTSKVILNRIVSLKDATSK

SEQ ID NO: 90855 - DNA, 1635 bp, Aeropyrum pernix K1
  CDS (1)..(1635): transl_table=11
atgtcaatgctcctaggggaccatcctgagcttaggagtagggcgagggagatagcctccctggctgcaagggtcgtggagcaggtgaacagcatgcctgctggcgagcagaagaggctcctctcagaacagtatccggagctagcgaggtttgaagagcagcgcgagaaaggcgataaaggcctacccccgctgcccggggccgtggaaggcagggtcaagctgaggttcgcccccaacccagactttgtgatacacatgggcaacgctaggccggccatagtgaaccacgagtacgccaggatgtataaggggaggatggtgctgcggttcgaagacacagaccctaggacaaagactcccctacgggaggcgtacgacctcatccgccaggacctcaagtggcttggcgtttcctgggacgaggagtacatccagagcctcaggatggaggtcttctacagcgtagccagaagggctatagagcgggggtgcgcctacgtcgacaactgtgggagagagggtaaggagctgctctcgcgtggagagtattgtccgaccagggatcttggccccgaggataatctggagctgtttgagaagatgcttgaaggagagttttacgagggggaggctgttgtgaggatgaagacggacccgcgccaccccaaccccagcctgagggactgggtggccatgaggattatagacacggagaaacacccccaccccctcgtggggagcaggtacctggtgtggccgacctataacttcgccgtcagcgtcgacgaccacatgatggagataacccacgtgctcaggggtaaggagcaccagctgaacaccgagaagcagcttgccgtctacaggtgtatgggctggaggccgccgtacttcatccacttcggcaggctaaagctggaggggtttatactgagcaagagcaagataagaaagctcctcgaagagaggccaggagagttcatgggctacgacgacccccgcttcggcacgatagccgggctgaggaggaggggtgtgctggcggaggccataagacagataatactcgaggtgggggtcaagcccacggacgctacaataagctgggcaaacctggcggccgctaataggaagctgctggacgagcgggcggacaggataatgtatgtcgaagaccccgttgagatggaggtcgagctggcccaggtggagtgcagagccgcggagataccgttccacccgagccgcccccagaggaagaggaggataaccttgtgcacgggggacaaggttctcctcacaagggaggacgcagtagagggtaggcaactgaggctcatgggcctatcaaacttcaccgtcagccaaggcatattgagggaggtggatcccagcctcgagtatgcgaggagaatgaagctacctatagtacaatgggtgaagaagggcggagaagctagcgtagaggtactcgagcccgtcgagctggagctcaggaggcaccagggctacgctgaggacgctattaggggctatggggttgacagccgcctacagtttgtaaggtacggttttgtgagggtggacagcgtggaagacggggtctacagggtgatatacacacacaagtag

SEQ ID NO: 90856 - protein, 544 aa, Aeropyrum pernix K1
MSMLLGDHPELRSRAREIASLAARVVEQVNSMPAGEQKRLLSEQYPELARFEEQREKGDKGLPPLPGAVEGRVKLRFAPNPDFVIHMGNARPAIVNHEYARMYKGRMVLRFEDTDPRTKTPLREAYDLIRQDLKWLGVSWDEEYIQSLRMEVFYSVARRAIERGCAYVDNCGREGKELLSRGEYCPTRDLGPEDNLELFEKMLEGEFYEGEAVVRMKTDPRHPNPSLRDWVAMRIIDTEKHPHPLVGSRYLVWPTYNFAVSVDDHMMEITHVLRGKEHQLNTEKQLAVYRCMGWRPPYFIHFGRLKLEGFILSKSKIRKLLEERPGEFMGYDDPRFGTIAGLRRRGVLAEAIRQIILEVGVKPTDATISWANLAAANRKLLDERADRIMYVEDPVEMEVELAQVECRAAEIPFHPSRPQRKRRITLCTGDKVLLTREDAVEGRQLRLMGLSNFTVSQGILREVDPSLEYARRMKLPIVQWVKKGGEASVEVLEPVELELRRHQGYAEDAIRGYGVDSRLQFVRYGFVRVDSVEDGVYRVIYTHK

SEQ ID NO: 90857 - DNA, 2388 bp, Arabidopsis thaliana
  CDS (1)..(2388)
atggttctcaaagacgataactccgagaaatctattgagctcttcattagtattggtttggacgagaaaacagctcgtaataccatcaataataacaaggtcaccgccaatctcaccgccgttatccacgaggctgctgttactgatgggtgcgatcgaaatactggcaatctgttatactcggtcgctactaagttccctacaaatgctcttgtgcatcgccctacattgctcaagtacattgttaactctaagattaaaactccagcccaattggaagctgcatttgccttttttgccagtaccggtcctgaggactttaagctgaatgagtttgaagaggcatgtggtgttgggattgaagtttccccagaagatattgagaaagcagttaaaggaatctttgaagagaataagaaaacaatattggagcagcgctatcgaactaatgtgggtgaattatttggacatgtccggaaaagtttgccatgggccgatcctaagattgtaaagaaactcatagatgagaaaatgtatgagctgcttggtgagaaaaccgctgctgataatgaaaaacctacaaaaaagaaggagaagaaggagaagcctgccaaagtcgaggaaaagaaagctgtggtggaaactaccgcagagccatctgaagaggagcttaatccatatactatattccctcagccagaacaaaattttatggttcacacagaagtgtttttcagtgatggctctattctcagatgtagcaatacaaaggaagtacttgacaaacatctcaaggtgactggagggaaagtttatactcggttcccccctgaaccaaatggttatcttcatattggacatgccaaggctatgtttgttgattttggtcttgcaaaggagcgagggggttgctgttatctaaggtatgatgatacaaatccagaggcagaaaaggaagagtatattaatcatattgaagaaattgttaagtggatgggttgggaacccttcaagattacatacaccagtgattatttccaggaactgtatgatttggcagtggagttgattcggagaggtcatgcttatgttgatcatcagactgctgatgagataaaagagtacagagagaagaaaatgaacagcccctggagggacagacctattgaagaatctctaaaactttttgatgaaatgagacgaggcatcattgaggaagggaaggcaaccctaagaatgaagcaagatatgcagagtgacaattttaatatgtatgatcttattgcctatcgaataaagttcgcacctcatcctaaggctggtgacaagtggtgtatctatccgagttatgattatgcccactgcactgttgattctcttgagaatataacgcattcgctctgtactcttgaatttgaaacccggcgtgcttcatactattggctgttacattccctgagtctctacatgccatatgtgtgggaatattcacggttgaatgtgacaaacactgtaatgtccaagcgtaagttgaattacatagtgacaaacaagtatgttgatggttgggatgatccacgtcttttgacactttctggtttgagacggaggggtgtgacttcaactgcgattaatgcatttgtacgaggcattgggattactagaagtgatggtagcatgatacacgtaagtcgtcttgagcatcatattagagaggaattgaataaaacagcccctcgcaccatggtggtgcttaatcctcttaaagtggtcatcaccaatttggaatcagacaagcttatagagcttgatgccaaaaggtggcctgatgctcagaacgatgatccctcagcattctacaaggtaccgttctctagagttgtatacattgaccaatctgacttccgaatgaaggattcaaaagattattatgggctcgcccctggtaaatctgttttgctaagatatgctttcccaatcaagtgcaccaatgttgtctttgctgatgacaatgaaaccgttcgtgagattcatgcggaatatgaccccgagaaaaagtcaaagccaaagggggttctacactgggtcgctgaatcttccccaggagaagagcccataaaggtggaagtccgattatttgagaaactctttaactccgagaacccggctgaactcaatgatgcttggctcactgacattaacccaaactctaaaatggtaatttctggtgcctatgctgtatcaacccttaaagatgctgcagttggggacagattccaattcgagaggctaggttattacgcggtggacaaggactctgagccaggaaagcttgtgttcaaccggacggtcacactcagagacagctacgggaaaggtggaaagtaa

SEQ ID NO: 90858 - protein, 795 aa, Arabidopsis thaliana
MVLKDDNSEKSIELFISIGLDEKTARNTINNNKVTANLTAVIHEAAVTDGCDRNTGNLLYSVATKFPTNALVHRPTLLKYIVNSKIKTPAQLEAAFAFFASTGPEDFKLNEFEEACGVGIEVSPEDIEKAVKGIFEENKKTILEQRYRTNVGELFGHVRKSLPWADPKIVKKLIDEKMYELLGEKTAADNEKPTKKKEKKEKPAKVEEKKAVVETTAEPSEEELNPYTIFPQPEQNFMVHTEVFFSDGSILRCSNTKEVLDKHLKVTGGKVYTRFPPEPNGYLHIGHAKAMFVDFGLAKERGGCCYLRYDDTNPEAEKEEYINHIEEIVKWMGWEPFKITYTSDYFQELYDLAVELIRRGHAYVDHQTADEIKEYREKKMNSPWRDRPIEESLKLFDEMRRGIIEEGKATLRMKQDMQSDNFNMYDLIAYRIKFAPHPKAGDKWCIYPSYDYAHCTVDSLENITHSLCTLEFETRRASYYWLLHSLSLYMPYVWEYSRLNVTNTVMSKRKLNYIVTNKYVDGWDDPRLLTLSGLRRRGVTSTAINAFVRGIGITRSDGSMIHVSRLEHHIREELNKTAPRTMVVLNPLKVVITNLESDKLIELDAKRWPDAQNDDPSAFYKVPFSRVVYIDQSDFRMKDSKDYYGLAPGKSVLLRYAFPIKCTNVVFADDNETVREIHAEYDPEKKSKPKGVLHWVAESSPGEEPIKVEVRLFEKLFNSENPAELNDAWLTDINPNSKMVISGAYAVSTLKDAAVGDRFQFERLGYYAVDKDSEPGKLVFNRTVTLRDSYGKGGK

SEQ ID NO: 90859 - DNA, 1722 bp, Neisseria meningitidis Z2491
  CDS (1)..(1722): transl_table=11
atgccgtctgaagccatctgttcaaagaaaactatgctcaataaagaccaatttgcggacaaccattttatccgcaccatcatcgaagacgacctcaaaagcggcaaacacgaagccgtccaaacccgttttccgccggagcccaacggttacctgcacatcggacacgccaaatccatctgcctgaacttcggtttggcgtatatttacgacggcttgtgcaacctgcgttttgacgataccaaccccgaaaaagaaaacgacgaatacgtcaacgccatcaaagaagatgtcgagtggctcggtttccattgggcgggcgagccgcgtttcgcttccaactatttcgaccagctttatgactacgccgtcggtttgattaaagacggcaaagcgtatgtcgatgatttgacgcccgaagaaatgcgcgaataccgcggtacgctgaccgaagcgggtaaaaacagcccttaccgcgaccgcagcgtcgaagaaaacctcgacctgttcacacgcatgaaaaacggcgagttccccgacggcagcaaaaccctgcgcctgaaaatcgacatggcatcgggcaacatcaatatgcgcgaccccgtcatctaccgcatccgccgcgcccatcaccacaacaccggcgacaaatggtgtatctacccgatgtacgactacacgcattgcatctccgatgccatcgaaggcatcacgcattccttgtgtacgctcgaatttgaagcacaccgtccgctgtacgactgggtgttggataacatccacgcgccgcatgccacccgtccgcgccaatacgagttttcccgtttggagcttttgtacaccattacctccaaacggaaattgaatcagttggttgtggaaaaacacgtttccggctgggacgatccgcgtatgccgactatttccggtatgcgccgacgcggctacacgcccgaaggcctgcgtctgtttgccaaacgcgccggtatttccaaatctgaaaacatcgtcgatatgagcgtgttggaaggcgcgattcgcgaagagttggaaaattccgccccacgcctgatggcggtgttgaacccgctcaaagtgaccctgaccaactttgaagccggcagaacccaaagccgccgtgccgcgttccatccgaaccacgaggaaatgggcgagcgcgaagtacctatttcacaaaccatctatattgaagccgacgactttgccgaaaatccgcccaaaggcttcaaacgcctgattcccggcggcgaagtacgcttgcgccacggctatgtcatcaagtgcgatgaagtcgtcaaagacgaagcaggcaatgtggttgaactcaaatgcagcatcgaccacgacaccttgggcaaaaatccagaaggccgtaaagttaaaggcgtgattcattgggtttccgccgaacacgccgccgaaatcaaagtccgtctgtacgaccgcctctttaccatcgagcgtcccgatgccgtgcgcggcgaagacggcgaatacctgccgttcaccgatttcctcaatccggaatccgtcaaggaaatcaccgcctacgccgaacctgccgccaaagatttgccggcagaaagccgttggcagttcgagcgtatcggctacttcgtaaccgaccgtaaagaccacggcaaagacacgccggtgtttaaccgcacggtcacgctgaaagattcttggcagcctaagtaa

SEQ ID NO: 90860 - protein, 573 aa, Neisseria meningitidis Z2491
MPSEAICSKKTMLNKDQFADNHFIRTIIEDDLKSGKHEAVQTRFPPEPNGYLHIGHAKSICLNFGLAYIYDGLCNLRFDDTNPEKENDEYVNAIKEDVEWLGFHWAGEPRFASNYFDQLYDYAVGLIKDGKAYVDDLTPEEMREYRGTLTEAGKNSPYRDRSVEENLDLFTRMKNGEFPDGSKTLRLKIDMASGNINMRDPVIYRIRRAHHHNTGDKWCIYPMYDYTHCISDAIEGITHSLCTLEFEAHRPLYDWVLDNIHAPHATRPRQYEFSRLELLYTITSKRKLNQLVVEKHVSGWDDPRMPTISGMRRRGYTPEGLRLFAKRAGISKSENIVDMSVLEGAIREELENSAPRLMAVLNPLKVTLTNFEAGRTQSRRAAFHPNHEEMGEREVPISQTIYIEADDFAENPPKGFKRLIPGGEVRLRHGYVIKCDEVVKDEAGNVVELKCSIDHDTLGKNPEGRKVKGVIHWVSAEHAAEIKVRLYDRLFTIERPDAVRGEDGEYLPFTDFLNPESVKEITAYAEPAAKDLPAESRWQFERIGYFVTDRKDHGKDTPVFNRTVTLKDSWQPK

SEQ ID NO: 90861 - DNA, 1653 bp, Thermoplasma acidophilum DSM 1728
  CDS (1)..(1653): transl_table=11
atgatgatgtacgaagatgatatcagaaggatagcactaataaatgcatatcagcacgagggaaaagccgatctcaagtctgtcatgggaaaggtcatggcggagattccggatctcaggcgcgatccccgatcagctagggagatggtctctcgcattgtagacgaggtcaattcaatgagtgcctatgagataagggaaaccgtagagaccagatacacctcatcgataagaaaggagaaaaaagtagaggaacatcgtcttccagatctcgagggagtaaacgggccggtagtaatgaggatggccccatctccgtccggaccactgcatattggccacaccaggatggcaatactcaacgacgagtatgtcaaaaggtatggcggcgaactgattctcaggatagaggatacaaatccgaaaaacatagatccagatgcatatcatatgataccggaggatcttgaatggcttggcgtgaacgtgacgaagatcgttatacagagtgacaggttcgatctgtactatgcagaagcaaagaagctgatggaaaacggccatatgtatgtctgcacctgccccagggaggagttcaagaagaggaagctagaatcaataccatgcaaagatcgcgataaccctcctgaaaccaatcttgaactcttcgataagatgatcgatggcaccataaaggaaggagacgccgttgcagtggtgaagactgatctaaaacatcctaacccttcggtgagggactggatagcattcaggatcatagaagcaaggcatccgagggtcgatgacaaataccgcgtctatcctatgatgagcttcagcgttgccgtggacgaccattatcttggcctgactcatgtccttagaggaaaggatcagctcacaaacaccgacaaacagaggtacattttcgattacaatggctggaaaaagccatactattaccattatgggatgataaaattcccgggaatcaagctgaaaacatctctgatgaaaaaggggatactcagcggacagtacgagggatggtctgatatcaggctcggaactgtgagggcttttgcaaagagaggctacagaccggagaccttcaggcgatactggataaactccggactgcgcgaaatagatgcgatcttctcgatagaaatatttgactccataaaccgtgagatcgtggatcctagagcgtaccgcttctcgtttgtaaaggatcctgtaccagttcgcatagagggcatgccaaacatcagcgcgaaactaccattgcatccaacgcacccagagtacggcttcagagaatatgaagttaagggctcagtttacatagccagtcgggattttgccgctatttcagagggcgagagaataaggctgaaggatctatgttacattagaaaaaaggggaacggcataatctatgacggtgttgaaatgacagagaaaaccaagataatcaactggtgcccagaggggtctagggacttctccgtactgaaacctgatggatcgaaggacagtggccttatagaaccaaaatcctcaggatatcgtggaatcgcacaacttgaaagatacgggtacgtcaactttgctgatggagatgatctggcctatttcactcacccctga

SEQ ID NO: 90862 - protein, 550 aa, Thermoplasma acidophilum DSM 1728
MMMYEDDIRRIALINAYQHEGKADLKSVMGKVMAEIPDLRRDPRSAREMVSRIVDEVNSMSAYEIRETVETRYTSSIRKEKKVEEHRLPDLEGVNGPVVMRMAPSPSGPLHIGHTRMAILNDEYVKRYGGELILRIEDTNPKNIDPDAYHMIPEDLEWLGVNVTKIVIQSDRFDLYYAEAKKLMENGHMYVCTCPREEFKKRKLESIPCKDRDNPPETNLELFDKMIDGTIKEGDAVAVVKTDLKHPNPSVRDWIAFRIIEARHPRVDDKYRVYPMMSFSVAVDDHYLGLTHVLRGKDQLTNTDKQRYIFDYNGWKKPYYYHYGMIKFPGIKLKTSLMKKGILSGQYEGWSDIRLGTVRAFAKRGYRPETFRRYWINSGLREIDAIFSIEIFDSINREIVDPRAYRFSFVKDPVPVRIEGMPNISAKLPLHPTHPEYGFREYEVKGSVYIASRDFAAISEGERIRLKDLCYIRKKGNGIIYDGVEMTEKTKIINWCPEGSRDFSVLKPDGSKDSGLIEPKSSGYRGIAQLERYGYVNFADGDDLAYFTHP

SEQ ID NO: 90863 - DNA, 1665 bp, Escherichia coli K12
  CDS (1)..(1665): transl_table=11
atgagtgaggcagaagcccgcccgactaactttatccgtcagatcatcgatgaagatctggccagtggtaagcacaccacagtacacacccgtttcccgccggagccgaatggctatctgcatattggccatgcgaaatctatctgcctgaacttcgggatcgcccaggactataaaggccagtgcaacctgcgtttcgacgacactaacccggtaaaagaagatatcgagtatgttgagtcgatcaaaaacgacgtagagtggttaggttttcactggtctggtaacgtccgttactcctccgattattttgatcagctccacgcctatgcgatcgaactgatcaataaaggcctggcgtacgttgatgaactgacgccggaacagatccgcgaataccgcggcaccctgacgcaaccgggtaaaaacagcccgtaccgcgaccgcagcgttgaagagaacctggcgctgttcgaaaaaatgcgtgccggtggttttgaagaaggtaaagcctgcctgcgtgcgaaaatcgacatggcttcaccgtttatcgtgatgcgcgatccggtgctgtaccgtattaaatttgctgaacaccaccagactggcaacaagtggtgcatctacccgatgtacgacttcacccactgcatcagcgatgccctggaaggtattacgcactctctgtgtacgcttgagttccaggacaaccgtcgtctgtacgactgggtactggacaacatcacgattcctgttcacccgcgccagtatgagttctcgcgcctgaatctggaatacaccgtgatgtccaagcgtaagttgaacctgctggtgaccgacaagcacgttgaaggctgggatgacccgcgtatgccgaccatttccggtctgcgtcgtcgtggttacactgcggcttctattcgtgagttctgcaaacgcatcggcgtgaccaagcaggacaacaccattgagatggcgtcgctggaatcctgcatccgtgaagatctcaacgaaaatgcgccgcgcgcaatggcggttatcgatccggtgaaactggttatcgaaaactatcagggcgaaggcgaaatggttaccatgccgaaccatccgaacaaaccggaaatgggcagccgtcaggtgccgtttagcggtgagatttggattgatcgcgccgatttccgcgaagaagctaacaagcagtacaaacgtctggtgctgggtaaagaagtgcgtctgcgtaatgcttatgtgattaaggcagaacgcgtcgagaaagatgccgaaggtaatatcaccaccatcttctgtacttatgacgccgataccttaagcaaagatccggcagatggtcgtaaagtcaaaggtgttattcactgggtgagcgcggcacatgcgctgccggttgaaatccgtttgtatgaccgtctgttcagcgtgcctaacccaggtgctgcggatgatttcctgtcggtgattaacccggaatcgctggtgatcaaacagggctttgctgaaccgtcgctgaaagatgcggttgcgggtaaagcattccagtttgagcgtgaaggttacttctgcctcgatagccgccattctacggcggaaaaaccggtatttaaccgcaccgttgggctgcgtgatacctgggcgaaagtaggcgagtaa

SEQ ID NO: 90864 - protein, 554 aa, Escherichia coli K12
MSEAEARPTNFIRQIIDEDLASGKHTTVHTRFPPEPNGYLHIGHAKSICLNFGIAQDYKGQCNLRFDDTNPVKEDIEYVESIKNDVEWLGFHWSGNVRYSSDYFDQLHAYAIELINKGLAYVDELTPEQIREYRGTLTQPGKNSPYRDRSVEENLALFEKMRAGGFEEGKACLRAKIDMASPFIVMRDPVLYRIKFAEHHQTGNKWCIYPMYDFTHCISDALEGITHSLCTLEFQDNRRLYDWVLDNITIPVHPRQYEFSRLNLEYTVMSKRKLNLLVTDKHVEGWDDPRMPTISGLRRRGYTAASIREFCKRIGVTKQDNTIEMASLESCIREDLNENAPRAMAVIDPVKLVIENYQGEGEMVTMPNHPNKPEMGSRQVPFSGEIWIDRADFREEANKQYKRLVLGKEVRLRNAYVIKAERVEKDAEGNITTIFCTYDADTLSKDPADGRKVKGVIHWVSAAHALPVEIRLYDRLFSVPNPGAADDFLSVINPESLVIKQGFAEPSLKDAVAGKAFQFEREGYFCLDSRHSTAEKPVFNRTVGLRDTWAKVGE

SEQ ID NO: 90865 - DNA, 1743 bp, Pyrococcus furiosus DSM 3638
  CDS (1)..(1743): transl_table=11
atgtcatttttccaggggagaaagatggaagtagaaaagcttgcactcaagtacgctctaataaatgcaatagagcacgacggtaaagctaatccaaaggcagtcatagggaaaatactcggagaaaaccccgagctcagaaagaaggccagagaaattgttccaatagttaataaaattgtagaggaagttaataccctctcactggaagagcagaaaaagaaacttgaagaaatttatccagagtacttcatggaaggcactaaaaaagaaaaagaggagaaaaagcaactccccccactacctaaagcagaaaagggtaaggttgtaacaagatttgctccaaatccagacggtgcttttcacctggggaatgctagagcagcaatattaagctatgagtatgccaaaatgtacgatggaaagtttattctaaggttcgatgacacggatccaaaggtaaagaggccagagctaatattctacgacatgataatagaagacttagaatggttagggataaaaccagacgaaattgtttatgcaagtgataggcttgaaatttattacaaatacgcagaagagctcataaaaatgggaaaggcatatgtatgtacttgcccaccagatgagtttaggaagttaagggatcaaggaattgcttgcccccatagagatgaacccgtagaggtgcaactggaaagatggaaaaaaatgctaaatggagaatatagagagggagaggccgtagttagaattaaaactgatttaaaccacccaaatccagcggttagagattggcccgctcttagaattgttgatgagccaaatcacccaaggactggaaataagtatagggtatggcctctctacaactttgcttcggcaatagatgaccacgaattaggagttactcacatcttcagagggcaagaacactcagaaaatgagacgaggcaaaggtatatctacgagtattttggatgggaatatccagtaacagttcatcacggaagactgtcaattgaaggagtaattctcagcaagtcaaagactagaaaggggatagaggaagggaaatatctaggatgggatgatcccaggttgggaaccataagggccttaagaaggagaggaatcttgccggaagcaataagagagctaatcctggaggttggacttaaaaagagcgacgcaaccgtaagctgggataacctagctgcaataaatagaaaactcgttgatccaatagcaaatagatacttctttgttgcagacccgattcccatgtatatagaggaggccgaagagtttgaggcaaagatacctcttcacccagatcatccagaaaggggatacagagtgctaaaattcgaaccgggaaagccaatttatgtctcaaaagacgatctaagcttgttaaagccaggaggatttattagactaaaggacttatttaacgtcgaaattttagaggtaggggatacaataaaggcgagattccacagccatgaatatgaagtcgcgaggaaaaacaagtggagaatgattcactgggttccagagggtaaagagtgtgaggtaataattccagaaggagaagagctaataatcagaaagggcctactggaaaagaatgccaacgtaaaagaaggagaaatagtgcagtttgaaagatttggatttgtaaggattgacaaaatagaaaacgacaaagttatcgcaatatatgcccacaaatga

SEQ ID NO: 90866 - protein, 580 aa, Pyrococcus furiosus DSM 3638
MSFFQGRKMEVEKLALKYALINAIEHDGKANPKAVIGKILGENPELRKKAREIVPIVNKIVEEVNTLSLEEQKKKLEEIYPEYFMEGTKKEKEEKKQLPPLPKAEKGKVVTRFAPNPDGAFHLGNARAAILSYEYAKMYDGKFILRFDDTDPKVKRPELIFYDMIIEDLEWLGIKPDEIVYASDRLEIYYKYAEELIKMGKAYVCTCPPDEFRKLRDQGIACPHRDEPVEVQLERWKKMLNGEYREGEAVVRIKTDLNHPNPAVRDWPALRIVDEPNHPRTGNKYRVWPLYNFASAIDDHELGVTHIFRGQEHSENETRQRYIYEYFGWEYPVTVHHGRLSIEGVILSKSKTRKGIEEGKYLGWDDPRLGTIRALRRRGILPEAIRELILEVGLKKSDATVSWDNLAAINRKLVDPIANRYFFVADPIPMYIEEAEEFEAKIPLHPDHPERGYRVLKFEPGKPIYVSKDDLSLLKPGGFIRLKDLFNVEILEVGDTIKARFHSHEYEVARKNKWRMIHWVPEGKECEVIIPEGEELIIRKGLLEKNANVKEGEIVQFERFGFVRIDKIENDKVIAIYAHK

SEQ ID NO: 90867 - DNA, 1929 bp, Encephalitozoon cuniculi
  CDS (1)..(1929): transl_table=11
atggatggaaagagcgagttcaaggaggagctcatcaactacattttgctgaagaagtatggcaagggggcgcaggatccgccagtgtattccaatgcattgaagaaagcaccccaggagatgtttcctccgggtcttgtggatgctcttgattcgtattccataaacctgagccgctctgagggagtggagtttctagtgttgctaaactcccttgtgaatgatatccgctctgaggaggtcaaggacattatatttgggatgattaacacaaaccagatgttgaccaagctcatgaaggacaaaaaggaagtggagagattcccggatacctgcaagatgtattcggaacagttcaaagcaaacaagcctctactgaaggagttcaatgcaggatccaggaaggagcaggggaaccttgagattggagaaccctccgagaatgttgtgactagattcccccctgaaccgaatgggcgcctccacatagggcatgcaagagcagcattactgaactggtactttgcaagcaaaggaaacggacggcttttggtcaggttcgatgacacaaacccagaaaaggaagaagagaggttcgaaaggggaattctctcggacctcagccttctggggattaatgagtacaccctttcgcacaccagtgactatttcgataagattattgacctgggggtttttttgattggggagggaaaggcgtatgcagataatactccacaggaggtgatgagagacgagagaggaaggggcgttgagtctaggtgcagaagcatggatgtagaagaaagcaaaaggatatttaaggaaatggccaggggaaatgcctcgggatattgcctaagagcaaagatcgacatgtcgagctccaacaaggccatgagagaccctgttatctttagggtgaatgaatcgcctcaccacagaacaggagataagtacaaggtctatcctacatacgactttgcatgtcccattgttgacagcctggaggggatcacactgtcgcttagggcgaacgagtacagggacagaaaccagcagtactactggttcattgacaaccttcggcttagaaacagacccaaaatccacgacttctcaaggcttaacttcgagaacacggttcttagcaaaagaaagcttaagtattatgtcgataacggatttgtatctggatgggacgacccaaggctggcgacgattgcaggaataaagaggcttgggatgaatatggaggcgctgagggagtacatcctgatgcaaggggtttcccaaaagacctgcactatctcctgggacaaggtgtgggcgattaacaggaaaaaaatcgatcccgtttccgcaagatatttctgtgtccagcaaagagatgccgttgaggtatcgattgacaacacgtctgaatacacgatggatgttccaaagcacaagaagaacggagatcttgggacaaaggaggttttctattcaagccagatattgctttctcaagaggacggcagagtgctgcaggacaacgaggagtttacactgatgaactggggaaatgctattgtgaagagcaaaaccgttgaaaatggaactgtgaccaaaatggaagtgtccttgaatccggatggagactttaagctgacaaagaacaaaatgtcctgggtttcgaagagagggtcagtgactgttgagcttgctgaatacggcaacctgatgaatgatgaggacacagaagacctggcattgaggtttaacaggaactctgtcaagaaggaatattggtacgctgagtctgctattataaatgttagagagggagaagtaatccaatttgagcgaaacgggttttattattgcgacggatttctggtatttaatttactaccctttaccaagcaaaagagaacgggcaattaa

SEQ ID NO: 90868 - protein, 642 aa, Encephalitozoon cuniculi
MDGKSEFKEELINYILLKKYGKGAQDPPVYSNALKKAPQEMFPPGLVDALDSYSINLSRSEGVEFLVLLNSLVNDIRSEEVKDIIFGMINTNQMLTKLMKDKKEVERFPDTCKMYSEQFKANKPLLKEFNAGSRKEQGNLEIGEPSENVVTRFPPEPNGRLHIGHARAALLNWYFASKGNGRLLVRFDDTNPEKEEERFERGILSDLSLLGINEYTLSHTSDYFDKIIDLGVFLIGEGKAYADNTPQEVMRDERGRGVESRCRSMDVEESKRIFKEMARGNASGYCLRAKIDMSSSNKAMRDPVIFRVNESPHHRTGDKYKVYPTYDFACPIVDSLEGITLSLRANEYRDRNQQYYWFIDNLRLRNRPKIHDFSRLNFENTVLSKRKLKYYVDNGFVSGWDDPRLATIAGIKRLGMNMEALREYILMQGVSQKTCTISWDKVWAINRKKIDPVSARYFCVQQRDAVEVSIDNTSEYTMDVPKHKKNGDLGTKEVFYSSQILLSQEDGRVLQDNEEFTLMNWGNAIVKSKTVENGTVTKMEVSLNPDGDFKLTKNKMSWVSKRGSVTVELAEYGNLMNDEDTEDLALRFNRNSVKKEYWYAESAIINVREGEVIQFERNGFYYCDGFLVFNLLPFTKQKRTGN

SEQ ID NO: 90869 - DNA, 2094 bp, Encephalitozoon cuniculi
  CDS (1)..(2094): transl_table=11
atggcagatcttgagaagattcttgaaaggctggggatttctcctgaaaagcggtgtcaggtgattaaaaaagagcaggtggttcggaacatggagaagatctttctggggagggacctttcgaataggttgctgtatacattagcctgcattgctccaaagaatgctgatcttgggctgttggcggatctggttgatgctcgggtcatcaagcatgagagcatgctgaaggaatgtctgcgatacacggagaagaaggatgtttcgatggaggagatgactcggtttgtgaagaggaacgaggtttcctctgaagatgtgcggaagtttgttgccaagatgagaagcgatagagtggcgaagaaggacatggtcagtaaggcaaggaaggccatgccctgtgcagacttcagggttgttgttgaggagattaataaggtccctgatgatgtagatggtggagatgagaaaaggcctttagaggggggttggctggaagagggggagattaagaagcttccgaagccttcggagattccccagatcaacgaggagataaggcaggcccatctacggaggacaggggggagggttgtcaccaggtttccgcctgagcctaatggaattcttcacattgggcatgcaaaggcaataaacctgaacttcgaatatgccaaaaagtttggaggatatacctatctgagatacgacgacacaaaccccaagaacgaggaggcagagtacttcgattcgatctacgaggatgtccggtggcttggatttgagccctacaaggtcactgcctcaagcgattatttcgacaagatgactgagtttggttttcagcttataagaaaaggaaaggcatatgtctgccacctaagccaggatgaaatatgcgaaagaagaagacagtatgtgtctgatggaacgaatgacagatcgcacctgagccagtacagagacaggcctgtctcggagaatctgaggctctttcaggagatggttgacggtaaatgggaagaggggaaggcatgcctcagattcaagatggacactgacacaaagaaccccctgatgcttgatcttgtgggcattcggatattggacgtggtgcatcccaggaaaaacgtgaagtatactgtgtatccaacctatgagtttgctctttgtgtatctgacagcctggaggacgtaacgcactccttctgtacaagggagttttatacgaggcaggagagctataactggctacttgtccagcttgagatctacaagcccatccagtgggaatttagcaggctgaatataagcaacactgttctgagcaagagaaagctgcttcctctgaagaagtacgggattgagctagacgatcctcggctgtttacgatcaaagggatgaggagaagaggcttccccccggaagccatcaaccagttctgccgaagcctcgggttcacctttgcagaaacaacggttgatgtgaagaagctcgagaactttgttagagacaatctcaataggacctctcgaagaatcatgtgtgtgaaggagcctctaaaggtgacgataatgaattcgacgccgtgcagtatatctattccggaccttcccgggtcgagtgttgtcagagatgttccatttactcctgtcatatacatagagaagtcggactttatggagaagggagacaaggacttcctgaggctgacccctgagcagcctgttgggctttacatgctttacccaataagagtcgtgaaggtcactccggacgggattgtagccgagagatgggatggagttccaaggaagtttatacactgggttagcgaagactctgtcgaagtagagatgaggatgtattcctcactctggacatcgttcagcccgaaggatgccacctatcttgaagagatgaacaaagacagcctcaaggtcttccacgggctctgcgacaagagaatttcagatgcaaggatcgaagacaggttccagttccagcgcataggatacttctgcgtggacaaagacacgaccaaagaaaacattgttgttaatcttacgattcctctcaagaacattgcttga

SEQ ID NO: 90870 - protein, 697 aa, Encephalitozoon cuniculi
MADLEKILERLGISPEKRCQVIKKEQVVRNMEKIFLGRDLSNRLLYTLACIAPKNADLGLLADLVDARVIKHESMLKECLRYTEKKDVSMEEMTRFVKRNEVSSEDVRKFVAKMRSDRVAKKDMVSKARKAMPCADFRVVVEEINKVPDDVDGGDEKRPLEGGWLEEGEIKKLPKPSEIPQINEEIRQAHLRRTGGRVVTRFPPEPNGILHIGHAKAINLNFEYAKKFGGYTYLRYDDTNPKNEEAEYFDSIYEDVRWLGFEPYKVTASSDYFDKMTEFGFQLIRKGKAYVCHLSQDEICERRRQYVSDGTNDRSHLSQYRDRPVSENLRLFQEMVDGKWEEGKACLRFKMDTDTKNPLMLDLVGIRILDVVHPRKNVKYTVYPTYEFALCVSDSLEDVTHSFCTREFYTRQESYNWLLVQLEIYKPIQWEFSRLNISNTVLSKRKLLPLKKYGIELDDPRLFTIKGMRRRGFPPEAINQFCRSLGFTFAETTVDVKKLENFVRDNLNRTSRRIMCVKEPLKVTIMNSTPCSISIPDLPGSSVVRDVPFTPVIYIEKSDFMEKGDKDFLRLTPEQPVGLYMLYPIRVVKVTPDGIVAERWDGVPRKFIHWVSEDSVEVEMRMYSSLWTSFSPKDATYLEEMNKDSLKVFHGLCDKRISDARIEDRFQFQRIGYFCVDKDTTKENIVVNLTIPLKNIA

SEQ ID NO: 90871 - DNA, 2328 bp, Mus musculus
  CDS (1)..(2328)
atggctactccagattcgctagcgctgttcaccggccttggccttagcgagaacaaggcccgcgagacgctcaagaacgaggctctgagcactcagctgcgcgaggcggcgacccaggcacaccagattctgggttctaccatcgacaaggctactggggtcctcctatatgacttggtctcccgactcagggatactcggcgtcgttctttccttgtgagctatatagccaataagaagattcacacgggactccagctgagcgctgctcttgaatatgttcggagtcatccccaggatcccattgataccaaggacttcgagcaggagtgtggcgtcggtgtggtggtgacaccggagcagattgaggaagctgtggagtccaccataaataagcatcagttgcagctcctagcggaacggtaccgtttcaacatggggctgctaatgggagaggctcgggctgcgctcagatgggcagacggcaaaatgatcaagaacgaggtggatatgcaggtgcttcaccttttggggcccaagatggaagctgatctggtgaagaagcccaaggtggcaaaggcacggctggaagaaacagaccggaagacagcaaaagatgtggtggagaaaggtgaagtggctggccagaccctgtctctgatggagcagctccggggggaggcacttaagtttcataagccaggtgagaactacaagacgccaggctatgtgatcactccatataccatggatctgctgaagcagcacctggagatcactgggggacaggtacgtacgcggttccctccagagcccaatggaatcctgcatattggacacgccaaagccatcaatttcaactttggttatgccaaggccaacaatggtatctgttttctgcgctttgatgacaccaaccctgagaaagaagaagcaaaattcttcactgctatttatgacatggtgacctggctgggttatacaccttacaaagtgacatatgcttctgactattttgaccagctgtatgcctgggccgtggaactcatccatgggggtcttgcttatgtgtgtcaccagagagtggaagagctcaaaggccataaccctttaccttctccatggagggacaggcctaaggaagaatcattgctgctctttgaggcaatgcgcaagggcaaatttgcagaaggagaggccacacttcgaatgaagttggtgatggaagatggcaagatggaccccgtggcctatcgagtcaagtacacgccacaccatcgcacaggggacaaatggtgcatctaccccacctatgactacacacattgtctgtgtgactccattgagcacattacccactcgttgtgtaccaaggagttccaggctcgacggtcttcctacttttggttatgtaacgctctgaaagtctattgtcctgttcagtgggaatatggtcgcctcaatttgcactatgctgttgtctcaaagcgcaagattctccagcttgtagcagctggtgctgttcgggactgggacgatccacggctcttcacactcactgccctacgacgacggggttttccaccagaggctatcaacaacttctgtgctcgggttggggtcacagtggcacagaccacaatggaacctcatcttctggaagcctgtgtgcgtgatgtgctgaatgatgcagccccacgtgccatggctgttctagagccactacaagttgtcatcaccaactttcctgctcccaagcccttggacatccgagtgccaaatttcccagctgatgagaccaagggtttccaccaggttccttttgcttccactgtcttcattgagagaagcgactttaaggaggagtcagaaccaggctataagcgcctagcttcgggccagcctgtgggcctgagacacactggttatgtcattgaactgcagaatattgtcaggggctccagtggctgtgtggaacgcttggaggtgacctgtagacgagctgatgctggagagaagcccaaggcctttattcactgggtatcacagcctttggtgtgtgagattcgcctctatgagcgcctattccagcacaagaaccccgaagaccctgttgaagtgcctggtggattcctaagtgacctgaacccggcgtcactacaagtggtagaaggagcattagtggactgctctgtggctttggcaaagccctttgacaagttccagtttgagcgccttgggtacttctctgtggatccagacagccatcaaggacagattgtcttcaaccgaactgtcacactaaaagaagacccaggcaaaatatga

SEQ ID NO: 90872 - protein, 775 aa, Mus musculus
MATPDSLALFTGLGLSENKARETLKNEALSTQLREAATQAHQILGSTIDKATGVLLYDLVSRLRDTRRRSFLVSYIANKKIHTGLQLSAALEYVRSHPQDPIDTKDFEQECGVGVVVTPEQIEEAVESTINKHQLQLLAERYRFNMGLLMGEARAALRWADGKMIKNEVDMQVLHLLGPKMEADLVKKPKVAKARLEETDRKTAKDVVEKGEVAGQTLSLMEQLRGEALKFHKPGENYKTPGYVITPYTMDLLKQHLEITGGQVRTRFPPEPNGILHIGHAKAINFNFGYAKANNGICFLRFDDTNPEKEEAKFFTAIYDMVTWLGYTPYKVTYASDYFDQLYAWAVELIHGGLAYVCHQRVEELKGHNPLPSPWRDRPKEESLLLFEAMRKGKFAEGEATLRMKLVMEDGKMDPVAYRVKYTPHHRTGDKWCIYPTYDYTHCLCDSIEHITHSLCTKEFQARRSSYFWLCNALKVYCPVQWEYGRLNLHYAVVSKRKILQLVAAGAVRDWDDPRLFTLTALRRRGFPPEAINNFCARVGVTVAQTTMEPHLLEACVRDVLNDAAPRAMAVLEPLQVVITNFPAPKPLDIRVPNFPADETKGFHQVPFASTVFIERSDFKEESEPGYKRLASGQPVGLRHTGYVIELQNIVRGSSGCVERLEVTCRRADAGEKPKAFIHWVSQPLVCEIRLYERLFQHKNPEDPVEVPGGFLSDLNPASLQVVEGALVDCSVALAKPFDKFQFERLGYFSVDPDSHQGQIVFNRTVTLKEDPGKI

SEQ ID NO: 90873 - DNA, 1740 bp, Methanosarcina acetivorans C2A
  CDS (1)..(1740): transl_table=11
ttgtttatttcaggagaaactcctatgaccttaagtcctgaagatcttaaaacaatagaaaaatacgcccttcaaaatgctgtaaaatacgaaaaagcccctcagtccaaagctgtaatgggcaaggtaatgggggagtgtccccagctgagggccaatcctggggccgtctcgacggcacttaaatccattgtttctgaaatcgctaaaggaaaccccgaagcctggaaaacccggctgtcggaaattgcccccgagctaatagaagccctgaatgtaaagaaagagcctgagaagggtttaaagcccctcgaaggggcagagcccggaaaagtcgtaatgcgttttgctccgaaccccaatgggcccgggaccctgggcagtgcaaggggtatggtggtcaattccgagtacgtaaagatgtataagggcaagtttgtcctgcgctttgacgataccgatcctgatattaagcgccccatgcttgaagcttatgactggtacctggacgacttcaaatggctcggggtcgtgcctgaccgggttgtctacgcttcggaccatttccccatctattacgattatgcaagaaagctgatcgagatgggcaaagcctatgtctgtttctgtaaaggggaagacttcaaaaggttaaaggacgccaagcaggcctgtccgcacagggacacgagccctgaagaaaacctcatgcactgggaaaagatgcttgccggggaatatgaagaccagcaggcagtgctccggattaagaccgatatcgaacataaggatcctgcgctgagggactggggggcattcaggatcagaaagatgtcccacccccgcgctgaaatcggaaacaaatacgttgtctggccccttctggactttgcaggcgcaatcgaagaccatgagctcggcatgacccatatcattcggggtaaagaccttatagacagcgaaaagcggcagggctacatctacaaatacttcggctggacctacccgaaaacaactcactggggcagggtcaagatccacgagttcgggaagttcagcacgagcagcctcaggaaagccattgaagccggagaatacagcggctgggatgaccccaggcttcccacaataagggcaatccgacgccgtggaatacaggctgaagcccttaaaaagttcatgatcgaaatgggagtcgggatgactgatgtgagtatcagtatggagtccctttatgccgaaaaccgcaaaatcgtggaccccgttgcaaacaggtacttctttgtctgggctcctgtagaactggaaattgcaggtatggagcctacggttgcaaaacttccgctccacccgactgatcattccagaggtgtaagggaaatcgccgtgggaaataaggtgcttgtctgcgctgaagacgttgaaaagctggaacttggttccgtcatccgcttaaaagatttctgcaacatcgaaatcacttccctttccccgcttcaggcaaaacactctgatgtctctctcgaagcccttaaaaaagcaaaagcaaagatcgtccactgggctccagttgacggaatttctgttaaagtgcgcggcccagaaggcgatcttgaaggaatcggagaaaaaggaatagtgggagaacttgacaaaattgtacagtttgaacgtttcggcttctgcagaattgatgccgtaagcgaagaaaaagttgtggcgtactttgcccacaaatga

SEQ ID NO: 90874 - protein, 579 aa, Methanosarcina acetivorans C2A
MFISGETPMTLSPEDLKTIEKYALQNAVKYEKAPQSKAVMGKVMGECPQLRANPGAVSTALKSIVSEIAKGNPEAWKTRLSEIAPELIEALNVKKEPEKGLKPLEGAEPGKVVMRFAPNPNGPGTLGSARGMVVNSEYVKMYKGKFVLRFDDTDPDIKRPMLEAYDWYLDDFKWLGVVPDRVVYASDHFPIYYDYARKLIEMGKAYVCFCKGEDFKRLKDAKQACPHRDTSPEENLMHWEKMLAGEYEDQQAVLRIKTDIEHKDPALRDWGAFRIRKMSHPRAEIGNKYVVWPLLDFAGAIEDHELGMTHIIRGKDLIDSEKRQGYIYKYFGWTYPKTTHWGRVKIHEFGKFSTSSLRKAIEAGEYSGWDDPRLPTIRAIRRRGIQAEALKKFMIEMGVGMTDVSISMESLYAENRKIVDPVANRYFFVWAPVELEIAGMEPTVAKLPLHPTDHSRGVREIAVGNKVLVCAEDVEKLELGSVIRLKDFCNIEITSLSPLQAKHSDVSLEALKKAKAKIVHWAPVDGISVKVRGPEGDLEGIGEKGIVGELDKIVQFERFGFCRIDAVSEEKVVAYFAHK

SEQ ID NO: 90875 - DNA, 1704 bp, Buchnera aphidicola str. Sg (Schizaphis graminum)
  CDS (1)..(1704): transl_table=11
atgagatttaaaaaaatgaacaataaaatagaaaaaaatgataataattttatttataaaattattaatgaagatttcaaaaaaaataaaaatttgttattgcatacgcgttttcctcctgaacctaatggatatcttcatattggacatgctaaatcaatatgtttaaattttgaacttgcaaatgtatacaatggatattgtaatcttcgtttcgatgatacaaatccagttaaggaaaacatcaaatatataaactcaatcaaaaacgatattaaatggttgggttatcaatggcataaaaaagttcgttattcttctgaatattttccaatactgtatgaatatgctaaagaattaattcaaaaaggtttagcatacgtagatgaattaacaaaagaagaaatacgtgaatacagaggcactttaagtaccgtaggaaaaaatagtccttatagaaatagaagtattacagaaaacttaaaattatttgaaaaaatgaaaaaaggagaatttaaagaaggagaggcatgcttacgtgcaaaaattaatatgagttcttcatttattgttatgcgtgatcctgtattatatcgaattattttctctacacatcaccaaactaaaaaaaaatggtgtatatatcctacatatgattttgctcattgtttatctgattctattgaaggtataactcattctttttgtacattagaatttcaagacaataaaaatttatataattggattttaaaaaatactagtatcaagcattattcaaaacaatatgagttctctagattaaatctagaatactcaattttatctaaaagaaaaatttcaattttaattgaaaaaaaaatagttaacggatgggacgatccaagaatactaactatttctggattgagaaaaaaaggatatacagcatcttctattcgtgatttttgtcatagaattggtatcactaaacaaaataatttaatagaattttctatgctagaatattgtattagaaaagaactaaacaaaaaagcaatacgtactatggctgtattagaaccaattaaaatatttctatataacatagataatgatcatgaagaaaaattaatagttcccaatcatccaaaacatctacatttagggactcacgaaattatctttacaaatacaatatatattgaacgagaagatttcaaagaaaaatacgataaaaaatataaaagattaaaaattggagaagaagttcgtttaagatatgcatatataataaaagcagaaaaaatagaaaaagatgaaagtggtaatattatcaaaataatatgcttctgtgatattaacagtttagggaaaaaaccaattaatagaaaaaatcctgcagtaatacactggattgcagtaaaaaattcatttccagctaaatttaaattatacaatcaattatttaaaataaaaaatcctgatcaagaaaaaaatttcttatcttatttaaattctaattcattaatagtaaaaaatggctttgtcgaaaaaaaaatagctcaaaaaataataaaaaaaatgagtaataattttataaaattgttttttcaatttgaaagaactggctacttttgtgtagatgaagttgattcaaaagaaaataaattagtttttaatcgtactgttagtttaaaagattcatggaatttaaaaaaatga

SEQ ID NO: 90876 - protein, 567 aa, Buchnera aphidicola str. Sg (Schizaphis graminum)
MRFKKMNNKIEKNDNNFIYKIINEDFKKNKNLLLHTRFPPEPNGYLHIGHAKSICLNFELANVYNGYCNLRFDDTNPVKENIKYINSIKNDIKWLGYQWHKKVRYSSEYFPILYEYAKELIQKGLAYVDELTKEEIREYRGTLSTVGKNSPYRNRSITENLKLFEKMKKGEFKEGEACLRAKINMSSSFIVMRDPVLYRIIFSTHHQTKKKWCIYPTYDFAHCLSDSIEGITHSFCTLEFQDNKNLYNWILKNTSIKHYSKQYEFSRLNLEYSILSKRKISILIEKKIVNGWDDPRILTISGLRKKGYTASSIRDFCHRIGITKQNNLIEFSMLEYCIRKELNKKAIRTMAVLEPIKIFLYNIDNDHEEKLIVPNHPKHLHLGTHEIIFTNTIYIEREDFKEKYDKKYKRLKIGEEVRLRYAYIIKAEKIEKDESGNIIKIICFCDINSLGKKPINRKNPAVIHWIAVKNSFPAKFKLYNQLFKIKNPDQEKNFLSYLNSNSLIVKNGFVEKKIAQKIIKKMSNNFIKLFFQFERTGYFCVDEVDSKENKLVFNRTVSLKDSWNLKK

SEQ ID NO: 90877 - DNA, 2757 bp, Plasmodium falciparum 3D7
  CDS (1)..(2757)
atggaaaagatatatagcaagaataagttggactatttatcaattatttttaatttttatagctggtataaaaggcacttcaagggtaccttgttaataaatgaaaatagtaatataaagaacacaaccttgatagaacttttaggtaataagaaattattattgaatgaaattaatgcttgtgaggctatattaaaattaaatgagcatcatgaaaattatgattcatcgagtggtacatgtaacgtgaataatataaaccaaccaaacaacaacaataataataaggaaaatattaacgacaataataataataataaggaaaatattaacgacaataataataataataaggaaaataatataaatccatgtagtaccaatagttttaacatcaatagttttagtaccaataattataataactttaataacccgtgctgcagttttagttgtaatatttatgattattatgatattttgaaaatagaagaattaaaagattttttaaaagattttattttaagaaataaaaaaataaataaagaattctttgatactatcgaagaagatatgactatgtggaaaaagatctttttctttggacaaaaaaaaagaactccagaatttttggactttttattattttatattttaaaaaaggaaaatattcatttctttgaagaagaaacacgttatataaatttacataattggtttcttaagaataaaatatatgatatatcaaatgataagaaggaagataatacacctagtgcatgcaatactaattttattcaacaaattattgaagaagatttaaaaaataaaaaacatacacatgttattactagattcccacctgaacctaatggttatttacatttaggacatgcaaaaagtatatgtttaaattttggtttatcaaataaatatggtggtagaacccatttacgttttgatgacacgaacccagttaccgaagaaattagatatatagaatccataaaagaagatgtcaaatggctaggatatgattggaaagaacatttatattttgcttctaattattttgaacaattatatgaatgggccaaaatactaataaaacaaggagatgcgtatgtagatgatcaaagtattgaagaaatacgaaaaaatagaggcaatctaaaagacccaggggttgattcaccatatagaaatagaaccgtagaagaaaatttacaattatttgaaaatatgaaaaatggtttatataaagaaggggaaaaagttttaagagctaaaataaatatgaaatcaggaaatatgaatttaagagatccaatattatatcgtattatgtataaaatacatcccaaaacaaaaaataaatgggttatatatccaatgtatgattatgctcatgggcaatcggattccattgaaaaaattacacattccatatgtacattagaattcgaaacacatagacctttatatgaatggtttcaagaaaaattacatatttttaaaacgagacaaatcgaatttgctcgtctaaatgtaacatatatggtcatgagtaaaagaaaattgttaaccctagttaatgagaaatatgttaaggattgggatgatcctcgtatgccgaccatatcaggtatgagaagaagaggttatagtccagatgccattaaagatttttgtaataaagttggtatagccaagagagaaaatatgattcctattgatctacttgaattctgtgtacgtgaagatatggataaaaaagcaatcagactatttgctatactcaagccattaaaagttattataacaaattataatgacgctcctgattatgaacatatccacaatctagttgctagtaatcatccaaaaatggaacaaatgggttttagaaatttgaaatttgaaaaagaaatttttattgatcacgacgattttcaagaaataccccaagataatttctttagactagctcctaatagaaccgttagattaagatatgcattctgcattacttgtaatgaagttattaaggatgatcaaggtaaggtcattgagttgagatgtacctacgacccgagcagtaaaagtgggctctgtaccaatcaaaagaaagataatgtcaatagacaaggtggtgatggggataacaaacaaggtggtggtggggataacaaaaaagtgaaagctaccattcattggttatgcgcaaaaaattctcttcaagcagaattcagaatgtatgataaattatttaccaaaccaaacccagaatctaacgaagacactgaacttgttcaaaaaatcacatcaacggcacatcttgaaaacaatacaaacaatcaaggtaatggtaaagatgaatatgcttctgatactttactacaagatgaacatttagaagatgaatccaaaaatgcgggatggagaaaatacataaatacaaattcattaattatacataaaggactagtagaaaattattcgacacgttttaaaattggagatccaatacaatttgaaagagtcggattttttacaaaagataaagacacaacaaatgaattaccggtttttaatttaacagtacccttagttgataataccatgttaaaaaaaaaaaaagaagacctactacaaaaggaattggataaattgaagagagaaaaaattgctgccgagcgaaaattaaagaaggagcaaaaaaaaataagggagcaaaagaaaaaagaacaaaattga

SEQ ID NO: 90878 - protein, 918 aa, Plasmodium falciparum 3D7
MEKIYSKNKLDYLSIIFNFYSWYKRHFKGTLLINENSNIKNTTLIELLGNKKLLLNEINACEAILKLNEHHENYDSSSGTCNVNNINQPNNNNNNKENINDNNNNNKENINDNNNNNKENNINPCSTNSFNINSFSTNNYNNFNNPCCSFSCNIYDYYDILKIEELKDFLKDFILRNKKINKEFFDTIEEDMTMWKKIFFFGQKKRTPEFLDFLLFYILKKENIHFFEEETRYINLHNWFLKNKIYDISNDKKEDNTPSACNTNFIQQIIEEDLKNKKHTHVITRFPPEPNGYLHLGHAKSICLNFGLSNKYGGRTHLRFDDTNPVTEEIRYIESIKEDVKWLGYDWKEHLYFASNYFEQLYEWAKILIKQGDAYVDDQSIEEIRKNRGNLKDPGVDSPYRNRTVEENLQLFENMKNGLYKEGEKVLRAKINMKSGNMNLRDPILYRIMYKIHPKTKNKWVIYPMYDYAHGQSDSIEKITHSICTLEFETHRPLYEWFQEKLHIFKTRQIEFARLNVTYMVMSKRKLLTLVNEKYVKDWDDPRMPTISGMRRRGYSPDAIKDFCNKVGIAKRENMIPIDLLEFCVREDMDKKAIRLFAILKPLKVIITNYNDAPDYEHIHNLVASNHPKMEQMGFRNLKFEKEIFIDHDDFQEIPQDNFFRLAPNRTVRLRYAFCITCNEVIKDDQGKVIELRCTYDPSSKSGLCTNQKKDNVNRQGGDGDNKQGGGGDNKKVKATIHWLCAKNSLQAEFRMYDKLFTKPNPESNEDTELVQKITSTAHLENNTNNQGNGKDEYASDTLLQDEHLEDESKNAGWRKYINTNSLIIHKGLVENYSTRFKIGDPIQFERVGFFTKDKDTTNELPVFNLTVPLVDNTMLKKKKEDLLQKELDKLKREKIAAERKLKKEQKKIREQKKKEQN

SEQ ID NO: 90879 - DNA, 2592 bp, Plasmodium falciparum 3D7
  CDS (1)..(2592)
atgatagagaataccaaagtgaatatattttatggaaataataagtatccatttatttgtaagagcattttgaatgtatataaaaataagaataagaagattcttgagaaaacggaaactactgtaaatgttgatgagaacataaagtttataaaggatgcaaatgtcgaagaactaaaaattgaatttttaactaacgctccgaacaataataacaataataataataataacaataataataataataacaataataataataataataatattaataagggtaatatgaaccactgtggtaagaatcaagaagaagaaaaaaaaaacttaagcaaaagtaataatattgaaaaggtaccatatatttgtagtagtgataagatattcgccaaaatattagatcatctattaaaaacagatttatataatatatctgaaaaaatagatcctaagaacaataaagttgttaatatttatgtacaaacacaatatgaggaatggcttgatttttttagatcgagaaatgttaacaaagatattgtatttatatgtgaacatcttaacaagcatttacatttaaacacctttgttgtttcagaatatttaacattgtccgatatctttatatattttcaaatgtataaatattttcatgtgagtagtacccagtatgccaaatattcaaaaatgtacaagaatattaatagatggcataaattaatagattccctaatttattttgaagacgctgaatggaaaaaaaacttgaaatgtttaatttgtgataataaaatgaactttgatgatagaaaggataatttaaaaaataataataaatcaatgaataataccgatgatgtaaaatgtaagaaaaaaacggttactacatcatattcaggcaaattagaaaatgcagttattgggaatgtagttacacgatttccacctgaaccatcaggttatttacatgtgggtcatgcgaaagcggcttttttaaataattattatgcacaaatgtatgaaggaaagatgttattacgttttgatgataccaatcctgttttagaagatataaaatatgaaaagtcgattattgaagatttagaaaatcttggattaaaatatgaaaaaattagttattcttctgatcattttgatttattagaaaaatattgtattgatatgataaaaatgaataaagcatatgctgatgatactggtgtagaagatatgagaaatcaaagaggggaaggtatcgaatctattaatagaaataattcaatagaaaagaatttggaattatttaatgaaatgagaaaaggtacagaaataggtcaaaaaaattgtataagagctaaaattaatatgcagagcaaaaataaatgtatgagagatccagtaatgtatcgttgtattgtagatgtaccacatcataaacatcaatttaaatataaatgttatccaacatatgattttgcatgcccaattattgattcaattgaaggtgtaactcatgcattacgaacaaatgaatatagtgatagaattgaacaatacaattggtttatatccacattaaatttaagaaaagtatatatatatgaatttagtagattagcatttgtaaaaactgtaatgtcaaaaagaaaattaaaatggtttgtagaaaataatgtggtagatagttgggtagatccacgttttccaacaatcaaaggtatattaagaagaggattaacaaaagaagcattatttcaatttattttagaacaaggtccatcaaaagctggaaatttaatgcaatgggataaattgtggtctattaataaacaaattattgatccaattatacctagatatgccgctgttgataaaaattcaagtatccttttaatattaacagatttaaccgatcaagttattcaaaaagagagagatttacatatgaaaaataaatccttaggaacatgtaacatgtattataataataaatatttaatagaattagaagatgcacaaaccttacttgaaaatgaagaaattacattaatcaaattaggaaatattattataaaaaatattgaaaaagagaatggtaaaattaaacaaataaatgcactttcaaattttcatggagattttaaaacaaccaaaaaaaaaatacattggttaccttatctacctcaacaattaatcacatgtacactatatgaatatgatcatctaataactgttgataaatttgaaaatgataacaaagacgattggaccaattttattaattttaatagtaaacatgaaacattagtgtatgccgaaccatccatttcttccttaaaagtttctgataaatttcaatttgaaagaagaggatattttattcttgacaaaatcgatccacatcatcatttacatttaattaaaataccagatggaaaatccaaaaatatgtccataataactaccaaagttgacccaaaacaattagcaggaacaaaagatacaaaagatgcaaaagatacaaaaaatacaaaagatacaaaaaatacaaaagatacaaaagatacaaaaaatacaaaacctaattaa

SEQ ID NO: 90880 - protein, 863 aa, Plasmodium falciparum 3D7
MIENTKVNIFYGNNKYPFICKSILNVYKNKNKKILEKTETTVNVDENIKFIKDANVEELKIEFLTNAPNNNNNNNNNNNNNNNNNNNNNNNINKGNMNHCGKNQEEEKKNLSKSNNIEKVPYICSSDKIFAKILDHLLKTDLYNISEKIDPKNNKVVNIYVQTQYEEWLDFFRSRNVNKDIVFICEHLNKHLHLNTFVVSEYLTLSDIFIYFQMYKYFHVSSTQYAKYSKMYKNINRWHKLIDSLIYFEDAEWKKNLKCLICDNKMNFDDRKDNLKNNNKSMNNTDDVKCKKKTVTTSYSGKLENAVIGNVVTRFPPEPSGYLHVGHAKAAFLNNYYAQMYEGKMLLRFDDTNPVLEDIKYEKSIIEDLENLGLKYEKISYSSDHFDLLEKYCIDMIKMNKAYADDTGVEDMRNQRGEGIESINRNNSIEKNLELFNEMRKGTEIGQKNCIRAKINMQSKNKCMRDPVMYRCIVDVPHHKHQFKYKCYPTYDFACPIIDSIEGVTHALRTNEYSDRIEQYNWFISTLNLRKVYIYEFSRLAFVKTVMSKRKLKWFVENNVVDSWVDPRFPTIKGILRRGLTKEALFQFILEQGPSKAGNLMQWDKLWSINKQIIDPIIPRYAAVDKNSSILLILTDLTDQVIQKERDLHMKNKSLGTCNMYYNNKYLIELEDAQTLLENEEITLIKLGNIIIKNIEKENGKIKQINALSNFHGDFKTTKKKIHWLPYLPQQLITCTLYEYDHLITVDKFENDNKDDWTNFINFNSKHETLVYAEPSISSLKVSDKFQFERRGYFILDKIDPHHHLHLIKIPDGKSKNMSIITTKVDPKQLAGTKDTKDAKDTKNTKDTKNTKDTKDTKNTKPN

SEQ ID NO: 90881 - DNA, 1668 bp, Salmonella enterica subsp. enterica serovar Typhi Ty2
  CDS (1)..(1668): transl_table=11
atgagtgaggctgaagcccgcccgactaactttattcgtcagattattgatgaagatctggcgagtggtaaacataccactgtccatacccgttttccgccggagccgaatggctatctgcacatcggccacgcgaaatctatctgcctgaactttggcatcgcgcaagattatcagggccagtgcaacctgcgtttcgatgacaccaacccggtaaaagaagatatcgagtacgttgattcgatcaaaaacgacgtcgagtggttaggctttcactggtctggcgatattcgctactcctccgattactttgaccaactgcacgcctatgcggtcgagctcatcaataaaggcctggcctacgttgatgagctgacgccggagcagatccgcgaataccgtggtacgctgaccgcgccgggtaaaaacagcccgttccgcgatcgcagcgtggaagaaaacctcgcgctatttgaaaaaatgcgtaccggcggttttgaagagggtaaagcctgtctgcgcgctaaaatcgacatggcgtcgccgtttatcgtgatgcgcgatccggtgctgtatcgcattaaattcgccgagcatcatcagaccggcacgaagtggtgcatctatccgatgtacgactttactcactgcatcagcgatgcgctggaaggcattactcattctctgtgtacgctggagttccaggacaaccgtcgtctgtacgactgggtgctggacaacatcaccattccggttcacccgcgccagtacgaattctcgcgcctgaatctggaatacaccgtgatgtccaagcgtaagctgaacctgctggtgaccgacaaacacgtcgaaggttgggatgatccgcgtatgccgactatttccggtctgcgccgtcgcggctataccgcggcttctattcgtgagttctgcaaacgcatcggcgtcaccaagcaggacaacactattgagatggcgtcgctggaatcctgcattcgcgaagatctgaacgaaaacgcgccgcgcgcgatggcggtaatcgatccggtaaaactggttatcgaaaactacccgcagggcgagagcgaaatggttaccatgcctaaccatccgaataaaccggagatgggcagccgtgaagtgccgtttagcggtgagatctggatcgatcgcgcggatttccgcgaagaagcgaacaaacagtacaaacgtctggtgatgggcaaagaagtgcgtctgcgtaatgcctacgtcattaaagcggagcgcgtagagaaggatgccgaagggaatatcaccaccatcttctgtacctatgatgctgatacgctgagtaaagatccggctgacgggcgtaaagtgaaaggcgtaatccactgggttagcgtagcacatgcgctgccgattgaaattcgtctctacgaccgtctgttcagcgtgccgaacccgggcgccgcggaggacttcctgtctgttatcaaccccgaatcattagtgattaagcaggggtatggcgagccgtcgctgaaagcggcggtagcagggaaagctttccagtttgaacgtgaaggttacttctgccttgacagccgctatgcaacggccgataagctggtctttaaccgcaccgtgggcctgcgtgatacctgggcgaaagcgggcgaataa

SEQ ID NO: 90882 - protein, 555 aa, Salmonella enterica subsp. enterica serovar Typhi Ty2
MSEAEARPTNFIRQIIDEDLASGKHTTVHTRFPPEPNGYLHIGHAKSICLNFGIAQDYQGQCNLRFDDTNPVKEDIEYVDSIKNDVEWLGFHWSGDIRYSSDYFDQLHAYAVELINKGLAYVDELTPEQIREYRGTLTAPGKNSPFRDRSVEENLALFEKMRTGGFEEGKACLRAKIDMASPFIVMRDPVLYRIKFAEHHQTGTKWCIYPMYDFTHCISDALEGITHSLCTLEFQDNRRLYDWVLDNITIPVHPRQYEFSRLNLEYTVMSKRKLNLLVTDKHVEGWDDPRMPTISGLRRRGYTAASIREFCKRIGVTKQDNTIEMASLESCIREDLNENAPRAMAVIDPVKLVIENYPQGESEMVTMPNHPNKPEMGSREVPFSGEIWIDRADFREEANKQYKRLVMGKEVRLRNAYVIKAERVEKDAEGNITTIFCTYDADTLSKDPADGRKVKGVIHWVSVAHALPIEIRLYDRLFSVPNPGAAEDFLSVINPESLVIKQGYGEPSLKAAVAGKAFQFEREGYFCLDSRYATADKLVFNRTVGLRDTWAKAGE

SEQ ID NO: 90883 - DNA, 1740 bp, Bacteroides thetaiotaomicron VPI-5482
  CDS (1)..(1740): transl_table=11
atgacagatattaaaaacgaagacacaggcgataagaaaagcctgaactttattgaacaggcagtagagaaggatttgaaggaaggtaaaaatggtggaaaagtgcagacccgcttcccgcccgaaccgaacggataccttcacatcggtcatgccaaagctatttgccttgacttcggcatcgctgccaagcatggcggcgtatgtaaccttcgtttcgacgacacaaatccgaccaaagaggatgtggaatatgtagaagccatcaaagaagatattcaatggctgggctaccaatggggaaacgaatactacgcttccgactatttccagcaattatgggacttcgccatccgcctcatcgaggaaggaaaagcatatattgacgagcaaactgccgaacagattgcccaacaaaaaggtactcccacccaggcaggtgtgaacagcccttaccgcgaccgccctatcgaagaaagtctggaacttttcaagaagatgaacagcggtgaaatagaagaaggtgctatggtactccgtgccaaaatcgacatgtccaatcctaacatgcacttccgcgacccgatcatctatcgtgtcgtaaaacatccgcaccaccgtacaggcactacctggaaggcttatccgatgtatgacttcgcccacggacagagtgacttcttcgaaggagtaactcactctctgtgtacacttgaatttgtggtgcaccgtccgctctacgacctcttcatcgactggctgaaagaaggtaaggacctgaacgacaaccgtccccgtcagactgagttcaacaaactgaacctgagctacacgctgatgagcaaacgtaacctgctgacactggtaaaagaaggactggtgaacggatgggacgatccccgtatgccgactatctgcggtttccgccgtcgtggttactctccggaatctatccataaatttatcgataagatcggttacaccacttacgacgcactgaacgatatcgcattgctggaaagctctgtccgcgacgatctgaacagccgtgctacccgtatatccgctgtcatcaacccggtgaaactcatcatcaccaactatccggaaggacaagtagaacaactggaagccatcaacaatccggaagatccggaagccggaagccatatgattgagttcagccgcgaattatggatggaacgcgaagacttcatggaagacgcgcccaagaaatatttccgcatgactccgggacaggaagtacgcctcaaaaacgcttacatcgtgaaatgtaccggatgcaagaaggatgaaaacggtgtgatcacagaagtatattgcgaatatgatgcaaatacccgcagcggcatgccggatgccaaccgtaaagtgaaaggtacactccactgggtaagctgcaaccactgtctgcaagcagaagtgcgcctctacgaccgtctgtggaaagtagaaaacccacgcgacgaactggctgctatccgcgaagcaaagaaatgcgaagctctggaagcaatgaaggaaatcatcaatccggattctctgaaagttcttccgaattgctatatcgagaagtttgcggcaaccttgcctgtactctcatacctgcaattccaacgcatcggctattttaatatagacaaagactcgactccggagaaacttgtattcaaccgtacggtaggattaaaagatacctggggtaaaatcaataaataa

SEQ ID NO: 90884 - protein, 579 aa, Bacteroides thetaiotaomicron VPI-5482
MTDIKNEDTGDKKSLNFIEQAVEKDLKEGKNGGKVQTRFPPEPNGYLHIGHAKAICLDFGIAAKHGGVCNLRFDDTNPTKEDVEYVEAIKEDIQWLGYQWGNEYYASDYFQQLWDFAIRLIEEGKAYIDEQTAEQIAQQKGTPTQAGVNSPYRDRPIEESLELFKKMNSGEIEEGAMVLRAKIDMSNPNMHFRDPIIYRVVKHPHHRTGTTWKAYPMYDFAHGQSDFFEGVTHSLCTLEFVVHRPLYDLFIDWLKEGKDLNDNRPRQTEFNKLNLSYTLMSKRNLLTLVKEGLVNGWDDPRMPTICGFRRRGYSPESIHKFIDKIGYTTYDALNDIALLESSVRDDLNSRATRISAVINPVKLIITNYPEGQVEQLEAINNPEDPEAGSHMIEFSRELWMEREDFMEDAPKKYFRMTPGQEVRLKNAYIVKCTGCKKDENGVITEVYCEYDANTRSGMPDANRKVKGTLHWVSCNHCLQAEVRLYDRLWKVENPRDELAAIREAKKCEALEAMKEIINPDSLKVLPNCYIEKFAATLPVLSYLQFQRIGYFNIDKDSTPEKLVFNRTVGLKDTWGKINK

SEQ ID NO: 90885 - DNA, 2160 bp, Arabidopsis thaliana
  CDS (1)..(2160)
atggatgggatgaagctttcgttcccaccggaaagtccaccactttcagtcatcgttgctctttctctctcagcttctccggtgacgattgattcttccgccgctgcaacaaccgtcccttcttttgtcttctccgacgggaggaaattgaatggagccaccgttcttcttcgctatgttggtcgatcagcgaaaaagcttcctgatttctatggcaacaatgcttttgattcttctcagattgatgagtgggtagattacgcatctgtcttctcttctggttcagagtttgagaatgcttgtggtcgtgttgataagtatctcgagagtagcacgtttcttgttggccattctctttccattgctgatgtcgctatttggtcagctcttgctggaactggtcaaagatgggaaagtttgaggaaatctaaaaagtatcagagtcttgttagatggttcaattcgatattagacgagtacagtgaggtgcttaacaaggttctagcaacttatgttaagaaaggatcagggaagcctgttgctgcacctaagtctaaagatagccaacaagctgtgaaaggagatggtcaggataaaggtaagcctgaagtggacttgccggaagcggagattggaaaggttaaactccggtttgctccagagccaagtggttatcttcacataggacatgctaaggctgcgttgctgaacaagtatttcgctgagcgttaccaaggggaagtgattgtgcgttttgatgatactaaccctgctaaagaaagcaatgagtttgtggataatcttgtgaaggatattgggaccttggggatcaagtatgagaaagtgacatacacttcggactattttcctgaattgatggatatggcggaaaaactgatgcgtgagggtaaggcatatgttgatgacacaccgagggagcagatgcagaaagagaggatggatgggattgattcgaaatgtaggaatcatagcgtcgaggagaatttgaagctatggaaggaaatgattgcaggaagtgagagaggattacagtgctgtgttcgtgggaaattcaacatgcaagatcccaacaaagccatgcgtgacccggtttattaccgatgcaatcctatgtctcaccaccgtatcggggataagtataagatatatccaacatatgactttgcttgcccgtttgttgattcccttgaaggtataacgcatgctcttcggtctagtgagtatcatgaccgaaatgctcagtactttaaagttctggaggatatgggactgcgacaggttcagctttacgaattcagccggttaaacctagtttttacacttctcagtaagcgcaagcttctctggtttgtccaaactggattggttgacgggtgggatgatccacgtttcccgacagtccaaggaattgttcgtagaggtttgaaaatcgaggctctgattcaattcattctcgagcagggggcttcgaagaatctaaatttgatggaatgggacaaactttggtctataaataagagaataattgatcctgtgtgccctagacacactgctgtggttgcagaacgtcgtgtactatttaccttaacggatggtcctgatgagccgtttgttcgcatgataccaaagcacaagaaattcgaaggtgctggagaaaaggcgaccactttcactaagagcatttggctcgaggaagctgatgcgagtgccatatccgttggtgaggaagtaactttgatggattggggaaatgctatcgtaaaggaaatcacaaaggacgaggagggtcgtgtcactgccttatctggtgtcttgaatctccaaggttctgtaaagactacaaagctgaagctgacatggcttcctgatactaatgaattggtcaatctcacattaacagagtttgattatctaatcaccaagaagaagctggaagatgatgatgaagttgctgattttgtgaatcctaacacaaagaaggaaacattggcacttggtgattcgaatatgaggaatctgaaatgtggagatgtgattcagcttgagaggaaaggctatttcagatgtgatgtgccttttgtcaaatcttcaaagcccattgtcttattctccattccagatggaagagccgctaagtga

SEQ ID NO: 90886 - protein, 719 aa, Arabidopsis thaliana
MDGMKLSFPPESPPLSVIVALSLSASPVTIDSSAAATTVPSFVFSDGRKLNGATVLLRYVGRSAKKLPDFYGNNAFDSSQIDEWVDYASVFSSGSEFENACGRVDKYLESSTFLVGHSLSIADVAIWSALAGTGQRWESLRKSKKYQSLVRWFNSILDEYSEVLNKVLATYVKKGSGKPVAAPKSKDSQQAVKGDGQDKGKPEVDLPEAEIGKVKLRFAPEPSGYLHIGHAKAALLNKYFAERYQGEVIVRFDDTNPAKESNEFVDNLVKDIGTLGIKYEKVTYTSDYFPELMDMAEKLMREGKAYVDDTPREQMQKERMDGIDSKCRNHSVEENLKLWKEMIAGSERGLQCCVRGKFNMQDPNKAMRDPVYYRCNPMSHHRIGDKYKIYPTYDFACPFVDSLEGITHALRSSEYHDRNAQYFKVLEDMGLRQVQLYEFSRLNLVFTLLSKRKLLWFVQTGLVDGWDDPRFPTVQGIVRRGLKIEALIQFILEQGASKNLNLMEWDKLWSINKRIIDPVCPRHTAVVAERRVLFTLTDGPDEPFVRMIPKHKKFEGAGEKATTFTKSIWLEEADASAISVGEEVTLMDWGNAIVKEITKDEEGRVTALSGVLNLQGSVKTTKLKLTWLPDTNELVNLTLTEFDYLITKKKLEDDDEVADFVNPNTKKETLALGDSNMRNLKCGDVIQLERKGYFRCDVPFVKSSKPIVLFSIPDGRAAK

SEQ ID NO: 90887 - DNA, 1650 bp, Wigglesworthia glossinidia endosymbiont of Glossina brevipalpis
  CDS (1)..(1650): transl_table=11
atggaaaaacaaaaaaaaataacatccaattttatttataaaattatacataaagatttatttattaataaatacaaatatattcatactagatttcctccagagcctaatggatatttacatttaggtcatgcaaaatctatttgtttaaattttaatttagctaagattttcaagggaaaatgtaatttaagatttgatgatactaatccaaatacaaaacatgaaaaatatataaataaaattaaaaatgacattttatggttaggatttaaatgggatggaaaaactcgttattcttcggattattttgatcaaatatataattttgctataaaattaataaaaaaaaatttagcatacgtagaagaattatctttaaaagaagtaagaaaaaacagagggtctttgacaagaaaaggaaaacaaagcccgtatagaaatagaaaaataaaagaaaatttaattttgtttgaaaaaatgaaaaatggagaattcaaagaaggatcagcttgcttaagagcaaagataaatatgcaatcttcatgtgttctaatgagagatcctattttgtatagaattagatttaaaaatcatcatcgtacaaaaaataaatggtgtatttatcctacttatgattttagtcattgcatttcagattctattgaaaatattactcattctttatgcacattagaatttcaagaaaataaaaaattatataattggattttaaaaaaagtttcaacagattttgttcctaaacaatatgaattttctagaatgaatttagaatattctattatgtcaaaaagaaaattgaaaattttaatagaaaaaaaattagtaagtggatggaatgatcctagaattccaacattagctggaataaggagaagaggatatactgcctcatctattcgtgaattctgcaatagaattgggatcactaaacaagaaagtactattagtgaatctatgcttgagtttttcataaaaaaagaactgaattttaactcatacagattaatggctgtaataaatcctctgttgttaataatagagaattttccagatgaatatgaagaaaaaatagaaatttctaatcatccatataacaatatggggaaaagaacagttatttttaacaaaaaaatatacatagaacgttcggattttatggaaaatccaaaattagaatataaaagattatcattagggaaaaaggtaaaattaagaaattcatatattataaaagcaaacagaatagaaaaaaataaacacggatatattacaaaagtttattgtaattattattcaaatataaaaaaaaataattataaattttcaaaattaggaattatacattgggtatctgaaaaaaataatattccagcagaatttcgtttttacgatagattgttcactcatcctaatcccgaaaaattggataattttttatcttttttcaacaaagattctttaataattaagcatggttttatagaaaaaaatataaaaaaacaccacataaactatccagttcaattcgaaagaataggatatttttttgcagataaatttaattataaaaaagattatccagtatttaatttaactgcaaaattatctagctatttaaatagataa

SEQ ID NO: 90888 - protein, 549 aa, Wigglesworthia glossinidia endosymbiont of Glossina brevipalpis
MEKQKKITSNFIYKIIHKDLFINKYKYIHTRFPPEPNGYLHLGHAKSICLNFNLAKIFKGKCNLRFDDTNPNTKHEKYINKIKNDILWLGFKWDGKTRYSSDYFDQIYNFAIKLIKKNLAYVEELSLKEVRKNRGSLTRKGKQSPYRNRKIKENLILFEKMKNGEFKEGSACLRAKINMQSSCVLMRDPILYRIRFKNHHRTKNKWCIYPTYDFSHCISDSIENITHSLCTLEFQENKKLYNWILKKVSTDFVPKQYEFSRMNLEYSIMSKRKLKILIEKKLVSGWNDPRIPTLAGIRRRGYTASSIREFCNRIGITKQESTISESMLEFFIKKELNFNSYRLMAVINPLLLIIENFPDEYEEKIEISNHPYNNMGKRTVIFNKKIYIERSDFMENPKLEYKRLSLGKKVKLRNSYIIKANRIEKNKHGYITKVYCNYYSNIKKNNYKFSKLGIIHWVSEKNNIPAEFRFYDRLFTHPNPEKLDNFLSFFNKDSLIIKHGFIEKNIKKHHINYPVQFERIGYFFADKFNYKKDYPVFNLTAKLSSYLNR

SEQ ID NO: 90889 - DNA, 1671 bp, Candidatus Blochmannia floridanus
  CDS (1)..(1671): transl_table=11
gtggataataaatcaaattttatatataatataattaatcaggatctaaattttaaaaaatataccataatacatacacgttttcctcctgaacctaatggatatttacatattggtcatgttaaatctatttatctaaattttaatatcgccaaatattatcatggtaaatgtaacttacggtttgatgatactaatccagataaagaaagtaaagaatatgtagaagctattaaatcagacattcaatggcttggttttatgtggaatggtgaagtgtgttatgtttctgattattttgaacaattatataattatgctgttgaacttatccaaaaaggtctagcatatgtagatgaattatctatatatgctattcgagaatatcgcggtacattaaaaaaatctggccaaaatagtccatatcgttctcgtagtattaaagacaatttattttttttctctaaaatgcgaaatggtgaatttccagaaggaagtgtatgtttgcgagccaaaattaatatgtccgattcttctatgattatgagggatccagtattatatcgaattaaatataccactcatcatcgtgtaggcaaaagttggtgcatttatccgacttatgattttagtcattgtatttctgatgctatagaaggtattactcattcattatgtacattagaatttcaagaaaatcgtcgtttatataattggatattaaaaaatattagtattactaaacatcccattcaatatgaattttctagattaaatataaaatatattattacctctaaacgtaagttaaatttattagttgtaaataatatagtggatggatgggatgacccaagaatgcctactatttctggattaaggcgtagaggttatacagcacgatcaatttgtgaattttgtaaacgtattggaattagtcgtcaagatagttacatagaattatcagagttagaatcttgtattcgtgatgatttgaacaaacactctttaagattaatggctataattaacccaattatggttaaaattattaatttacctacaggatatatagaaaaaattcctatgcctaatcatcctaatgattgcagtatgggaatacgttatgtattttttacgcaagaaatttttattgatcgatttgatcttgatcaatactgtaaaaacagtagatttcctaaattaacgataggacgagaaatacgtttaaggcatgcatatgtcattaaagtagatcattttaaaaaagataccgaaggaaacattatttctgttcattgttattatgatccaactacactaaacagaaaacctatagatggtcgaaaaatacaaggtgttatacattgggtatcagctacaaaaaatatatcagctgaatttcgattatatgataaattatttattcatcctactcctgatattgttataaacatattaaacatcgttaatcctcgttctttagttatttctcacgggtttgttgaattaaatccgatattttcaaataatccaggtccttatcaatttgaaagagaaggttatttcattctagactatcaatatagtaaaccaacttatttagtgtttaatagaactgtaacattaaagaaatctaataaatctattagatttattaagccacaataa

SEQ ID NO: 90890 - protein, 556 aa, Candidatus Blochmannia floridanus
MDNKSNFIYNIINQDLNFKKYTIIHTRFPPEPNGYLHIGHVKSIYLNFNIAKYYHGKCNLRFDDTNPDKESKEYVEAIKSDIQWLGFMWNGEVCYVSDYFEQLYNYAVELIQKGLAYVDELSIYAIREYRGTLKKSGQNSPYRSRSIKDNLFFFSKMRNGEFPEGSVCLRAKINMSDSSMIMRDPVLYRIKYTTHHRVGKSWCIYPTYDFSHCISDAIEGITHSLCTLEFQENRRLYNWILKNISITKHPIQYEFSRLNIKYIITSKRKLNLLVVNNIVDGWDDPRMPTISGLRRRGYTARSICEFCKRIGISRQDSYIELSELESCIRDDLNKHSLRLMAIINPIMVKIINLPTGYIEKIPMPNHPNDCSMGIRYVFFTQEIFIDRFDLDQYCKNSRFPKLTIGREIRLRHAYVIKVDHFKKDTEGNIISVHCYYDPTTLNRKPIDGRKIQGVIHWVSATKNISAEFRLYDKLFIHPTPDIVINILNIVNPRSLVISHGFVELNPIFSNNPGPYQFEREGYFILDYQYSKPTYLVFNRTVTLKKSNKSIRFIKPQ

SEQ ID NO: 90891 - DNA, 1764 bp, Bordetella parapertussis 12822
  CDS (1)..(1764)
atgacccacgccccgacgccgcctgccgccagcaatttcctgcgcccgatcatcgaagacgacctgcaagcgaaccgcttccagggcaagctgtgggccggcaaacccggcccggccgcgctgcaggcgcagggacagcccgacccggcgcgcatccgcacccgctttccgccggagcccaacggctacctgcacatcggccacgccaagagcatctgcgtgaacttcgggctggcgcgcgactacggcggcgtctgccacctgcgcttcgacgacaccaaccccgagaaggaagagcaggagtacgtcgacgccatcatcgaggccgtgcattggctgggcttcgattggcaggccgatggcaatgacaacctgtatttcgccagcgactacttcgaattcatgtacgagttcgccgaggcgctggtgcaggccggccacgcctacgtcgacgagcaaagcgccgaagagatccgcgccagccgcggcacgctgaccgagccgggcaccgactcgccgtggcgcgaccgcccggccgacgagtcgctgctgcgcctgcgcgagatgcgcgacggcaagcatcccgacggcagcctggtgctgcgcgcccggatcgacatggcctcgcccaacatcaacctgcgcgacccggtcatgtaccgcgtgcgccatgccacccaccaccgcaccggcaacgcatggtgcatctacccgatgtacagctgggcccatccggtggaagacgccctggaaggcatcacccacagcatctgcacgctggaattcgaagaccagcggccgttctatgactggatcctggcgcgcctggccgagctgggcaagctggcgcgcccgctgccgcaccagtacgagttcgcccggctgaacctgacctacgtggtcaccagcaagcgcaagctgctgcaactggtgcgcgaaggctacgtggatggctgggacgacccgcgcatgccgacgctgttcggcctgcgccggcgcggctacacgccgtcctcgatccggctgttctgcgaccgcaccgcggtgtcgaagtcggattcgcgcatcgactacagcctgctcgagcaggccgtgcgcgacgacctcgacccggtggcgccgcgctcggtcgcggtgctggacccgctcaagctggtgatcaccaatcacccggaaggccgcagcgagacctgctcggccccgcgcaacccgcacgatccgcaggccggcgtgcgcgaattcccgttcacgcgcgagctgtggatcgagcaggacgacttccgcgaagagccgcccaagaagtacttccgcctgtttcccggcaacacggtgcggctgaagtacggctacgtggtgcgctgcaccggctttaccaaggacgaatcgggcaaggtcgtggaagtgcaggccgagtacctgccggataccaagagcggcacgccgggcgccgacagcgtcaaggtcaaaggcaatatcacctgggtgagcgcggcccacgccgtaccggcccaggtacacctgtacgaccggctgttcgccgatgcgcatcccgacggcggcgacaaggacttcctggcctgcctgaaccccaattccaagcagaccgtgcaggcctggctggagccgggcatcgaggccgtcccgggcgccacgtggcagttcgagcggctgggctatttcacggtggacagcaaggactcccgccccgaggcgccggtcctgaaccgcatcgtgaccctgcgcgactcctggcaggcggcctga

SEQ ID NO: 90892 - protein, 587 aa, Bordetella parapertussis 12822
MTHAPTPPAASNFLRPIIEDDLQANRFQGKLWAGKPGPAALQAQGQPDPARIRTRFPPEPNGYLHIGHAKSICVNFGLARDYGGVCHLRFDDTNPEKEEQEYVDAIIEAVHWLGFDWQADGNDNLYFASDYFEFMYEFAEALVQAGHAYVDEQSAEEIRASRGTLTEPGTDSPWRDRPADESLLRLREMRDGKHPDGSLVLRARIDMASPNINLRDPVMYRVRHATHHRTGNAWCIYPMYSWAHPVEDALEGITHSICTLEFEDQRPFYDWILARLAELGKLARPLPHQYEFARLNLTYVVTSKRKLLQLVREGYVDGWDDPRMPTLFGLRRRGYTPSSIRLFCDRTAVSKSDSRIDYSLLEQAVRDDLDPVAPRSVAVLDPLKLVITNHPEGRSETCSAPRNPHDPQAGVREFPFTRELWIEQDDFREEPPKKYFRLFPGNTVRLKYGYVVRCTGFTKDESGKVVEVQAEYLPDTKSGTPGADSVKVKGNITWVSAAHAVPAQVHLYDRLFADAHPDGGDKDFLACLNPNSKQTVQAWLEPGIEAVPGATWQFERLGYFTVDSKDSRPEAPVLNRIVTLRDSWQAA

SEQ ID NO: 90893 - DNA, 1701 bp, Porphyromonas gingivalis W83
  CDS (1)..(1701): transl_table=11
atgaacgaaaataagaacagcggcatagaggaaaagaagagtcttaacttcatcgaacaaattgtggaatcagacctgtccgaagggaagaatgacggtcgaatccagacacgtttccctccggaacccaacggctatctccatatcggccatgccaaagctatctgcatagacttcgggatagctcagcgatacgggggcgtctgcaacctgcgcttcgacgataccaatccggtgaaagaggacgtggagtacgtggatgccatcagagaagatatagaatggcttggcttccactggggcaatatctactatgcttccgactattttcaggaattgtacgacttcgccgagcgactgatccgcgagggacatgcctatgtggacgaacagactgccgagcagatcgccgcacagaaaggtagcccgactgtgcccggcacggccagtccgttccgcgaccgtccggcagaagagagcctcgacctcttccgtcgaatgaatgtcggagagttcgaagaaggcgccatgaccctacgtgccaagatcgatatggcttcgtccaatatgcacttccgagatccgattatctatcgcatcatcaagcatccgcatcatcgtacaggcaacgaatggaatgtctacccgatgtacgactttgctcacggccagagcgattatttcgaaggagtcacgcattcgatctgcaccctcgaattcgaggtgcatcgtcccctttacaattactttatcgagctgctcagaaaagacagctatgcacctcgtcagatagagttcaaccgcctgaatctgacctatacgatgatgagcaagcgcaagctgctccagctcgtcaaagacgggctggtatcgggctgggacgatccccgtatgcctactttgtgcggctatcgccgtcgtggctatacaccggagtcgatccgcaacttcatagacaaaataggctataccaagtacgatggcattatagacgtagcccttctggagcatgctgttcgggaggacttgaataaacgtgccacaagggtttccggtgtaatcgatccgatcaaactggtgatcacgaactatcccgaggacaagacggaagagatggcagccgtgaacaatccggaagatgagtctgccggcgtacatacgattactttcgctcgcgaactgtacatagagaaggaggatttcatggaggatgctcccaagaaatatttccgaatgacgcccgggcaggaagtacgcttgaagagttcttacatagtccgttgtacgggatgcaaaaaggacgaggacggaaacgtcgtggaagtatatgccgaatacgatccgctgacgctgtccggtatgcctgagagcaaccgcaaagtaaagggtaccatccattgggtatcggcacagcacagtctgccggcagaggtacgactgtacgatcgtctcttcactgacgaaaacccgtcggacatcaaagacaagacactggccgagatgctgaacccggattctctcaaggtgctaaaaaactgccgagtagagcctttcctcgcggatgccgctccgggatcgcacttccagttccagcgcataggttacttcacggtggatccggatagtcgtccgggggcattggttttcaaccgcacggtttcgctgaaagattcttggcagaaagcccaaaagaacgcataa

SEQ ID NO: 90894 - protein, 566 aa, Porphyromonas gingivalis W83
MNENKNSGIEEKKSLNFIEQIVESDLSEGKNDGRIQTRFPPEPNGYLHIGHAKAICIDFGIAQRYGGVCNLRFDDTNPVKEDVEYVDAIREDIEWLGFHWGNIYYASDYFQELYDFAERLIREGHAYVDEQTAEQIAAQKGSPTVPGTASPFRDRPAEESLDLFRRMNVGEFEEGAMTLRAKIDMASSNMHFRDPIIYRIIKHPHHRTGNEWNVYPMYDFAHGQSDYFEGVTHSICTLEFEVHRPLYNYFIELLRKDSYAPRQIEFNRLNLTYTMMSKRKLLQLVKDGLVSGWDDPRMPTLCGYRRRGYTPESIRNFIDKIGYTKYDGIIDVALLEHAVREDLNKRATRVSGVIDPIKLVITNYPEDKTEEMAAVNNPEDESAGVHTITFARELYIEKEDFMEDAPKKYFRMTPGQEVRLKSSYIVRCTGCKKDEDGNVVEVYAEYDPLTLSGMPESNRKVKGTIHWVSAQHSLPAEVRLYDRLFTDENPSDIKDKTLAEMLNPDSLKVLKNCRVEPFLADAAPGSHFQFQRIGYFTVDPDSRPGALVFNRTVSLKDSWQKAQKNA

SEQ ID NO: 90895 - DNA, 2142 bp, Oryza sativa (japonica cultivar-group)
  CDS (1)..(2142)
atggaggcgaagttatcgttttctcaggacagcccgccaatttccataatttctgctgctaaggttgccggtgtctccctgtccatagatcctagtcttgctgcgggctcagcacccgttctatgcttcagttctggagaatcactccgtggtatcaaccctattctcgagtacattgcccaatcctctccaagcctccatggccgagatgctattgagtctggacatgttgttgaatggcttgaatacgcccccaccttccttttaggatcagaatttgaggttgcctgctcatttgttgatggatacttgatgtctcggacctttctggttggtcatgttttaacgattgctgatatcactgtatggtcaaatctggctgggattggtcaacgatgggagagtctacggaaatcaaagaaataccaaaatcttgtccgttggttcaatggcatagattcagactacaaagacacattgaatgaggttatagctgcttatgttgggaaacgaggaattgggaaatcccctgcaccaaaccttaaggaaaaggttaatgactcaaaggatccttcagctccagaagttgatctccctggtgcaaaatttggagaggtgtgtgttcgctttgccccagagcccagtggttacctccatataggtcatgcaaaggctgcactcttgaacaagtactttgcagaaagatatcaaggtcgattaattgttcgatttgatgacactaacccttcaaaagaaagcaatgagtttgttgaaaacctcctaaaagatattgagaccctgggaatcaaatatgatgctgtcacatacacatctgattattttccaaagctaatggaaatggctgaaaaactgattaagcagggaaaagcatatgttgatgacacaccaaaggagcaaatgagaagtgagagaatggatggtgtggagtcaaagtgcagaaataatactgtggaggaaaatctgtctctatggaaagagatgataaatggttctgaaaggggtatgcaatgctgtgtgaggggtaaacttgacatgcaggatcctaacaagtcccttcgggatccagtttactaccgttgcaacactgatcctcaccatcgtattggttcaaagtacaaggtctatccaacttatgactttgcttgtccattcgttgatgcgctggagggagtgacccatgctcttcgttccagtgaatatcatgacaggaatgcacaatactatcgaattcttcaagatatggggatgaggagagtagaaatatatgagttcagcagattgaatatggtttatactcttcttagcaagcggaagctgctttggtttgtgcagaacaagaaggttgaagattggacagaccctcgtttccccactgttcaaggcatagtacgccgtggcttgaaagttgaggctttgatacaatttatactccaacagggtgcttcgaaaaatttgaatcttatggagtgggataaactctggacaatcaacaagaaaataattgacccagtttgtgcaaggcatactgctgtgttgaaagatcagcgtgtgatcttcaggcttactaatggtccagagaaatcatttgttcaaattttgccaaggcacaagaaatttgatggtgcaggaaagaaggcaacaaccttcacaaacagaatttggctagattatgctgatgcatctgcaattagcaagggtgaggaagttactctgatggactggggaaatgccatcattaaagaaatcaagatggagaatggagtaattactgaactgattggagaactacatcttgagggatctgtgaagacaacaaaattgaaggttacatggcttccggacatagatgatctggttcctctctcattggtggaatttgattacctgattagcaagaagaagcttgaggaggatgagaacttccttgacaacctgaacccatgcactcggaaagaaaccctggccctaggagacgcaaatatgaggaacctcctgcgtggggaggtcatacagcttgagaggaaaggctattacaggtgcgatgccccttttgtcagatcctcgaagccggtggttttgttcgctatccctgatggtcgacagcaggccagtttgaactag

SEQ ID NO: 90896 - protein, 713 aa, Oryza sativa (japonica cultivar-group)
MEAKLSFSQDSPPISIISAAKVAGVSLSIDPSLAAGSAPVLCFSSGESLRGINPILEYIAQSSPSLHGRDAIESGHVVEWLEYAPTFLLGSEFEVACSFVDGYLMSRTFLVGHVLTIADITVWSNLAGIGQRWESLRKSKKYQNLVRWFNGIDSDYKDTLNEVIAAYVGKRGIGKSPAPNLKEKVNDSKDPSAPEVDLPGAKFGEVCVRFAPEPSGYLHIGHAKAALLNKYFAERYQGRLIVRFDDTNPSKESNEFVENLLKDIETLGIKYDAVTYTSDYFPKLMEMAEKLIKQGKAYVDDTPKEQMRSERMDGVESKCRNNTVEENLSLWKEMINGSERGMQCCVRGKLDMQDPNKSLRDPVYYRCNTDPHHRIGSKYKVYPTYDFACPFVDALEGVTHALRSSEYHDRNAQYYRILQDMGMRRVEIYEFSRLNMVYTLLSKRKLLWFVQNKKVEDWTDPRFPTVQGIVRRGLKVEALIQFILQQGASKNLNLMEWDKLWTINKKIIDPVCARHTAVLKDQRVIFRLTNGPEKSFVQILPRHKKFDGAGKKATTFTNRIWLDYADASAISKGEEVTLMDWGNAIIKEIKMENGVITELIGELHLEGSVKTTKLKVTWLPDIDDLVPLSLVEFDYLISKKKLEEDENFLDNLNPCTRKETLALGDANMRNLLRGEVIQLERKGYYRCDAPFVRSSKPVVLFAIPDGRQQASLN

SEQ ID NO: 90897 - DNA, 1683 bp, Rhodopseudomonas palustris CGA009
  CDS (1)..(1683): transl_table=11
atgacgactgcagatacagcggcgggcgaggcagggcgcgacttcattcgcgacatcgtccaggccgatctcgacagcgggaagcaccggaccatcgtgacccggttcccgccggagcccaacggctatctgcatatcggccatgccaagtcgatcgcgctgaatttcggcatcgcgcaggaattcggcggccgctgccatctgcggttcgacgacaccaatccgaccaaagaagagcaggaatacatcgactcgatccaggccgacgtccgctggctcggcttcgattggggcgagcacatgttctacgcctcggactatttcgagcagctctacgcctgggcggagctgatgatcaaaaacggcgacgcgtatgttgacgatcagtcgcaggacgagatccgcgccagccgcggcacgctgaccgagcccggtaagaacagcccgttccgcgatcgctcggtcgaggagaatctcgacctgttccggcggatgaaggccggcgaattcccgaacggcgcgcgggtgcttcgcgccaagatcgacatggcgtcgggcaacatcaacctgcgcgatccggtgctgtaccgcatcctgcacgcccaccatccgcgcaccggcgacaaatggtcgatctatccgagctacgactacgcgcacggccagtcggatgcgatcgaaggcatcacgcattcgatctgcacgctggagttcgaggatcaccggccgctgtacgaatggctgctgtcgaagctgccggtgccgtcgcagccgcgtcagtatgaattcgcgcggctcaacatcacctacacgctgctgtcgaagcgcgtgctgaccgagctggtgcgcggcggccatgtcgcgggctgggacgacccgcggatgccgacgatcgcgggcatgcggcgtcgcggcgtgccgccggcggcgctgcgcgacttcgtcaagcggatcggcgtcgcgaaagccaacagcgtggtcgatctcggtatgctggagttctgcatccgtgaggaattgaaccgcacggcgcagcggcggatggcggtgctgaagccgctgaaggtggtgatcgagaactacccggaaggccagaccgaagaactcgaggcgatcaaccatccagacgatccgagcctcggcacgcgcaagatcgccttcggccgcgagatctacatcgagcaggacgatttcatggagaacccgccgaagaaattcttccgactgtctccaggcaatgaggtgcggctgcgctacgcctacttcatcaagtgccgcgacgtgatcaagaatgacgccggcgagatcgtcgagctgcgctgcacctacgatccggaaacccgcggcggcaacgcgcccgacggccgcaaggtcaaggcgacgatgcactggctgccggcggcgcagtcggtgaaggcggagatccggatctacaatcagctgttcgccaacccggcgccgagcgcgtcgacctttgccgacgatctcaatccgcagtcgctcgaagtcctgaccgaggcgcggatcgagccggagacggcggcgagcacgtcggccgagccgctgcagttcgagcgccagggttacttcgtccgcgatcgcgactcgaccgcagataagccggtgttcaatcgcaccatcgggttgcgcgatacctttgccaaggaagtcgcgaaggggtga

SEQ ID NO: 90898 - protein, 560 aa, Rhodopseudomonas palustris CGA009
MTTADTAAGEAGRDFIRDIVQADLDSGKHRTIVTRFPPEPNGYLHIGHAKSIALNFGIAQEFGGRCHLRFDDTNPTKEEQEYIDSIQADVRWLGFDWGEHMFYASDYFEQLYAWAELMIKNGDAYVDDQSQDEIRASRGTLTEPGKNSPFRDRSVEENLDLFRRMKAGEFPNGARVLRAKIDMASGNINLRDPVLYRILHAHHPRTGDKWSIYPSYDYAHGQSDAIEGITHSICTLEFEDHRPLYEWLLSKLPVPSQPRQYEFARLNITYTLLSKRVLTELVRGGHVAGWDDPRMPTIAGMRRRGVPPAALRDFVKRIGVAKANSVVDLGMLEFCIREELNRTAQRRMAVLKPLKVVIENYPEGQTEELEAINHPDDPSLGTRKIAFGREIYIEQDDFMENPPKKFFRLSPGNEVRLRYAYFIKCRDVIKNDAGEIVELRCTYDPETRGGNAPDGRKVKATMHWLPAAQSVKAEIRIYNQLFANPAPSASTFADDLNPQSLEVLTEARIEPETAASTSAEPLQFERQGYFVRDRDSTADKPVFNRTIGLRDTFAKEVAKG

SEQ ID NO: 90899 - DNA, 1815 bp, Onion yellows phytoplasma OY-M
  CDS (1)..(1815): transl_table=11
ttggagaccaaaactaagattcccaaacaaattttttcacaaacaaaaccacccaaaaagcccaaaccccaaataaaccaaataaaaagaaaaaggacttataaaatgcaaaaacaatcaaatttcatcaaaaccatcattcaaaaagacctccaaagcggaaaatgcagccaaatcattacacgtttcccgcccgaacccaatggttttttacatttaggacacgccagagccatcattattaattttgaattggcacatttttttgaaggcaaaacccttttacgttatgatgacaccaacccttccaaagaaaaacaaatttatgttaatgccatcctcaatgacatcaaatggctgggatacactccttacaaaatcacttttgcctcagattatttccctcaaatgtatcaaatggcactttttttaatcaaacaaggaaaagcctatgttgatgaccaaaccgctgaacaaattgcccaaagtcgcggtaatttaacccaaaaaggtaccaattctccttatcgcaatcgtagtattgaagaaaatatcttgctatttgaacaaatgaaaaaaggaaaatttgtagaaggtagcaaagttttgcgtgccaaaattgatatgcaaagccctaaccttaatttgagagaccctattttgtaccgtattctttctgcttttactttaaaacaaaaacattggcatattttccctacctatgattacgctcatccattggaagattcctttgaaaacatcacacattctttgtgttctttggaattcgaagaccacagacctttatatgattggataatcaaagaaacaaaagccaaacatactccacgccaaattgaatttggaagacttaatcttacccaaactttgatgagcaaaagacatcttaataatttggtagaaaaaaacttagtaacaggttgggatgaccctagaatgccaactttatcaggcatccgcaaaaaaggctacactcctgaagctatcaaaaattttgtccttgaaacaggcttatccaaagtaaattcacaagttaaacaagaaatgttagaatcttttgtaagagatgaccttaaaggaaaatccttgcctcgcatggcagttataaaccccctcaaacttactattactaactttcctgaaaaccaaatagaaaatctaaaagctccttggactaataattttcatacttgtaaatgttgcaacacatctcaaacccaaggaaaaaccccagaacaaaatcaagaacaaacaaaaggaaaagaacaaacccaagaaagagaaatttatttttcccgccatctctacattgaaaaagacgattttgcactccaaaaaccagataaaaattataaaagattaactttgggcgaagaagtaagattatttcatgcttattttgttaaagcttacgatgttgtcaaaaacaacaaaggagaaataacagaaattcttgcaacatacgacccccaaaccaaaagcggcagcggctttaaagatagaaaaccaaacggaactattcattttgtagaagcaaagactgcttgcaaagccacttttaatttttttgctccactactttgcacaaatggcaatttcaactataaatcctggcatatcaaaaaaggttttgtagaatcaagtttacaaaaaagctgttgttgcaaaaaccatttgcaatttctaagacaaggttattttgcagcagacaaaatcacaaaagacacaaatggaaaaacgcaagaacttaatttcaatgaagtagtaagcttaaaatcaaatcctcaaaaataa

SEQ ID NO: 90900 - protein, 604 aa, Onion yellows phytoplasma OY-M
METKTKIPKQIFSQTKPPKKPKPQINQIKRKRTYKMQKQSNFIKTIIQKDLQSGKCSQIITRFPPEPNGFLHLGHARAIIINFELAHFFEGKTLLRYDDTNPSKEKQIYVNAILNDIKWLGYTPYKITFASDYFPQMYQMALFLIKQGKAYVDDQTAEQIAQSRGNLTQKGTNSPYRNRSIEENILLFEQMKKGKFVEGSKVLRAKIDMQSPNLNLRDPILYRILSAFTLKQKHWHIFPTYDYAHPLEDSFENITHSLCSLEFEDHRPLYDWIIKETKAKHTPRQIEFGRLNLTQTLMSKRHLNNLVEKNLVTGWDDPRMPTLSGIRKKGYTPEAIKNFVLETGLSKVNSQVKQEMLESFVRDDLKGKSLPRMAVINPLKLTITNFPENQIENLKAPWTNNFHTCKCCNTSQTQGKTPEQNQEQTKGKEQTQEREIYFSRHLYIEKDDFALQKPDKNYKRLTLGEEVRLFHAYFVKAYDVVKNNKGEITEILATYDPQTKSGSGFKDRKPNGTIHFVEAKTACKATFNFFAPLLCTNGNFNYKSWHIKKGFVESSLQKSCCCKNHLQFLRQGYFAADKITKDTNGKTQELNFNEVVSLKSNPQK

SEQ ID NO: 90901 - DNA, 1689 bp, Nanoarchaeum equitans Kin4-M
  CDS (1)..(1689): transl_table=11
atgtacaaagaaataatagcctatcttaagcttaaatatggaaaagtaaaaccccaatctgttattggtaaaataatagctaaaaaccccgagttaaaagctaaaataaaagagctaatccctataatagagcaagagataaaagaggtagaacaaatggatatagaacaaataaaagaattagctaaagcttatgaacaaaccatagagaaaaaagaaaaagacatagagataccggtaaaagacaaagtaataacaagatttgctccaaacccctcggggttattacatataggccatgcaagagctatagttctaaaccattatattgcaaaaaaatataatggccaattcatattaagaatagaagataccgatccagatgtaaaaaaacctatgattgaggcttacgagttaataccgaaagatgtggaatggttaatacaagaaaagcccgacaaaatagttgtacaaagtgatagattagatatttactataaatatatagaagagcttataaaacaaggcaaagcatatgtttgtttatgtaaagctgaggaatttagagaatatagaaacaaaggtttaccttgcccccataggaatcaatctatagaagaaaacctagagttatggagcaaaatgttaaaaggcgaattcaaaaaaggagaagcggtagtaagattaaaaacagatttaactcacaaagaccccggggtaagggatttccccatagcgaggatagtagaaaaccctcatcctagaatagggtataaacctgtatttccattatataattttgctgtcgtaatagatgaccatttacttggcataacccatgttattagaatgaaagaacatacaaacaatgctataaagcaatcttttatatataaagcatttggttgggaagaacccatctatttggagtatggtgctctattaacggatatgcccacacataaaagcgaaataagaaaattaatagaacaaaaacaaatcgaaggttgggatgatattagattgccaacattaatagcattaagaaggaggggaattttaccagaggcgatatatgaatatatagtaaaagatgtaggattaaacaaagccgatataaaagtagattggaacaaaatatattattatcataaaattaggatagacaaacaaactcccagatattttatgattagagatcctatcgcaatagtaatagaaaactatgacgatattatagacaaattcgaaataaaaaatggcatcccatataaaaagatttctaaacatccagatgttgatttggggtatagggaattaccaataaaagaggtattatatatagacaaaagagatgctgaaaggctcaaacaaaagccattaagattattcgagctattcaatataaaatttgtgggcgaaatagaaattgagtatggcgatgaatattctaaaacaaaagagaaagcttatgctgttagagttatatctttcgatgtgcaagaagcaataaaaaacaaataccccatagtgcaatggttaccggaatatgaagaaactacattatttgaattggatggatataaaaaagcttatgtagagccaaacattaaagagaattatgtgcattttattagagaaggttattataaaagggaaaatgataaatggatatttagtgtgaaatag

SEQ ID NO: 90902 - protein, 562 aa, Nanoarchaeum equitans Kin4-M
MYKEIIAYLKLKYGKVKPQSVIGKIIAKNPELKAKIKELIPIIEQEIKEVEQMDIEQIKELAKAYEQTIEKKEKDIEIPVKDKVITRFAPNPSGLLHIGHARAIVLNHYIAKKYNGQFILRIEDTDPDVKKPMIEAYELIPKDVEWLIQEKPDKIVVQSDRLDIYYKYIEELIKQGKAYVCLCKAEEFREYRNKGLPCPHRNQSIEENLELWSKMLKGEFKKGEAVVRLKTDLTHKDPGVRDFPIARIVENPHPRIGYKPVFPLYNFAVVIDDHLLGITHVIRMKEHTNNAIKQSFIYKAFGWEEPIYLEYGALLTDMPTHKSEIRKLIEQKQIEGWDDIRLPTLIALRRRGILPEAIYEYIVKDVGLNKADIKVDWNKIYYYHKIRIDKQTPRYFMIRDPIAIVIENYDDIIDKFEIKNGIPYKKISKHPDVDLGYRELPIKEVLYIDKRDAERLKQKPLRLFELFNIKFVGEIEIEYGDEYSKTKEKAYAVRVISFDVQEAIKNKYPIVQWLPEYEETTLFELDGYKKAYVEPNIKENYVHFIREGYYKRENDKWIFSVK

SEQ ID NO: 90903 - DNA, 1695 bp, Bdellovibrio bacteriovorus HD100
  CDS (1)..(1695): transl_table=11
gtgtactggtacgctatgagcaagcccaataaaacacctgtagatgcacccaatttcctgaaacaaatcatcgaaaaagacctggagactggcaaagtcaaaggcgaagtggtcacgcgcttcccgccagagccgaacggatacctgcacttgggtcacgccaagtcgatctgtttgaattttggtctggctcaggaataccagggtcgctgccatctgcgttttgacgacaccaatcctgaaacggaagaaaccgaatacgttgaatccatccaggaagacgtcaagtggctgggctatgactggggccaacacctgtattacgcgtctgattacttcgagcagatctatcagtgggctgaacagctgattaaagacggcaaggcctatgtggattcccagaatgaagaggaagtgcgcaagaaccgcggcgacttcacgactccgggtaaggattccccttaccgcaatcgtactgttgaagaaaatctggatttgttccgtcgcatgcgtgccggtgagttcgatgaaggtcagcatattctgcgtgcgaaaatcgacatgcagtctccgaacatgaacatgcgtgacccgttgttgtaccgtatccgcaaggcgcatcaccaccgtactggtgacaagtggtgcatctatccgatgtacgattatgctcaccccttgtctgatgcaatggagcacatcacgcattccatctgtactttggaattccaggatcaccgtccattctatgactggtgtgtgcagaatgttccggtgccggcagagcctcatcaatatgagtttgcacgcatgaacatgacgtatctggtgatgagcaagcgcaagcttttgcaactggtaaaagaaaagctggtttctggctgggatgacccgcgcatgccgactatttccggtgttcgccgtcgtggttacactccggaatccatccgtcgatttgcaaaacgcattggtgtggcgaaatctgaaagcatcatcgaatacgacatcctggaaagctgcgtgcgtgagcacctggatgaaacggctcatcgtgcgatggcggttctggatccaatcaaagttgtgattgaaaacctgccggacggtcataaagagctgattgaaacgtctgtgcatccaaaaaacaccgagttggggaaccgctctttgccgttcactaaagaagtgtacattgatgcggcggacttcatggaaaatccgccggatgattacttccgtctgtctccgggcaaggaagttcgtctgcgcaatgcctatgtgatcaagtgcaaagacgtggtcaaagatgcttccggcaaagtgactgaattgcgctgtgaatatgatcctgtgactttgggcggtaagccgactgccgatggccgcaaagtaaaaggtatcgtccactgggtttcggcaacggattgtgtggatgcggaagtgcgtgtgtacgggcgtctgttcaaagtggcggatccggaaaatgtaccggacggtcaggatttcaaagtgaacctgaatccggactctttgaaggtgatcaagaacgcgaagctggaaaaaggtttgaaggatgcgaaacttgaaaaccgttaccagtttgaacgtgtgggttacttctgcctggacagtaaggactccaagccaggggcgttggtgttcaaccgggttgtcgagctgccatcaagtcactaa

SEQ ID NO: 90904 - protein, 564 aa, Bdellovibrio bacteriovorus HD100
MYWYAMSKPNKTPVDAPNFLKQIIEKDLETGKVKGEVVTRFPPEPNGYLHLGHAKSICLNFGLAQEYQGRCHLRFDDTNPETEETEYVESIQEDVKWLGYDWGQHLYYASDYFEQIYQWAEQLIKDGKAYVDSQNEEEVRKNRGDFTTPGKDSPYRNRTVEENLDLFRRMRAGEFDEGQHILRAKIDMQSPNMNMRDPLLYRIRKAHHHRTGDKWCIYPMYDYAHPLSDAMEHITHSICTLEFQDHRPFYDWCVQNVPVPAEPHQYEFARMNMTYLVMSKRKLLQLVKEKLVSGWDDPRMPTISGVRRRGYTPESIRRFAKRIGVAKSESIIEYDILESCVREHLDETAHRAMAVLDPIKVVIENLPDGHKELIETSVHPKNTELGNRSLPFTKEVYIDAADFMENPPDDYFRLSPGKEVRLRNAYVIKCKDVVKDASGKVTELRCEYDPVTLGGKPTADGRKVKGIVHWVSATDCVDAEVRVYGRLFKVADPENVPDGQDFKVNLNPDSLKVIKNAKLEKGLKDAKLENRYQFERVGYFCLDSKDSKPGALVFNRVVELPSSH

SEQ ID NO: 90905 - DNA, 2397 bp, Eremothecium gossypii
  CDS (1)..(2397)
atgtcatctgttgaggagctaagccagctgttcgcagatgtggggtttgaggaagcgaaggtgaaggagatagtcaagaacaagaaggttgcacactcgctggaagaactggttcgcgaagcaggggcgagggccgaatgggacaagggtaagcgtgcgctactgcacacgcttgcaagctccttgaagggggccacggtcaccgggcagaacctggttgccgagggcatccgcagcggtgaactgaagacatcgttgcaggtggatgcggccctgaagtatgtcaagcgggcgggcgagggagccacagtggccgagatgcacgctgagagcggcgtaggcgtccaggtgacggaagaccaggtgcaggcgcgcgtggtgcagtatctcgaagagaaccgcgcgaagatcgaaagcgagcgttacaagttggttccaggcatctttgcgcagatcaaggcgttgcccgagctgaagtgggcggacccgcggctgttcaagcctattattgatcgcgaggtattgaaaatccttgggcccaaggatgagcgcgatgttgttaagaaggaaaagaagaaagagcctaaaacgaacgacaaaaagaaggccgcggtggaggaggctcctaagcgcacgatgttctccgaaggttttctaggcgacctgcacaaagttggagagaacccacaggcctacccagagctcatggtagaacacttgaaagccactggcggcaaggtgcacacgcgtttcccacctgagccaaacggatacctacacatcggtcactcgaaggccatcatggtgaactttggctatgcgaagcatcacggcggtgtctgctacttgcgttttgacgataccaacccagaggcagaagcaccagaatattttgaaagtattgagagaatggtggcatggttggggttcagtccatggaagatcacatactcgagcgactactttgaccagctatatgaacttgccgaagttctgatcaagaatggtaagggatacatctgtcactgtactgcggaagagataagacgtggacggggtatcaaggaggacggtacaccaggtggcgagagactgccatgtgcccaccgtgaacggcccattgaggagaaccttgctgagttcaggaacatgcgcgatggcaaatatgctcccggagaggctattctccgtatgaagcaggatctgtcttctccttctccgcagatgtgggatttagttgcctacagagtcttgaacgctccacacccaagaacgggttccaaatggcgcatctatcctacctatgacttcacacactgtcttgttgattctctggagaacattacccattctctgtgcaccgccgagttctatttatcgcgcgagtcgtatgaatggttgtgcgatcaagtgcatgtcttcagacctgctcaaagggagtatggtcgtctgaatatcacaggcactgtattgtctaagcgcaagatcgccaagcttgtccacgagaaatacgtccgtggctgggatgatccccgtctcttcacccttgaggctattcgcaggcgcggtgtcccacctggagccatcctctccttcattaatacgctgggtgtcaccactagtactacaaacatccaggttgtccgttttgagagtgcaatcagaaagtacctcgaagacaccactgcacgcttgatgtttgtcttagatcccatagaagtcatcgtggacaacttgccagaggactatgaggagcttgtatcgattccttaccgcccaggcacgccagagttcggagagaggacggttcccttcagcaagcgtttctacatcgagcgttccgatttctctgaggacacctctgacaaagagttcttccgtctcacgcctgctcaatcggtaggtctcatcaaggtgccatacactatcgccttcaagagcctagagcgtgatgcgaacggaaagatcacgcgtattcacgcccactatgagaacgacacacctgatgggaagcctcgcaagccaaagacctacatccagtgggttcctattgcacctcgccatggttctcctatcccagttgcagaaacgcgtgtttacaaccagctgttcacttcagagaacccaagcggagacccagccgacatcaacccttacagtgaggtcatatatccttccgcggtcgtcgagcacaacttccgtcatgtcgtctctaactctccgtgggtcgtcgaaagcgccaagcagtccgagttctacgtcccagaggaacatgatcgcaaagaggtctgccgtttccaggctatgcgcgtaggctacttcacgcttgacaaggacagtacccatgaccgcatcatcctcaaccgcattgtcagcctcaaagatggctccaagtag

SEQ ID NO: 90906 - protein, 798 aa, Eremothecium gossypii
MSSVEELSQLFADVGFEEAKVKEIVKNKKVAHSLEELVREAGARAEWDKGKRALLHTLASSLKGATVTGQNLVAEGIRSGELKTSLQVDAALKYVKRAGEGATVAEMHAESGVGVQVTEDQVQARVVQYLEENRAKIESERYKLVPGIFAQIKALPELKWADPRLFKPIIDREVLKILGPKDERDVVKKEKKKEPKTNDKKKAAVEEAPKRTMFSEGFLGDLHKVGENPQAYPELMVEHLKATGGKVHTRFPPEPNGYLHIGHSKAIMVNFGYAKHHGGVCYLRFDDTNPEAEAPEYFESIERMVAWLGFSPWKITYSSDYFDQLYELAEVLIKNGKGYICHCTAEEIRRGRGIKEDGTPGGERLPCAHRERPIEENLAEFRNMRDGKYAPGEAILRMKQDLSSPSPQMWDLVAYRVLNAPHPRTGSKWRIYPTYDFTHCLVDSLENITHSLCTAEFYLSRESYEWLCDQVHVFRPAQREYGRLNITGTVLSKRKIAKLVHEKYVRGWDDPRLFTLEAIRRRGVPPGAILSFINTLGVTTSTTNIQVVRFESAIRKYLEDTTARLMFVLDPIEVIVDNLPEDYEELVSIPYRPGTPEFGERTVPFSKRFYIERSDFSEDTSDKEFFRLTPAQSVGLIKVPYTIAFKSLERDANGKITRIHAHYENDTPDGKPRKPKTYIQWVPIAPRHGSPIPVAETRVYNQLFTSENPSGDPADINPYSEVIYPSAVVEHNFRHVVSNSPWVVESAKQSEFYVPEEHDRKEVCRFQAMRVGYFTLDKDSTHDRIILNRIVSLKDGSK

SEQ ID NO: 90907 - DNA, 1668 bp, Methanococcus maripaludis S2
  CDS (1)..(1668): transl_table=11
atgaaagatactgtaatgacatatctacttgaaaattcgattaaatttaaaggaaaaccaaatccaaaagctgcaatgggtaaaatacttggggaaaaccctgatttaagaagcaaagttaaagaagtaaatcaggttatttcagaagttttaaaagaaattgaaacaatgtctcttgaagaacagcaggcaaaattagacgaacttgctccagaaggactcggtcaaaaaacagaaagaaaaagaaaggaaatcgagttgaaaaacgttaaaggaaatgttgtaatgagatttgcaccaaatccttcaggacccctccatattggacatgcaagagcatccgtattaaacgactttttctcaaaaaaatacaacggaaagcttgttttaaggcttgaagacactgatgccaaaagagtacttccagaagcttacgaaatgattcaggaagatttaaaatggctcggagtaaaagttgacgaagtaatcgtacaatcagaaaggcttgaaacttactatgaatatggtagaaaattaattgaaatgggacacgcttacgtttgcgattgtgatgcggatgagtttagaactttaagagaacaggggctcccgtgtaaatgtagggatactactccagaagaaaatattgcattatgggaaaaaatgctcgctggagaacttgataatgttgcagtaaggttaaaaacagatattgcacacaaaaacccatcaatcagagattttccaatatttagaattgaaagaacgccccaccctaaaaatggaacaaaatatcacgtatatccattaatgaatctttcagtaactgttgacgaccatttgctcggtatgacacacgttttaaggggaaaagatcacattgtaaacaccgaaaaacaagaatatatttataattatttcggatgggaaattccagaatacgtacactacggaattttaaaaatagaagggccagttttaagtacttcaaaaatgcatgcaggaattttgagcggagaatactcaggctgggatgatgcaaggcttggaacattgagggctcttagaaaaagaggaataaggccagaagcactctataaattaatggttgaaattggaataaaacaggcagacgttagatttgcatgggaaaacctctacgctgcaaacaaagacataatcgataaagatgcaagaagattcttctttgtagaaagtccgaaaaaattagtaatttctggcgcagaaaatagaaaaatcgatcttagaatgcaccctgacagaagtgaacttggaaacagggaattattgtttgacggtgaaatatacgtttcagacgatcttgaagctggaaaaatgtatagattaatggaattattcaatattgttgttgaaaaagtagaaaatgatataatttatgcaaaatacgacagtgatgactttaaagttgcgaaaactaataaagcaagtatcattcactggattcctgtaaaagacagcattcctgtaaccgttattgatgaaaatgctgaaaaaatagaaggatttgcagaaaaagactttgcagttgtaaaagaagatgattttgtccagtttgaaagatttggatttgtaagaattgacgaaaaattagacaataaatatacctgctacttaactcataaataa

SEQ ID NO: 90908 - protein, 555 aa, Methanococcus maripaludis S2
MKDTVMTYLLENSIKFKGKPNPKAAMGKILGENPDLRSKVKEVNQVISEVLKEIETMSLEEQQAKLDELAPEGLGQKTERKRKEIELKNVKGNVVMRFAPNPSGPLHIGHARASVLNDFFSKKYNGKLVLRLEDTDAKRVLPEAYEMIQEDLKWLGVKVDEVIVQSERLETYYEYGRKLIEMGHAYVCDCDADEFRTLREQGLPCKCRDTTPEENIALWEKMLAGELDNVAVRLKTDIAHKNPSIRDFPIFRIERTPHPKNGTKYHVYPLMNLSVTVDDHLLGMTHVLRGKDHIVNTEKQEYIYNYFGWEIPEYVHYGILKIEGPVLSTSKMHAGILSGEYSGWDDARLGTLRALRKRGIRPEALYKLMVEIGIKQADVRFAWENLYAANKDIIDKDARRFFFVESPKKLVISGAENRKIDLRMHPDRSELGNRELLFDGEIYVSDDLEAGKMYRLMELFNIVVEKVENDIIYAKYDSDDFKVAKTNKASIIHWIPVKDSIPVTVIDENAEKIEGFAEKDFAVVKEDDFVQFERFGFVRIDEKLDNKYTCYLTHK

SEQ ID NO: 90909 - DNA, 1758 bp, Yersinia pestis biovar Medievalis str. 91001
  CDS (1)..(1758): transl_table=11
ttgtttgccgtaacaaacggttgtttccgggccgggcttgttggattatatgcggttatgtttgttgcgtttgcattgaggaatagaacaatgagtgaggcagaagcccgcccaagtaattttatccgtcaaattattgacgaagatttagccagcggtaaacacacgtcggttcatacccgttttccgccagagcctaacggctatctgcatatcggccatgcaaaatctatttgcctgaattttggtattgctgaagattatcagggccaatgtaatttacgctttgatgacactaatccagtgaaagaagatgtcgagttcgtcgagtcaattaaacgcgacgtagagtggctgggcttcacttggagtggtgatgtacgctattcctcagactactttgatcaactgtatcagtacgctgtggagttgattaacaagggtcttgcgtatgtggatgagctgacccccgagcagatgcgcgaatatcgtggcaccttgactgcgccgggtaaaaatagcccatatcgtgaccgcagtgtggaagagaacctggcgctgtttgaaaagatgcgtgcggggggttttgctgaaggcaccgcctgcttacgggccaaaattgacatggcgtcaccgttcattgtgatgcgtgaccctgtgctgtaccgcatcaaatttgcagaacatcatcaatctggcaataagtggtgcatctacccgatgtatgacttcacccattgcatttccgatgcgctggaggggatcactcattcattgtgtacgttggaattccaggataaccgtcgcttgtatgattgggttctggataatatctcgattgattgtcatccgcgtcagtatgagttctcccgtctgaacctcgaatataccatcatgtctaagcgtaagctgaaccagttggtcacagagaaggtcgttgagggctgggatgatccacgtatgccgaccatttctggcctgcgccgtcgtggttataccgcagcgtctatccgtgagttctgccgccgtattggtgtcaccaagcaggataacaatgtcgaaatgatgtcactggaatcgtgtatccgtgatgatctgaacgaacatgcgccacgggcgatggccgtgcttgacccgattaaggttgttattgaaaatcgcgcggcgggtgaagagtggctgacgatgccaaaccacccgaataaccccgaaatggggagccgtcaggtgccattcgatagcgaaatctacattgatcgggctgatttccgcgaagaagctaacaagcaatataagcgcttggtcttgggcaaagaagtgcgcctgcgtaatgcctacgtgatcaaagctgaacgcgttgagaaagacgcagaaggcaatgtcacgacactttattgcagctatgacgctgagacattaaacaaagatccggctgatggccgcaaagttaaaggggttattcattgggtttctgttgcccatgcgctgcctgcggagatccgtttatacgatcgcttgtttaacgtaccaaacccagcggcagcggaagacttcctgtcaaccatcaaccctgagtccttggttatccgtcagggctttgttgagccaagtctggctgatgcggtatcagataaaacctatcagtttgagcgtgaaggttatttctgtgctgatagccgttattcacgtcccggtgctctggtgtttaaccgtactgtcggcttacgtgatacctgggcggcgaaagccactcagtaa

SEQ ID NO: 90910 - protein, 585 aa, Yersinia pestis biovar Medievalis str. 91001
MFAVTNGCFRAGLVGLYAVMFVAFALRNRTMSEAEARPSNFIRQIIDEDLASGKHTSVHTRFPPEPNGYLHIGHAKSICLNFGIAEDYQGQCNLRFDDTNPVKEDVEFVESIKRDVEWLGFTWSGDVRYSSDYFDQLYQYAVELINKGLAYVDELTPEQMREYRGTLTAPGKNSPYRDRSVEENLALFEKMRAGGFAEGTACLRAKIDMASPFIVMRDPVLYRIKFAEHHQSGNKWCIYPMYDFTHCISDALEGITHSLCTLEFQDNRRLYDWVLDNISIDCHPRQYEFSRLNLEYTIMSKRKLNQLVTEKVVEGWDDPRMPTISGLRRRGYTAASIREFCRRIGVTKQDNNVEMMSLESCIRDDLNEHAPRAMAVLDPIKVVIENRAAGEEWLTMPNHPNNPEMGSRQVPFDSEIYIDRADFREEANKQYKRLVLGKEVRLRNAYVIKAERVEKDAEGNVTTLYCSYDAETLNKDPADGRKVKGVIHWVSVAHALPAEIRLYDRLFNVPNPAAAEDFLSTINPESLVIRQGFVEPSLADAVSDKTYQFEREGYFCADSRYSRPGALVFNRTVGLRDTWAAKATQ

SEQ ID NO: 90911 - DNA, 2325 bp, Anopheles gambiae str. PEST
  CDS (1)..(2325)
atgaccacgatggaacatctcgtttctctcggtctaaatgagcaaaaaatcaaggaaacgcttaaaaacgcaacccttactagcacaattacacgtgccttctcttacgtcccgccgggtgtggagttaagttcagcacaaaaaccgctgatatttcaggcatgctcaaagataaaaccgcagacggctcaccatttggaacttatagtgagaaaaattttggataacagtttggacactagtctacgtgttgacaccgcactggaatatgttctggctaacgtgacgaaagccactatcgacgaagctactttcgatgcggcttgcggtgtgggagtagttgtgacaccggaagaaatcgagcgggcggttgaaataaccgttgccaaatatcgtagcgatatcgtcgaccaacgttatcgttttaatgtcggaaaattgttgagcgaaattcgaagtgctttgccatgggtggatggtaaagcccttaaaagtgaggtggatgtgcaaatgtttgatttacttggccccaaaacggatgccgatggcgagaaagtgggtaaaaaacgtcgggaaaccccagcctcagatactgcacccaaagcaacctctgtcgttgaaccatcagccgtcaatgctaataatcgaccagaaggccctcgaacgatggttgatctgatgcgtaatgtcgatttccatcgtccaggcgaaaatttcaaaactgatgggtatattattactcccgatacggaacgtctcttgaaggatcatttacagcgaactggtggcaaagtgcgtacccgcttccctcctgagccgaatggaattctgcacattggccacgctaaagctatcaacatcaactttgcttacgcggcagcgaacgatggcatctgcttccttcgttacgatgacaccaatcccgagaaggaagaggaaaaatttgttaaaggcatacgcgacattgtcgaatggctcggttataagccattcaaaattacttactcttcggactacttccaacagttgtacgaatttgctgtgcagctcataagaaaagatatggcttacgtgtgtcatcaaactgctgatcaaatgaagggatttacaaccgaaccatccaagtggcgtaatcgtccaatcgaggaaagcctgcagctgttcgaagacatgaaaaatgggaaaattgatgaaggtgcggcaacattacgcatgaaaatcacgctggaggagggaaaaatggacccggtagcctaccggatcaagtttattccacaccatcggaccggaacaaagtggtgcatctatccgacgtacgactacacacattgtttgtgcgatagtctggaggatatcacccattcgctttgcaccaaggagttccaatcgagaagatcgtcgtattattggctctgtaatgcactcaatatatactgcccagtgcaatgggaatatgcgcggcttaatgttaactacaccgtagtttctaagcgcaaaattaacaagctgatcactgaaaatattgttaacgactgggatgatcctagattattcaccctgtctgctttgcgacgcaagggttatccagccgaagcaatcaacaatttttgtgcccagatgggtctcaccggtgcccaaacgtccattgaccctgctgcactggaagcgtctgccagagatgtattgaatcttgcagcatcacgtacaatggcagtattagaacctctgaagattactatacttgattatccgcatgacgggccaattcaactatcagtgcccaattttccaaacgtgccggagaaaggcgagcacatgatttggttcgatcgtgttgtatatatagagcgaaccgatttcatggaaaatgctgacaaatctttccgtcgactaacgccaggacaaccggttggactgaaatacattggttccatgcttagagtagaaagtgttgttcgaaaatcgggcaccgtcgaggaactagtatgtcgcatagaaccgtgtactgcaaccgaaaaacctaaagcgtatgtacactgggtagctaaaccctgtccagtagaggtacgtttgtatgagaagctgtttatgcacaagaacccagaagacagtaacgatgttcccaatgggtttttgagcgactgtgcttcggacacgattcgttcactgtgcggctatgtcgatgcacatgtcatgaacagtaaagtgtacgataaatatcaattcgaacgcattggttacttctccgtggatccggatagcagaaacggccagcttgttttcaatcgtaccgtcacgcttaaagaagatactggtaaaaattag

SEQ ID NO: 90912 - protein, 774 aa, Anopheles gambiae str. PEST
MTTMEHLVSLGLNEQKIKETLKNATLTSTITRAFSYVPPGVELSSAQKPLIFQACSKIKPQTAHHLELIVRKILDNSLDTSLRVDTALEYVLANVTKATIDEATFDAACGVGVVVTPEEIERAVEITVAKYRSDIVDQRYRFNVGKLLSEIRSALPWVDGKALKSEVDVQMFDLLGPKTDADGEKVGKKRRETPASDTAPKATSVVEPSAVNANNRPEGPRTMVDLMRNVDFHRPGENFKTDGYIITPDTERLLKDHLQRTGGKVRTRFPPEPNGILHIGHAKAININFAYAAANDGICFLRYDDTNPEKEEEKFVKGIRDIVEWLGYKPFKITYSSDYFQQLYEFAVQLIRKDMAYVCHQTADQMKGFTTEPSKWRNRPIEESLQLFEDMKNGKIDEGAATLRMKITLEEGKMDPVAYRIKFIPHHRTGTKWCIYPTYDYTHCLCDSLEDITHSLCTKEFQSRRSSYYWLCNALNIYCPVQWEYARLNVNYTVVSKRKINKLITENIVNDWDDPRLFTLSALRRKGYPAEAINNFCAQMGLTGAQTSIDPAALEASARDVLNLAASRTMAVLEPLKITILDYPHDGPIQLSVPNFPNVPEKGEHMIWFDRVVYIERTDFMENADKSFRRLTPGQPVGLKYIGSMLRVESVVRKSGTVEELVCRIEPCTATEKPKAYVHWVAKPCPVEVRLYEKLFMHKNPEDSNDVPNGFLSDCASDTIRSLCGYVDAHVMNSKVYDKYQFERIGYFSVDPDSRNGQLVFNRTVTLKEDTGKN

SEQ ID NO: 90913 - DNA, 1956 bp, Neurospora crassa
  CDS (1)..(1956)
atgaccgacgccgttgtagatgccgctgccaagatgcagctggccgacgcccccgtcgaccccaatgcccccaagctcgttcttgacgaggagaccggcgagatggtctccaagggcgagctcaagaagcgtctggccaagcgcgcaaagaaggccatcaaggagaagaacaaggacgacaagaagaacgtcgccgctacgactgccgctgcccaagacggtgccacccccaagaagcagacccccaagcccgaagaggcccccatcgacacccaggccatgttcaagcagggcttcctcaacgacgtctacaacgagcgccccgtcaagcccgtcttcacccgtttccctcccgagcccaacggcttcctccatatcggccacgccaaggccattgccatcaactttggctttgccaaataccacggcggcaactgctacctccgattcgacgacaccaaccccgaggccgaggaggaaatctacttcaccgccatcgaggacacggtccgctggctcggcttcaccccctacaagatcacgtactcgtccgacaacttccagaagctgtacgacctggccgaaaagctgattggcctcgacaaggcctacgtctgccactgcaacgatgacgagatcaagctccagcgtggaggtgagaagggctccagcccccgtttccgctgcaagcacgccgagcagtccgtcgaggagaacctccagaagttccgcgacatgcgcgacgggaaatacaagcccagggaagctttccttcgcatgaagcaggatatcaccgacggtaacccccagatgtgggatcttgccgcttacagagtccttgacaagcctcaccacaggaccggaagccagtggaagatctaccctacatatgacttcacccactgtctttgcgatagcttcgagggcatcacccactccctctgcaccaccgagttcgtgctcagccgtgtctcgtacgagtggctcaacaagtctctcgaggtctacgagcccatgcagcgcgagtacggccgtcttagcttgtccggcaccgtgctctccaagcgcaagctcaaggagctggtcgaccgcaagattgtccgcggctgggacgacccccgtctgtacaccctgatcgccgtccgccgcagaggtgttcctcccggcgccatcctcgagttcgtcaacgagctcggcgtcaccacctccaacagcatcatccagattgtccgctttgagcagaccatccgccgctacctcgagcgcaccgtgccccgcctgatgctcgtgcttgaccccgttcccgtcgtgatcgaggacgctgacgagttcgacggttccgagctcaccgtgcctttctcgtccaagaacgccgctatgggcgaccacaagatcaagttcaccaagaccgtttacattgaccgctccgacttccgtgaggtcgactccaaggactacttccgcctcgccccgggcaagaccgtcggccttctccaggcccccttccccatcaaggccaccagcttcaccaaggacgagaccacgggcaaggtcaccgagatccgcgccgtcttcgaccgtgagaccaagaagcccaagacctttatccagtgggttggcaccgacggctctcgcaagtgtgaggtccgcgtctacaaccaactgttcaagtcggagaaccccgctgctgccgagggcggctggttgagcgacatcaaccccgagagcgaggtcgtctaccctgatgcccttatcgagtctggcttcgacgaggtcaagcgccgcgctccttggcctgaggcggctggtgagagcgagcttggcaagggcggtcctgagagtgtccgcttccaggctatgcgtgttgcttactttgccctggacaaggaaagcacagatgacaagatcgttcttaaccgcattgtttcgctcaaggaggataaggagaagaactaa

SEQ ID NO: 90914 - protein, 651 aa, Neurospora crassa
MTDAVVDAAAKMQLADAPVDPNAPKLVLDEETGEMVSKGELKKRLAKRAKKAIKEKNKDDKKNVAATTAAAQDGATPKKQTPKPEEAPIDTQAMFKQGFLNDVYNERPVKPVFTRFPPEPNGFLHIGHAKAIAINFGFAKYHGGNCYLRFDDTNPEAEEEIYFTAIEDTVRWLGFTPYKITYSSDNFQKLYDLAEKLIGLDKAYVCHCNDDEIKLQRGGEKGSSPRFRCKHAEQSVEENLQKFRDMRDGKYKPREAFLRMKQDITDGNPQMWDLAAYRVLDKPHHRTGSQWKIYPTYDFTHCLCDSFEGITHSLCTTEFVLSRVSYEWLNKSLEVYEPMQREYGRLSLSGTVLSKRKLKELVDRKIVRGWDDPRLYTLIAVRRRGVPPGAILEFVNELGVTTSNSIIQIVRFEQTIRRYLERTVPRLMLVLDPVPVVIEDADEFDGSELTVPFSSKNAAMGDHKIKFTKTVYIDRSDFREVDSKDYFRLAPGKTVGLLQAPFPIKATSFTKDETTGKVTEIRAVFDRETKKPKTFIQWVGTDGSRKCEVRVYNQLFKSENPAAAEGGWLSDINPESEVVYPDALIESGFDEVKRRAPWPEAAGESELGKGGPESVRFQAMRVAYFALDKESTDDKIVLNRIVSLKEDKEKN

SEQ ID NO: 90915 - DNA, 1899 bp, Magnaporthe grisea 70-15
  CDS (1)..(1899)
atggctgacgcaatcacagagggggcggccaagctccagcttgacgaggagacaggcgagatggtctccaagggcgaattgaagaagcgcatgcagaagagagccaagaaagccgcccaagcaaaggccaaagaggctgcccaggccaccgccggcgatgcagagaagaaggcacctgccaaacctgcagcaaaacccgaggaggtggtcattgatgccgatgccatgtttaaacagggtttcctcgacgaagtcttccgcaaccgacccatgaagcccgtattcactcgattccctcccgagcccaacggattccttcacatcggtcacgccaaggctatcgctatcaacttcggatttgcgaggcaccacggcggccaatgctatctgcgttacgacgacacgaaccccgaaaaagaggaggaaaagtacttcacgtccatcgagtccatggtccggtggctgggattctcgccgtacaagattacctactcgagtgacaactttgacaagctctacgagctggctgagaagctaatcaaccttggcaaggcctacgtgtgcaagtgcgacgacgccgagatcaagcttcagcgtggtggcgagaagggcaagtcaccgcggtaccggtgtgcccatgccgaccagaccccggaggacaacctggctcagttccgcgatatgcgtgacggaaagtacaaggagagggaggcattcctgcgcatgaagcaagacatcaccgacggcaaccctcagatgtgggacttggccgcttaccgtgttaagaaagccgagcaccacagaacaggagacaagtggaaaatctacccgacatatgatttcacccactgcttgtgcgattctttcgagggcatcacccactccctctgcacgaccgaattcatccaatcgcgccagagctacgagtggctcaacacaactctcggggtatacgagcctcagcagcgcgaatatggcaggctgggtctcggcggcactgtcctgtcaaaacgcaaaattctcaagcttgtcgagctgggccacgttcgggaatgggacgaccccagactctacactctgacggcaatcaagaggcgcggtgtcccacctggcgccatcctcgaattcgtcaatgagctcggtgtcactacagccgcaactgtgattcaaattaagcggtttgagcagacgattcgccggtaccttgagcgcactgtgccccggttgatgatggttctggacccactacgtgtcgttattgaggacgccgacgatctcgacggcaaacccctctcaatcccattctcttccaaggttcccgagatgggttctcatgacttgaagttcaccaagacagtctacatcgacaggtctgacttccgagaggtcgacagtaaagactacttccgcttggcccctggcaaacccgtgggtctgctgaatgttccgtatcccatcaaggtgaagtcattcagcaaagacaaagcaacgggtgaagtaacagaagttcgggccgaattcgatcgggagaagaaaaagcccaaggcctacattcagtgggtacctgagggttctcgcaaggttgaggcccgtgtgtataatccgttgttcaaatcggagagcccggactccgtagaggggggctttttggcagacatcaatccagagagccagatcatatacccagacgcgctgctagagagcggattcgaagaggtcagacggcgtgcaccatggcctgaagcggctggcgagagcgaactgggcaagggaggaccggagagtgtccggttccaggccactagggtggcttactttgccatggactccgacagcacggaagacaagattgttctcaaccgcattgtgtctctaaaagaagacgccggcaagaactaa

SEQ ID NO: 90916 - protein, 632 aa, Magnaporthe grisea 70-15
MADAITEGAAKLQLDEETGEMVSKGELKKRMQKRAKKAAQAKAKEAAQATAGDAEKKAPAKPAAKPEEVVIDADAMFKQGFLDEVFRNRPMKPVFTRFPPEPNGFLHIGHAKAIAINFGFARHHGGQCYLRYDDTNPEKEEEKYFTSIESMVRWLGFSPYKITYSSDNFDKLYELAEKLINLGKAYVCKCDDAEIKLQRGGEKGKSPRYRCAHADQTPEDNLAQFRDMRDGKYKEREAFLRMKQDITDGNPQMWDLAAYRVKKAEHHRTGDKWKIYPTYDFTHCLCDSFEGITHSLCTTEFIQSRQSYEWLNTTLGVYEPQQREYGRLGLGGTVLSKRKILKLVELGHVREWDDPRLYTLTAIKRRGVPPGAILEFVNELGVTTAATVIQIKRFEQTIRRYLERTVPRLMMVLDPLRVVIEDADDLDGKPLSIPFSSKVPEMGSHDLKFTKTVYIDRSDFREVDSKDYFRLAPGKPVGLLNVPYPIKVKSFSKDKATGEVTEVRAEFDREKKKPKAYIQWVPEGSRKVEARVYNPLFKSESPDSVEGGFLADINPESQIIYPDALLESGFEEVRRRAPWPEAAGESELGKGGPESVRFQATRVAYFAMDSDSTEDKIVLNRIVSLKEDAGKN

SEQ ID NO: 90917 - DNA, 1896 bp, Gibberella zeae PH-1
  CDS (1)..(1896)
atgtccgaccctgtcgctgaggtcaccgaggccactgtcaagctcgtgcttgacgaggtgacaggcgagcaggtcacgcgcaacgagctgaagaagcgaacccagaagcgagctaagaaggctgctgctcaggcatcgcgagaggagaaggcaaagaaccaggaggcaaaccccaagcctgctgcgcccaagcccaaggcccaggagcctacccagctcgaccccgatgctatgttcaagcagggcttcctcgccgatgtatacaaggagagacctgtgaagcctgttgtcacccgattccctcccgagccaaacggataccttcacttgggtcacgccaaggctattgccattgactttggattcgctcgctaccacggtggcaagacgatccttcgattcgatgacacaaaccccgacgaagaggaggagatctattttgaatggatcctgaagatcatcaggtggcttggttttgagcctagcgccatcacacactctagcgacaacttccagaagctattcgatctcgccaaggagcttattaagaaggacaaggcatacgtctgccactgtaacgaagccgagatcaagcttcagcgtggtggaaaggaaggaaaggaaggtccccgataccgttgcgcccatgccgagcaggatgtcgagacaaacctccagaagttccaggatatgcacgatggaaaatacgcaccccagactgctttcctccgcatgaagcaggacatcacaaacggcaaccctcagatgtgggatcttgcggcctaccgcatacctaagaaccagaaggttcaccaccgagcgcccgagtggaagattttccctacctacgatttcacacactgtctttgcgatagtttcgagggtatcacacacagtctgtgcaccaccgagtttattctgtctcgtgaaagctacgagtggctgaacaagtccctcgaggtctacgagccaatgcagcgagagtttggccgacttaatgttagcggaaccatcatgagcaagcgagctctcaagaagcttgttgagggcggatatgttcgagcttgggatgaccctcgtctgtacacactgatcgccatcaagcgtcgcggtatcccccctggcgctcttttggctttcatcaacgagcttggtgttaccacagccaaaacaatcatccagattgcacgattcgagcagaccgtccgccgttacctcgagaacactgtgccacgactcatgcttgtcctggaccctattcccgtgaccattgaggatcacgaggaaactgtagaacttgaggttccttactcccctaaggaccccaagttcggtactcacaaggtccgatttaccaagactgtctacattgaccgatccgatttccgagaggaagacattaagggctacttccgacttgcccctggtaagaccgttggtcttctcaacgctcctcaccctatcaaggctacttcgttcgagaaggatgagtcaggtaaggtcactagcatcaaggctgtgttcgacaaggagagcaagcccaagacctacatccagtgggtgcccgagggctccatcaagttggaggcccgtgtgcaaagccctctgttcaagtctgacgaccctactgcggttgagggcggctttttgaacgacatcaaccccgacagtgaggtcgtctaccctgaggctcttgttgaggagggttttaatgaggtgcgccagcgcgctccttggcctgttacagctggtgagaccaacgaggctagcggccccgagagtgttcgattccaggctatgcgtgtcgcctactttgccatggactcggatagcacagatgacaagattgtgcttaaccgtattgtttctctgaaggaggatcgcgaaaagaactag

SEQ ID NO: 90918 - protein, 631 aa, Gibberella zeae PH-1
MSDPVAEVTEATVKLVLDEVTGEQVTRNELKKRTQKRAKKAAAQASREEKAKNQEANPKPAAPKPKAQEPTQLDPDAMFKQGFLADVYKERPVKPVVTRFPPEPNGYLHLGHAKAIAIDFGFARYHGGKTILRFDDTNPDEEEEIYFEWILKIIRWLGFEPSAITHSSDNFQKLFDLAKELIKKDKAYVCHCNEAEIKLQRGGKEGKEGPRYRCAHAEQDVETNLQKFQDMHDGKYAPQTAFLRMKQDITNGNPQMWDLAAYRIPKNQKVHHRAPEWKIFPTYDFTHCLCDSFEGITHSLCTTEFILSRESYEWLNKSLEVYEPMQREFGRLNVSGTIMSKRALKKLVEGGYVRAWDDPRLYTLIAIKRRGIPPGALLAFINELGVTTAKTIIQIARFEQTVRRYLENTVPRLMLVLDPIPVTIEDHEETVELEVPYSPKDPKFGTHKVRFTKTVYIDRSDFREEDIKGYFRLAPGKTVGLLNAPHPIKATSFEKDESGKVTSIKAVFDKESKPKTYIQWVPEGSIKLEARVQSPLFKSDDPTAVEGGFLNDINPDSEVVYPEALVEEGFNEVRQRAPWPVTAGETNEASGPESVRFQAMRVAYFAMDSDSTDDKIVLNRIVSLKEDREKN

SEQ ID NO: 90919 - DNA, 1875 bp, Gibberella zeae PH-1
  CDS (1)..(1875)
atgactttcgacgccgagaagatcggcgctgccgacttcaagagccttggacctcttgttgctgagctcgacaagcaccttaccctccgaacctacctcaacggctacactctgagcgaggaggatggcaagatctggactgctcttcgaaccaacaaggttgccattggccttgtccgaaagggtgcctacaccaacatcacccgatggttcaagctgattgaggaggcacaccccgagtttaacgagaagctcaacgccggaaaggagaagcgctctggaggtgccaattacaacattggcctctccaacactgagaacggtgttgtcactcgattccctcccgagcccagtggttaccttcacattggtcacgccaaggccgctctcctcaacgattacttcgcaaagacctcccccgacggaaacggaaagcttattgttcgattcgatgacacaaaccccgccaaggagaagcaggagtttgaggatgctatcctccacgacctcgagctgatggacatcaagtaccacaaggtcacccactccagtgactacttccaggagatttacgacctgaccgagaagatgatccaagacggcaacgcctacgccgatgataccgaccccgaggtccagagcgccgaccgaaagaaccgccttgccagcaagcgacgtgaccgccctgcggaggagagtttggccatgttcagagagatgaaggctggtaccgacctgggacgaaagcactgcattcgcgcacgcattgcttttgactcgagcaacggttccatgcgagaccccgtcatcttccgattccccaactggaagggagaagagcccgccccccaccaccgaacaggctggacctggaacatctaccccacatacgatctcgtcgtccctatccttgactccatcgagggagtcacccacgccctccgaacgaccgagtatgccgaccgaaacgagcaataccactggttcctcaaggccttgaacctccgacaggtccacctgtgggatttcgcccgtatcaacttcatccaaacattcctctccaagcgaaagctcacaaaggttgtcgacactggacgtgtcagtggctgggatgacccccgtatgcctactgtccgtggtatcatccgccgtggtctgactgtccccgctctccgcgagttcatgttgaagcagggtcctagccgaaacgtcgtcaccatggattggaccaccatctgggccatcaacaagcgaatgctcgaccccgttgtgccccgatacatggccattgaggagaaggatgctgttactgtcaccatcactggaggccccgagaagtcctacaaggaggacaggcccaagcacgtcaagaaccctgacgtcggtaccaagcaggttacctttggacccaagctcctcctagaccaggtcgacgttgcttctttcgatgacaacgaggagattaccctgatgagctggggtaacgccatcgtccgaggtatcaacaagactgcctcgcccatcaacgagctcaacctcgagctccaccttgccggtgacttcaagaccaccagcaagaaggttcattggctcgccgccgaccccgagaacctcgtcaaggctgagctctgggagtttggctcgctcatcaccaaggatactctcgagaaggacgacaacctggacgacttcctcaacgacaacagcgccaccctcaccaacgcccttgtcgacgccagcatcgccgagctcaaggagaacgacttcctccagcttgagcgaaagggctactaccgcgtggacaaggctctcggccaaggccccgacggccgagctgtgctgttcaaggtccccacaggtggccagaagggttag

SEQ ID NO: 90920 - protein, 624 aa, Gibberella zeae PH-1
MTFDAEKIGAADFKSLGPLVAELDKHLTLRTYLNGYTLSEEDGKIWTALRTNKVAIGLVRKGAYTNITRWFKLIEEAHPEFNEKLNAGKEKRSGGANYNIGLSNTENGVVTRFPPEPSGYLHIGHAKAALLNDYFAKTSPDGNGKLIVRFDDTNPAKEKQEFEDAILHDLELMDIKYHKVTHSSDYFQEIYDLTEKMIQDGNAYADDTDPEVQSADRKNRLASKRRDRPAEESLAMFREMKAGTDLGRKHCIRARIAFDSSNGSMRDPVIFRFPNWKGEEPAPHHRTGWTWNIYPTYDLVVPILDSIEGVTHALRTTEYADRNEQYHWFLKALNLRQVHLWDFARINFIQTFLSKRKLTKVVDTGRVSGWDDPRMPTVRGIIRRGLTVPALREFMLKQGPSRNVVTMDWTTIWAINKRMLDPVVPRYMAIEEKDAVTVTITGGPEKSYKEDRPKHVKNPDVGTKQVTFGPKLLLDQVDVASFDDNEEITLMSWGNAIVRGINKTASPINELNLELHLAGDFKTTSKKVHWLAADPENLVKAELWEFGSLITKDTLEKDDNLDDFLNDNSATLTNALVDASIAELKENDFLQLERKGYYRVDKALGQGPDGRAVLFKVPTGGQKG

SEQ ID NO: 90921 - DNA, 2529 bp, Ustilago maydis 521
  CDS (1)..(2529)
atggctactcccacactcaagctcgacccgcaggcaaaggtcgccccgctggcacctatcgcgcttgccaaactcgttactgctgctgacgcttctcaggcgctcacgctcgtctttgaggacggcatcgcgcccactctgatccttcctaacgccgctcctgttgagggctaccttcacattatccgagagctcgcctcgcactatgcccaccttggtctctctggcaccgacaaggaccagagcgcacaggtcaacctctacgtcagccaaggcgacaacctagcactcgccaacttccagaccgcttcggcgatcgccgacagcctcgaccagcaccttgctctgcgcacgtttctcgtcagccactctgtcactgcggctgatgcagccatctgggcggctgtgcgtgccagctcgcccgtcattggtctcgtccgtaagggtctccacaagcacttgcagcgatggttcaaccacatcgactcgcttgcacccttctctgacgcgctcgtccaactcgccgatgccaaggccgagaagttcaagaacaaaaagaccgctgctggctttgatctcttcctcaaggatgctcagcagggccaggtggtcactcgcttccctcccgagccttcgggttatctgcacgtcggtcacgccaaagccgccattctcaaccagtattttgctcgccagtacaacggcaaactcattattcgattcgacgacaccaacccaagcaaggagaaggaggagttcgaacagtcaatcatcgaggatctcgcacttctcggtatcaagggtgacgcgacgagccacacctcggattactttgacaagctttaccagcttgccatccagatgattcagcttggcaaagcgtacgctgatgacacacctcaggagcagatgcgtgccgagcgtatggacgggatcgcttcgaagcgccgtgatgcatcggtcgaggaaaatatgacgcgtttcgccgacatgtcgactggctctgctgaaggtcgtaagtggtgcttgcgtgccaagatctcgtattcggatccgaacaaggcaatgcgtgacccagtcatctatcgctgcaacccagacgtctcgcatcaccgcacgggcactacctggaaggtgtacccaacgtacgactttgcgtgcccgattgtcgactcgatcgaaggcgtcacgcacgctctgcgtaccaacgagtaccgcgaccgcaacccgcagtactactggatgctcgacgcgctcaagctgcgtaaagtggatatttgggactttggtcgtctcaactttgtctacacgcttctgtccaaacgtaagctgcagtggtttgtggataatggagtggtttctggttgggacgatccacgtttccctaccgtccgaggtatccgcaggagaggtatgacgatcgaaacgatccaagagttcatcttggcgcagggcccatcgcaacagatcatcaacatggaatgggacaatatctggaccatcaacaagcgcaacatcgatcctgttgttccacgataccatgctctcgataaagacggccttgtcaaggtcaacgtcaaaggtgcgcccaagcgtcacaccaaggagatgccgaggcacaagaagaacgcggatctgggcaccaagctcaccgtgttcgaccaagaggtatatgtggagcaggcagacgcgcggtcgttcggccaagccgaagaggtgacgttgatggattggggcaatgtgatcattgactcgaagcagaccgacgctgcaggcaacgtggtttcgatcgatgcaagcgccaatttggatggtgactttaaaaagaccaagaagaaggtcacctggctcgcggcgtcggcttccactacagagacattggtcgaggtggacctgctcgactttgactacctgatcaccaagaaaaagttggacgaggaggataactttgccgactttgtcacgccgaattccgagtttcgcagtgtcgcgctcgcggatcacaacgtggcgtcgcttgagccgggcgctgcgatccaattcgagcgcaaaggctactatattttggaccagttggtcggtaagaatggtaggagagagtttatcaggattccggatggaaaacaggcatcttcggctagcaaggtggcgcccgatgcggatgtcgaggcaaagaagcacgcggctcaaaaggcgcgtgctgaaaaagcggcagccaaagccaagaagcaacaggaaaaggctgacaagaccaaggccaaggcacttgaaaagggcgacggcttgcagtacgtcgccggggctgtcagtgccagtgtagccgccgccactgccggtcttgccaccgccatagctaccaaaccatcctcggctgccaacacgcacaacactcgcgcatcccaccccccccacttcccagaactcatcgactctgcccacaccatcaacatgtatcacgcccccatcatcaccaccaacatccccacccccgtccgcacaaacatgtactccatgaacaagatcctgtaa

SEQ ID NO: 90922 - protein, 842 aa, Ustilago maydis 521
MATPTLKLDPQAKVAPLAPIALAKLVTAADASQALTLVFEDGIAPTLILPNAAPVEGYLHIIRELASHYAHLGLSGTDKDQSAQVNLYVSQGDNLALANFQTASAIADSLDQHLALRTFLVSHSVTAADAAIWAAVRASSPVIGLVRKGLHKHLQRWFNHIDSLAPFSDALVQLADAKAEKFKNKKTAAGFDLFLKDAQQGQVVTRFPPEPSGYLHVGHAKAAILNQYFARQYNGKLIIRFDDTNPSKEKEEFEQSIIEDLALLGIKGDATSHTSDYFDKLYQLAIQMIQLGKAYADDTPQEQMRAERMDGIASKRRDASVEENMTRFADMSTGSAEGRKWCLRAKISYSDPNKAMRDPVIYRCNPDVSHHRTGTTWKVYPTYDFACPIVDSIEGVTHALRTNEYRDRNPQYYWMLDALKLRKVDIWDFGRLNFVYTLLSKRKLQWFVDNGVVSGWDDPRFPTVRGIRRRGMTIETIQEFILAQGPSQQIINMEWDNIWTINKRNIDPVVPRYHALDKDGLVKVNVKGAPKRHTKEMPRHKKNADLGTKLTVFDQEVYVEQADARSFGQAEEVTLMDWGNVIIDSKQTDAAGNVVSIDASANLDGDFKKTKKKVTWLAASASTTETLVEVDLLDFDYLITKKKLDEEDNFADFVTPNSEFRSVALADHNVASLEPGAAIQFERKGYYILDQLVGKNGRREFIRIPDGKQASSASKVAPDADVEAKKHAAQKARAEKAAAKAKKQQEKADKTKAKALEKGDGLQYVAGAVSASVAAATAGLATAIATKPSSAANTHNTRASHPPHFPELIDSAHTINMYHAPIITTNIPTPVRTNMYSMNKIL

SEQ ID NO: 90923 - DNA, 2574 bp, Ustilago maydis 521
  CDS (1)..(2574)
atgccgcccaaggtcgatgtcaacgatccagagaatgcaaggcttctcaagctcttcgaatcgctcaatctgaccggaaacagagccatcgagacgctcacaaacccaaagcacgtcgctgctatcgagagcgttatcgcacacaaccatctcactaacaaacagatcgaccccaaggcgtccgcactcatcatatctgcatccaccgccaaagatgcttccaaccagcccgccagagactatatcgtatcacgcatcctcgacgccagcctcacatcgtccgatcaagttaacgcagcatacaagtacctctcatccctcaacagcgagccagacaaggctgcttttgacaaggaatgcggtgttggcgtcgtcgtaacaccacaacaatctcgcaaggcggtagatgactacattgcatctcaccgatccgaactcgatcccgttgatggttggccgaaactcggctcgatcctctctggcgtcaaagcttcgcccgacatgcgatgggccaacgcagtcgacctcaaggacgccgtagatgcggcgctcctagctacatatggtcccaaaaagccacctcctcccaaggaaaagaagaagccatctgcttccacctcggcccaccccaaaaaggaagctgcaccagctggtcccgtcgatccagacgccatgttcaaggaaggcttcctcgccagtctccacaaacccggcgaaaacccccagatcaagccagagctcaaacaacagcacctcgccgctaccaagggcatggtcatgacgcgtttcccaccagaacccaacggctttctccacattggtcacagcaaggccatcgccgtcaactttggctttgcccgcttccatcgcggtctctgttacctccgatacgacgataccaaccccgaggcagaagaggaaaagtactttaccagcatcctcgagacagttcgatggcttggcttcgaacccttcaaggtcacctactcgagtgactacttccagcagctctaccagctcgccgtcgaactcattaagcgtggcaaggcttacgtcgatcactcgacacccgaagagatcaaggagcagcgcggtggtcccgagcgcggtccacgcaagccttcacgcttccgcgatcgtcccgttcaagagtcgcttcaggactttgaggacatgaagaacggcaaatacgccccaggcaaagtcacgcttcggatgaagcaggacatcgagaatggcaacccgcagatgtgggatctgatcgcctaccgtgtcctcgaagcttcacaccaccgcaccggcaaggactggtgcatctatcccacctacgactttacccactgtctcgtcgatagctttgaaaacatcagccactcgctctgcaccaccgagtttatcctctcgcgcgaatcctacgagtggctgtgcgacgcgctcgaggtgtacaagccacgtcagtccgagtacggccgtctggcgctccagggaaccgtcatgtcgaagcgcaagattctcaaactcgtaaaggagcgctacatcgaagactgggatgacccgcgcatgtttaccctcatcgctcttaggcgtagaggtgtacctcccggtgcgatcctgtcctttgttagcgcgcttggcgtcaccacagccaaatccaccatccagatcagtcggttcgatcaagctgtgcgacaatacctcgagctttcgacgccacgtttgatgatggtgctcaacccgctcaaggtgaccatcgagaacttacccgacgaccacttccaggagatcgaaaagcctctgcatcccaaggcgcccgagatgggcaccaacaagatccccttcacccgcactgtctacatcgactcgtccgacttccgcaccgaggatagcaaggactacttccgtctggccccaggcaagacggtaggtctgttgcaggtacccttccccatcacatgtcaatcgttcaagaccaacgaccagggtgtaccgatcgaagtgattgccacgtacggcgatacaagctcggccaagcccaagacatacatccagtgggtagcagagcacgctccctcgcaaagtcctgtcaaagtcgacgagacacgcatcttccaccagctcttcacctcggacgatccggcagctgaggagaacttcttggaccacgtcaacccggattctctcgaaatcgtgcgcggtgctatggtcgaggttggtttttgggatgtggccaagcgcagcgtcgagcacgctagaaaggaggctgctcagcgcaccgaaagagccgaagccgatgcggccaaagcgagaagcgagaccgagactagtgcaaccgagggtgctggtgcaggtgctcctcaacgtactgctgatcaactggtgggcaaagagttggtccgcttccagggtatgcgtaccgcctactttgcgctcgatcgcttgagcggcgatttgggcctctttggtgataaacagaagggcggcaagattgtgctcaacaggatcgtctcgttgaaagaggatgcaaagaaggacgataaggcagtcgcgtcaccggtggccaagaaagccaagtaa

SEQ ID NO: 90924 - protein, 857 aa, Ustilago maydis 521
MPPKVDVNDPENARLLKLFESLNLTGNRAIETLTNPKHVAAIESVIAHNHLTNKQIDPKASALIISASTAKDASNQPARDYIVSRILDASLTSSDQVNAAYKYLSSLNSEPDKAAFDKECGVGVVVTPQQSRKAVDDYIASHRSELDPVDGWPKLGSILSGVKASPDMRWANAVDLKDAVDAALLATYGPKKPPPPKEKKKPSASTSAHPKKEAAPAGPVDPDAMFKEGFLASLHKPGENPQIKPELKQQHLAATKGMVMTRFPPEPNGFLHIGHSKAIAVNFGFARFHRGLCYLRYDDTNPEAEEEKYFTSILETVRWLGFEPFKVTYSSDYFQQLYQLAVELIKRGKAYVDHSTPEEIKEQRGGPERGPRKPSRFRDRPVQESLQDFEDMKNGKYAPGKVTLRMKQDIENGNPQMWDLIAYRVLEASHHRTGKDWCIYPTYDFTHCLVDSFENISHSLCTTEFILSRESYEWLCDALEVYKPRQSEYGRLALQGTVMSKRKILKLVKERYIEDWDDPRMFTLIALRRRGVPPGAILSFVSALGVTTAKSTIQISRFDQAVRQYLELSTPRLMMVLNPLKVTIENLPDDHFQEIEKPLHPKAPEMGTNKIPFTRTVYIDSSDFRTEDSKDYFRLAPGKTVGLLQVPFPITCQSFKTNDQGVPIEVIATYGDTSSAKPKTYIQWVAEHAPSQSPVKVDETRIFHQLFTSDDPAAEENFLDHVNPDSLEIVRGAMVEVGFWDVAKRSVEHARKEAAQRTERAEADAAKARSETETSATEGAGAGAPQRTADQLVGKELVRFQGMRTAYFALDRLSGDLGLFGDKQKGGKIVLNRIVSLKEDAKKDDKAVASPVAKKAK

SEQ ID NO: 90925 - DNA, 1887 bp, Aspergillus nidulans FGSC A4
  CDS (1)..(1887)
atgacggaagctcttgctgaggctacggccaagctggtcctcgacgaggagaccggcgagatggtctccaagaacgagctcaagaagcggactcagaaacgcgccaagaaggccgccgctgccgccgcgaaagcaaaccaggcccagaagcctgcgacgccaaagcccaaaactgaagtgaaacctgcggaggaaaccccgctggaccctgacgccatgttcaagcagggcttcctcgccaatgtcttccgcgagcgccctatgaagccggtcctcactcgattcccgcccgagccgaacggatatctacacttgggacattgcaaggctattgcggtaaacttcggttttgcgcggtaccatggaggagagacgatccttcggtttgacgacacaaatcctgaagctgaggaggagaagtattttacggctattgaggacatcattcagtggcttggattcaaacctgctagaataacccactcgagcgaccacttccagaagctctatgagcacgccgagaaactcatccagctcggaaaagcctacgtatgccactgcagcgatacagaaatcaagctgcagcgcggcggcgagaaccacggtgcgcgttatcgatgcaaggacgcggagcaggatgtcgagacaaacctcaaaaagttcagggacatgaaggatggcaaatacgaaccccagacggcgttcttgaggatgcgccaggacattgacaaccccaatcctcagatgtgggatcttgccgcctaccgagtcctgaagaaggaacaccacaaagcgcccggctgggttatcttcccaacatacgattttgcgcactgtctctgcgatagcttcgaaggaatcacccacagtctgtgcacgactgagttcgtcttgtcacgggaaagttatgaatggcttaactcgactcttggagtctacgagcccatgcagcgcgagtacggccggttaaacgtcagtggaacgatcatgagcaagcgaggcctgaagaagctggtcgacgggggctatgttcgagcatgggacgacccccgtctgtacactgttattgctctccgtcgacgcggtgtccctccggaggctatcttgtcgtttgttaacgagctcggggtgactaccgctaactctgtcatcaacatcgctcgtttcgaacagtctatccgtacctacctcgaatcgcgtgtaccccgtcttatgctcgttcttgacccgctccctgttgttattgaagactttgataccctcagtgcagaacagctcaacctcgatattcctttctcgcccaaagaccctgcgatgggctcacaccaggtcggcttcaccaaaacggtctacatcgatcgttctgacttccgagaggaagatgccaagggttacttccgtcttgcacctggcaagagtgtcggtctgtggaaggccccgtacccgatcaaggcgaccaccttcactaaggatgccgatggaaaaatcacggaagttcgtgccgtcctggacaaggatggtggaaagccaaagacgtacatccactgggtccctgagggatcgcgcaagcttgaagtccgcatccacgaccaactgttcaagtccgacgagcctgccgctgccgagggtggcttcctcgcggacattaacccgaacagtgagaccatctacgcagacgccatgattgagtcaggtttcgacgaggtgcggcgcagggcaccgtggcctgaagccgcgggtgagacgagcgagggaactcctcgaccagagactgttcgcttccagggcatgcgggtggcctactttgccatggactcggactccaccgacagccacgttgtgctcaaccggattgtatccctgaaacaggatacgggcaaggcgtaa

SEQ ID NO: 90926 - protein, 628 aa, Aspergillus nidulans FGSC A4
MTEALAEATAKLVLDEETGEMVSKNELKKRTQKRAKKAAAAAAKANQAQKPATPKPKTEVKPAEETPLDPDAMFKQGFLANVFRERPMKPVLTRFPPEPNGYLHLGHCKAIAVNFGFARYHGGETILRFDDTNPEAEEEKYFTAIEDIIQWLGFKPARITHSSDHFQKLYEHAEKLIQLGKAYVCHCSDTEIKLQRGGENHGARYRCKDAEQDVETNLKKFRDMKDGKYEPQTAFLRMRQDIDNPNPQMWDLAAYRVLKKEHHKAPGWVIFPTYDFAHCLCDSFEGITHSLCTTEFVLSRESYEWLNSTLGVYEPMQREYGRLNVSGTIMSKRGLKKLVDGGYVRAWDDPRLYTVIALRRRGVPPEAILSFVNELGVTTANSVINIARFEQSIRTYLESRVPRLMLVLDPLPVVIEDFDTLSAEQLNLDIPFSPKDPAMGSHQVGFTKTVYIDRSDFREEDAKGYFRLAPGKSVGLWKAPYPIKATTFTKDADGKITEVRAVLDKDGGKPKTYIHWVPEGSRKLEVRIHDQLFKSDEPAAAEGGFLADINPNSETIYADAMIESGFDEVRRRAPWPEAAGETSEGTPRPETVRFQGMRVAYFAMDSDSTDSHVVLNRIVSLKQDTGKA

SEQ ID NO: 90927 - DNA, 2118 bp, Candida glabrata CBS138
  CDS (1)..(2118)
atgagttctactttggttatcaacggtaaagcccctgtggttgcctatgccgaattgatcgctgctcgtcttgtcaacgactccaagagtgatgcctctgtcactgttgaatttgtcgacgacaagaagagtgctgctgctactttcgatggcaagtctgacaatgctctagaggctattgttgccaagttccctgaaatcttgggtgctaatgaggagtccaagccttggatcaagttggctgctgaagaattggttatcaagaacttccaaaagcttgctcaatctctagaaaagctagacgctcaattgaactttagaacatacatcaacggtggcttgaagtttgactccgctgacattgcctgttggggtgctttgagatccaacggtatggttggttccatcatcaagaacaaggtctacgtcaacgtttcccgttggtacttgctcctagagtccaacccttcctttggtcaatctcacgagttcttgaccaagtctctacaagaattgaagaaggctgctaatgccggtaagaagaaggagtcccacaaggctaactttgaaattgatcttccagatgccaagatcggcgaagttgtcacccgtttcccacctgaaccttctggatacttgcatattggtcacgctaaggccgctttattgaaccaatattttgctcaagcctacaagggtaagttgatcatcagatttgatgacactaacccatctaaggagaagaccgagttccaagactctattctagaggatttggaactattgggtatcaagggtgacagaattacttactcctcagactacttccaagagatgtatgaattgtgtgttaagttgatcaaggagggtaaggcttactgtgacgacactccaactgaaaagatgagagaagaacgtatggatggtattgcatctgctagaagagagcgctccgttgaagaaaacttgaagatcttcaccgaagatatgaagaatggtactgaagaaggtttgaagaactgtgttcgtgctaagatcgactacgctgctttgaacaagactctaagagatcctgtcatttacagatgtaacttaactccacaccacagaaccggttccgaatggaagatgtacccaacttatgatttctgtgttccaattgttgactccatcgaaggcgttacccacgctctacgtaccatcgaatacagagaccgtaatgctcaatacgattggttcttggataacttgaacttgagaaaggtccacatctgggattttgccagagtcaacttcgttagaactttgctatccaagagaaagctacaatggatggttgacaagaacctagtttccaactgggacgacccaagattcccaactgtcagaggtgtcagaagaagaggtatgactgttgaaggtttgagaaactttgttctttctcaaggtccttccagaaatgttattaacctagaatggaacttaatttgggcttttaacaaaaaggttattgacccagttgccccaagacacactgctatcgttaacccagtcaagatccacatcgaaggcgctccagaatctccaaagactgaaatgaaaccaaagcacaagaagaatcctgctgttggtgaaaagaaggtcatctactaccagaacgttgtcattgacaaggaggatgctgattctattgaagacaacgaagaagtcactcttatggactggggtaacatcatcatcacaaagaagaatgctgacggttccatggaagctaagcttcatctggaaggtgacttcaagaaaaccaagcacaaacttacctggttggccgacactgacgattctgtcaaggtcgatttagttgacttcgatcacttgatcagcaaggacaaacttgaagaagatgaaagttttgaagacttcctaactcctcaaactgaattccacactgaggctattgctgatctaaacgtcaaggacatgatcgtcggtgacattattcaatttgagagaaagggttactacagactagatgccgaagccaaggatggtaaaccttacgtcttcttcactatcccagatggtaagtctgttaacaaatacggtgccaagaaataa

SEQ ID NO: 90928 - protein, 705 aa, Candida glabrata CBS138
MSSTLVINGKAPVVAYAELIAARLVNDSKSDASVTVEFVDDKKSAAATFDGKSDNALEAIVAKFPEILGANEESKPWIKLAAEELVIKNFQKLAQSLEKLDAQLNFRTYINGGLKFDSADIACWGALRSNGMVGSIIKNKVYVNVSRWYLLLESNPSFGQSHEFLTKSLQELKKAANAGKKKESHKANFEIDLPDAKIGEVVTRFPPEPSGYLHIGHAKAALLNQYFAQAYKGKLIIRFDDTNPSKEKTEFQDSILEDLELLGIKGDRITYSSDYFQEMYELCVKLIKEGKAYCDDTPTEKMREERMDGIASARRERSVEENLKIFTEDMKNGTEEGLKNCVRAKIDYAALNKTLRDPVIYRCNLTPHHRTGSEWKMYPTYDFCVPIVDSIEGVTHALRTIEYRDRNAQYDWFLDNLNLRKVHIWDFARVNFVRTLLSKRKLQWMVDKNLVSNWDDPRFPTVRGVRRRGMTVEGLRNFVLSQGPSRNVINLEWNLIWAFNKKVIDPVAPRHTAIVNPVKIHIEGAPESPKTEMKPKHKKNPAVGEKKVIYYQNVVIDKEDADSIEDNEEVTLMDWGNIIITKKNADGSMEAKLHLEGDFKKTKHKLTWLADTDDSVKVDLVDFDHLISKDKLEEDESFEDFLTPQTEFHTEAIADLNVKDMIVGDIIQFERKGYYRLDAEAKDGKPYVFFTIPDGKSVNKYGAKK

SEQ ID NO: 90929 - DNA, 2388 bp, Candida glabrata CBS138
  CDS (1)..(2388)
atgtctttggagaagtttgggtacgaggaggcgaagatcaaggagattaccaagaatcagaagattctgagtgagttggagaagcttttgggcgaggtccaggtcggggagttggacaagacgcagagggctatattgcaccagtttgcgacgctactggccaagcggaaggatgccggtgaggtgagcactgctctggttgtggagaatgttgtgaacggtggtatcaagaccaacttgcagatagacgctgcgttcaagtatgtggtggcacacccggatgtggaccaggagacgctggccgccgaggctggtattggtgtgcatgtcggcgaggaggatgtcagacgcaaagttgtggagtatatcgagagcaacaagagcaagattgaagagcagagatacaagcttgtgccagggatcatggcggatgtcaagaagatgccagagttgaagtgggctgaaccacgtttgttcaagcctatcattgatgaagagatcctgaaggccattggtcctaaggacgagagagatgtggtcaagaagcagcctaaggcaaagaagaatgccaagaaggatgacagtggcgacaagagctctgattcaaagggtgagaagagaaccatgttcactgaaggtttcctaggtgacctgcacaaagtcggtgagaacccacaagcttaccctgagttgatggcagaacacttgaaagccactggtggcaaagtccacaccagattcccacctgagccaaatggttacttacatatcggtcattccaaggctatcatggtcaacttcggttacgccaagtaccacgacggtgtgtgctacttgagatttgacgataccaatccagaagctgaagccccagagtactttgagtccattaagagaatggtttcgtggctgggctttaagccatggaaggttacgtactccagtgattacttcgataagctgtacgaattggctgaggttttaataaagaatggcaagggttacgtttgtcactgtactgctgaagaaatcaagcgtggtcgtggtatcaaagaggatggtactccaggtggtgaaagacatgcctgcaaacacagagatcagagtgtagaaaagaacttggaagaattcagagctatgagagatggtaagtacaagccaggtgaagctattctgagaatgaagcaaaacctagaatctccatctccacagatgtgggatttgattgcctacagagtgctaaacgctccacatccaagaactggtaccaaatggaagatttacccaacatacgatttcacacactgtttggttgattctttcgaaaacatcacacactctctatgtactactgaattttacttatcgagggagagttatgaatggctatgtgaccaggttcacgtctttagaccagcacagagagagtatggtcgtctaaacatcaccggtacggttttatccaagcgtaagattgctaagcttgttgatgaacatttcgttagaggttgggatgacccaagattatttactttggaagccattcgtagacgtggtgttccaccaggtgcaatcttatctttcatcaatacacttggtgtcacaacaagcacaaccaatattcaagttgttagatttgagagcgcaatcagaaagtacttggaagattctactccaagattgatgatgattcttgatccaattgaggtcgttgttgaaaacctaccagaggactatgaagaacttgttactattccatacagagctggtaccaaagaattcggtgacagaaatgtcccattcactaataagttttacattgaaagggcagatttctccgaaaatacagaagacaaggaattcttcagacttactccaaaccaaccggttggtttgattaaagttccatacactgtttctttcaagagtgttgagaaggatgctgatggtaagatcactagaattcatgttaagtacgataatgaagacaagccagtgaagccaagaacttacatccaatgggttcctatctccaagaagtacaactccccagtacgtgtttctgaaaccagagtttataaccaactcttcaagtctgaaaatccatccgctcatccagatggttatttgaaagacatcaaccctgaaagtgaggtcatttatgataagtctgtcattgaacataatttcgaccacgttatcaagaactccccatgggttgttgattccgttaagaattctgaattttatgttaaagaagataagtccggaaaggaaatttgtagattccaggctatgagagttggttacttcactcttgacaaggagagcactgatgataagatcattctaaatagaattgtctccctaaaagacaacactaaataa

SEQ ID NO: 90930 - protein, 795 aa, Candida glabrata CBS138
MSLEKFGYEEAKIKEITKNQKILSELEKLLGEVQVGELDKTQRAILHQFATLLAKRKDAGEVSTALVVENVVNGGIKTNLQIDAAFKYVVAHPDVDQETLAAEAGIGVHVGEEDVRRKVVEYIESNKSKIEEQRYKLVPGIMADVKKMPELKWAEPRLFKPIIDEEILKAIGPKDERDVVKKQPKAKKNAKKDDSGDKSSDSKGEKRTMFTEGFLGDLHKVGENPQAYPELMAEHLKATGGKVHTRFPPEPNGYLHIGHSKAIMVNFGYAKYHDGVCYLRFDDTNPEAEAPEYFESIKRMVSWLGFKPWKVTYSSDYFDKLYELAEVLIKNGKGYVCHCTAEEIKRGRGIKEDGTPGGERHACKHRDQSVEKNLEEFRAMRDGKYKPGEAILRMKQNLESPSPQMWDLIAYRVLNAPHPRTGTKWKIYPTYDFTHCLVDSFENITHSLCTTEFYLSRESYEWLCDQVHVFRPAQREYGRLNITGTVLSKRKIAKLVDEHFVRGWDDPRLFTLEAIRRRGVPPGAILSFINTLGVTTSTTNIQVVRFESAIRKYLEDSTPRLMMILDPIEVVVENLPEDYEELVTIPYRAGTKEFGDRNVPFTNKFYIERADFSENTEDKEFFRLTPNQPVGLIKVPYTVSFKSVEKDADGKITRIHVKYDNEDKPVKPRTYIQWVPISKKYNSPVRVSETRVYNQLFKSENPSAHPDGYLKDINPESEVIYDKSVIEHNFDHVIKNSPWVVDSVKNSEFYVKEDKSGKEICRFQAMRVGYFTLDKESTDDKIILNRIVSLKDNTK

SEQ ID NO: 90931 - DNA, 2415 bp, Kluyveromyces lactis NRRL Y-1140
  CDS (1)..(2415)
atgtcatctgtagacgagttgaccaatctattttccaagattgggttcgaagaagctaaagtaaaggaaatcttaaagaatgctaaagtatccagctccctagagtccttagtaaacttggcatctgatgatttcccatggaacaagaattctagagctttaattcacacgttagcagcctctttaaagggagctgaagttcctcatttgcaatatatcgttgatggtattggtaagaatgatttgaagactgcattgcagatagatgcagctttgaagtacttgaagaccaagggtgaggatgccactgttgtggacttgaacaaagagtccggtgtcggtattgaagttactgaagatcaagttagaaaccgtgttgctaagtacgttgaggataacaaagataccattttgaaggaaagatacaagttagtgcctggtctatttgccaaaatcaaagctctccccgaattaaaatgggctgaaccacgtttgttcaaaccaatcattgacgaagaaatcttgaaggttttgggtccaaaagatgaaagagatatcgtaaagaaggaaaagaaaccaaaggctgaaaagaaggctaatggcaaagcaagcaaggaccaaacagaagaagatggtccaaagagatctatgttcacagaaggtttcttgggtgacttgcataaggttggagaaaatgagcaggcctacccagaactaatggctgagcatctcaaggctaccggtggtaaagtacacactagattcccaccagaacctaacggatatttacatattggtcattctaaggccattatggttaactttggcttcgctaaataccataacggggtatgttatctaagatttgatgataccaaccctgaagcagaagctccggaatatttcgagagtatcaaaagcatggtatcatggttggggttcaaaccatggaaaactacctattcctctgattacttcgatgagttataccaattagctgaaactttgattaagaacggaaaggcttatgtctgtcactgctctgcagaagaaataaaacgtggccgtggtatcaaagaagatggtacacctggtggtgaaagaaaagcttgtgtctccagagaaagacctattgaggaaagcttaactgagttcagaaagatgagagacggattctacaaaccaggtgaagcaatcttaagaatgaaacaagatttgaactctccatcaccacaaatgtgggatttgattgcttatagggtcttggatgctccacatccaagaactggtgacaaatggaaaatttacccaacatacgacttcactcactgtttagtcgattccttagaaaacattacccactccttgtgtaccacagaattttacttgtctagagaaagttacgaatggctatgtgaccaagtgcacgtcttcagaccagctcaaagagaatatggtagattgaacatcaccggtaccgttctatctaagagaaaaattgctaaacttgttactggtggatacgtcagcggatggaatgatcctcgtttattcacattggaagctatccgtagacgtggtgttccaccgggagccattctatctttcattaacactttgggtgtgaccaccagtaccactaatatccaagtcgtaagattcgaaagtgctattagaaagtacttggaagacactacacccagactcatgttcattttggatccagtggaagtggttgtggacaatgtcgatgaagatttcgttgagctatgtaacatcccatacaggccaaacactccagagttcggtgatagaaccgtcccattcaccaagagattctacatcgaaagaagcgacttctcggaagacgttgacaacaaggagttcttcagattaacacctaaccaatcagttggtttaatcaaagtaccatacaccgtatcctaccaatctttagagaaggatgcgaacgggaagatcactaaaattcatgttaaatatgagaacgaggaagccaaaccaaagaaaccaaagacctacattcaatgggtgccaatctccgaaaagcacgactccccagtaagaattgcggaaactagagtttacaaccaattgttcaagtccgaaaacccatcagcgcacccagatggttacttatctgatattaacccagacagcattatcgtgtacaagagttctgtcgctgaatacaacatcaacagcattataaagaactcgccatgggtcgtggacagtgcaaagaagtctgaattctatgtggaagaagaaaagggaagaaaggaagtctgcagattccaagccatgagagttggttatttcaccttggactctgatagcacagatgaaaagatcgtcttgaacaggatcgtttccttgaaagacggtactaaatga

SEQ ID NO: 90932 - protein, 804 aa, Kluyveromyces lactis NRRL Y-1140
MSSVDELTNLFSKIGFEEAKVKEILKNAKVSSSLESLVNLASDDFPWNKNSRALIHTLAASLKGAEVPHLQYIVDGIGKNDLKTALQIDAALKYLKTKGEDATVVDLNKESGVGIEVTEDQVRNRVAKYVEDNKDTILKERYKLVPGLFAKIKALPELKWAEPRLFKPIIDEEILKVLGPKDERDIVKKEKKPKAEKKANGKASKDQTEEDGPKRSMFTEGFLGDLHKVGENEQAYPELMAEHLKATGGKVHTRFPPEPNGYLHIGHSKAIMVNFGFAKYHNGVCYLRFDDTNPEAEAPEYFESIKSMVSWLGFKPWKTTYSSDYFDELYQLAETLIKNGKAYVCHCSAEEIKRGRGIKEDGTPGGERKACVSRERPIEESLTEFRKMRDGFYKPGEAILRMKQDLNSPSPQMWDLIAYRVLDAPHPRTGDKWKIYPTYDFTHCLVDSLENITHSLCTTEFYLSRESYEWLCDQVHVFRPAQREYGRLNITGTVLSKRKIAKLVTGGYVSGWNDPRLFTLEAIRRRGVPPGAILSFINTLGVTTSTTNIQVVRFESAIRKYLEDTTPRLMFILDPVEVVVDNVDEDFVELCNIPYRPNTPEFGDRTVPFTKRFYIERSDFSEDVDNKEFFRLTPNQSVGLIKVPYTVSYQSLEKDANGKITKIHVKYENEEAKPKKPKTYIQWVPISEKHDSPVRIAETRVYNQLFKSENPSAHPDGYLSDINPDSIIVYKSSVAEYNINSIIKNSPWVVDSAKKSEFYVEEEKGRKEVCRFQAMRVGYFTLDSDSTDEKIVLNRIVSLKDGTK

SEQ ID NO: 90933 - DNA, 2385 bp, Debaryomyces hansenii CBS767
  CDS (1)..(2385)
atggcgtcagaagaagaattgatcaacttgtttagcaaagttgggttcaatgataagaaatctaaagaagtttgcaaaaataaaaaggtttcccaatcattagcagaaatcatcaatgagtcaaaggtggaagaaacagatgaaaagaagctttctttgttgcatgcgttagccgttgagagtaaaggaggagatgttcctagacgtgaattaattacgaaggctattattgatggtagattgaagactaacttacaggtcaccgaagcattcaaatatgtcaaggaaaaccccgaaactgccaacaacgaaaccatggaagaaaagtcaggggttggtattgagctcagtgattccgatgttgaaagagagattaaaaagtacatggaagcccataagtctgatattgagactaagagatactcgattgttcctagtctattaggtgacgtcaagaaggtaccagaattgaaatgggccaagccaaacttattcaagccaattattgacagtttggtcttggagatgattggaccaaaggatgagagagatgtcgttaagaaggaaaagaagaagctgactaaaaagcaagttgaaaccaagaaggaagcacagattgagagatcgatgttttccgaagggtttttgggtgacttacacaagcctggtgaaaatccacaaaaatatcctgaattaatgaaagaacatttagaattcaccaagcgtaaagtattcactagattcccaccagaaccaaacggatatttgcacatcgggcattcgaaggcaattatggttaattttggatatgctaagtacaatggtggtaactgctacttaagattcgacgacaccaaccctgaagcggaagaagaagtgtatttcaagtcaattgaaaaaatgattgactggttaggatatgaaccatggaaagttactcattcatccgactattttgatgagttatacgatttagctgagagattaatcagcttaggtaaaggttatgtttgccattgtacggcggaagaagttaaggctcaaagagggttgaaggaagatggtaccttaggtggagaaaggtttgcatgtaagcatcgttcaagaagcgttgaagatagtatggctgaattccgtaagatgaagaacggtgaatataagagtggagaggctaccttgagaatgaagcaagacttggaatcgccatctccacaaatgtgggatcttgttgcgtacagagtcttaaacaagccccaccacaggactggagacaaatggaagatctacccaacatacgattttactcactgtcttgttgattcttttgaaaacattagtcattcattatgtactactgaatttagactttctagagagtcttacgaatggttgtgtgacgagctacacgtttacagaccagcacaaagagaatatggtagattaaatattactggtaccatattgagtaagagaaagattgctaaattagtcaacgaaggtattgttagaggatgggatgatcctagattgtacacgttagaagctatccgtcgtcgtggggttccaccgggcgctattttaagtttcatcaacacgttaggggtcaccacttcaactactaatattcaagcagtgagactcgacagtgctatcagagcattcttggaccaaacgaccccaagattgatgatgattcttgaccctgtcgaagtcgaagttgagaacttaccagaagggtacgaggaaatggtcgaggtgccatacaaaccgggtgacaccgttaagttcggaaccagaaaggttccgttcaccaagcgtttctatattgacagatctgactacagagactctacttccgacgactactttagattagcccctggccaaccagttgggttaattagggtaccattcaatgtttctgtcaaggacgttgtcaaggatgacgcaggtaaggtgacgaagatcatcgcgcactacgacaacgacggtacgttcaaaaagcctaagacttatatccaatgggtcccaaaatcggcctcttcaccaatcaaggtcaacgaggtgaggattcagaaccaattgttcaacagcgagaacccatcagctcacccagacggattcttgaacgatctcaacgagcaatcggaagagatctaccgcgatgcgattgtcgagtcggctttcactgaaattaaggagaaatcgccattgaatattcctatcgaaggaagcgagttcaacatcaaggagaagccgagtgtcgaaacggtgagattccaggccttgagagtgggatacttctgcatggacaaggattcgagcgcggacaaattggtgttgaaccgtattgtcactttgaaggaggactcgtcgaaaaattga

SEQ ID NO: 90934 - protein, 794 aa, Debaryomyces hansenii CBS767
MASEEELINLFSKVGFNDKKSKEVCKNKKVSQSLAEIINESKVEETDEKKLSLLHALAVESKGGDVPRRELITKAIIDGRLKTNLQVTEAFKYVKENPETANNETMEEKSGVGIELSDSDVEREIKKYMEAHKSDIETKRYSIVPSLLGDVKKVPELKWAKPNLFKPIIDSLVLEMIGPKDERDVVKKEKKKLTKKQVETKKEAQIERSMFSEGFLGDLHKPGENPQKYPELMKEHLEFTKRKVFTRFPPEPNGYLHIGHSKAIMVNFGYAKYNGGNCYLRFDDTNPEAEEEVYFKSIEKMIDWLGYEPWKVTHSSDYFDELYDLAERLISLGKGYVCHCTAEEVKAQRGLKEDGTLGGERFACKHRSRSVEDSMAEFRKMKNGEYKSGEATLRMKQDLESPSPQMWDLVAYRVLNKPHHRTGDKWKIYPTYDFTHCLVDSFENISHSLCTTEFRLSRESYEWLCDELHVYRPAQREYGRLNITGTILSKRKIAKLVNEGIVRGWDDPRLYTLEAIRRRGVPPGAILSFINTLGVTTSTTNIQAVRLDSAIRAFLDQTTPRLMMILDPVEVEVENLPEGYEEMVEVPYKPGDTVKFGTRKVPFTKRFYIDRSDYRDSTSDDYFRLAPGQPVGLIRVPFNVSVKDVVKDDAGKVTKIIAHYDNDGTFKKPKTYIQWVPKSASSPIKVNEVRIQNQLFNSENPSAHPDGFLNDLNEQSEEIYRDAIVESAFTEIKEKSPLNIPIEGSEFNIKEKPSVETVRFQALRVGYFCMDKDSSADKLVLNRIVTLKEDSSKN

SEQ ID NO: 90935 - DNA, 2175 bp, Debaryomyces hansenii CBS767
  CDS (1)..(2175)
atgagttttagtttaacagtagctgccaaggctccgttagtcgcatacccatctttaattggtgtcggatttatcgatgccagtgattctgagatctcaatcccaatcgaatttgtcgatgagaagacagttgattccacagacgctggtgtcaaattggttactccagaaggcaaaacttattctaaccagttagatattttaaactacttagcagaaaaatttccatctattcttggtgaacaagccaaatctcaagaatgggtcaaatttgccttggacaaattatctaataagaacttcaaggaattagcaggtgatttagaaaaattagatgcccacttaaatttcagatcattcgttattggatactcctattccttagctgatgttgctatctggggtgtattgagagccaatgctttaatgggttctgttatcaagaatggcgtttacacaaatgtctcgagatggtacaacttattagctgctgataaaaagtttgacggtagtgttgaaaacatgaccaaattagtcaatgaattaagaaagtcagctaagtcatccaagaatgggggtaagaaagagacccacaaagctaactttgaaatcgatttaccaaatgctgaagttggtaaggttgttactcgtttcccacctgaaccatctgggtatttgcatattggacatgctaaggccgcagtcttgaatgaatactttgctcatgcttacaagggtaaattgattatcagattcgacgacactaatccaacaaaagaaaagattgaattccaggactcgattattgaagatttggccttgttaggtattaaaggtgataaaatcacatattcttcagactatttccaagatatgtacgatttagcaattaaattaatcaaggaaggtaaagcttactgtgatgatactccgttagaaaagatgagagaagaaagaatggttggtgatgcttctgctagaagagaaagatctatcgaagaaaacttgaaaattttcacagaagaaatgaagaatggtaccgaaggaggtttgaagaattgtcttagagctaagattgattatactgctttaaacaaaaccttaagagatccagttatctacagatgtaatgttacgccacatcacagaacaggaagcgaatggaagatttacccaacttatgatttctgtgctccagtagttgactctatcgaaggtgtcacccatgctttaagaacgaacgagtacagagaccgtaatgctcaatacaattggattattgatgcgttaggtttacgtaaggttgatatttgggatttcgccagagtcaatttcgtcagaaccttattgtctaagagaaagttgcaatggtttgttgataagaactacgtatccaactgggatgatccaagattcccaactgttagaggtgttagaagaagaggtatgacggttgaaggtattagaaactttattatcgctcaaggcccttcaagaaacattattaacttagattggtctgttatttgggccttgaacaagaaaattattgacccagctgcaccaaggcatactgctgtcgatgcaaaaaacgttgttcctgtcaagttgttaaatggaccatctgaaccattcactgaagaaaagccaaaacataaaaagaacccagaagtcggtaataaacctgttatttactctaatcaggtcttaattgaccaagctgatgctgaaggcttggtagacggtgaagaaatcacttttatggactggggtaatgttattatttctaaggttgttaaggaaggtgatgttgtcaaatcaattgaagctaacttacacttggaaggggatttccgtaaaacttccaagaaaatcacttggttggctgacaccaaggataaagttgaggttgagttaatggactttgatcatttgattactaaggataaattagaagaaggtgatagctttgaagatttccttactccacaaactgaattcactgttgaagctattgctgatttaagtgtccgtaatatgaaggccggcgatatcattcaatttgaaagaaagggttactacagagtggaccaaccttacagcgaaggtaagcgtccagtcttatacaatattcctgacggtaagacagtatcaagatacgggactaagaaataa

SEQ ID NO: 90936 - protein, 724 aa, Debaryomyces hansenii CBS767
MSFSLTVAAKAPLVAYPSLIGVGFIDASDSEISIPIEFVDEKTVDSTDAGVKLVTPEGKTYSNQLDILNYLAEKFPSILGEQAKSQEWVKFALDKLSNKNFKELAGDLEKLDAHLNFRSFVIGYSYSLADVAIWGVLRANALMGSVIKNGVYTNVSRWYNLLAADKKFDGSVENMTKLVNELRKSAKSSKNGGKKETHKANFEIDLPNAEVGKVVTRFPPEPSGYLHIGHAKAAVLNEYFAHAYKGKLIIRFDDTNPTKEKIEFQDSIIEDLALLGIKGDKITYSSDYFQDMYDLAIKLIKEGKAYCDDTPLEKMREERMVGDASARRERSIEENLKIFTEEMKNGTEGGLKNCLRAKIDYTALNKTLRDPVIYRCNVTPHHRTGSEWKIYPTYDFCAPVVDSIEGVTHALRTNEYRDRNAQYNWIIDALGLRKVDIWDFARVNFVRTLLSKRKLQWFVDKNYVSNWDDPRFPTVRGVRRRGMTVEGIRNFIIAQGPSRNIINLDWSVIWALNKKIIDPAAPRHTAVDAKNVVPVKLLNGPSEPFTEEKPKHKKNPEVGNKPVIYSNQVLIDQADAEGLVDGEEITFMDWGNVIISKVVKEGDVVKSIEANLHLEGDFRKTSKKITWLADTKDKVEVELMDFDHLITKDKLEEGDSFEDFLTPQTEFTVEAIADLSVRNMKAGDIIQFERKGYYRVDQPYSEGKRPVLYNIPDGKTVSRYGTKK

SEQ ID NO: 90937 - DNA, 2382 bp, Yarrowia lipolytica CLIB99
  CDS (1)..(2382)
atgtccgacgttgccgagctcagcaccaagctggaacatctcggttttgccgagcccaagatcaaggaggtgttgaaaaacaaaaaggtcgccgcctccttcaacgacattctcaacgtagtgaacgtgggcaaggacgagaagcgagctgctctactccacaacctcgcctcgtcctccaaggacgccaaggatgaagccgtgatcaagaagcgaaatgaggtcgcctctgccattgccgacggccgaatcaagaccaacgtgcagctggacgccgcctggaagtgggcccaggacctacacagctccgagagcctcgatcaggctgctggcgtgggcattgaggtcacccgggacgacgtttatcgtgagattgccgcctacattgccgcaaacaaggctcagctcgaggaggagcgatacaaggccctgcctggtgtcatggtggctgccaagaagatccctgctctcaagtgggccaaccctgccgactttaagcccgtgatcgacgagcagctcaaggagcttctgggacccaaggatgagcgagatctcgtcaagaagaaggcgcccaaggccaagcctgctgccaaggatgctgccaagaaggaggagcctgagaaggtgtctgccaccgccatgttcaccaccggtttcctgggcaacctgcacaagactggagagaaccctcaggccaacatggagcgaatggttgagcatctcaaggccaccaagggccaggttttcacccggttccctcccgaacctaacggatacctgcacattggccactccaaggccatcaccgttaactttggctatgcccagttcaacaagggtaagtgctacctgcgatttgacgacacgaaccctgaggccgaggaggagcgattcttcacttccattcgagagaccattgagtggctgggcttcgagccctacaaggtcacctactcgtcggactacttccaggagctgtacgacctagctgagaagctgatcgagtgtggaggtgcgtttgtgtgtcaccagaccgccgaggagatgaaggcttcccgaggagtgtctgagggatctcgaggaggcgagcgagtgccttctccctggagaaacagaaccgtggaggagaacctggtggagttccgaaagatgcgagacggccactacaagcccggagaggcagttttgcgaatgaagcaagatctcaacaaccccaacccccaaatgtgggatctggttgcctaccgagtactcaacgctccccatcaccgaactgccgacaagtggaagatttaccctacctacgacttcacccactgtctggttgattcgctggagaatatttcgcattcgctttgtaccaccgagttctacctctcccgtgagtcatacgagtggctgtgtgacgctgtggacgtctaccgaccagcccagcgagagtatggccgacttaacatcactggaaccgttctttccaagcgaaagattgccaagctcgtttctgagggtcatgttcgaggctgggatgatccccgtctcttcactctggtcgctattcgacggcgaggtattcctcctggagccattctcaactttgtctccactctcggtgtcaccactgccgagtccaacattcagcattctcgatttgagaacaatgtgcggaagtaccttgaggacactactcctcgtctcatgatggtgctggaccccgtcaaggtgaccattgagaacctgcctgaggaccactttgaagagtttgacatgccctttggcaagaatgacgagcggtcgcgaaaggtgcccttcacccgagagctgtacattgaccgaagcgactttgaggagtctgctggcaaggagttcttccgactcactgctactcagcccgtgggtctgctcaaggtgccccacaacatttctctcaaggaggtcaagaaggatgctgctggaaacatcaccgagctgatttgccatctcgacaacgacattcccttcaagaagcccaagacatacatccagtgggtccccgagtgtgctgccaagaagtctcccgtcaagatttccgagacccgaatcttcaagcagctcttcaagtccgagaaccctcagggccaccccgatggataccttgcagatcttgctgaggagtccgaggtcatccacaagcatgctcttgtcgagcccggcttctacgacgtcaaggagaactctccttgggtcactggtgagcatactggcaaggagaagaagggatcccccgagagtgtgcggttccaggctcttcgagtgggatacttttgcatggataaggattctactgagaaggatattgttctgaaccagattgtttctctgaaggaggataaccagaagaagtaa

SEQ ID NO: 90938 - protein, 793 aa, Yarrowia lipolytica CLIB99
MSDVAELSTKLEHLGFAEPKIKEVLKNKKVAASFNDILNVVNVGKDEKRAALLHNLASSSKDAKDEAVIKKRNEVASAIADGRIKTNVQLDAAWKWAQDLHSSESLDQAAGVGIEVTRDDVYREIAAYIAANKAQLEEERYKALPGVMVAAKKIPALKWANPADFKPVIDEQLKELLGPKDERDLVKKKAPKAKPAAKDAAKKEEPEKVSATAMFTTGFLGNLHKTGENPQANMERMVEHLKATKGQVFTRFPPEPNGYLHIGHSKAITVNFGYAQFNKGKCYLRFDDTNPEAEEERFFTSIRETIEWLGFEPYKVTYSSDYFQELYDLAEKLIECGGAFVCHQTAEEMKASRGVSEGSRGGERVPSPWRNRTVEENLVEFRKMRDGHYKPGEAVLRMKQDLNNPNPQMWDLVAYRVLNAPHHRTADKWKIYPTYDFTHCLVDSLENISHSLCTTEFYLSRESYEWLCDAVDVYRPAQREYGRLNITGTVLSKRKIAKLVSEGHVRGWDDPRLFTLVAIRRRGIPPGAILNFVSTLGVTTAESNIQHSRFENNVRKYLEDTTPRLMMVLDPVKVTIENLPEDHFEEFDMPFGKNDERSRKVPFTRELYIDRSDFEESAGKEFFRLTATQPVGLLKVPHNISLKEVKKDAAGNITELICHLDNDIPFKKPKTYIQWVPECAAKKSPVKISETRIFKQLFKSENPQGHPDGYLADLAEESEVIHKHALVEPGFYDVKENSPWVTGEHTGKEKKGSPESVRFQALRVGYFCMDKDSTEKDIVLNQIVSLKEDNQKK

SEQ ID NO: 90939 - DNA, 2391 bp, Oryza sativa (japonica cultivar-group)
  CDS (1)..(2391)
atgggcaccggaggcggcgagggggacaagtcggccgtgctgccgctggaggcgctgctggcgctggggctcgaccagcgcacggcggagaacgctctggtcaacagcaaggtcaccgccaacctcgccgccgtcatagccgaggctggtataagtggatgtgataagacggttgggaacctcctgtacacggttgccactaaatacccaaccaatgcgcttgtccatcgtcctgtactcattgactatattgtgtcaacgaagataaagaatcctgcacaactagatgctgctctgtcattccttactaatactggccctgactctttagatactgggaagtttgaagaagcctgtggtgtaggtgtggttgtttcaattgaagagattaaatcaacagtcaatgaggtattaaagcataatatggaggctatattggagcagcgatatcatattaatgttggtaacctatgcggacaggttaggaagaggcacccctggggtgatgctaaggcgaccaaggatgaaattgacaagaagcttgcagagatattaggtccaaagacagatgctgacaatgtaaaaccagtgaaaaagaaaaaggaaaaagcagcaaaagttgaggagaaaaaagctgcagtagtcactgctgcaccgccatctgaggaggaattgaatccatactctatatttcctcagccagaggaaaattttaaggttcatacagaaatattctatagtgatgggaacatatggagagcgcataacagtaaggagattttagagaaacaccttaaggcaaccggtggaaaagtgatgacccgtttcccaccagaacctaatggatatcttcatattggtcatgccaaggctatgtttattgattttggactggcgaaagagagaaatggtcattgttaccttaggtttgatgacacaaatccagaagccgaaaagaaagagtatattgaccacattcaggaaatcgtacactggatgggatgggagccctacaaagttacatatacaagtgattatttccaggctttatatgagcatgcagttgagttaatacgaaaagggctagcctatgtggatcaccagaccgcagaagaaatcaaggaatacagggaaaagaaaatgaatagtccatggagggatagacccattgaagaatcactgaaactatttgaagacatgagacgtgggttgattgctgaaggtgcagcaacactccgaatgaaacaagatatgcagaatgataacaagaatatgtctgatttaatagcatatagaataaaattcactcctcatccacatgctggtgataagtggtgcatctatccaagctatgactatgctcactgcatggtggattctcttgagaacattacacattcgctgtgcacgctcgagtttgacatacgtcgcccgtcatactactggctacttgttgccttgggcctgtaccagccatatgtttgggagtattcgaggctaaacatatcgaatactgtgatgtctaaaagaaagttgaatcgacttgtgacagaaaagtgggtagatgggtgggatgaccctcgtttgttgacactagcaggattgcggcgacgtggagtgtcatcaactgcaattaattcgtttatttgtggaattggaataacaagaagtgacaatagcttaattcgggttgaccgtcttgaatatcatatcagagaagagcttaataaaacagcttcccgtgccatggttgtgttgaatcctctaaaggttgtaataactaacttggaggatgaaaaagtcatagaccttgatggaaaaatgtggcctgatgctcctgcagacgatgcttcatcctactacaaggttcctttctcaagaatcgtttacatcgaaaaaactgattttcgtctaaaggactcgaaagattactacgggctagctcctggtaaatctgccctgctaagatatgcattccccattaaatgtaccgaggttgtttatggtgacaatccagatgacatcattgaaattcgagctgaatatgacccttcaaagactactaaacctaagggtgttctgcactgggttgctcagccagcacctggagttgaaccacttaaggtggaagtaagattatttgataaattattcctctctgagaatcctgctgaactggaggattggctgggtgatcttaacccgaactcaaaagaggtgatcaagggtgcctacgccgtgccatcgcttgcgactgcggttcttggtgacaagttccagttcgagcggctaggctacttcgcagtggacacagactcgacacctgagaacattgtgttcaacaggacggttaccctgcgtgattcgtatgggaaagctgggccaaagtga

SEQ ID NO: 90940 - protein, 796 aa, Oryza sativa (japonica cultivar-group)
MGTGGGEGDKSAVLPLEALLALGLDQRTAENALVNSKVTANLAAVIAEAGISGCDKTVGNLLYTVATKYPTNALVHRPVLIDYIVSTKIKNPAQLDAALSFLTNTGPDSLDTGKFEEACGVGVVVSIEEIKSTVNEVLKHNMEAILEQRYHINVGNLCGQVRKRHPWGDAKATKDEIDKKLAEILGPKTDADNVKPVKKKKEKAAKVEEKKAAVVTAAPPSEEELNPYSIFPQPEENFKVHTEIFYSDGNIWRAHNSKEILEKHLKATGGKVMTRFPPEPNGYLHIGHAKAMFIDFGLAKERNGHCYLRFDDTNPEAEKKEYIDHIQEIVHWMGWEPYKVTYTSDYFQALYEHAVELIRKGLAYVDHQTAEEIKEYREKKMNSPWRDRPIEESLKLFEDMRRGLIAEGAATLRMKQDMQNDNKNMSDLIAYRIKFTPHPHAGDKWCIYPSYDYAHCMVDSLENITHSLCTLEFDIRRPSYYWLLVALGLYQPYVWEYSRLNISNTVMSKRKLNRLVTEKWVDGWDDPRLLTLAGLRRRGVSSTAINSFICGIGITRSDNSLIRVDRLEYHIREELNKTASRAMVVLNPLKVVITNLEDEKVIDLDGKMWPDAPADDASSYYKVPFSRIVYIEKTDFRLKDSKDYYGLAPGKSALLRYAFPIKCTEVVYGDNPDDIIEIRAEYDPSKTTKPKGVLHWVAQPAPGVEPLKVEVRLFDKLFLSENPAELEDWLGDLNPNSKEVIKGAYAVPSLATAVLGDKFQFERLGYFAVDTDSTPENIVFNRTVTLRDSYGKAGPK

SEQ ID NO: 90941 - DNA, 2577 bp, Cryptococcus neoformans var. neoformans JEC21
  CDS (1)..(2577)
atgcctcccaagtttgaccccaactccccagaaaacgcccctcttattcagctcttccagagtctcggcctcgccagcaactctgccacagagctcgttcgtcagcctaagtctggaaaggctttcaagtccctgatagacgagtacggtcttacaaacaacaagtacgatgagaagcaagcaggagctcttgtcaagcttagctctgtgagcgctaagctgggcagtgaacagaaggatttcctcgtgcagaagattgtgaagggggatgtgaagactccagaccaggttacagcggccgtcaaatttgcagagaaaaatcctgacttgaaggcgaacgaggaggctttcgacaaggaatgtggtgttggtatcaacatcactcttgccgacctccctgaactcctcaaatcatatattacttctcttccttcaccccctgagggctggaacagtcttggtcctattcttggcggcatcaagggtggtgcttctgaccttcgatgggccaacgccacggaagttaagtccacccttgaatccatattcgtctctcttttcggtaccaaggaagccgccgccgccgctgccgctgctaagcccaaagctaaggcccccaaggccgctgaaaaacccgttaaacctgtctccaccactgctgccgttgctaccaaatcttcttccgctacccctgctatccctacaaacatttttgaggaaggcttcctttccgaattccacaaagtcggtgaaaacccccagagtgatcccaagttgaaggaggagcatttggcgtggacaaaggggcaggtgtacacccgattcccaccagagcctaatggatacctacatattggacacgtcaaggctatcatggtcgactttggttatgccaaataccacggtggtcgaacatacctcagatacgacgataccaatcctgaagctgaagaaggccgatactttcaatctatcctcgagactgttcgatggcttggttttgagccttggaagattacttactccagcgacaactttgacaggttatacgagctcgcggttgaattgattcggcgaggaaagggatacgtctgtacttgtgacgctgagaaaatcaaggaagaccgaggtatgggcaaggggaaccccatcccttgtgtgcaccgagaccgacctatcgaggagtctcttcatgagtttgaacgaatgaagaatggcgagtataaggaaaaggaggcgtgcatgaggatgaagatggacttgaatagcggcaacccttatatgtgggacactgttgcctaccgagtcaagaaggcgcctcatcacaggaccggtgacaagtggaagatctaccccacttatgactttacacattgtctttgtgatagcattgagaacatcacgcactctctctgtaccatcgaatttatccccgctcgtgaatcctacgaatggctctgtgacgccctcagcgtttacaaggctcgtcagtacgaattcgcacgtctcaacctccagggtactttcctctccaaacgaaagatcgcgaagcttgtccagaacggccacgtcaaggactgggatgaccctcgtctttacactatcatcgcccttcgtcgacgcggcattcctcccggcgccttgctctcctttgtttccgagcttggtgtgaccaacatcccttccaccactgaaattcaaaagttcgaatcttgcgtccgaggttaccttgagagctccgcgcccaggttgatgatggttctcaaccctatcaaaatcatcatcgacaatgtgcccgacgattaccgtgtccaggtcgaagtgcctctccatcccaaaatccctgctatgggcactgtccagaccatcttcaccaaggaagtctacatcgatgctgacgatttcagagaggtcgattctcccgactacttccgtctggcccccggcaagtctgtcggcttgttcaaggctccctaccctgttacttgcacatccttcaccaaggaccccgttaccggtcgtgttaccgaggtacattgtacgctcgccggcgaaggcttcaagaagccaaaggcttacatccagtgggtcaatgcgcccgaggcagttaagatcgacgaagtgcgatacttcaagaagcttttcaagtctgatccccctcctgcggactatgaggcagatgtcgaccccgattctcttgaggtttacagcaatgctgtgattgagcctgcgttctatgaacttgctaagaagcagatctccgatgcgaggaaagacagtgaagaacgtacgaagaaggccgtcgagcaggctgctaagcctgatacatcttctgctcctgtggaaggcagtgcggcggctcagcacaaggatgaggagcccgtagctactgctgagcagttggtgggtaacgagaacatcagattccagggtatgaggttggcgtactttactttggacagggaaagcaagttgggctgcttggagaaggaggatgtcaagggcaggagcgagggtgacaagattatactaaacaggattgtctcgctcaaggaggatgcgggcaagagtgcttag

SEQ ID NO: 90942 - protein, 858 aa, Cryptococcus neoformans var. neoformans JEC21
MPPKFDPNSPENAPLIQLFQSLGLASNSATELVRQPKSGKAFKSLIDEYGLTNNKYDEKQAGALVKLSSVSAKLGSEQKDFLVQKIVKGDVKTPDQVTAAVKFAEKNPDLKANEEAFDKECGVGINITLADLPELLKSYITSLPSPPEGWNSLGPILGGIKGGASDLRWANATEVKSTLESIFVSLFGTKEAAAAAAAAKPKAKAPKAAEKPVKPVSTTAAVATKSSSATPAIPTNIFEEGFLSEFHKVGENPQSDPKLKEEHLAWTKGQVYTRFPPEPNGYLHIGHVKAIMVDFGYAKYHGGRTYLRYDDTNPEAEEGRYFQSILETVRWLGFEPWKITYSSDNFDRLYELAVELIRRGKGYVCTCDAEKIKEDRGMGKGNPIPCVHRDRPIEESLHEFERMKNGEYKEKEACMRMKMDLNSGNPYMWDTVAYRVKKAPHHRTGDKWKIYPTYDFTHCLCDSIENITHSLCTIEFIPARESYEWLCDALSVYKARQYEFARLNLQGTFLSKRKIAKLVQNGHVKDWDDPRLYTIIALRRRGIPPGALLSFVSELGVTNIPSTTEIQKFESCVRGYLESSAPRLMMVLNPIKIIIDNVPDDYRVQVEVPLHPKIPAMGTVQTIFTKEVYIDADDFREVDSPDYFRLAPGKSVGLFKAPYPVTCTSFTKDPVTGRVTEVHCTLAGEGFKKPKAYIQWVNAPEAVKIDEVRYFKKLFKSDPPPADYEADVDPDSLEVYSNAVIEPAFYELAKKQISDARKDSEERTKKAVEQAAKPDTSSAPVEGSAAAQHKDEEPVATAEQLVGNENIRFQGMRLAYFTLDRESKLGCLEKEDVKGRSEGDKIILNRIVSLKEDAGKSA

SEQ ID NO: 90943 - DNA, 2187 bp, Cryptococcus neoformans var. neoformans JEC21
  CDS (1)..(2187)
atgcccgacgttgtactacctctcgtgcagactcccccctttgttatcattgctctcgccgctttacagggtattcccgtcacctgggatgctcagtctggagaacagggtcagactacttacggtgatattgttggtgccgaaaacgttcgagctgagctcgaaaagggtgtcgacggcaaggagatccctctccctcctctccctacccttttgacctcgaccagctctttccaagacgtctccgcggtcctggacgctttcgatgactacctcgcctatcgtacctactttgccggccccaagtttggtttcggcgatgctaccatttggggcaccattcgaggcaacaactctgccattggttccatcaagaagcccggacgaccccatttgcagcgatggttcaaccacgttgagactctcgatgtgcccaaggctgcgctcgagtctcacagacaggccaagagcgagatggagaagggcaagaagaccaagagattggaaagtattgatgttgttttgcctaacgctatcaagggcaaggttgtcgttaggttcgcccctgagccttcaggatacttgcacattggtcacctcaaggctgctatccttaacagatacctggcagaccagtaccagggcaagttcatcctccgtttcgatgacaccaaccctctcaaggaggagggtgagttcgaagaggctatccaggaagacctcaaaatgattgaaatctccttcgacaagatagttcacacttccgaccacttcgacaaaatccaggcctacgctgagcaactcatcaagcaaggcgacgctttcatggacgacactgagggcgaaaccgtcaaggagcagcgtcgagcgatgatcccttctaaaaaccgagacctctctattgaagagaacttggttaagttcaaggagatgtgtgagggtacggaggaaggcaagaggtggagtttgagagccaagattgattatcaacacaagaacggtactttgcgtgaccctgtcatctaccgatatgttgagggctcgcaccatgttactggtaccaagtacaagtcttaccccatgtacgatctcgcctgtcctatcatcgaccacctcgatggcgtcactcacgctctccgcgccaatgagtactgggcccgtcatgagcaataccaatggttccttaagactcttggtttcgccaatattgagatctttgacttcagcagggtcgactttgtttacactgttttgagcaagaggaaattgaagtatcttgtcgagaagaatgttgtcaaaggctgggatgacccccgattccctaccgtccgaggtatacgatcccgcggtatgacggttcaaggtctcaagaactatattctcggtcagggtgcttctcagcaagccgttcagcttgagtgggatggtatctggactgttaacaagaaggttatagaccccgttgctcctcgatactgggccattgcggaggacaggatggtcagtgtcaatgttattggccgtgagactgaagagcctgaggttgtcagcaggcccttacacaagaagaaccctgaggttggagagaagaagttggtttttgctagcaagttgatcatggagcaggaggacgccaagacctttggtgagaatgaagagatcacggccatggactggggaaatgctttcgttacttccaagattaccaccccttccggcgacgtttcttctctcactatcacacttcacctcgccggagacttcaagaagacttctaagaaagtcacctggctcgctgcgccgactgatgccaaccctcttatccccgttgtcctcattgaatacgattacctcatcaccaagaagaagctcgaagaggacgactccctccctgaggtcctcaacccgaagaccgagtaccgcacctacgcgcttgcttctaaggaagttgaaggccttaaaaagtgggatatcatacagttcgagaggaagggattctacatctgccagggtactagagataaccagggcaggatggagtttggtttcatccctgatggacgggctgcgactgtggcgttgaaagccaagcccgcaaaggaaaaaactaaggtccccggaactgcgaaggggtcatggggtaagcccgggcccaaggctgtctccaccgctgctgctgctccttga

SEQ ID NO: 90944 - protein, 728 aa, Cryptococcus neoformans var. neoformans JEC21
MPDVVLPLVQTPPFVIIALAALQGIPVTWDAQSGEQGQTTYGDIVGAENVRAELEKGVDGKEIPLPPLPTLLTSTSSFQDVSAVLDAFDDYLAYRTYFAGPKFGFGDATIWGTIRGNNSAIGSIKKPGRPHLQRWFNHVETLDVPKAALESHRQAKSEMEKGKKTKRLESIDVVLPNAIKGKVVVRFAPEPSGYLHIGHLKAAILNRYLADQYQGKFILRFDDTNPLKEEGEFEEAIQEDLKMIEISFDKIVHTSDHFDKIQAYAEQLIKQGDAFMDDTEGETVKEQRRAMIPSKNRDLSIEENLVKFKEMCEGTEEGKRWSLRAKIDYQHKNGTLRDPVIYRYVEGSHHVTGTKYKSYPMYDLACPIIDHLDGVTHALRANEYWARHEQYQWFLKTLGFANIEIFDFSRVDFVYTVLSKRKLKYLVEKNVVKGWDDPRFPTVRGIRSRGMTVQGLKNYILGQGASQQAVQLEWDGIWTVNKKVIDPVAPRYWAIAEDRMVSVNVIGRETEEPEVVSRPLHKKNPEVGEKKLVFASKLIMEQEDAKTFGENEEITAMDWGNAFVTSKITTPSGDVSSLTITLHLAGDFKKTSKKVTWLAAPTDANPLIPVVLIEYDYLITKKKLEEDDSLPEVLNPKTEYRTYALASKEVEGLKKWDIIQFERKGFYICQGTRDNQGRMEFGFIPDGRAATVALKAKPAKEKTKVPGTAKGSWGKPGPKAVSTAAAAP

SEQ ID NO: 90945 - DNA, 1713 bp, Desulfovibrio vulgaris subsp. vulgaris str. Hildenborough
  CDS (1)..(1713): transl_table=11
atgagcgaacagaacccgaacgtttccgaacgaaccaccgaggcgactcccggcctcgacttcgtgcgcagccgcgttgtcgccgacaacagaacgggccgtttcgacggtcgcgtacacacgcgctttcccccggaacccaacggctatctgcatatcgggcacgccaagtccatctgcctcaatttcggcatagcgaacgaatacggcggcaagtgcaacctgcgtttcgacgacaccaaccctgtcaaggaaagccgggaatacgtcgactccatccgcaccgacgtggcatggatgggcttttcgtgggacgaccgtgaattctacgcctcgaactacttcgaacaactctaccagttcgccgaacagctcatcatggctggcaaagcctacgtggacagcctctccgccgaggagatacgcgcccaccggggtacgctcacgcagcccggcaccgaaagcccctaccgcaaccgtagcgttgaagagaacctcgacctcttccgccgcatgagagctggcgaattcgccgacggcacccacgtgctgcgtgccaagatagacatggcttcgcccaacgtggtcatgcgcgaccctacgctgtaccgcatccgccatgcccaccaccatcgtaccggcgacgcatggtgcatctatcccatgtacgacttcacgcactgcatctccgactcgcttgagggcatcacgcattccatctgcaccctcgaattcgagaacaaccgcgaactgtacgactggacgctcgatgccctcggcgtctaccacccgcagcagatagagttcgcccggctcaacctcacctacacggtgctgtccaagcgcaagctcatccagcttgtggaaggcggcttcgtgaagggatgggacgacccgcgcatgcccaccatcagcggcttgcgccgtcgcggcgtgccccccgaggcgctacgcgaattctgcgcccgcatcggcgtcgccaaggcggacagcacggtcgactacgggctgttcgagttctgcatccgcgagcgcctcaacgccaccaccccccgcgtcatgggcgttctcgaccccattcgcgtggtcatcgagaactatcctgaagggcaggtcgaagagttcgacatgccctaccaccccgaagacgcgtctttcggttcgcgcatagtgcccttctcgcgcgtgctgtacatcgaacgtgacgacttcagggaagacccgcccaagaagttcttccgactcgcccccggtgccgaagtgcgcctgcgctacgcctactacatcacctgccgcgaggtggtgaaggacgaggcgggcaacatcgtcgaacttcgctgcacctacgaccccgaatcgcgcggcggttcgtcgcccgacggtcgcaaggtcaaggggacgctgcactgggtctccgctgcccatgccgttgagtcggaagtgcgcctctacgagcaactcttcgccgtatccgaccccgatgacgtgcccgaaggcggtgtcttcaccgacaatctcaatcccgactcgctcaaggtcgtccgcgccatgctcgaaccttcgctgggcggcatcgaacccggcaccaaggtgcaattcgagcgcatgggctacttctgcgccgacccggactccgtgcccggtgcgcccgtgttcaaccgcaccgtgaccctcaaggacacgtgggcgaaactcgagaagaagatgggctag

SEQ ID NO: 90946 - protein, 570 aa, Desulfovibrio vulgaris subsp. vulgaris str. Hildenborough
MSEQNPNVSERTTEATPGLDFVRSRVVADNRTGRFDGRVHTRFPPEPNGYLHIGHAKSICLNFGIANEYGGKCNLRFDDTNPVKESREYVDSIRTDVAWMGFSWDDREFYASNYFEQLYQFAEQLIMAGKAYVDSLSAEEIRAHRGTLTQPGTESPYRNRSVEENLDLFRRMRAGEFADGTHVLRAKIDMASPNVVMRDPTLYRIRHAHHHRTGDAWCIYPMYDFTHCISDSLEGITHSICTLEFENNRELYDWTLDALGVYHPQQIEFARLNLTYTVLSKRKLIQLVEGGFVKGWDDPRMPTISGLRRRGVPPEALREFCARIGVAKADSTVDYGLFEFCIRERLNATTPRVMGVLDPIRVVIENYPEGQVEEFDMPYHPEDASFGSRIVPFSRVLYIERDDFREDPPKKFFRLAPGAEVRLRYAYYITCREVVKDEAGNIVELRCTYDPESRGGSSPDGRKVKGTLHWVSAAHAVESEVRLYEQLFAVSDPDDVPEGGVFTDNLNPDSLKVVRAMLEPSLGGIEPGTKVQFERMGYFCADPDSVPGAPVFNRTVTLKDTWAKLEKKMG

SEQ ID NO: 90947 - DNA, 1647 bp, Picrophilus torridus DSM 9790
  CDS (1)..(1647): transl_table=11
gtgagtattacagaagaaataagaaagcaggcaattaaaaatgcatacttgcatgatggaagggccgatgtaaaatccgtagttagcaagttaatggcggagtttcctgaggccagaaagaatcctggtgatttaatcaacgatgttaaaaaatgcgttgatgagataaattcaatgggaaaggaccgtattattgaaataataaacaatgagtacccggaatttaaaataaaggaaaaaaaggaggagaagcacgagctgccagagctgccaaatgcaaaaaatggcgttgtcatgaggatggcgccttcaccatcaggaccattgcacataggccattcaaggatggcaatactcaacgatgaatacgtaaaaagatacggtggtgatctaatactaagaatagaggataccaatcccggaaacatagacatagatgcctatgatatgatacctgaagatttaaaatggctggatgtgaatgtaacaaaaacggttatacagacatcgagaatggatctatattacagggaggcaaaaaagcttatagaaaatggatatatgtacatagcggagaccgatcagaaaaggtttaaggaattaaaattaaaatcaatggccctgccagacagatccatggatcctggcgtgcatttggatagatttgataaaatgcttaaccgtgaatacagggagggcgaggctgtagctgttttaaagactgacctgaatcatccaaatccatcaataagggactggatagcctttagaatatcatataaaagacatccacttacaggcgatgaatactgtgtttatccaatgatgaatttttccgttgccattgatgatcattatcttggattaacacatgttataaggggcatggaccatctggtaaatacagagaaacagaaatatatatttaattacaacaactggaagcttccttactattaccattatggaattataaagataccaggttcggtattaaaaacaagcataataaagaatggtataaaatctggaaagtacacaggctgggatgacgtaaggcttggaacgatacgtgcgctaagaaagaggggttacaggccggagacgtttagaagatactggataaactccggcatgaaggaaacaggtgcaacgttctcctgggagatctttgattcaataaacaggcagctgatcgatagggatgcaatgaggttcttctttgttaatgatcctgttctacttgatttaaacaatgatattgaccttgagagccatgcaaggtaccatcctgatattgatcttggatacagaaaatacattataaagagccattcaaggatatatttaagcaggcgtgaccttgatgatatcaaacctgacgagatattcagattaaaggatctttgcgtggttaaaagaacagaggatggaatagcatacattgatgatgattcaaacaaaaggctcaagattatacaatggtgccctgaaaacagccatgaatttaccgttcagaagcctgatggaactgttgactctggtatgcttgaacctcttgcatataattacaatggcgtatcacaatttgagcgctatggctacgtaaatattataaacagaaatggatacttcttgcatagataa

SEQ ID NO: 90948 - protein, 548 aa, Picrophilus torridus DSM 9790
MSITEEIRKQAIKNAYLHDGRADVKSVVSKLMAEFPEARKNPGDLINDVKKCVDEINSMGKDRIIEIINNEYPEFKIKEKKEEKHELPELPNAKNGVVMRMAPSPSGPLHIGHSRMAILNDEYVKRYGGDLILRIEDTNPGNIDIDAYDMIPEDLKWLDVNVTKTVIQTSRMDLYYREAKKLIENGYMYIAETDQKRFKELKLKSMALPDRSMDPGVHLDRFDKMLNREYREGEAVAVLKTDLNHPNPSIRDWIAFRISYKRHPLTGDEYCVYPMMNFSVAIDDHYLGLTHVIRGMDHLVNTEKQKYIFNYNNWKLPYYYHYGIIKIPGSVLKTSIIKNGIKSGKYTGWDDVRLGTIRALRKRGYRPETFRRYWINSGMKETGATFSWEIFDSINRQLIDRDAMRFFFVNDPVLLDLNNDIDLESHARYHPDIDLGYRKYIIKSHSRIYLSRRDLDDIKPDEIFRLKDLCVVKRTEDGIAYIDDDSNKRLKIIQWCPENSHEFTVQKPDGTVDSGMLEPLAYNYNGVSQFERYGYVNIINRNGYFLHR

SEQ ID NO: 90949 - DNA, 1728 bp, Acinetobacter sp. ADP1
  CDS (1)..(1728): transl_table=11
atgaagccaaatgatgttgtttcaactctgcccaattctccgacaacgaatactcatacatctgtcgattctgcgcagcaagaacaacaggcaggcttagattttgtcagacaagtcatcacagaagatttgaacgaaggtcgtacccaaactgtggtcactcgttttccacctgaaccaaacggttatttgcatattggtcatgttaaggccatttgtcttaattttggcgttgctgaagaatttggtggttattgtaatctcagatttgatgataccaacccagatgcagaagagcaggaatatgtcgatgggattgccaacgacgtaaaatggcttggttttgaatggaaagatgaaccacgttatgcatcgagctacttcgaccagctttatacgtgggcggtacaactgattaaacaaggtgatgcctatgtcgacttgcaaacacccgaagaaattaagctgaaccgtggtaactttgtagagccaggtaaaaactctccttaccgtgatgcgagtgtagaagaaaaccttcaacattttgaaaaaatgaaagatgggacttatcaggaaggtcaagctgttttacgtgccaaaattgatatggcaagcccgaatgtacatatgcgtgatccaattttgtatcgtattctgcattcagagcaccatcaaacaggtgatacatggaaaatctatccaatgtatgactatgcgcatccgttatctgatgcgattgaaggtgttacgcattcgttatgtacgcttgagttccaagatcatcgtccattttatgactgggtgattgaaaaagttcattcagaagcagtaccacgccagtatgaatcatctcgtttaaacatcgattacaccattacctctaagcgtaagttacgccgtctggtcgaaggtggttttgtaaatggttgggatgatccgcgtatgccaacagtcgtcggtatgcgccgtcgtggatttacctctgaaggcttgcgtgatttttgtaagcgtgtaggtgtatctaaaacggatggtattgtggatgttgcaatgctcgaattctgtattcgtcagtcgctcgaaaatactgcaagccgtggcatggctgtactcaatccgttgaaagtcaccttaaccaatttgccagaaacacttgatcttgtgcatgcacgccatccgaatgtcgatatgggcgaacgtgttattccactaacatctgagctttatattgaccgcaaagactttgaagaagtgccaccaaaaggctttaaacgtttgattccaggtggtgaagtacgtttgcgtcatgcttacgtgatcaaatgcgatgaagtggtcaaagatgaacagggtgaagtcattgagcttaaatgttcaattgatccagacactttaggtaaaaaccccgaaggtcgtaaggtaaaaggggtgattcattgggtatctgcaaccaaaggacttcctgcggaagtgcgtatttatgatcgcctatttacagaagctgcacctgatgcagatgatgactttcttgccaatttgaatcctgactcattacaagtcgttcaggcctatattgagccagcattggcacaagcatcacctgaacaacgctttcagtttgagcgcgaaggttattttgtagcagatcagcatgatcacacttcagaaaaaccagtgtttaaccgtattttagacctaaaagatagcttcaaacctgagaaaaaataa

SEQ ID NO: 90950 - protein, 575 aa, Acinetobacter sp. ADP1
MKPNDVVSTLPNSPTTNTHTSVDSAQQEQQAGLDFVRQVITEDLNEGRTQTVVTRFPPEPNGYLHIGHVKAICLNFGVAEEFGGYCNLRFDDTNPDAEEQEYVDGIANDVKWLGFEWKDEPRYASSYFDQLYTWAVQLIKQGDAYVDLQTPEEIKLNRGNFVEPGKNSPYRDASVEENLQHFEKMKDGTYQEGQAVLRAKIDMASPNVHMRDPILYRILHSEHHQTGDTWKIYPMYDYAHPLSDAIEGVTHSLCTLEFQDHRPFYDWVIEKVHSEAVPRQYESSRLNIDYTITSKRKLRRLVEGGFVNGWDDPRMPTVVGMRRRGFTSEGLRDFCKRVGVSKTDGIVDVAMLEFCIRQSLENTASRGMAVLNPLKVTLTNLPETLDLVHARHPNVDMGERVIPLTSELYIDRKDFEEVPPKGFKRLIPGGEVRLRHAYVIKCDEVVKDEQGEVIELKCSIDPDTLGKNPEGRKVKGVIHWVSATKGLPAEVRIYDRLFTEAAPDADDDFLANLNPDSLQVVQAYIEPALAQASPEQRFQFEREGYFVADQHDHTSEKPVFNRILDLKDSFKPEKK

SEQ ID NO: 90951 - DNA, 1698 bp, Propionibacterium acnes KPA171202
  CDS (1)..(1698): transl_table=11
atggcagaacctactggaaacccggctgagtccagctcggacttcattcatcaggttgttcgcgcggacatccaacaggacacctacggcgggcgcgtccagacccggttcccacctgagcctaacggctacctccacattggccacgcgaaggccatcgtcaccgatttcggcgttgccgaggatttcggcggcacctgcaacctgagacttgatgatactaatccaggcaccgaggaaaccgagtatgtcgagtcgatcattgcagacattgagtggttaggctactccccggcccacgttgtccacgcgtcggactatttcgagcagctttacgagtgggcgaaatacctcgtacgtgagggactggcctacgttgacgaccagtcccccgaaactatccgtgagcaacgcggcggctacggtaagccgggcattgaaagtccctatcgcaaccgtcctgccgaagaatcccttaacctgttgaggcggatgcgtgccggggaattccccgacggttcccgctgcctgcgcgcccgcatcgatatgcaggccgaaaatatgtggctgcgcgacccagtcatgtaccggatccgccaccaagcccaccactccaccggtaccgagtggtgcatctaccccacgtatgactgggcacatggtcagtctgacgctattgagggcgtgactcactcgttgtgctccctagaattcaacagtcatcgtccgctctacgactggttcctttcccacttgcctctggacggccctgcccccaagcagcgcgaatttgcccgtctcgagttgacccacaccatcacctcgaagcgccggctcaagtccctagtaaccaacaacatcgttgacggatgggatgatccgcgcatgcccaccctgcgcggtatgcgtcgccgtggatacccagcagccgccattcgagccttctgccaggccgtcggcactaccaagaacaactcggtcaaggccattgaggagtttgagtccttcgtgcgccgcgagctcaacgccaccgctcagcggcgcatggctgtgttgcaccccctcaagcttgtccttgacggctggccgactgacgacgacggcaacccggtggtggaatggttccagctggtcaataatccggagaatcctgacgacggcacccgtcgcgtccccttcaccggagagctctggattgaggccgatgatttccgcgaggaccctccccgcaaattcttccgcctctcccccggacatgaggtgcgcctgcgcggcgcctatctggtgacagccaccgacgtcgtcaaaaatcctgacggaactattgctgaggttcacgccagttacgacccgcaatcgcgcggcggaaccgcccctgacggccgcaaggtgaagtcgacgatgcactgggtttcggctggccatgccattcccgtgacagccaacctgtacgaccgcttattcagcgctgagattcctgggtcgcagaccggggaagcccttgacgatctcaacccacattcccgcgaaacactcaccgaggtcatggccgaaccggccctggccaatgtggctccgggcgaggtagtgcaattcgagagactgggatacttcgctgcagatcacgacaccgccgtgttccatcgcaccgtcggtctgcgtgacgaatgggcccagctacaaaagcgccaggcctga

SEQ ID NO: 90952 - protein, 565 aa, Propionibacterium acnes KPA171202
MAEPTGNPAESSSDFIHQVVRADIQQDTYGGRVQTRFPPEPNGYLHIGHAKAIVTDFGVAEDFGGTCNLRLDDTNPGTEETEYVESIIADIEWLGYSPAHVVHASDYFEQLYEWAKYLVREGLAYVDDQSPETIREQRGGYGKPGIESPYRNRPAEESLNLLRRMRAGEFPDGSRCLRARIDMQAENMWLRDPVMYRIRHQAHHSTGTEWCIYPTYDWAHGQSDAIEGVTHSLCSLEFNSHRPLYDWFLSHLPLDGPAPKQREFARLELTHTITSKRRLKSLVTNNIVDGWDDPRMPTLRGMRRRGYPAAAIRAFCQAVGTTKNNSVKAIEEFESFVRRELNATAQRRMAVLHPLKLVLDGWPTDDDGNPVVEWFQLVNNPENPDDGTRRVPFTGELWIEADDFREDPPRKFFRLSPGHEVRLRGAYLVTATDVVKNPDGTIAEVHASYDPQSRGGTAPDGRKVKSTMHWVSAGHAIPVTANLYDRLFSAEIPGSQTGEALDDLNPHSRETLTEVMAEPALANVAPGEVVQFERLGYFAADHDTAVFHRTVGLRDEWAQLQKRQA

SEQ ID NO: 90953 - DNA, 1710 bp, Desulfotalea psychrophila LSv54
  CDS (1)..(1710): transl_table=11
atggctacaaatgagcgtatagaagaaaagggcgaagaggaacacaaaaagactctcgactttatcagacagatcattgcagaagacctgcgcacaggaaaacataaacagccggtgacccgttttccgcctgagcccaatggatttctccatatcggtcatgcaaaatcaatctgcctcaattttggcattggccaggagaataacagcccctgccatcttcgttttgacgataccaacccaagcaaggaggagagcatctacgttgactccatcaaaaaggatgtctcctggctcggttttgattggggcgaagacctgttcttttcctccaactactttgagcagatatacgattatgccctgcagctgatcaaaatgggtaaggcctatgtctgccagctcaatgctgagcagatgagagaataccgaggcaccctgaccgagccgggtaaggatagcccctaccgcgatcgcgccattgcagagaacctcgaccttttcgagcgcatggccaggggagagtttgacgagggcagtcacgtgctccgcgccaagattgatatggcctcacccaatatcaacctgcgggatcccattatttaccgcatcctcaagatagagcaccaccgtaccggcgataagtggcagatctatcccatgtacgattttacccacgccctctccgatgccatcgagggaataacccactccctctgtactctggagttccaggaccatcgccctctctacgactgggtactggataccctggcgaccccctgccacccccggcagatagaatttgcccgcctcaaccttacctatacggtaatgagtaagcgaaaactcctgcagatggttcagaaaaactatgtaagtggctgggatgatccccgcatgctgaccatctccggtctgcgtcgtcgaggctatacccctgcatccatccgtaacttctgtgcagaaattggtcttgccaagagagagagctggatcgagatgggcgtattggagaacgagatacgaaacgacctcaaccccagcgcccaacgggccatgtgtgtccttgatccaataaaactaatcattgacaactatcctgaagagaaggaagaggaggtggttgccaaaatccacccacaaaatccagagatgggtaccaagaccctgcccttctcccgagaactctatatcgaacgtaatgattttatggagaaccctccaggaaaattccgccgtctcggaccaggcaaagaggttcgcctgcgctacggctattatatacagtacgcatcccacctaaaggacgagacaacaggggaaatcacagagatccactgtacctacgaccctgaaagccgaggtggttcttcacccgatggccgtaaggtaaagggcaccatccactgggtttctgccaagcatgctcttgactgtaccgttcacctctacgatcgtctctttaacgtggagaatcccgatgcggacaaggaagttgacttccttgagcaccttaacaaagactccaagcttgtcctccgacatgccaaggcggaacctgccctggcgacactccccgttggagagagtgtccagtttgagcgacagggatatttttgcgtagattctgtggactccacagaggagaatattgtcttcaaccgggttgtcaccctgcgtgattcctgggccaagatcaacaaatag

SEQ ID NO: 90954 - protein, 569 aa, Desulfotalea psychrophila LSv54
MATNERIEEKGEEEHKKTLDFIRQIIAEDLRTGKHKQPVTRFPPEPNGFLHIGHAKSICLNFGIGQENNSPCHLRFDDTNPSKEESIYVDSIKKDVSWLGFDWGEDLFFSSNYFEQIYDYALQLIKMGKAYVCQLNAEQMREYRGTLTEPGKDSPYRDRAIAENLDLFERMARGEFDEGSHVLRAKIDMASPNINLRDPIIYRILKIEHHRTGDKWQIYPMYDFTHALSDAIEGITHSLCTLEFQDHRPLYDWVLDTLATPCHPRQIEFARLNLTYTVMSKRKLLQMVQKNYVSGWDDPRMLTISGLRRRGYTPASIRNFCAEIGLAKRESWIEMGVLENEIRNDLNPSAQRAMCVLDPIKLIIDNYPEEKEEEVVAKIHPQNPEMGTKTLPFSRELYIERNDFMENPPGKFRRLGPGKEVRLRYGYYIQYASHLKDETTGEITEIHCTYDPESRGGSSPDGRKVKGTIHWVSAKHALDCTVHLYDRLFNVENPDADKEVDFLEHLNKDSKLVLRHAKAEPALATLPVGESVQFERQGYFCVDSVDSTEENIVFNRVVTLRDSWAKINK

SEQ ID NO: 90955 - DNA, 1665 bp, Mannheimia succiniciproducens MBEL55E
  CDS (1)..(1665): transl_table=11
atgaataataacgaaattcttatcgaagaaacccgcccgacaaactttatccgtcaaattattgatgaagatttggcttcaggtaaacataataacgtttacacgcgttttccgccggaaccgaacggctatttgcatatcggtcatgcgaaatccatttgtttaaactttggtattgcgcaggattatcagggcaaatgtaatttgcgttttgacgataccaatccggtgaaagaagatgtggaatatgtagattcaatcaaacaggatgtggaatggttagggttcaaatgggaaggtgagcctcattatgcgtcggattattttgaccagctttacggctatgccatcgaattaatagagaaaggcatggcttatgtggatgaactgtcgccggaacaaatgcgcgaataccgcggcacgttaaccgaaccgggcaaaaacagcccgtatcgtgaccgcagtattgaagaaaatctgaatttgtttgaaaaaatgaaaaacggcgaatttgcagaaggtgcggcttgtttacgtgcaaaaatcgatatggcgtctccgtttatggtaatgcgcgatcccgtgctttatcgtgtgaaatttgccagccatcaccaaaccggcgacaaatggtgtatttatccgatgtacgatttcactcattgcatttccgatgctattgaacgcattacacattcgttatgtacactggagttccaggataaccgccgtttatacgactgggtgttggagcatatttcaattgagcgtccgctgccgcatcaatatgaattttcacgtttaaatttagaaggcacattaacttctaagcgcaaattattaaaattggtcgcggaaggtgcggtggacggttggaacgatccgcgtatgccgactatttccggtttgcgacgtcgcggttatacaccggccgcattacgtgaattctgtcgccgtatcggggtgaccaagcaggataacgtagtggagttcagcgcattagaaagctgcattcgagacgacttaaataggaatgcgccacgagccatggcggtgttgaatccgctgcgtatcgtgattgaaaacttcactgaaaaagaagtattaactgcgccgaatcatcctaattatccggaattaggcacccatgaaatgtcgtttacgaaagaaatttatattgatcaggcggattttcgtgaagaggccaacaaacaatataaacgcttagtattaggcaaagaagtgcgtttacgtcatgcttatgtcattaaagcggaacgcgtggaaaaagacgaacaaggcggtattaccaccgtttattgttcttatgatcctgaaacgttaggcaaaaacccggcggacggccgcaaagtgaaaggcgtgatccattgggtgtccgcaacggaaaatttacctgcagaattccgtgtctacgggcgtttgttcaatgtgccgaatccgggggcggaagaagatattttagccgctatgaatcctgaatctttagttgtgaaacatggcgtagttgaaatgagtctggctaacgccgagccggaaaaagcgtatcagtttgaacgcgaaggctattattgtgcggataacaaagatagtaaagcaggcaatttagtatttaatttaaccgtaagtttaaaagaaggtttttaa

SEQ ID NO: 90956 - protein, 554 aa, Mannheimia succiniciproducens MBEL55E
MNNNEILIEETRPTNFIRQIIDEDLASGKHNNVYTRFPPEPNGYLHIGHAKSICLNFGIAQDYQGKCNLRFDDTNPVKEDVEYVDSIKQDVEWLGFKWEGEPHYASDYFDQLYGYAIELIEKGMAYVDELSPEQMREYRGTLTEPGKNSPYRDRSIEENLNLFEKMKNGEFAEGAACLRAKIDMASPFMVMRDPVLYRVKFASHHQTGDKWCIYPMYDFTHCISDAIERITHSLCTLEFQDNRRLYDWVLEHISIERPLPHQYEFSRLNLEGTLTSKRKLLKLVAEGAVDGWNDPRMPTISGLRRRGYTPAALREFCRRIGVTKQDNVVEFSALESCIRDDLNRNAPRAMAVLNPLRIVIENFTEKEVLTAPNHPNYPELGTHEMSFTKEIYIDQADFREEANKQYKRLVLGKEVRLRHAYVIKAERVEKDEQGGITTVYCSYDPETLGKNPADGRKVKGVIHWVSATENLPAEFRVYGRLFNVPNPGAEEDILAAMNPESLVVKHGVVEMSLANAEPEKAYQFEREGYYCADNKDSKAGNLVFNLTVSLKEGF

SEQ ID NO: 90957 - DNA, 1656 bp, Legionella pneumophila subsp. pneumophila str. Philadelphia 1
  CDS (1)..(1656): transl_table=11
atgacagaacaaactgaaaaaagagctcactttattagacaactcattatagatgatttggcaaatggaaaacatcagggaatcgttactcgtttccctcctgaaccaaatggatatctccatgttggacatgccaaatctatttgtcttaattttggtttggcagaagagtttaagggaaaatgctttttacgttttgatgacaccaatccaattaaagaagaagaagaatatgtaaacgcgatcattgatgatgttcgttggttgggatttgaatggtgtgccatgacgcattcttcggattactatcatgagctgtatgaattagccatttatcttattaagaaagatatggcttatgtcgatagcttgagtatggaagaaattcgtgcttttcgcggcactctacaagaaccagggcgcgaaagcccttatagaaacagaacaattgaagagaatctggatttgttcgctcggatgaaagctggtgagtttcctgatggaactcatgttttgagagcaaaaatagatatgaaatcaggtaatttaaatatgcgtgatccggttttatatcgtatacgccacgcccggcaccagcgtacaggagatgaatggtgtatttatcccatgtatgattatgctcatcctatttctgatgccctggaaaaaataacacattctttatgtacgttggaattccaggatcatagacctttgtatgattggctggttgataatttacctttgcctgccaaaccagtacaaaccgaatttgccagattaaatttatcccatactgttacgagcaagagaaaattacgtgaattggttgaaaaaaaaatcgttacaggatgggatgacccacgattgcccacattacgcggtatgcgcaaaaggggatacccacctgctgcaattcggcaattctgtgaaataattggcatatcaagaagtgattcagtgattgatatgagtttacttgaggaatgtgtacgcgctgaatttaataaaactgcaaaacgggctctctgtgttatggatcccttaaaagttgttattgtaaattatccggaaaataaagtagaacagcttcaagcagctttctaccctcaaaatcctgagtcagcgagtaggaatttacccttttcccgtgaaatttatattgaaaagtctgattttatggaaaatccgcctaataaatatttccggttatctcctggagctgaagtacgcttacgtcatgcctatgttataaagtgccaggaagttatccgtaatgaccaaggcgaaataacagaattgcattgcacttatgatgaaaatactcttggcaaaaatccggaggatcgcaaggtgaagggtgtcattcattgggtgtcttcatcacatgcctatcctgtcactatttatcaatacgacaggttatttacagatcctaatcctgcacgggaagaggattattttcagtttctgaaccataactctttacaaaccctccagggattttgtgaaccggcaatggctgagcaggcagaaggagatgtgtttcaatttgagcgtttaggttattattgcgtcaattcagtggctgagggctgtgttcaagcctttcatcgggtagtggatttgaaggacacttggggtaaagtgagttga

SEQ ID NO: 90958 - protein, 551 aa, Legionella pneumophila subsp. pneumophila str. Philadelphia 1
MTEQTEKRAHFIRQLIIDDLANGKHQGIVTRFPPEPNGYLHVGHAKSICLNFGLAEEFKGKCFLRFDDTNPIKEEEEYVNAIIDDVRWLGFEWCAMTHSSDYYHELYELAIYLIKKDMAYVDSLSMEEIRAFRGTLQEPGRESPYRNRTIEENLDLFARMKAGEFPDGTHVLRAKIDMKSGNLNMRDPVLYRIRHARHQRTGDEWCIYPMYDYAHPISDALEKITHSLCTLEFQDHRPLYDWLVDNLPLPAKPVQTEFARLNLSHTVTSKRKLRELVEKKIVTGWDDPRLPTLRGMRKRGYPPAAIRQFCEIIGISRSDSVIDMSLLEECVRAEFNKTAKRALCVMDPLKVVIVNYPENKVEQLQAAFYPQNPESASRNLPFSREIYIEKSDFMENPPNKYFRLSPGAEVRLRHAYVIKCQEVIRNDQGEITELHCTYDENTLGKNPEDRKVKGVIHWVSSSHAYPVTIYQYDRLFTDPNPAREEDYFQFLNHNSLQTLQGFCEPAMAEQAEGDVFQFERLGYYCVNSVAEGCVQAFHRVVDLKDTWGKVS

SEQ ID NO: 90959 - DNA, 1749 bp, Bacteroides fragilis YCH46
  CDS (1)..(1749): transl_table=11
atgacagatatgacagatataaaaaacgaagaagcaggcgaaaagaaaagcctcaatttcattgaacaggcagtagaaaatgatttgaaagctggaaagaacgggggaaaagtacaaacacgcttcccgccggaaccaaacggttacctgcacatcgggcacgctaaagccatttgtctcgacttcggcatcgctgccgcacacggcggtgtgtgcaaccttcgtttcgacgacactaacccgacgaaagaggatatggaatatgtagaagccatccaggaagatatccggtggctgggattccaatggggcaacgtatattatgcctcagattatttccaacaattatgggactttgccgtcactctgattaaagaaggcaaggcctacgtagacgagcagacttcagaacagatagcgcaacagaaaggcactcccacccaacccggtgtcgagagtccgtaccgcaaccgtccgatcgaagagagccttgccctgttcgaaaagatgaatagcgacgaagccaaggaaggttccatggtgcttcgtgccaaaatagacatggcaagccccaacatgcacttccgcgacccgatcatgtaccgcatcctgcatgtggcacaccaccgcaccggaacccaatggaaagcctacccgatgtatgactttgcacacggtcagagcgactatttcgaaggagtcacccactcactctgtacactcgagttcgtgcctcaccgtcctctttacgacctgttcatcgactggctgaaagaaggcaaggatctggacgacaaccgtccccgtcagacggagttcaacaaactgaacctgaattacacgctgatgagtaaacgcaacctgctgatcctggtgaaggaaggactggtgaacgactgggacgatccccgtatgccgactctctgcggattccgccgtcgcggctattctcccgaatccatccgtaagttcatcgataaaataggttacaccacttacgatgcgctcaacgacttcgccctgctcgaaagcgccgtacgcgaagacctaaatgcccgtgccacccgtgtatctgccgtactgaacccggtgaaactgatcatcaccaactatcccgaaggacaagttgaggaactggaagccatcaacaaccccgaagatccgacagccggaagccataccatcgaattcagccgcgaactgtggatggaacgcgatgacttcatggaagatgccccgaagaaatatttccgcatgactccgggacaggaagtgcgtctgaagaacgcctacatcgtaaaatgtacaggctgcaagaaagacgagaacggcaccgtgaccgaggtatactgcgaatacgatcccaacaccagaagcggcatgcccgacgccaaccgcaaagtgaaaggcaccctccattggctcagctgcaaccattgcctgccggcagaggtacgtctgtacgaccgtctctggaaagtggaaaacccgcgcgacgagatggcagccatccgtgaagccaaaggttgcgacgccctcgaagccatgaaggaaatgatcaatccggattcactgaccgtactgccccattgctatatagagaagtacgtggccgacatgcccgcgctctcttatctgcaattccagcgtatcggttatttcaatatcgacaaagattccacccccggacatctggtattcaaccgcaccgtaggactgaaagatacctggggaaagatcaataaataa

SEQ ID NO: 90960 - protein, 582 aa, Bacteroides fragilis YCH46
MTDMTDIKNEEAGEKKSLNFIEQAVENDLKAGKNGGKVQTRFPPEPNGYLHIGHAKAICLDFGIAAAHGGVCNLRFDDTNPTKEDMEYVEAIQEDIRWLGFQWGNVYYASDYFQQLWDFAVTLIKEGKAYVDEQTSEQIAQQKGTPTQPGVESPYRNRPIEESLALFEKMNSDEAKEGSMVLRAKIDMASPNMHFRDPIMYRILHVAHHRTGTQWKAYPMYDFAHGQSDYFEGVTHSLCTLEFVPHRPLYDLFIDWLKEGKDLDDNRPRQTEFNKLNLNYTLMSKRNLLILVKEGLVNDWDDPRMPTLCGFRRRGYSPESIRKFIDKIGYTTYDALNDFALLESAVREDLNARATRVSAVLNPVKLIITNYPEGQVEELEAINNPEDPTAGSHTIEFSRELWMERDDFMEDAPKKYFRMTPGQEVRLKNAYIVKCTGCKKDENGTVTEVYCEYDPNTRSGMPDANRKVKGTLHWLSCNHCLPAEVRLYDRLWKVENPRDEMAAIREAKGCDALEAMKEMINPDSLTVLPHCYIEKYVADMPALSYLQFQRIGYFNIDKDSTPGHLVFNRTVGLKDTWGKINK

SEQ ID NO: 90961 - DNA, 1668 bp, Photobacterium profundum SS9
  CDS (1)..(1668): transl_table=11
ttgatgagtgaatctgaagctcgtccaactaactttatccgccaaattattgatgcggatttagatagtggcaaacataaaagcgttcatacccgattcccgccggaaccgaatggttacctgcatatcggccatgctaaatctatttgtttgaacttcggtattgctcaggactatcagggtcaatgtaatttacgttttgacgatactaatcctgaaaaagaagacatcgaatacgttgagtcaattaagaacgatgttaactggttgggctttgattggagcggtgagatttgttattcatcaaactatttcgataagctatacgggtttgcagttgaattaattaataaaggcttagcgtatgttgatgagctaagtccagagcaaatgcgtgaataccgtggcaacttaacagagccaggtaaaccaagcccataccgtgatcgtagtgttgctgaaaaccttgaactgttcgaaaaaatgaagaacggtgaagttgaagaaggcattatgtctcttcgcgctaagatcgatatggcttcatcatttatggtgttgcgtgatcctgttatttatcgtgttcgcttcgcgactcatcaccaaacaggtgataagtggtgtatctacccgatgtacgacttcacacactgtatttctgatgcgctagaaggtattacgcactcgatttgtacgcttgagttccaagataaccgtcgtttatacgattgggttttggataatattacgattgattgccaacctcgccagtacgagtttagccgtttaaatcttgaatatacggtaatgtctaagcgtaagcttaatcaattagtcactgataacttggtgtctggttgggacgatccacgtatgccaactgtttctggtttacgccgtcgtggctttacgtctgcatctattcgtgaattctgtaaacgtattggtgttactaagcaagaaaataccatcgaaatgagttcactagaatcatgtattcgcgatgatttgaatgagaatgcaccacgtgcaatggctgttcttgatccagtgaaaattgtgattgaaaactttactggtgatactgaagtattaacagtaagtaatcacccaaataactcagaaatgggtacgcgtgaagttccatttacgcgtgaaatttggattgaacgtgaagatttccgcgaagaagcgaataagaaatacaagcgtttagtgttgggtaaagaagtgcgtttacgtggcgcttacgtaattaaagctgaacgtatcgaaaaagatgcagaaggtaatatcacgaccattttctgttcttatgataatgaaacattaggtgttaacccatctgatggtcgtaaagtaaaaggtgttattcactgggtatctgcagatgcaggtttaccagcagaaattcgcctttacgatcgcctatttactgttgctaacccagcagcagcagatgatttcgttactgtgattaaccctgaatcgttaacggtactgaatggttttgtggagccaagcttaaaagtggcagaagctgaaaaagcatttcagtttgaacgtataggttacttctgtgttgatagcaaagactcttcagcagagaaactagtttttaaccgtacagtaggcttacgcgatacatgggcaaaaatgggtgaataa

SEQ ID NO: 90962 - protein, 555 aa, Photobacterium profundum SS9
MMSESEARPTNFIRQIIDADLDSGKHKSVHTRFPPEPNGYLHIGHAKSICLNFGIAQDYQGQCNLRFDDTNPEKEDIEYVESIKNDVNWLGFDWSGEICYSSNYFDKLYGFAVELINKGLAYVDELSPEQMREYRGNLTEPGKPSPYRDRSVAENLELFEKMKNGEVEEGIMSLRAKIDMASSFMVLRDPVIYRVRFATHHQTGDKWCIYPMYDFTHCISDALEGITHSICTLEFQDNRRLYDWVLDNITIDCQPRQYEFSRLNLEYTVMSKRKLNQLVTDNLVSGWDDPRMPTVSGLRRRGFTSASIREFCKRIGVTKQENTIEMSSLESCIRDDLNENAPRAMAVLDPVKIVIENFTGDTEVLTVSNHPNNSEMGTREVPFTREIWIEREDFREEANKKYKRLVLGKEVRLRGAYVIKAERIEKDAEGNITTIFCSYDNETLGVNPSDGRKVKGVIHWVSADAGLPAEIRLYDRLFTVANPAAADDFVTVINPESLTVLNGFVEPSLKVAEAEKAFQFERIGYFCVDSKDSSAEKLVFNRTVGLRDTWAKMGE

SEQ ID NO: 90963 - DNA, 1740 bp, Haloarcula marismortui ATCC 43049
  CDS (1)..(1740): transl_table=11
atggacgacgagctgcgagaccgaatcacggaggcggcggagacaaacgccctcctcaacgcggtcaaacacgatagcgaggcacaggtcggcgcaataatgggcccgctcatgggcgagaacccggagttccgcgagtacggcgacgagatacccggcgttatcgcgccggtcgtcgagcgggtcaacgggatggacgccgaggagcgccgcgagcggctggccgaactcgctccggagaaactcgaagagctggaggctgaggacgagggcgaggaccacccactgccggacctgcccagcgccgaggagtacgacaccgtccggatgcgcgtcgcgccaaaccccaacgggccgtggcacatcggccacgcgcggatggccgctgtcgtcgggacgtacaaacagcgctacgacggggagttcatctgccgcttcgacgacaccgaccccgagaccaagcggccggatctggatgcctacgacgcaattctggacgcaatcgactatctcggcttcgaaccggacgacgtggtcaacgccagcgaccgcgtcgagacctactacgagtacgctcgcaagctcatcgacaagggcggggcctacacctgctcgtgcccgcagggtgagttttcggacctgaagaacaacggcgaggcctgtccccaccgggataaggacgccgagaccacgcgctcggagttcgaggcgatggtcgacggcgagtacgacagcggcgagatggtcctgcgggtccggaccgatattactcacaagaaccccgcgctgcgggacttcgtcgccttccggatggtcgacacgccccatccacgcgaggcggccgagcagtaccgctgctggccgatgctggacttccagagcgggcttgacgaccacctgctgggtgtcacccacattatccgcggtatcgacctgcaggactccgcgaagcgccagcagttcgtctatgactacttcgactgggagtaccccgaagtcatccactggggccacgtccaggtcgacgagtacgacgtgccgctgtccacgtcaagcatcgccgaactcattgaggacggcgaactggcgggctgggacgatccgcgagcgccgaccgtcgccagcctcgaacggcgcggcatccgcggcgaggccgttgtcgatgcgatgattcagctgggcacgtccacctcgaacgtcgacctggcgatgtcctcgatctactcgaacaaccgtgacctcatcgacgacgactcggaccgggcgttcttcgtccgggacagcgacgaccacggtggcctcgttgagcgccagatcgtcggcgggccggacgccggcgaaccgccgctgcacccggactacgaggagcgtggccgccgcgagattccggtgaccagcggtgtcgtcgtcgagggtgacgacctgccagaccacggcgatcgtatctggctcaagggctacggctgcgtgcgacacactcgcgacgccttcgagtacaccggcgacgatatcgacgccgtccgtgaggagggcgtcgacgtgattcactgggcaccggctgacggcccagcgctccgcctccggacgatggacggcgacgtatcaggcgtggccgaaccgggactgcgcaactacgacactgacgacgtggtgcagttcgaacgcattggcttcgctcgcctcgacaaggttgcggacgactcggatacggagtccgtcgcgtactttacccatccctga

SEQ ID NO: 90964 - protein, 579 aa, Haloarcula marismortui ATCC 43049
MDDELRDRITEAAETNALLNAVKHDSEAQVGAIMGPLMGENPEFREYGDEIPGVIAPVVERVNGMDAEERRERLAELAPEKLEELEAEDEGEDHPLPDLPSAEEYDTVRMRVAPNPNGPWHIGHARMAAVVGTYKQRYDGEFICRFDDTDPETKRPDLDAYDAILDAIDYLGFEPDDVVNASDRVETYYEYARKLIDKGGAYTCSCPQGEFSDLKNNGEACPHRDKDAETTRSEFEAMVDGEYDSGEMVLRVRTDITHKNPALRDFVAFRMVDTPHPREAAEQYRCWPMLDFQSGLDDHLLGVTHIIRGIDLQDSAKRQQFVYDYFDWEYPEVIHWGHVQVDEYDVPLSTSSIAELIEDGELAGWDDPRAPTVASLERRGIRGEAVVDAMIQLGTSTSNVDLAMSSIYSNNRDLIDDDSDRAFFVRDSDDHGGLVERQIVGGPDAGEPPLHPDYEERGRREIPVTSGVVVEGDDLPDHGDRIWLKGYGCVRHTRDAFEYTGDDIDAVREEGVDVIHWAPADGPALRLRTMDGDVSGVAEPGLRNYDTDDVVQFERIGFARLDKVADDSDTESVAYFTHP

SEQ ID NO: 90965 - DNA, 1647 bp, Thermus thermophilus HB8
  CDS (1)..(1647): transl_table=11
atgggccttgtccccgagtgcttcatcaccgagctcgtggagcgggacctcaaggaggggaagtacgccaagctcgtcacccgcttccccccggagcccaacggctacctccacatcggccacgcccggagcatcgttttgaacttcggcctcgcccaggactacggcggggagtgcaacctgcgctttgacgacaccaaccccgagacggagaaggaggagtacgcccgggccattgaggaggacgtgcgctggctgggcttccggcccacccgggtcctctacgcctcggactactttgagaccatgtaccaatgcgccctggtcctcatccaggagggcaaggcctacgtggacgacctcccggaggaggagatgagcgagcttcgggcccagggaaagccaagcccctaccgggagcggagcgtggaggagaacctggagctctttgagaggatgcgccggggggagttccccacgggaagccgggtcttaagggccaagattgaccccgcccaccccaacttcaagctccgcgaccccgtgctctaccgcatcgtccacgccccccactaccacgttggggaccggtgggtcatctaccccatgtacgacttcgcccaccccctggaggacttcatcgagggggtcacccactccctctgcaccctggagtttgagaacaaccgcaccgtctacgactgggtcattgagaacctcaaggggaagtgtgggcttcccacctcccccaggccccaccagtacgagttcgcccggctggacttaagccacaccgtgctctccaagaggaagctcatcaagctggtggaaggggggtacgtctcgggctgggacgaccccaggctccccaccctgaggggcctgaggcggaggggggtgaggcccgaggccatcgtggagttcgtgcgcaagacggggatctccaggaacgaggcccagatagagatggacctctttgaggaggtggtgcgggacgacctgaaccccatcgcccccagggtcttgggcgtggtggaccccctgaaggtggtcctcaccaactacgagggggaggagtggatagaggccccctactggccccgggacatccccaaggaggggacgaggccccttcccttctccccggagctctacattgagcgcacggacttcagcctcaacccccctaaaggttggaagcgcctcgccccagggcagagggtgcgcctgaggcacgcctacgtcatagagcttgaggacgtggtggaagaggggggcgaggtgaggctcctcaaggcccggatcgtccccggcaccctgggggcgaaccccgaggacggggtcaggcccaagggggtgatccactgggtctccgcccgccacgccctccccgtggagtttaggctctacggcaggctcttccgcaccaaggacccggaggaggggggggacttcctgcaaaacctcaaccccgaggcccttgtggtgaagcggggcttcattgagccgagcgtggcccaggaccccgaggacacccgctaccagctggagcgcctgggctacttctggcgggaccccgtggactcgaggcccgaggccctggtgatgaaccgcatcgtgcccctaaaagaggggtatagggtctga

SEQ ID NO: 90966 - protein, 548 aa, Thermus thermophilus HB8
MGLVPECFITELVERDLKEGKYAKLVTRFPPEPNGYLHIGHARSIVLNFGLAQDYGGECNLRFDDTNPETEKEEYARAIEEDVRWLGFRPTRVLYASDYFETMYQCALVLIQEGKAYVDDLPEEEMSELRAQGKPSPYRERSVEENLELFERMRRGEFPTGSRVLRAKIDPAHPNFKLRDPVLYRIVHAPHYHVGDRWVIYPMYDFAHPLEDFIEGVTHSLCTLEFENNRTVYDWVIENLKGKCGLPTSPRPHQYEFARLDLSHTVLSKRKLIKLVEGGYVSGWDDPRLPTLRGLRRRGVRPEAIVEFVRKTGISRNEAQIEMDLFEEVVRDDLNPIAPRVLGVVDPLKVVLTNYEGEEWIEAPYWPRDIPKEGTRPLPFSPELYIERTDFSLNPPKGWKRLAPGQRVRLRHAYVIELEDVVEEGGEVRLLKARIVPGTLGANPEDGVRPKGVIHWVSARHALPVEFRLYGRLFRTKDPEEGGDFLQNLNPEALVVKRGFIEPSVAQDPEDTRYQLERLGYFWRDPVDSRPEALVMNRIVPLKEGYRV

SEQ ID NO: 90967 - DNA, 1686 bp, Idiomarina loihiensis L2TR
  CDS (1)..(1686): transl_table=11
atggcagatactgactctcgtcccagtaattttattcgtcaaatcattgataaagatttggccagtggtaagcacgcaactgtacacacccgttttcctccggagccgaatggttacctgcatattggccatgccaaatcgatagtgctgaacttcggtattgccgaagactacaacggcacctgtaacctgcgttttgatgataccaacccactgaaagaaaaagtggactatgtgaactccattaaaaaagacgtggaatggctggggtatcactgggaaggcgagccgcgttattcctctaattactttgatcagctacacgggtttgcggttgagctgattgaaaaaggcctggcctacgttgatttcagttcgcaggataaaatgcgcgaaatgcgcggtactctgaaagagccgggcgtaaacagcccttaccgtgatacttctgtggaagagaacttaaagcactttgctgacatgacagcaggtaagcacgaagaaggcaccgccgcattacgggcaaaaattgatatgagctcgccgtttatgtgtatgcgcgatccggtaatttaccgtgtgcgttttgtacaccatcaccagactggtgataaatggtgcgtttacccaatgtacgacttcacccactgcatttcggatgcgctggaaggcattacacattcattgtgtacgctggagttccaggataaccgtcgtttgtatgactgggtgctggataacatcagcattgactgccatccacagcaaattgaattctcgcgcctgaatctgcaatacacggtaatgagtaaacgcattattaatacgttggtagatgagaataaagtaagcggctgggatgacccgcgtattgccagcattgctggtttgcgtcgccgtggttatacaccagattcagttcgtgagttctgccgccgtattggtgtgaccaaaatggataaccaggtagaaatgagcatgctggaagcctgcattcgtgatgacctgaacgtcaatgcaccacgcgctatggcggtgatggatccggttaaaattgttattgaaaactaccctgaaggcgaacaggaactgctggatgcgccaaaccacccgaatgacccggaaatgggctcgcgtcaggtgacttttagtcgtgaaatctggattgaacgggaagacttccgtgagtcggctaataagaagttcaagcgtctggtgctggataaagaagtgcgtttgcgtaatgcctatgttattcgtgcagaccggatagaaaccgacgataacggcgagatccagactatttactgtcattacgacgctgacactctgggtaaagacccggcagacggtcgtaaggtgaagggcgttattcactgggtgtctgcagaaactgcaaaagcagcagaattccgtgtgtatgatcgcttattccaggtgcctaacccggcagccgaggaagacttgttctcaaccctgaatccggagtctttggttattaagaaaggctttgtggaagctaacttagcgagtgcgaaactgggcgagaacttccagtttgaacgtctgggctactattgtctggatcaggatgctgagactgaaggccgtttaatattcaaccagaccgttggtttacgtgacagctgggcgaaaatagaacaggaacaaactactggatcttaa

SEQ ID NO: 90968 - protein, 561 aa, Idiomarina loihiensis L2TR
MADTDSRPSNFIRQIIDKDLASGKHATVHTRFPPEPNGYLHIGHAKSIVLNFGIAEDYNGTCNLRFDDTNPLKEKVDYVNSIKKDVEWLGYHWEGEPRYSSNYFDQLHGFAVELIEKGLAYVDFSSQDKMREMRGTLKEPGVNSPYRDTSVEENLKHFADMTAGKHEEGTAALRAKIDMSSPFMCMRDPVIYRVRFVHHHQTGDKWCVYPMYDFTHCISDALEGITHSLCTLEFQDNRRLYDWVLDNISIDCHPQQIEFSRLNLQYTVMSKRIINTLVDENKVSGWDDPRIASIAGLRRRGYTPDSVREFCRRIGVTKMDNQVEMSMLEACIRDDLNVNAPRAMAVMDPVKIVIENYPEGEQELLDAPNHPNDPEMGSRQVTFSREIWIEREDFRESANKKFKRLVLDKEVRLRNAYVIRADRIETDDNGEIQTIYCHYDADTLGKDPADGRKVKGVIHWVSAETAKAAEFRVYDRLFQVPNPAAEEDLFSTLNPESLVIKKGFVEANLASAKLGENFQFERLGYYCLDQDAETEGRLIFNQTVGLRDSWAKIEQEQTTGS

SEQ ID NO: 90969 - DNA, 1734 bp, Azoarcus sp. EbN1
  CDS (1)..(1734): transl_table=11
atgaatccgaacacgcccaaagatggcgccgccagcacgccttccaacttcatccgcaacctcatcgacgaggacaaccggagcgggaaatgggacggccgcgtcgagacgcgctttcctcccgaaccgaacggctacctgcactacggccacgcgaagtcgatctgcctgaacttcggcctcgcgcagagctacggcggcgcctgccatctgcgcttcgacgacaccaatccggaaaaggaagagcaggaatacgttgattcgatcatcgaggcggtgcgttggctcggcttcaactggggcgaacacctgtatttcgcctcggattatttcgatcgcatgtacgcatgcgccgaatacctgatcacgtcgggccgtgcctacgtcgaatcgctgtcggccgaggagatgcgcgcgtatcgcggcacgctgactgaagccgggcgcgagagcccgtaccgcagccgcagcgtcgaggaaaacctcgatcttttccgccgcatgcgcgctggcgagttcaccgacgggcagcacatcctgcgcgcgaaagtcgacatggcctcgccgaacctgaacctgcgcgacccggcgatctaccgcattcgccgcgcgactcaccaccgcaccggcgacgcctggtgcatctacccgatgtacaccttcgcccatccgatcgaggacgcgatcgaaggcatcacgcattcgctgtgcacgctcgagttcgaggaccagcgcccgttctacgactggctgctcgacgcgctcgcgaccggcggtttcttcccccggccgctgccgcagcagatcgagttcgcacggctgaacctcacctacgtcgtgctctcgaagcgcaagctgattcagctcgtcgacgagcaccatgtcgacggctgggacgacccgcgcctgccgacgctcgtcggcgcgcgccgccgcggcttcacggcggcaggcttccgcctcttcgccgagcgcatcggcgtgacgaagtccgacacgtggatcgacgtcagcgtgctcgaggaatgcatgcgcgaggacctcaacgatgctgccgagcggcgcgtggcagtgctcgatccgttgaagctcgtcatcacgaactacccggaagggcacagcgagcagtgcgaggcgccgaaccatccgctcaaacccgaactgggcaagcggccgatgccgttctcgggcgaactgtggatcgagcgcgaggacttcatggaaacgccggccaaaggcttccgccgcctctaccccggcaacatggcgcggctgcgttacggctacgtcgtcaaatgcaccggctgcgagaaggatgccgacggcaacatcaccgcagtgctgtgcgagtatctgcccgacacgaagtccggcacgccgggcgccgacagcgtcaaggtcaagggcaacctgcactgggtatccgtcgcgcacgcgtacgaagcccaggtgcggctctacgaccgactgttcgcccatccctaccccggcaaccggcgcgaaggcgatccggaggatttcgagcgcagctacatcgacgacctcaacgacacgtcgaagctgacgatccacgcgcagctcgaaccggcgctcgcgaacgcccggccggaagaccatttccagttcgagcgccacggctacttcgtcgccgaccgcatcgattcgaccgccggagcaccggtcttcaaccgcaccgtgacgctgaaggactcgtggagcaaggccaaaggataa

SEQ ID NO: 90970 - protein, 577 aa, Azoarcus sp. EbN1
MNPNTPKDGAASTPSNFIRNLIDEDNRSGKWDGRVETRFPPEPNGYLHYGHAKSICLNFGLAQSYGGACHLRFDDTNPEKEEQEYVDSIIEAVRWLGFNWGEHLYFASDYFDRMYACAEYLITSGRAYVESLSAEEMRAYRGTLTEAGRESPYRSRSVEENLDLFRRMRAGEFTDGQHILRAKVDMASPNLNLRDPAIYRIRRATHHRTGDAWCIYPMYTFAHPIEDAIEGITHSLCTLEFEDQRPFYDWLLDALATGGFFPRPLPQQIEFARLNLTYVVLSKRKLIQLVDEHHVDGWDDPRLPTLVGARRRGFTAAGFRLFAERIGVTKSDTWIDVSVLEECMREDLNDAAERRVAVLDPLKLVITNYPEGHSEQCEAPNHPLKPELGKRPMPFSGELWIEREDFMETPAKGFRRLYPGNMARLRYGYVVKCTGCEKDADGNITAVLCEYLPDTKSGTPGADSVKVKGNLHWVSVAHAYEAQVRLYDRLFAHPYPGNRREGDPEDFERSYIDDLNDTSKLTIHAQLEPALANARPEDHFQFERHGYFVADRIDSTAGAPVFNRTVTLKDSWSKAKG

SEQ ID NO: 90971 - DNA, 1647 bp, Francisella tularensis subsp. tularensis Schu 4
  CDS (1)..(1647): transl_table=11
atgactagtgaaattaaagtaaataaaactaattttataaaaaatatcattaagaaagacctcgaaacaaacaaagtctcaagtattttgacgcgttttcctcctgagcctaatggttatcttcatattggccatgcaaaatcaatatgtcttaattttggtattgcacaagaatttgatggtaagtgtaatctacgctttgatgatactaatcctgataaagaagacattgagtatataaacgcaatccaagaagatgtcgagtggcttggttttaaatgggaaaatcaaccacgttttgcctctgaatattttgataagatgtatgagctagctatattgcttataaaaaaaggcaaagcttatgtctgcgatttgtcagcagaagaaatacgcgcgtaccgtggcacgctaaaagagccaggaaaaaatagtccatacagagaacgcagtatcactgaaaaccttgaattatttgaagagatgaaaaatggtaaatttgctgaaggtagtaaaactttgagagcaaaaattgatatgtcttctggtaatatcaaccttagagatcctgccttatacagaataaaattctcacaccaccctaaaactggtgacaaatggtgtatttatccgatgtatacatttgctcatccacttgaggatgcaatcgaagaaataactcattcgttatgtactttggaattccaagatcaaagaccattctatgactgggttattgaggaaacagaatttagtataaaaccacagcaaattgaattttcaagacttaatcttaattacacaattacaagtaagcgaaaactaaaatatttggttgataataaacttgtcaatggctgggatgacccacgtatgccgactataaaaggctatcgccgtagaggttatacccctgagtctatacgcaatttctgtgagatgataggaatatctaaacaagattctgttattgacgtatcggttttagaagatgctgtaagagatgatttaaacaaaagtgtcttaagaaaaaacgttgtcctagatccaataagagtaagcataaaagatatgccaaatcatcatttagatgtaccaaaccacccacaagatccagaatttggacgccgcgagatcacaatatcttcacaaatattcattgaaagagatgactttgtcttcaagctagaaaaagatatgaaaaaacttagtcctaatggtagagtgcgtttactaaatggctatgtaattgagtgtcaagaagtaattactgatactagtggcgaagtcatagaactaaaatgctcttatctaccagaaactttaggtggtaaaaaaccaaatgatggtatcaagcctaatggcattatccattgggttgatgctaataattgccttgatgctgaagttaggatttatgatcgcttatttaatgatgaaaatccagcaaatgctgatcgaattgaagatgttttaaatccagactcattacaagttatcaaaaatgccaaagttgaaagatctcttgaaagtgtcaaagctgaagaacgctttcagtttaacagagttggttattttattgctgacttaaaagattgctctaacgacacattagtatttaatcatattgcaactcttagaaactga

SEQ ID NO: 90972 - protein, 548 aa, Francisella tularensis subsp. tularensis Schu 4
MTSEIKVNKTNFIKNIIKKDLETNKVSSILTRFPPEPNGYLHIGHAKSICLNFGIAQEFDGKCNLRFDDTNPDKEDIEYINAIQEDVEWLGFKWENQPRFASEYFDKMYELAILLIKKGKAYVCDLSAEEIRAYRGTLKEPGKNSPYRERSITENLELFEEMKNGKFAEGSKTLRAKIDMSSGNINLRDPALYRIKFSHHPKTGDKWCIYPMYTFAHPLEDAIEEITHSLCTLEFQDQRPFYDWVIEETEFSIKPQQIEFSRLNLNYTITSKRKLKYLVDNKLVNGWDDPRMPTIKGYRRRGYTPESIRNFCEMIGISKQDSVIDVSVLEDAVRDDLNKSVLRKNVVLDPIRVSIKDMPNHHLDVPNHPQDPEFGRREITISSQIFIERDDFVFKLEKDMKKLSPNGRVRLLNGYVIECQEVITDTSGEVIELKCSYLPETLGGKKPNDGIKPNGIIHWVDANNCLDAEVRIYDRLFNDENPANADRIEDVLNPDSLQVIKNAKVERSLESVKAEERFQFNRVGYFIADLKDCSNDTLVFNHIATLRN

SEQ ID NO: 90973 - DNA, 1722 bp, Thermococcus kodakaraensis KOD1
  CDS (1)..(1722): transl_table=11
atggaggaaattagggagcttgtcctgaagtacgcgctcatcaacgcctacacgcacaggggaaaggcaaacccgaaggcggtcatcggcaaagtcctcggtgagaacccagagcttagaaagagggcaaaggagataattccccttgtgaacgaggtcgttaatgaagtgaactccctctcacttgaggagcaggaggcaaagcttagagaaatctatccagagttctttgaagagaagaatgagaaaaaagaggaaaagaagggtcttcccccgctcccgaaggccgagaggggtaaggtcgttacccgctttgccccgaaccccgacggtgctttccacctcgggaacgctagggcagcgatccttagccatgagtacgccaggatgtacgacggcaagttcattctccgcttcgatgacacagaccccaaggtcaagaggcctgagccgatattctacgagtggataaaggaggacctcgaatggctcggcttcaggatagatgagatccacatagcgagcgacaggcttgaaatctactacgactacgctgagaagctcataaagatgggcaaggcctacgtctgcacctgcccgcccgagaagttccgcgagctcagggataaggggatagcctgcccccacagggaggagccagttgaagtccagctcgaacgctggaggaagatgctcaacggcgaatacagagagggcgaggcggtggtgaggataaagaccgacctcaaccacccgaatcctgccgtaagggactggccagccctcagaataatagacaacccgaaccatccgaggactggaaacaagtaccgcgtctggccgctctacaacttcgcctctgccattgacgaccacgagcttggggtcacccacatcttccgcggacaggagcatgcagagaacgagacgaggcagaggtatgtctatgagtattttggctgggagtatcccgttaccgtccaccacggaaggctttcaatcgagggcgtgatcctcagcaaatccaagacgagaaagggaatcgaagaaggcaagtacctcggctgggacgacccgcgccttggaacaataagggcccttagacggcgcggcataaaacctgaagccataagggagctcatcatagaggtcggcctcaagaggagcgacaccactataagctgggacaacctcgcggcgataaacaggaagataatcgagccgatagccaatcgctacttcttcgttgccgatccgattccgatgtacgttgaaggtgctcaggagttcacggctgagatacccctccatccagattacccggagaggggagttaggaggctcaagtttgagccagataagccggtctacgtctcaaaggacgacatggagctgttcaagcctggaaacttcgtccgcctcaaggatctcttcaacgttgaaatcatggaagtgaacgagaacggcattagggccaggttccacagctttgaatacgaagtcgcgagggagaaccgctggaggatggttcactgggtcacggaaggaaaggcctgtgaggtttgggttcccgagggagacgagctgatcatcagggaggggcttcttgagagcgacgcggacgttaaggtggacgacatcgtccagttcgagcgcttcggcttcgttagaatcgacgacgtcaggccagagaaagttgttgcgatttttgcccacaagtga

SEQ ID NO: 90974 - protein, 573 aa, Thermococcus kodakaraensis KOD1
MEEIRELVLKYALINAYTHRGKANPKAVIGKVLGENPELRKRAKEIIPLVNEVVNEVNSLSLEEQEAKLREIYPEFFEEKNEKKEEKKGLPPLPKAERGKVVTRFAPNPDGAFHLGNARAAILSHEYARMYDGKFILRFDDTDPKVKRPEPIFYEWIKEDLEWLGFRIDEIHIASDRLEIYYDYAEKLIKMGKAYVCTCPPEKFRELRDKGIACPHREEPVEVQLERWRKMLNGEYREGEAVVRIKTDLNHPNPAVRDWPALRIIDNPNHPRTGNKYRVWPLYNFASAIDDHELGVTHIFRGQEHAENETRQRYVYEYFGWEYPVTVHHGRLSIEGVILSKSKTRKGIEEGKYLGWDDPRLGTIRALRRRGIKPEAIRELIIEVGLKRSDTTISWDNLAAINRKIIEPIANRYFFVADPIPMYVEGAQEFTAEIPLHPDYPERGVRRLKFEPDKPVYVSKDDMELFKPGNFVRLKDLFNVEIMEVNENGIRARFHSFEYEVARENRWRMVHWVTEGKACEVWVPEGDELIIREGLLESDADVKVDDIVQFERFGFVRIDDVRPEKVVAIFAHK

SEQ ID NO: 90975 - DNA, 1659 bp, Vibrio fischeri ES114
  CDS (1)..(1659): transl_table=11
atgagtgaaactgaaactcgtcctaccaactttatccgtcaaattattgatgaagatttaaagtctggtaaacattccagtgtccatactcgtttcccgccagagccaaatggctatctgcatatcggacacgcaaaatctatctgtttgaattttggtattgctcaagattatcagggtcagtgtaatcttcgttttgacgatacaaaccctgagaaagaagacatcgaatacgttgagtctattaagaatgacgttaactggttaggttttcagtggagtggagatattcaatattcttcaaactactttgataagctatatggttatgctgttgaattaattgaaaaaggattagcgtatgttgatgagctaactcctgagcaaatgcgtgaataccgtggttctctaaaagagccaggtaaaaacagcccgtaccgtgatcgtagcgtagaagaaaacctagcgttatttgaacaaatgcgtgatggtaaatttaaagaaggcacaatttgcttacgagctaaaattgatatggcttcttcattcatcgtacttcgtgatcctgttatttatcgtgtacgttttgctactcaccatcaaactggtgataagtggtgcatttacccaatgtacgacttcacacactgtatttctgatgcgttagaaggcattacgcactctatttgtacgcttgaattccaagacaaccgtcgtttatacgattgggtactagagaacatcacaattgattgccaaccgcgtcaatatgaatttagccgtctaaatcttgaatatacggtaatgtctaagcgtaagctgaaccaactagtgactgagaaattagtaaatggttgggatgacccacgtatgcctactgtttctggtttacgtcgtcgtggctttacttctgcatcaattcgcgagttctgtaagcgtatcggtgtaacgaaacaagaaaacatgattgaattcagctctcttgagtcttgtattcgcgatgatttaaacgaatcagcacctcgtgcaatggctgttcttgagccagtgaaacttgtgattgaaaactacgaagaaggtaaggttgagacgctaaatattgctaaccatccaaataaacctgaaatgggcactcgtgaagtaccatttactcgtgaagtttatattgaacaagatgatttccgcgaagaagcgaacaaaaaatacaagcgtttagtgctaggtaaagaagttcgtttacgtggtgcttacgttattcaagctaaccgtattgaaaaagacgaagcaggtaatatcacaacgattttctgtagttacgatgaagatacgttaggtaaaaaccctgcagatggtcgtaaagttaaaggtgttattcactgggtttctgctgataaagcattaccagctgaaattcgtttatacgatcgtttatttactgtaccaaacccaggtgctgcggatgattttgctgcaacaatcaaccctgagtctttagtggttaaaaatggttttgttgaacctagtttagcaacagcagaagctgaagttggttatcagtttgagcgtacaggttacttctgtgcagataacaaagactcaagtgctgatgcattagtctttaaccgtactgtaggtttacgtgatacttgggctggttaa

SEQ ID NO: 90976 - protein, 552 aa, Vibrio fischeri ES114
MSETETRPTNFIRQIIDEDLKSGKHSSVHTRFPPEPNGYLHIGHAKSICLNFGIAQDYQGQCNLRFDDTNPEKEDIEYVESIKNDVNWLGFQWSGDIQYSSNYFDKLYGYAVELIEKGLAYVDELTPEQMREYRGSLKEPGKNSPYRDRSVEENLALFEQMRDGKFKEGTICLRAKIDMASSFIVLRDPVIYRVRFATHHQTGDKWCIYPMYDFTHCISDALEGITHSICTLEFQDNRRLYDWVLENITIDCQPRQYEFSRLNLEYTVMSKRKLNQLVTEKLVNGWDDPRMPTVSGLRRRGFTSASIREFCKRIGVTKQENMIEFSSLESCIRDDLNESAPRAMAVLEPVKLVIENYEEGKVETLNIANHPNKPEMGTREVPFTREVYIEQDDFREEANKKYKRLVLGKEVRLRGAYVIQANRIEKDEAGNITTIFCSYDEDTLGKNPADGRKVKGVIHWVSADKALPAEIRLYDRLFTVPNPGAADDFAATINPESLVVKNGFVEPSLATAEAEVGYQFERTGYFCADNKDSSADALVFNRTVGLRDTWAG

SEQ ID NO: 90977 - DNA, 1722 bp, Neisseria gonorrhoeae FA 1090
  CDS (1)..(1722): transl_table=11
atgccgtctgaagccatctgtttaaagaaaaccatgctcaataaagaccaattcgcggacaaccatttcatccgcaccatcatcgaagacgacctcaaaagcggcaaacacgaagccgtccaaacccgttttccgcccgaacccaacggctatttacatatcggacacgccaaatccatctgcctgaacttcggtttggcgtatatttacgacggtttgtgcaacctgcgtttcgacgacaccaaccccgaaaaagaaaacgacgaatacgtcaacgccatcaaagaagatgtcgagtggctcggtttccattgggcgggcgagccgcgtttcgcttccgactatttcgaccggctttatgactacgccgtcggtttaatcaaagacggcaaagcgtatgtcgatgatttgacgcccgaagaaatgcgagaataccgcggtacgctgaccgaagcgggtaaaaacagcccttaccgcgaccgcagtatcgaagaaaacctcgacctgttcacgcgtatgaaaaacggcgagttccccgacggcagcaaaaccctgcgcctgaaaatcgacatggcggcaggcaacatcaatatgcgcgatcccgtcatctaccgcatccgccgcgcccatcaccataacaccggcgacaaatggtgcatctacccgatgtacgattacacgcattgcatttccgatgccatcgaaggcatcacgcattccttgtgcacgctcgaatttgaagcgcaccgtccgctttacgactgggtgttggacaacatccccgcgctgcacgccacccgtccgcgccaatacgagttttcccgtttggagcttttgtacaccattacctccaaacggaaattgaatcagttggttgtggaaaaacacgtttccggctgggatgatccgcgtatgccgaccatttccggtatgcgccgccgcggctacacgcccgaaggggtgcgcctgtttgccaaacgcgccggtatttccaaatctgaaaacatcgtcgacatgagcgtgttggagggtgcgattcgcgaagagctggaaaactccgccccgcgcctgatggcggttttgaacccgctcaaagtgaccctgaccaactttcaagccggcaaaacccaaagccgccgtgccgcgttccatccgaaccacgaagaaatgggcgatcgcgaagtacctgtttcacaaaccatctacatcgaagccgacgactttgccgaaaatccgcccaaaggcttcaagcgtctgattcccggcggcgaagtacgcttgcgccacggctatgtcatcaagtgcggtgaagtcgtcaaagacgaagcaggcaatgtggttgaactcaaatgcagcatcgaccacgacaccttgggcaaaaatccagaaggccgcaaagttaaaggcgtgattcactgggtttccgccgaacacgccgccgaaatcaaagtccgtctgtacgaccgcctctttaccgtcgagcgtcccggtgccgtgcgcggcgaagacggcgaatacctgccgtttaccgatttcctcaatccggaatccgttaaggaaatcactgcttacgccgaacctgccgcgaaagatttgccggcggaaagccgttggcagttcgagcgtatcggctattttgtgaccgaccgccaagaccacggcaaagacacgccggtgtttaaccgcacggtgacgttgaaagattcttggcagcctaagtaa

SEQ ID NO: 90978 - protein, 573 aa, Neisseria gonorrhoeae FA 1090
MPSEAICLKKTMLNKDQFADNHFIRTIIEDDLKSGKHEAVQTRFPPEPNGYLHIGHAKSICLNFGLAYIYDGLCNLRFDDTNPEKENDEYVNAIKEDVEWLGFHWAGEPRFASDYFDRLYDYAVGLIKDGKAYVDDLTPEEMREYRGTLTEAGKNSPYRDRSIEENLDLFTRMKNGEFPDGSKTLRLKIDMAAGNINMRDPVIYRIRRAHHHNTGDKWCIYPMYDYTHCISDAIEGITHSLCTLEFEAHRPLYDWVLDNIPALHATRPRQYEFSRLELLYTITSKRKLNQLVVEKHVSGWDDPRMPTISGMRRRGYTPEGVRLFAKRAGISKSENIVDMSVLEGAIREELENSAPRLMAVLNPLKVTLTNFQAGKTQSRRAAFHPNHEEMGDREVPVSQTIYIEADDFAENPPKGFKRLIPGGEVRLRHGYVIKCGEVVKDEAGNVVELKCSIDHDTLGKNPEGRKVKGVIHWVSAEHAAEIKVRLYDRLFTVERPGAVRGEDGEYLPFTDFLNPESVKEITAYAEPAAKDLPAESRWQFERIGYFVTDRQDHGKDTPVFNRTVTLKDSWQPK

SEQ ID NO: 90979 - DNA, 1743 bp, Xylella fastidiosa Dixon
  CDS (1)..(1743)
atgtccgagatcaccaccaccgacgcccaagcccaacctgagaagaaagactttatccggcagatcatcagagaagacttagcccacggcacacacactcacatccacacccgtttccccccagaacccaacgggtacctgcacattggccacgccaaagcaatctgcctggattttggcgtcgccgcggaattcggcggacactgcaccctccgcatggacgacaccaatccgagcaaagaagaccccgccttcgccgctgcaatccaggaagacgtctcttggctaggcttccattggaacgcactacgacatacatcggattatttcgaagtgctgtacctagccgcagaaaaactcattgccgatgggaaagcctacgtctgtgacctcaatagcgaacaggtacgcgaataccgcggcaccctgacagaagcgggccgtccctcaccatggcgtgaacgcagccctgatgaaaatttagaactattccgacaaatgcgcgccggcacgtttccagacggaacacgtaccctgcgtgccaaaatcgacatggctagcggcaacatcaacctgcgggacccagcgctctaccgcattaaacacgtcgaacatcaaaacaccggcaacacctggccgatctaccccatgtatgacttcgcacacgcactgagcgatgcgatcgaaggcattacccattcattgtgcaccctcgagttcgaagaccaccgccccctgtacgactggtgtatcaaccatgtcgacctaccaaacaactcacacctactcaaaccgttactggacaaaggcttccctcaagagcccagccaacctcggcaaatcgagttttcgcgcctgaacatcaactacaccgtgatgagcaaacgcaagctcaccgcactggtagacgaaaaactcgtcgaagggtgggacgacccccgcatgtacaccctgcaaggcctacgccgccgtggttacaccccagcggcgatgcgcctattcgtagagcggatcggcatcagcaaacagaactcaatcattgatttttcagtactagaaaactgcttacgcgagaacctggacaccattgcaccacgccggatggcaaccattgcaccaatgaagctcgtgctgaccaacctacccgaagaccatgaagaacaactgatcttccccaaccatcccaaagacgacacacaaggcacccgaacagtgccgttctcacgcgaactatggatcgaacgcgatgatttttccgaagtcccccccaagggctggaaacggctggttccaggcggagaagtacgcctacgcggtgccggcatcgcacgtatagatgaggtggtgaaaaacgcagaaggccacatcatcgcactacacggctggcttgatccgacctcacgtcccggcatggaaggcgctcaccgcaaagtcaaaggcaccatccactgggtcagcgcaccacacgctgtagcagcggaaatccgcctgtacgaccggctgttctccattgaaaaacccgacgacaacaccgacggaaaaacctaccgcgacttcctcaacccagactccaaacgcgtcgtgcatggctacatcgaaccagcggcagcacaaaccgcaccagaacacgcattccaatttgaacgcttgggctacttcgtcacagaccggcatgaccacgatgccacacaccccgtctttaatcgcagcgtcacgctgcgcgacacctggcagcgcgactga

SEQ ID NO: 90980 - protein, 580 aa, Xylella fastidiosa Dixon
MSEITTTDAQAQPEKKDFIRQIIREDLAHGTHTHIHTRFPPEPNGYLHIGHAKAICLDFGVAAEFGGHCTLRMDDTNPSKEDPAFAAAIQEDVSWLGFHWNALRHTSDYFEVLYLAAEKLIADGKAYVCDLNSEQVREYRGTLTEAGRPSPWRERSPDENLELFRQMRAGTFPDGTRTLRAKIDMASGNINLRDPALYRIKHVEHQNTGNTWPIYPMYDFAHALSDAIEGITHSLCTLEFEDHRPLYDWCINHVDLPNNSHLLKPLLDKGFPQEPSQPRQIEFSRLNINYTVMSKRKLTALVDEKLVEGWDDPRMYTLQGLRRRGYTPAAMRLFVERIGISKQNSIIDFSVLENCLRENLDTIAPRRMATIAPMKLVLTNLPEDHEEQLIFPNHPKDDTQGTRTVPFSRELWIERDDFSEVPPKGWKRLVPGGEVRLRGAGIARIDEVVKNAEGHIIALHGWLDPTSRPGMEGAHRKVKGTIHWVSAPHAVAAEIRLYDRLFSIEKPDDNTDGKTYRDFLNPDSKRVVHGYIEPAAAQTAPEHAFQFERLGYFVTDRHDHDATHPVFNRSVTLRDTWQRD

SEQ ID NO: 90981 - DNA, 1668 bp, Azotobacter vinelandii
  CDS (1)..(1668)
atgagcaagcccgagactcccgccgccgcgaacttcctccgcccgatcgtccaggccgacctggagtcgggcaagcacgccaagatcgtcacccgcttcccgccggagcccaacggctacctgcatatcggccatgccaagtcgatatgcctgaacttcggcctggcccaggagttcggtggcgagtgcaacctgcgcttcgacgacaccaacccggccaaggaagaccaggagtacatcgatgcgatcaagagtgacgtccgctggctgggtttccagtgggcgggcgaggagcgctacgcctccagctatttcgatcagctctacgactgggcgattcatctgatcgaggccggcaaggcctacgtctgcgatctgtcgccggacgaggcgcgcgagtatcgtggcagcctgaccgagccgggcaggaacagtccctaccgggagcgctcggtggaagagaacctcgacctgttcgcgcgcatgagggctggcgagttcccggatggcgcccgcgccctgcgggcgaagatcgacatggccgccccgaacatgaacctgcgcgacccgatcctctatcgtatccgccacgcccatcaccaccagaccggcgacaagtggtgcatctacccgagctacgatttcacccacggccagtcggatgccatcgagggtatcactcactcgatctgcaccctggagttcgaggatcaccgtccgctctacgagtggttcctggataacctgcctgtgccgtgccggccgcgccagtacgagttcgcccgcctcaatctgaattacaccatcaccagcaagcgcaagctcaagcaactggtcgacgaggggcatgtcggcggctgggacgacccgcgcatgtcgactttgtccggttatcgccgccgcggttacacaccggcttcgatccgcgccttctgcgacatgatcggtgtcaaccgcgctggcggcgtggtcgatatcggcatgctggagttcgccatccgcgaggatctggacgccaacgccgcgcgtgccatgtgcgtgcttaagccgctgaaagtggtgatcaccaattatccgcaagggcgggtcgagagcctcgagttgccgcgccatcccaagcaggacatgggtgtgcgcgtgcttccgttctcccgcgagatctacatcgatgccggcgatttcgaggaaacccctccggccggctacaagcgcctgattcccggtggcgaggtgcgcctgcgcggcagctacgtgatccgcgccgacgaggcgatcaaggacgaagccggcaacatcgtcgagctacgttgttcctatgacgagaacactctcggcaagaacccggaaggccgcaaggtcaagggagtgattcactgggtgccgcttgagggcagcattaaatgcgaggtgcgcctgtacgatcgtctgttcaaggtcgccaatccggagaagagcgaagagggcggcagttttctcgataacatcaattccggctccctggtggtgctcacgggctgccgcgccgagccgtcgctggccaatgcgcgcccggaggagcgcttccagttcgagcgcgaaggctatttctgcgccgatctgaaggactccaggccgggcgctccggtgttcaaccgtaccgtcaccctgcgcgactcctgggggcagtga

SEQ ID NO: 90982 - protein, 555 aa, Azotobacter vinelandii
MSKPETPAAANFLRPIVQADLESGKHAKIVTRFPPEPNGYLHIGHAKSICLNFGLAQEFGGECNLRFDDTNPAKEDQEYIDAIKSDVRWLGFQWAGEERYASSYFDQLYDWAIHLIEAGKAYVCDLSPDEAREYRGSLTEPGRNSPYRERSVEENLDLFARMRAGEFPDGARALRAKIDMAAPNMNLRDPILYRIRHAHHHQTGDKWCIYPSYDFTHGQSDAIEGITHSICTLEFEDHRPLYEWFLDNLPVPCRPRQYEFARLNLNYTITSKRKLKQLVDEGHVGGWDDPRMSTLSGYRRRGYTPASIRAFCDMIGVNRAGGVVDIGMLEFAIREDLDANAARAMCVLKPLKVVITNYPQGRVESLELPRHPKQDMGVRVLPFSREIYIDAGDFEETPPAGYKRLIPGGEVRLRGSYVIRADEAIKDEAGNIVELRCSYDENTLGKNPEGRKVKGVIHWVPLEGSIKCEVRLYDRLFKVANPEKSEEGGSFLDNINSGSLVVLTGCRAEPSLANARPEERFQFEREGYFCADLKDSRPGAPVFNRTVTLRDSWGQ

SEQ ID NO: 90983 - DNA, 1623 bp, Desulfitobacterium hafniense DCB-2
  CDS (1)..(1623): n means a or g or c or t/u
atggataacgagaataaatcctctaattttttacgcagcattatccttgaggatttacgggagggaaaggtagaagaaatcacgacacggtttccccccgagcccaatggttacctgcatattgggcatgctaaatccatctgtttgaactttggtttggccgacgaattcaaaggaaaaaccaatttgcggtttgatgatacgaatccggtcaaagaagatactgaatatgtagaatccatcaaagaagatgtcaagtggttggggtttgactgggacaacctctttttcgcttccgattattttgcggagatgcataagcgagccgttctgctgatcgaaaagggcaaagcgtatgtttgtgatttatccgctgaggagattagaaaaagccgcggcaccctgactgaggccggtaaggaaagcccttaccgcaaccgcagcgtggccgagaacctggagctctttgagagaatgcgtcaaggtgaatttaaggacggagaaaaggttctccgggctaagatcgatatgggctcacctaacatcaatatgcgggatcctgtcctttatcggattgcccatgccacccaccataatacaggggacacatggtgcatctaccccatgtatgattatgcccatcctttagaggatgctatcgaagggataactcactctatctgtactttagaatttgaagatcaccgtcccctctatgattgggtcgttcgggaatgtgagatggaacatgtcccacatcaatatgaatttgcccgcttaaatatgaccaatacggtgatgagcaagcgcaagctgaagcagctggtggacgaaaaagtggtggatggttgggatgatcccagaatgcccaccatctccgggctgcgccgccggggatatacccctgaagccatccgcaattttgcccaagccattggtgtggccagagcggacagtgtggtggattccaaaatgctggagcactttattcgggaagatctgaagctcaaagtgtcccggcccatggcggtcatccgtcccttgaaggtggtcattaccaattacccggaaggccaagtggaaaggctggatgccgatcacaataaagagaaccctgagatggggaaacgcaagattcctttttccagggagatttacatcgagcaggaagatttcatggaggtcccgccgccgaagtaccaccgcctttacccgggcaatgaagttcgtttgatggatgcctactttattaagtgtgaagaggtcatcaaggatgatgagggcaagatcatcgagattcgttgcacctatgatccggaaacaaaaagcggcacaggatttaccggccgcaaggtcaaggggacgattcattgggtggaagccactcaggcagtgccggcagagtttcgcctctatgagccgttaattcaggatgattatatcaatcccaattctctggaaataaggcaagggtttgtggaaccttatatgaaagaggccaaaccncaggataaattccagtttccccgtcacggctactttaatgtagatccgaactataccaccccggaaagcttagtgttgaatttaattgtttccttaaaaagctctttcgttatataa

SEQ ID NO: 90984 - protein, 540 aa, Desulfitobacterium hafniense DCB-2
MDNENKSSNFLRSIILEDLREGKVEEITTRFPPEPNGYLHIGHAKSICLNFGLADEFKGKTNLRFDDTNPVKEDTEYVESIKEDVKWLGFDWDNLFFASDYFAEMHKRAVLLIEKGKAYVCDLSAEEIRKSRGTLTEAGKESPYRNRSVAENLELFERMRQGEFKDGEKVLRAKIDMGSPNINMRDPVLYRIAHATHHNTGDTWCIYPMYDYAHPLEDAIEGITHSICTLEFEDHRPLYDWVVRECEMEHVPHQYEFARLNMTNTVMSKRKLKQLVDEKVVDGWDDPRMPTISGLRRRGYTPEAIRNFAQAIGVARADSVVDSKMLEHFIREDLKLKVSRPMAVIRPLKVVITNYPEGQVERLDADHNKENPEMGKRKIPFSREIYIEQEDFMEVPPPKYHRLYPGNEVRLMDAYFIKCEEVIKDDEGKIIEIRCTYDPETKSGTGFTGRKVKGTIHWVEATQAVPAEFRLYEPLIQDDYINPNSLEIRQGFVEPYMKEAKPQDKFQFPRHGYFNVDPNYTTPESLVLNLIVSLKSSFVI

SEQ ID NO: 90985 - DNA, 1686 bp, Pseudomonas aeruginosa UCBPP-PA14
  CDS (1)..(1686)
atgaccaaggatcccatgagcaagccagagaccaccgccgccccgaacttcctgcgccagatcgttcaagccgacctggatgccggcaagcacgcgaagatcgtcacccgtttccccccggagcccaacggttacctgcacatcggccacgccaagtcgatctgcctgaacttcggcctggcccaggaattcgctggcgattgccatctgcgcttcgatgacaccaacccggccaaggaagaccaggagtacatcgatgccatcgaggccgacatcaagtggctgggcttccagtggtccggcgaggtctgctatgcctccaactatttcgaccagctgcatgcctgggccatcgagctgatcaaggccggcaaggcgttcgtctgcgacctcggtcccgaggaaatgcgcgaataccgcggcaccctcaccgagccgggccgcaacagcccttaccgtgaccgttcggtggaggagaacctcgacctgttcgcccgcatgaaggccggtgagttccccgacggcgcccgttcgctgcgggcgaagatcgacatgggttcgccgaacatgaacctgcgcgacccgatcctgtaccgcatccgccatgcgcatcaccaccagaccggcgacaagtggtgcatctacccgagctacgacttcacccacggtcagtcggacgccatcgagggcatcacccattcgatctgcaccctggaattcgaagaccatcgtccgctctacgagtggttcctggccaacctgccggtgcctgcgcaaccgcgccagtacgaattctcccggctcaacctgaactacaccgtgaccagcaagcgcaagctcaagcaactggtcgacgaaggccatgtcagcggctgggacgatccgcgcatgtcgaccctgtccggctatcgccgccgcggctacaccccggagtcgatccgcaacttctgcgagatgatcggggtgaaccgcgccagcggcgtggtcgacatcggcatgctcgagttcagcatccgcgaccacctggacgccaccgcgccgcgtgccatgtgcgtgctgaaaccgctcaaggtggtgatcaccaactaccccgaagggcaggtggagaacctcgagttgccgcgtcatccgaaggaagacatgggggtgcgcgtactgccgttcggtcgcgagctgttcatcgatgccggtgacttcgaggaagtcccgccggccggctacaagcgcctgatccccggtggcgaggtgcgtctgcgtggcagctacgtgatccgtgccgacgaagcgatcaaggatgccgacggcaatatcgtcgaactgcgctgcagctacgatccggacaccctgggcaagaacccggaaggccgcaaggtcaagggcgtgatccactgggtgccggccgagggcagcgtcgagtgcgaagtgcgcctgtacgatcggctgttccgctcggccaatccggagaaggcggaagagggcggcagcttcctcgacaacatcaacgccgactccctgcaggtactgaccggctgtcgcgccgagccgtcgctgggccaggcgaacccggaggatcgcttccagttcgagcgcgaaggctatttcgtcgccgacctgaaggactccaggccgggcaagccggtgttcaaccgtaccgtcaccctgcgtgactcctggggacagggctga

SEQ ID NO: 90986 - protein, 561 aa, Pseudomonas aeruginosa UCBPP-PA14
MTKDPMSKPETTAAPNFLRQIVQADLDAGKHAKIVTRFPPEPNGYLHIGHAKSICLNFGLAQEFAGDCHLRFDDTNPAKEDQEYIDAIEADIKWLGFQWSGEVCYASNYFDQLHAWAIELIKAGKAFVCDLGPEEMREYRGTLTEPGRNSPYRDRSVEENLDLFARMKAGEFPDGARSLRAKIDMGSPNMNLRDPILYRIRHAHHHQTGDKWCIYPSYDFTHGQSDAIEGITHSICTLEFEDHRPLYEWFLANLPVPAQPRQYEFSRLNLNYTVTSKRKLKQLVDEGHVSGWDDPRMSTLSGYRRRGYTPESIRNFCEMIGVNRASGVVDIGMLEFSIRDHLDATAPRAMCVLKPLKVVITNYPEGQVENLELPRHPKEDMGVRVLPFGRELFIDAGDFEEVPPAGYKRLIPGGEVRLRGSYVIRADEAIKDADGNIVELRCSYDPDTLGKNPEGRKVKGVIHWVPAEGSVECEVRLYDRLFRSANPEKAEEGGSFLDNINADSLQVLTGCRAEPSLGQANPEDRFQFEREGYFVADLKDSRPGKPVFNRTVTLRDSWGQG

SEQ ID NO: 90987 - DNA, 1740 bp, Psychrobacter sp. 273-4
  CDS (1)..(1740)
atgagtgagcaatcaagcaaccatgcacaaaaagacgaacaaaaaaatgactttattcgtaatatcattcgtgatgatgttactgcgcaaaagtaccaacagattatcactcgtttcccacctgagccaaatggttacttacatttgggtcacgtaaaatctatttgcttaaactttggtgtggctgaggagtttggcggtgtctgtaacctgcgttttgatgacaccaaccctaccgcagaaaagcaagacttcattgataacatcgagaacgatgtaaaatggctaggctttgagtgggcaggagaagcgcatcatgcgtcaggctactttgaccagttgtatgcttgggcagtgcaattgattgagcaaggcgatgcgtacgtagacttgcagtcgcctgagcaaatcaaagaaaaccgtggctcatttaatgatgcaggcacagcgtcaccacatcgtgatgccagtgtcgaagaaaacctgcaactctttgatgatatgaaagagggcaaatatgctgaaggtaaagctgttttacgtgccaagattgatatggcaagcccaaatatgaacctgcgcgatcctgttgtttatcgcatcatgcatcaaacgcatcatcaaactggtgataaatggtgcatttatccgatgtatgattttgcccatccgctctctgatgcgctcgaaggcattactcattcattatgtacgctagaatttgaagaccatcgtccattttatgactgggtaatagaaaaggttggctttgagcaagcgccgcatcagtatgagtttagccgcctcaatgttgatcatacattaaccagtaagcgcaaattaaagcagctcgttgatgagaatatcgttagcagttgggacgatccacgcatgccgactattgcaggtatgcgtcgccgtggttatacgccagaaggcttacgtgacttctgtgagcgtgttggtgtgaccaaagtggacagtgttgtagatttccgtctgttagaatttagcattcgtcagtcactagagacgacgactgcacgtggcatggcagtgctcaaaccattaaaagtgacgattactaactttgcggaagctgttagcagttgggagtcgcaaaaggctgatagcgttcaagctcgctttgacgatgcctcgcagactttatggctgactcagccaaaccatcctaatgtcgatatgggcgagcgagagattcctttcactgagaccatttatattgatcaaggcgattatgagattgagccgccagcgggctataagcgtctgtcaccagagaagaatgagattcgtctgcgtaatacctatgtattggcagtaactgagcatattactgatgatagcggcaatgtgattgagctaaaagcaacgattgatccagctactttaggtaacaaccctgaaggtcgcaaggtgaagggtgttattcattgggtatcagcgagccaaggtataccagcgacagtacgcatgtatgagcagttatttagtgttgaagacccaagtagcgttgctgacgtacatcaagcactaaacccaaactcgttgactgagctcaatgcagtggttgaaccatcattggtgaatgcagatgctggtacgcgcttccagtttgagcgtgaaggttactttatttctgatagcgaagatcatagcagtgataagccagtatttaaccaaatcgtgagcttacgtgatagttataaacccgcttaa

SEQ ID NO: 90988 - protein, 579 aa, Psychrobacter sp. 273-4
MSEQSSNHAQKDEQKNDFIRNIIRDDVTAQKYQQIITRFPPEPNGYLHLGHVKSICLNFGVAEEFGGVCNLRFDDTNPTAEKQDFIDNIENDVKWLGFEWAGEAHHASGYFDQLYAWAVQLIEQGDAYVDLQSPEQIKENRGSFNDAGTASPHRDASVEENLQLFDDMKEGKYAEGKAVLRAKIDMASPNMNLRDPVVYRIMHQTHHQTGDKWCIYPMYDFAHPLSDALEGITHSLCTLEFEDHRPFYDWVIEKVGFEQAPHQYEFSRLNVDHTLTSKRKLKQLVDENIVSSWDDPRMPTIAGMRRRGYTPEGLRDFCERVGVTKVDSVVDFRLLEFSIRQSLETTTARGMAVLKPLKVTITNFAEAVSSWESQKADSVQARFDDASQTLWLTQPNHPNVDMGEREIPFTETIYIDQGDYEIEPPAGYKRLSPEKNEIRLRNTYVLAVTEHITDDSGNVIELKATIDPATLGNNPEGRKVKGVIHWVSASQGIPATVRMYEQLFSVEDPSSVADVHQALNPNSLTELNAVVEPSLVNADAGTRFQFEREGYFISDSEDHSSDKPVFNQIVSLRDSYKPA

SEQ ID NO: 90989 - DNA, 1806 bp, Dechloromonas aromatica RCB
  CDS (1)..(1806)
atgagcagccccaaccagcccgccaacaccccggcccccgccgccaatttcatcaagaacatcgtcgaagccgacctcgccgccggcaagcacgcccagcgccactgggccggccatccgggtacggcggccgaccacgctgccgcccccctcgatccggccaaactgcgtacccgcttcccgcccgagccgaacggctacctgcatttcggccacgccaagtccattctgctcaatttcggccttgccgagcaatacggcggccgctgccacctgcgctttgacgacaccaaccccgagaaggaagatcaggagtacgtcgactcgatcgtcgatgcggtcaaatggctcggctgttcgtgggaaaaagacggcgaagccaacctttactacgcctcgaattacttcgactggatgttgcaatgcgccgaggcgctgatcgccgccggccacgcctatgtcgatagccagaacgccgaagaaatgcgcgccaaccgcggcacgctgacccagcccggcaagaattcgcctttccgcgaccgttccgtcgccgagaacatggatctgttcaagcgcatgcaggccggcgaatttgctgatggcgcccatatcctgcgcgccaggatcgacatggctgcgccgaacatcaacctgcgcgacccggccatctaccgcatccgccacgccacgcaccacaacactggcgacaagtactgcgtctatccgatgtacaccttcgcccatccgatcgaggatgcgctggagaacatcacccattcgatctgcacgctggaattcgaagaccagcgcccgttctacgactggctgctcgagcgcctggctgaagccggcctgttgcagcgcccgctgccgcagcagatcgagttctcgcgcctcaacctgacctacgtcgtgctctccaagcggaaactcattcagctggttgaggaaaaacacgttaccggctgggacgacccgcgtatgccgacgctggtcggcgcccgtcgtcgcggctattcggccgaaggcttccgcctgtttgccgaccgcatcggcgtttccaagaacgactcgctgatcgactacgtgctgttcgaagacgccatgcgcgaagtgatgaacgagtccgatctacgccgtatcgcggtactcgatccagtcaagctgatcatcgacaattacccggatggccaggtcgaagagtgcttcgcgccgaatcacccgctgcaccccgaacttggccagcgcagcatcccgttcagccgtgagttgtggatcgaaggtgaagacttcatggaagtgccgagcaagggcttccgccgcctgttccccggcaacatggcgcgcctccgttacggctacgtggtcgagtgcaccggctgcgacaaggatgaaaacggtaaggtcatcgccgtccattgcaactacctgccggaaaccaaatccggcacgccaggcgccgacagcgtcaaggttaagggcaatctgcactgggtctctgccgcccaatcctatcaagccgaaattcgcctctacgagcgcctgttcaaggtgcccgcccccggcgcccggcgcgaaggcgatgcgcccgatctggagcgcgatttcctcgacgacatgaatacggattccgccaagaccatcaccgcccagctcgaaccctgtctgcgcgatgccaagccggaagagcgcttccagttcgaacgacacggctactttgtggccgaccgcgttgactccaagcctggcgccccggtcttcaatcgggccgtcaccttgaaggattcgtggggcaaggcgagctaa

SEQ ID NO: 90990 - protein, 601 aa, Dechloromonas aromatica RCB
MSSPNQPANTPAPAANFIKNIVEADLAAGKHAQRHWAGHPGTAADHAAAPLDPAKLRTRFPPEPNGYLHFGHAKSILLNFGLAEQYGGRCHLRFDDTNPEKEDQEYVDSIVDAVKWLGCSWEKDGEANLYYASNYFDWMLQCAEALIAAGHAYVDSQNAEEMRANRGTLTQPGKNSPFRDRSVAENMDLFKRMQAGEFADGAHILRARIDMAAPNINLRDPAIYRIRHATHHNTGDKYCVYPMYTFAHPIEDALENITHSICTLEFEDQRPFYDWLLERLAEAGLLQRPLPQQIEFSRLNLTYVVLSKRKLIQLVEEKHVTGWDDPRMPTLVGARRRGYSAEGFRLFADRIGVSKNDSLIDYVLFEDAMREVMNESDLRRIAVLDPVKLIIDNYPDGQVEECFAPNHPLHPELGQRSIPFSRELWIEGEDFMEVPSKGFRRLFPGNMARLRYGYVVECTGCDKDENGKVIAVHCNYLPETKSGTPGADSVKVKGNLHWVSAAQSYQAEIRLYERLFKVPAPGARREGDAPDLERDFLDDMNTDSAKTITAQLEPCLRDAKPEERFQFERHGYFVADRVDSKPGAPVFNRAVTLKDSWGKAS

SEQ ID NO: 90991 - DNA, 1791 bp, Methylobacillus flagellatus KT
  CDS (1)..(1791)
atggttaccatgtctgaaaaaccccctgttgctccagcttccaatttcattcgcaatatcattgagcgcgaccttgaacaagggacttatgccagccgccgctgggcaggctcgcccggcgacgccgtgcatcaagccactggcgggccggatccggccaaaatccgcacccgttttccgccggaacccaatggttacctgcatattggtcatgccaagagcatttgtctcaatttcggcttggcacgagatttcggcggtgtgtgccatatgcgcttcgacgacaccaatccagaaaaggaagaacaggaatacgtcgacagtattaccgagtccgtgaagtggctgggctttgattgggaggcgtttggtacatcccatctctattttgccagcaactatttcgacttcatgtatcgggctgcggaatacctgatcgaatcgggtaatgcctatgtcgaccagcaatctgccgaagaaatgcgcattaaccggggcacgttgacggaacccggcaagaactccccctggcgtgaccgcccgatgcaggaaagcctaaccctgttccgcgaaatgcgcgacggtaagcatgcggacggcagcatggtgctgcgcgccaagatcgatatggcttcaccaaatatcaatttgcgcgatcctgcgatttaccgcatcaagcgcgcgcatcaccacaacactggcgacaaatggtgcatctacccgatgtatacctatgctcatccactggaagacgcctacgagggtgtcacccattccatctgtacgctggagttcgaggatcaacgccctttctacgattgggtgctggaaaagctggcggaaggcggcctgctcgctcacccgctgcccaaacagtatgaatttgcccgtctcaacctcacctacgtcgtgctttccaaacgcaagctgatcgaactggtggagaagcaattggtcaatggctgggatgacccccgcatgcctaccctggtcggagcgcgtcgtcgcggctatgcacctgaaggtttccgcctatttgctgaacgtatcggtgtttccaaggcagattcctggattgaatacactattctcgaggattgcatgcgcgaagtactcaatgcatcggcagaacgccgcattgccgtactcgacccggtcaagctcgtcattgacaattatccggaaggccaatccgaagattgccacgcccctaaccatccgcaaaagccggagctcggccatcgcgtcgtaccgctttcgcgcgaattatggatagagcgcgaagacttcatggaagagccggtcaaaggctatttccgcctatttccgggcaacatggtgcgcctgcgctatggctatgtcgtcaaatgcacaagctacgagaaggatgccgctggccatgttactgtcgtacattgtgaatacctgccagacaccaagtccggcacgccaggtgctgactcggtcaaggtcaaaggcaatatccactgggtttcagcggcgcatgcctatgctgccgaagtacgcctgtacgaccggctgttcaaggaggcccatccaggccaaggcaaacatgaggacggctcggatcgcgactacttggacgacatcaatccgaactcagtgaaaacgattacggcacagttggaacctgcattgaaggatgccaaaccggaagagcgcttccagtttgagcggcatggctatttcgtcgcggacagcaaggatagccagccaggcaagccggtgttcaaccgcaccgtgaccctgcgtgatgcctggcagaaataa

SEQ ID NO: 90992 - protein, 596 aa, Methylobacillus flagellatus KT
MVTMSEKPPVAPASNFIRNIIERDLEQGTYASRRWAGSPGDAVHQATGGPDPAKIRTRFPPEPNGYLHIGHAKSICLNFGLARDFGGVCHMRFDDTNPEKEEQEYVDSITESVKWLGFDWEAFGTSHLYFASNYFDFMYRAAEYLIESGNAYVDQQSAEEMRINRGTLTEPGKNSPWRDRPMQESLTLFREMRDGKHADGSMVLRAKIDMASPNINLRDPAIYRIKRAHHHNTGDKWCIYPMYTYAHPLEDAYEGVTHSICTLEFEDQRPFYDWVLEKLAEGGLLAHPLPKQYEFARLNLTYVVLSKRKLIELVEKQLVNGWDDPRMPTLVGARRRGYAPEGFRLFAERIGVSKADSWIEYTILEDCMREVLNASAERRIAVLDPVKLVIDNYPEGQSEDCHAPNHPQKPELGHRVVPLSRELWIEREDFMEEPVKGYFRLFPGNMVRLRYGYVVKCTSYEKDAAGHVTVVHCEYLPDTKSGTPGADSVKVKGNIHWVSAAHAYAAEVRLYDRLFKEAHPGQGKHEDGSDRDYLDDINPNSVKTITAQLEPALKDAKPEERFQFERHGYFVADSKDSQPGKPVFNRTVTLRDAWQK

SEQ ID NO: 90993 - DNA, 1830 bp, Ralstonia eutropha JMP134
  CDS (1)..(1830)
atgaaattggcaatccgccacgcaacactgaagaccaagcggtccatccagccgctagccggcgccaccatgagccacgacaacaagcctaccgacagcacgcccgcctcgcccgcagtctccaactttctgcggagcatcattgaccaggatctcgcagccggcacgtacgccggccgccaggacagccagggcgagccgctgccgaccgtcatcacccgctttccgccggagcccaacggctacttgcatatcggccatgccaagagcatctgcctgaacttcggcctcgcgcgcgactacggcggccgctgccacctgcgcttcgacgacaccaatccggtcaaggaagacaccgaatacgtcgactcgatcatcgacgcggtgcactggctcggcttttcctgggacagcaagaccccgggcggccagccgcacctgcattatgcgagcgactacttcgaccagctgtacgcatttgccgaaaagctgatcgagcgcggcgccgcctatgtcgacagccagagcgcggagcagatcgccgccaaccgtggcaatttctcggagccgggcaagccgtcgccattccgcgaccgcagcgtcgaggagaacctgcagctgttccgcgatatgcgcgacggcaagtacaaggacggcgagcacgtgctgcgcgcgaagatcgacatgaccgcgccgaacatcgtgatgcgcgatccagtgatctaccgtatccgccatgcccatcaccaccgtactggcgacaagtggtgcatctacccgatgtacgacttcacgcactgtatttcggatgcgatcgagaacatctcgcattcgctgtgcacgctcgagttcgagaacaatcgcccgctgtacgactgggtgctcgagcatctgcgcgacgctggcgtgttccgcgatccgctgccgcaccagtatgaattcgcgcgcctgaacctgacctacgcgatcaccagcaagcgcaagctcaagcaactggtggacgaacagcgcgtggacggctgggacgatccgcgcatgccgaccatcgtcggtatccgccgccgcggctacacgccggaatcgatccagctgttctgcgaccgcgtgggcgtggccaaggccgacagctggatcgacatgagcacgctcgaaggctccgtgcgcgacgacctggacgcgcgcgcagcgcgcggcgtggccgtgctcgacccgctcaagctgatcctcgacaactaccccgaaggccagaccgaggaatgctcggcgccggtgcatccgaagaagccggaattgggcaagcgcgtgttcccgatctcgcgcgagctgtggatcgagcgcgaggacttcaacgagaccccgccgaagggctatttccgcctgttcccgggcaacaaggtgcgcctgaagtacggctatgtgatcgagtgcaccggcgtggacaaggacgctgacggtaacgtcatcgccgtgcacgcaaactaccttcccgacaccaagagcggcacgccgggcgcggacagcgtcaaggtcaagggcgtgatccactgggtcagcgccgccgcggcctacgagtgcgaagtgcgcctgtacgaccgcttgttcaacgacccgaacccggatgccggcggcaagaacttcctcgaagcgctgaaccccgattcgaagaaggtaatcaccgcctatctggagccgagcctgcgtgacgcgaagccggaagaccgcttccagttcgagcgccatggctacttcgtcgccgaccgcaacgattcccagccgggcaagccggtattcaaccgcatcgtcgggttgaaagacagctggggcaagtga

SEQ ID NO: 90994 - protein, 609 aa, Ralstonia eutropha JMP134
MKLAIRHATLKTKRSIQPLAGATMSHDNKPTDSTPASPAVSNFLRSIIDQDLAAGTYAGRQDSQGEPLPTVITRFPPEPNGYLHIGHAKSICLNFGLARDYGGRCHLRFDDTNPVKEDTEYVDSIIDAVHWLGFSWDSKTPGGQPHLHYASDYFDQLYAFAEKLIERGAAYVDSQSAEQIAANRGNFSEPGKPSPFRDRSVEENLQLFRDMRDGKYKDGEHVLRAKIDMTAPNIVMRDPVIYRIRHAHHHRTGDKWCIYPMYDFTHCISDAIENISHSLCTLEFENNRPLYDWVLEHLRDAGVFRDPLPHQYEFARLNLTYAITSKRKLKQLVDEQRVDGWDDPRMPTIVGIRRRGYTPESIQLFCDRVGVAKADSWIDMSTLEGSVRDDLDARAARGVAVLDPLKLILDNYPEGQTEECSAPVHPKKPELGKRVFPISRELWIEREDFNETPPKGYFRLFPGNKVRLKYGYVIECTGVDKDADGNVIAVHANYLPDTKSGTPGADSVKVKGVIHWVSAAAAYECEVRLYDRLFNDPNPDAGGKNFLEALNPDSKKVITAYLEPSLRDAKPEDRFQFERHGYFVADRNDSQPGKPVFNRIVGLKDSWGK

SEQ ID NO: 90995 - DNA, 1710 bp, Burkholderia cepacia R1808
  CDS (1)..(1710)
atgagcaccgaacgtaacgacgcccccgcggcttccaatttcatccgcaacatcatcgacgacgacaaccgcaccggcaaatggggcggccgcgtcgagacgcgcttcccgcccgagccgaacggctatctgcacatcggccatgcgaagagcatctgcctgaacttcagcgtcgcacgcgactacggcggcgtgtgccacctgcgcttcgacgacacgaacccggaaaaggaaagcgtcgaatacgtcgactcgatcgtcgacgcggtgcgctggctcggcttcgactggcgcaaggacgcggtcgatcatcagtatttcgcgagcgactactacgacaagctctacgagttcgccgagctgctgatccagcgcggcaaggcgtacgtcgacagccagagcgcggacgaaatgcgcgcgaaccgcggctcgctgaccgaaggcggcaagccgtcgccgtatcgcgaccgttcgcccgaggaaaacctcgacctgttccgccggatgaaggccggcgagttcaaggaaggcgagcacgtgctgcgcgcgaagatcgacatggcgtcgccgaacatgaacatgcgcgacccggtgatctaccggatccgctacgcgcaccactatcgcaccggcgacgcatggtgcgtgtatccgatgtacgactacacgcactgcatctcggatgcgctcgaaggcatcacgcattcgctgtgcacgctcgaattcgaggatcaccgtccgctgtacgactgggtgctcaacgagctcgccgaagccggcgtgttcacgcggccgctgccgcaacagatcgaattctcgcgcctgaacctcacgtacgcgatcaccagcaagcgcaagctgctgcaactggtgaccgaaggccacgtcgaaggctgggacgacccgcgcatgccgaccatcgtcgggattcgtcggcgcggcttcacgcctgagagcatccagctgttctgcgagcggatcggcgtgacgaaggtcgactcgtggatcgacatgagcgtgttcgaaggcgcgctgcgcgacgacctcgacgacaaggcggcgcgtacggtcggcgtgctcgatccgctgaagctcgtgatcgacaactatccggaagacctcgaggaagcctgcacggcgcccgtgcatccgcatcatccggatcgcggcgtgcgcacgttcccgatctcgcgcgagctgtggatcgagcgcgacgacttcgccgaagcgccgccgaagggctatttccggctgttcccgggcaacaaggtgcgcctgcgctacggctacgtggtcgaatgcacgggtttcgacaaggacgccgacggcaacgtgacggccgtgcactgcaactacttcccggacagcaagtcgggcaccgacggcgcgaacaactacaaggtcaagggcaacatccactgggtcagcgcgaagcacgcgcagccggccgaagtgcggatctacgatcggttgttcaaggagccgcacccggacgcaggcggcgcgaacttcctcgacgcgctcaacccgaattcgaagaaggtcacgcaggcctacgtcgaaccgggcgccggcgacgtcgcgccggaaacgcgcctgcagttcgagcgccacggctatttcgtcgccgatcgcatcgactcgaagccgggcaagccggtgttcaaccgcatcgtcgggctgcgcgacagctggggcaagccggcctga

SEQ ID NO: 90996 - protein, 569 aa, Burkholderia cepacia R1808
MSTERNDAPAASNFIRNIIDDDNRTGKWGGRVETRFPPEPNGYLHIGHAKSICLNFSVARDYGGVCHLRFDDTNPEKESVEYVDSIVDAVRWLGFDWRKDAVDHQYFASDYYDKLYEFAELLIQRGKAYVDSQSADEMRANRGSLTEGGKPSPYRDRSPEENLDLFRRMKAGEFKEGEHVLRAKIDMASPNMNMRDPVIYRIRYAHHYRTGDAWCVYPMYDYTHCISDALEGITHSLCTLEFEDHRPLYDWVLNELAEAGVFTRPLPQQIEFSRLNLTYAITSKRKLLQLVTEGHVEGWDDPRMPTIVGIRRRGFTPESIQLFCERIGVTKVDSWIDMSVFEGALRDDLDDKAARTVGVLDPLKLVIDNYPEDLEEACTAPVHPHHPDRGVRTFPISRELWIERDDFAEAPPKGYFRLFPGNKVRLRYGYVVECTGFDKDADGNVTAVHCNYFPDSKSGTDGANNYKVKGNIHWVSAKHAQPAEVRIYDRLFKEPHPDAGGANFLDALNPNSKKVTQAYVEPGAGDVAPETRLQFERHGYFVADRIDSKPGKPVFNRIVGLRDSWGKPA

SEQ ID NO: 90997 - DNA, 1830 bp, Rubrivivax gelatinosus PM1
  CDS (1)..(1830)
atgaaccacgctcccaagaagcccggcccgggcgacgcctccgccgagccgcaccgccccggcaatttcctgcgcggcatcatcgagcgcgacctggaagccggcacctacgccggtcgccgccacgccggatcgcccggcgacgccgcccaccacgccggcgcaccgctcgacgccgcgaagatccgtacccgtttcccgcccgagcccaacggttacctgcacgtgggccacgcgaagagcatctgcctgaatttcgggctggcgcgcgattacggcggtgtgtgccacctgcgtttcgacgacaccaatcccgagaaggaagagcaggagtacgtcgacgccatcgtcgacgccgtcaagtggctcggcttcgactggcaggggcgcgatcccgcccaccccgagacgccggtggagcacctgtactacgccagcgactatttcgacttcatgtaccgcgccgccgaggccctggtcaccgcgggcttcgcctacgtggacgagcagagcgcggagcagatgcgcgccacgcgcggcgacttcaacacgcccggcaccgacagcccgttccgcagccgaacgccggccgagaacctggcgcgctttcgggccatgcgcgacggccagctcgccgacggcgccgcggtgctgcgcgcgcgcatcgacatggcctcgcccaacatcaacctgcgcgacccggccatctaccgcatcaagcgcgcgacgcaccataacaccggcgacacctggtgcatctacccgatgtacacgtacgcgcacccgatcgaggacgcgctggagggcatcacccacagcatctgcacactggagttcgaggaccagcgcccgttctacgactggctgctcgacacgctgtgcacgctgggcctgctggcgcagccgcgaccgcaccagcacgaattcgcgcggctcaacctgacctacgtggtcaccagcaagcgcaagctcaagcaactggtggacgagggccacgttgacggctgggacgacccgcgcatgcccaccctcgtcggactgcgccggcgcggctacacgcccgatagcattcagctgttctgcgagcgcatcggcgtcagcaaggactacagctggatcgactacgccacgctcgacgccgcactgcgcgacgacctggaaggcaaggcgccgcgcgcgatggctgtcctcgatccgttgaagctcaagctcacgaactgggccgaggtgttcggcagcgccgaccacctggagccctgccacgcgccggcccaccctcacctgcccgagctgggctcgcgcgagttcacgctcggccccgaggtctggatcgagcgcgacgacttcgccgagcagccgccgaagggattcttccgcctattccccggcaacaaggtgcggctgaagtacggcgtggtggtggagtgctccggttgcgagaaggacgccgacggccgcatcgtcgcggtgctcgccacggtggtgccggacaccaagagcggcacgcccggcgccgacgcggtgaaggtcaagggcacgatcacctgggtgggcgtgcacgaggcggtgccggccgagctgcggctctacgaccgcctgttcaccgaggcgcaacccgacgccggcgggcgcgacttcctgacggtgctgaatccggacagccggcgcgtggcggccggctacgtcgaggcatcggtcggtcgggtgatgcccgagtcacgtctgcagttcgagcgacacggctacttcgtcgccgactcgaaggcccaccggacgggccaacccgtcttcaaccgcatcactggcctgaaggactcctggggcaaatag

SEQ ID NO: 90998 - protein, 609 aa, Rubrivivax gelatinosus PM1
MNHAPKKPGPGDASAEPHRPGNFLRGIIERDLEAGTYAGRRHAGSPGDAAHHAGAPLDAAKIRTRFPPEPNGYLHVGHAKSICLNFGLARDYGGVCHLRFDDTNPEKEEQEYVDAIVDAVKWLGFDWQGRDPAHPETPVEHLYYASDYFDFMYRAAEALVTAGFAYVDEQSAEQMRATRGDFNTPGTDSPFRSRTPAENLARFRAMRDGQLADGAAVLRARIDMASPNINLRDPAIYRIKRATHHNTGDTWCIYPMYTYAHPIEDALEGITHSICTLEFEDQRPFYDWLLDTLCTLGLLAQPRPHQHEFARLNLTYVVTSKRKLKQLVDEGHVDGWDDPRMPTLVGLRRRGYTPDSIQLFCERIGVSKDYSWIDYATLDAALRDDLEGKAPRAMAVLDPLKLKLTNWAEVFGSADHLEPCHAPAHPHLPELGSREFTLGPEVWIERDDFAEQPPKGFFRLFPGNKVRLKYGVVVECSGCEKDADGRIVAVLATVVPDTKSGTPGADAVKVKGTITWVGVHEAVPAELRLYDRLFTEAQPDAGGRDFLTVLNPDSRRVAAGYVEASVGRVMPESRLQFERHGYFVADSKAHRTGQPVFNRITGLKDSWGK

SEQ ID NO: 90999 - DNA, 1701 bp, Pseudomonas fluorescens PfO-1
  CDS (1)..(1701)
atgagcaagcccactgtcgaccctacctcgaattccaagaccggccccgttacgccggtcaatttcctgcgcccgatcatccaggcggacctggactcgggtaagcacacgcagatcgtcacccgtttcccgccagagcccaacggctacctgcacatcggccacgccaagtcgatctgtgtgaacttcggcctggcccaggagttcggcggcgtcactcacctgcgtttcgacgacaccaacccggccaaggaagaccaggaatacatcgacgcgatcgaaagcgacgtcaaatggctgggcttcgaatggtccggcgaagtacgctacgcctcgcaatacttcgaccagctgcacgactgggccgtcgagctgatcaaggccggcaaggcctacgtcgacgacctgacgcctgagcaagccaaggaataccgcggcagcctgaccgagccgggcaagaacagcccgttccgcgaccggtcggtggaagagaacctggactggttcgcccgcatgcgcgccggcgagttcccggacggtgcccgcgtactgcgtgccaagatcgacatggcctcgccgaacatgaacctgcgcgacccgatcatgtaccgcatccgccacgctcatcaccaccagaccggtgacaagtggtgcatctacccgaactacgacttcacccacggtcagtcggacgccatcgaaggcatcacccactcgatctgcaccctggagttcgaaagccatcgtccgctgtacgagtggtttctcgacgcactgccagtgccggcgcgtccgcgtcagtacgagttcagccgcctgaacctcaactacaccatcaccagcaagcgcaagctcaagcaactggttgacgagaaacacgtcaacggctgggacgatccgcgcatgtcgacgctgtcgggcttccgccgccgtggctacaccccggcatcgatccgcaacttctgcgagatgatcggcaccaaccgttccgacggcgtggtcgacttcggcatgctcgagttcagcatccgtcaggacctggacgccaacgccccgcgcgccatgtgcgtgctgcgtccgttgaaagtcgtgatcaccaactacccggaagatcaggtcgagaacctcgaactgccgcgtcatccgcagaaagaagaactcggcgtgcgccagctgccgttcgcccgtgaaatctacatcgaccgcgatgacttcatggaagagccgccgaagggctacaagcgcctggagccgaacggcgaagtgcgtctgcgcggcagctacgtgatccgtgccgacgaagcgatcaaggacgccgacggcaacattgtcgagctgcgttgctcgtacgatccggacaccctgggcaagaaccctgaaggccgcaaggtcaagggcgtgatccactgggtgccggccgctgccagcatcgagtgcgaagtgcgtctgtacgatcgcctgttccgttctccgaacccggagaaggccgaagacagcgcgagtttcctggacaacatcaaccctggctcactgcaagtgctgaccggttgtcgtgccgagccttcgctgggcaatgcacagccggaagaccgtttccagttcgagcgcgaaggctacttcgtcgcggatatcaaggactcgaaaccaggtcagccggtattcaaccgtaccgtgaccctgcgcgattcgtggggccagtga

SEQ ID NO: 91000 - protein, 566 aa, Pseudomonas fluorescens PfO-1
MSKPTVDPTSNSKTGPVTPVNFLRPIIQADLDSGKHTQIVTRFPPEPNGYLHIGHAKSICVNFGLAQEFGGVTHLRFDDTNPAKEDQEYIDAIESDVKWLGFEWSGEVRYASQYFDQLHDWAVELIKAGKAYVDDLTPEQAKEYRGSLTEPGKNSPFRDRSVEENLDWFARMRAGEFPDGARVLRAKIDMASPNMNLRDPIMYRIRHAHHHQTGDKWCIYPNYDFTHGQSDAIEGITHSICTLEFESHRPLYEWFLDALPVPARPRQYEFSRLNLNYTITSKRKLKQLVDEKHVNGWDDPRMSTLSGFRRRGYTPASIRNFCEMIGTNRSDGVVDFGMLEFSIRQDLDANAPRAMCVLRPLKVVITNYPEDQVENLELPRHPQKEELGVRQLPFAREIYIDRDDFMEEPPKGYKRLEPNGEVRLRGSYVIRADEAIKDADGNIVELRCSYDPDTLGKNPEGRKVKGVIHWVPAAASIECEVRLYDRLFRSPNPEKAEDSASFLDNINPGSLQVLTGCRAEPSLGNAQPEDRFQFEREGYFVADIKDSKPGQPVFNRTVTLRDSWGQ

SEQ ID NO: 91001 - DNA, 1716 bp, Methanosarcina barkeri str. fusaro
  CDS (1)..(1716)
atgaccttaagtcctgaagatcttaagacaattgaaaaatacgcctatcaaaatgctgtaaaatatgggaaagccccccaacctaaagctgtaatgggaaaagtaatgggggagtgccctcaactcagatccgatccaaatgccgtatctgaagctcttaaagttattattcccgagattgcaaagggaaatcctgaaacctgggagacaaagctttcggaaattgcccctgagcttattgaagctcttagtgtaaaaaaagaaccagataagggtttaaaacctctagaaggggcagaaaatggcaaggttgtaatgcgttttgccccgaatccaaacgggcctgcaacccttggcagtgcaagaggcatggtagttaattccgaatatgtgaaaatgtacggaggaaaatttgtcctgcgtttcgatgataccgatcctgatataaaacgacctctgcttcaagcttatgactggtatcttgatgacttcaaatggctcggggttgtgcctgaccaggttgtctatgcttctgaccatttccctatgtattacgattatgcaagaaaacttatcgagatgggaaaggcttatgtctgcttctgtaaaggaggagatttcaagcggtttaaggatgcaaagcagtcctgcccgcacagagataccagccccgaagaaaaccttatgcactgggagaagatgcttgccggagaatatgaagaccagcaggcagtgctgaggatcaagaccgatataaagcacaaggaccctgcattgagggactggggagcattcaggataagaaagatgtcgcatccccgccctgaaattgggaacaagtacgttgtctggccgcttcttgattttgcaggggctatcgaagaccacgaactgggaatgactcatatcatccggggcaaagatcttatagacagcgaaaagcggcagggttatatctacaaatacttcggctggaaatacccgagaacaactaactggggcagggtcaagatccacgaatttggaaagttcagcacgagtaccctgagaaaagctattgaagcaggggaatacagcggctgggatgacccgaggcttccaacaatccgggcaatccggcgtcgtggaatccaggctgaagctctcaagaagttcatgatagagatgggagtcggaatgactgacgtaagcataagcatggagtctctctacgccgaaaaccgcaaaatcgtggaccctattgcaaatcgctatttctttgtctggaatcctgtagaactggaaattacagatgctgagccgacagttgctaagcttcctcttcaccctactgaccataaaagaggattcagggaaattgctgtaggaaataaagtacttgtctgcacggaggatgtcgaaaagctggaagttggctctattatccgcttaaaagatttctgcaatatagagattacttccctttccccacttcaggcaaagctctcagatgtttctcttgaagcccttaaaaaagcaaaggcaaaaatcatccactgggccccgcttgacggaataaacgtgaaagtacgcggtcctgaaggtgatcttaacggtatcggtgagcaggggattgcagccgaacttgacaaaatcgtgcagttcgagcgcttcggtttctgcaggattgatgccgtaagcgaagacgaaattgtggcttactttgcccacaaataa

SEQ ID NO: 91002 - protein, 571 aa, Methanosarcina barkeri str. fusaro
MTLSPEDLKTIEKYAYQNAVKYGKAPQPKAVMGKVMGECPQLRSDPNAVSEALKVIIPEIAKGNPETWETKLSEIAPELIEALSVKKEPDKGLKPLEGAENGKVVMRFAPNPNGPATLGSARGMVVNSEYVKMYGGKFVLRFDDTDPDIKRPLLQAYDWYLDDFKWLGVVPDQVVYASDHFPMYYDYARKLIEMGKAYVCFCKGGDFKRFKDAKQSCPHRDTSPEENLMHWEKMLAGEYEDQQAVLRIKTDIKHKDPALRDWGAFRIRKMSHPRPEIGNKYVVWPLLDFAGAIEDHELGMTHIIRGKDLIDSEKRQGYIYKYFGWKYPRTTNWGRVKIHEFGKFSTSTLRKAIEAGEYSGWDDPRLPTIRAIRRRGIQAEALKKFMIEMGVGMTDVSISMESLYAENRKIVDPIANRYFFVWNPVELEITDAEPTVAKLPLHPTDHKRGFREIAVGNKVLVCTEDVEKLEVGSIIRLKDFCNIEITSLSPLQAKLSDVSLEALKKAKAKIIHWAPLDGINVKVRGPEGDLNGIGEQGIAAELDKIVQFERFGFCRIDAVSEDEIVAYFAHK

SEQ ID NO: 91003 - DNA, 1662 bp, Geobacter metallireducens GS-15
  CDS (1)..(1662)
atgtcaaccgaaacgccccacaccgccaacttcctccgcaccatcgttcaggaggacctgaagggcggcaaacgcgaaaccatcgtcacccgcttcccccctgagcccaacggctatctccacatcggccacgccaagtccatctgcctgaacttcggcctggcaaaggagttcgggggccgctgccacctccgcttcgacgacacgaacccggtaaaggaagaaaccgagtatgtggaatccatcaaggaaagcgtgcggtggctcggcttctcatgggggacgcacctctactacgcctccgagtacttcgagcagctctaccagtgggcagagcacctaatcctccaggggaaggcctacgtggacgacctgacggccgaggagatccgggcccaccgcggcaccctgaccgaggcggggaaggagagcccctggcgcaaccgctccccggaggagaacctggatcttttccgccggatgcgggccggggagtttcccgacggcgccaaggtgctccgggcgaagatagacatggcctcccccaacatgaacctccgggacccggtcatgtaccggatcatccacgcctcccacccccacgtgggtgacgcctggcgcatctaccccatgtacgactacgcccacggccagtccgacgccatcgaggggatcacccactccatctgcaccctggagttcgaggaccacaagcctctctacgagtggttcctggacaacctgccggtgcccaaccgcccccgccagtacgagttcgcgcgcctgaacctcacctacgcggtcatgagcaagcgcaagctcctgcagttggtgaaggacggcgacgtctccggctgggacgacccgcgcatgcctaccatcatggggatccggcgccgtggctacactcccgaggcggtcagaaacttctgcgagaccatcggcgtggggcggagcgacagctggatcgacatgagcatcctggaggagagcgttcgccaggacctgaacgagcgggcaccccgggtcatggcggtgctgaagcccctgcggctcgtcatagaggattatccggaaggggaggcggaggagctcaccatcccgtaccacccccagaagcctgagctggggagccgggtggtccccttctgcagcgagctcttcatcgagcaggatgattttgcggaagttccccccaagggattcaagcgcctctcccccggggaggagatccggctgcggggggcatacatcattaagtgcgtcgacgtggagaaggatgccgagggcgccgtcaccgcggtccgctgtacctacgatcccgaaacccgcagcggtctcccagggtccgagcggaaggtgaagggggtcatccactgggtgtcggcccgccacgccgaaacagcgaaggtgcgcctctacgaccggctcttcaccgaccctaacccctccggcgacgactggaaggaccacctgaatccggcatccatggagattctggccgactgccggctggaaccctcccttgctacagcccaggccgaggaccgcttccagtttgaacggcagggatacttctgcgttgacctgaaggattcacgaccaggggcgccggtcttcaaccggacggtgaccctgcgggattcctggaccaagaaataa

SEQ ID NO: 91004 - protein, 553 aa, Geobacter metallireducens GS-15
MSTETPHTANFLRTIVQEDLKGGKRETIVTRFPPEPNGYLHIGHAKSICLNFGLAKEFGGRCHLRFDDTNPVKEETEYVESIKESVRWLGFSWGTHLYYASEYFEQLYQWAEHLILQGKAYVDDLTAEEIRAHRGTLTEAGKESPWRNRSPEENLDLFRRMRAGEFPDGAKVLRAKIDMASPNMNLRDPVMYRIIHASHPHVGDAWRIYPMYDYAHGQSDAIEGITHSICTLEFEDHKPLYEWFLDNLPVPNRPRQYEFARLNLTYAVMSKRKLLQLVKDGDVSGWDDPRMPTIMGIRRRGYTPEAVRNFCETIGVGRSDSWIDMSILEESVRQDLNERAPRVMAVLKPLRLVIEDYPEGEAEELTIPYHPQKPELGSRVVPFCSELFIEQDDFAEVPPKGFKRLSPGEEIRLRGAYIIKCVDVEKDAEGAVTAVRCTYDPETRSGLPGSERKVKGVIHWVSARHAETAKVRLYDRLFTDPNPSGDDWKDHLNPASMEILADCRLEPSLATAQAEDRFQFERQGYFCVDLKDSRPGAPVFNRTVTLRDSWTKK

SEQ ID NO: 91005 - DNA, 1644 bp, Ferroplasma acidarmanus
  CDS (1)..(1644)
atgcagcaagaaatcaggaaacaggttattaaaaacgcatatatgcatggtgggaaagcggatatttcctcagttgttggaaagttgatttccattaacccggatgcaaaaaaggatatgaaaacccttatgggaacaataaggaaatatgttgacgaggtaaatgcaatgggtgctgaccagctggaggagatcgttaacaccgagtacccggatatacttataaaggaaaagaaagaagaaaggcatgaactgcctgatcttcccggggtaaatgggagtgttgttatgaggatggctccgtccccctcaggacccctgcacataggccattcgagaatggctatcctcaacgatgagtatgtaaagcgttatggcgggaaactgatacttagaatagaagacacaaatccgggcaacattgatccggatgcatatacaatgattccggaggatctaaaatggctgggcgttgatgttacagaaactgtaatccaatcatcccggatggagttctattattctgaagcaaagcgcatgatttctgaagggtatatgtacgttattgaagaaaatcagcaggaattccatgatctcaaattgaagaaagtacctgtaaaagaaagggatgccgacccttcagttaaccttgaaaaattcgataagatgatttcaggccattactccgagggtgaagcagcactggtaatgaaaacggacataaatcacccgaatccctcgataagggactggattgcattcaggataaataccaccgagcacccgctaaccggatcaaaatattcagtatatcctactatgaatttttcagtgtctgttgacgaccattatctggggcttacacatgttataaggggaattgaccatcttgtcaataccgagaagcagaaatatgtttttatgtacaataactggaaaatacctgaatatttccattatggtttcataacaattcccgatacaattcttaaaacaacaataatcaaggaaggcataaaatccggaaagtacagtggatgggacgatatcaggcttggaactttaaaggcattgaagaagagaggatataatcctgaaacattcaggaagtactgggtccgttcaggaatgaataaaagcaatgcaaccttttcatgggaaatatttgattccatggatagggaaataatagattataatacagaaaggtattcctttgtaccacatccggaactcattagccttcagaatgcagaacccttaaaaagccatgccctgctacatccacagcgcccagattccggtttcagggaatatagcattccggcacaggcatctgtttatttccctggcgatgaaattgataaaataaatgaaggggaagtaataaggttaaaagacctctgtgtggcggtaaaaaagggcaataaacttgtttatagcaatattgaaccggaaggcagggtgaagataatccagtgggcacctgaaaattccggagacctccagatattttatccggacgggaacatagacaagggaaaactggaacctttagcaacagagaaacggggagttgtacagctggaacgttacggatatgtcaacctggatggcaaaaatggttatttcctccataaatga

SEQ ID NO: 91006 - protein, 547 aa, Ferroplasma acidarmanus
MQQEIRKQVIKNAYMHGGKADISSVVGKLISINPDAKKDMKTLMGTIRKYVDEVNAMGADQLEEIVNTEYPDILIKEKKEERHELPDLPGVNGSVVMRMAPSPSGPLHIGHSRMAILNDEYVKRYGGKLILRIEDTNPGNIDPDAYTMIPEDLKWLGVDVTETVIQSSRMEFYYSEAKRMISEGYMYVIEENQQEFHDLKLKKVPVKERDADPSVNLEKFDKMISGHYSEGEAALVMKTDINHPNPSIRDWIAFRINTTEHPLTGSKYSVYPTMNFSVSVDDHYLGLTHVIRGIDHLVNTEKQKYVFMYNNWKIPEYFHYGFITIPDTILKTTIIKEGIKSGKYSGWDDIRLGTLKALKKRGYNPETFRKYWVRSGMNKSNATFSWEIFDSMDREIIDYNTERYSFVPHPELISLQNAEPLKSHALLHPQRPDSGFREYSIPAQASVYFPGDEIDKINEGEVIRLKDLCVAVKKGNKLVYSNIEPEGRVKIIQWAPENSGDLQIFYPDGNIDKGKLEPLATEKRGVVQLERYGYVNLDGKNGYFLHK

SEQ ID NO: 91007 - DNA, 1743 bp, Clostridium thermocellum ATCC 27405
  CDS (1)..(1743)
atggacgctcaggttgatggcaaagcaaatgaattaaattcaacagaagaaaatgaaaaagtatattcaaattttattcaggatattattgatgaggataatagaacaaatagatatggcggaagagtgcatacgaggtttccgcccgagcccaacggctaccttcatataggacatgccaagtcaatttgccttaatttcggaattgcagaacagaacggcggtttgtgcaatcttagatttgacgatacaaatccttcgaaggaagacactgaatatgttgagtccattaaagccgatgttaaatggcttggttttgactgggaagacagattgtactatgcatcggattattttgacaaaatgtttgaatacgccgttaagctgattaaaatgggaaaggcttatgtttgcgatttgagtgccgatgagataagggaatacaggggaactttgaccgagcccggaaaggaaagcccgtatcgcaacagaagtgttgaagagaatctggatttgtttatgagaatgaaaaacggtgaattcgaggaaggttcgagggttttgcgggcaaaaatagatatggcatcccccaatctcaatatgagggacccggtgatttacagaattataaaggcaagtcatcacaggtccggtgacaagtggtgtatttacccgatgtatgattttgcccatcctatatctgactctcttgagggtataacccattccatctgtacgctggagtttgaagaccacaggcctttgtacaactgggttttggagacccttgacatggagtgcaagacccgtcagatagagtttgcccgtttgaatttgacctatacggtaatgagcaaacgaaaattgctaaggcttgtgcaggaagggcatgtgaggggatgggacgacccaagaatgcctaccatatcaggacttagaagacgtggatatactccttcggccataagaaacttttgtgcccgcataggggttgccaagagcaacagcaccgttgatatatcgctccttgagcattgtatcagagaggaacttaatcagaaggctcaaagggtaatggcggtactgagacctctcaaacttgtcatagacaactatcctgagggaatggttgaagagtttgaggttgagaacaatcccgaggatccgaatgcgggaaccaggaaagtacctttttcaaaagttctttatattgagaaggacgatttttgcgaaaatcctccgaagaaatatttccgcctggcgcccggtcaggaggttagactcaaaggtgcttatatagtaaaatgcgtggatgttgtaaaggatgacaaaaccggagagataacagaagtacattgcacctatgacccccaatcccgtggaggaaatgcttctgacgggcgaaaagtaaaaggtaccattcactgggtttcggcagctcatgccattgatgccgaggtacgcctgtatgatcatttgtttagcgtgcccaatcccggtgctgatgaaaatgttgactttattgaacagctaaatcccaattctctcgaagtgttaaaatcgtgcaagctcgagcccagccttgctggtgcaaaaccgggagatgcgttccagttcctccgtttgggttatttctgtgttgatttggtggattcaaaggaaggctctttggtatttaacagaacggtgacactcaaggatacctgggcaaagatagcaagtaaagagaaagaagataagtaa

SEQ ID NO: 91008 - protein, 580 aa, Clostridium thermocellum ATCC 27405
MDAQVDGKANELNSTEENEKVYSNFIQDIIDEDNRTNRYGGRVHTRFPPEPNGYLHIGHAKSICLNFGIAEQNGGLCNLRFDDTNPSKEDTEYVESIKADVKWLGFDWEDRLYYASDYFDKMFEYAVKLIKMGKAYVCDLSADEIREYRGTLTEPGKESPYRNRSVEENLDLFMRMKNGEFEEGSRVLRAKIDMASPNLNMRDPVIYRIIKASHHRSGDKWCIYPMYDFAHPISDSLEGITHSICTLEFEDHRPLYNWVLETLDMECKTRQIEFARLNLTYTVMSKRKLLRLVQEGHVRGWDDPRMPTISGLRRRGYTPSAIRNFCARIGVAKSNSTVDISLLEHCIREELNQKAQRVMAVLRPLKLVIDNYPEGMVEEFEVENNPEDPNAGTRKVPFSKVLYIEKDDFCENPPKKYFRLAPGQEVRLKGAYIVKCVDVVKDDKTGEITEVHCTYDPQSRGGNASDGRKVKGTIHWVSAAHAIDAEVRLYDHLFSVPNPGADENVDFIEQLNPNSLEVLKSCKLEPSLAGAKPGDAFQFLRLGYFCVDLVDSKEGSLVFNRTVTLKDTWAKIASKEKEDK

SEQ ID NO: 91009 - DNA, 1695 bp, Microbulbifer degradans 2-40
  CDS (1)..(1695)
atgactgacaccccactgggttccgcagagaccgaagcaggtaacgacaagccgcttaacttcctagagcaaatcatcaaaaaagatatagatgaaggtcggtgtaatggccttgttacgcgttttccacccgaaccaaacggctatttacacattggccacgccaaatctatctgcttaaattttggccttgctgagcgctttggcggtgtgtgtaacttgcgttttgatgatacgaacccagccaaagaagaaatggagtatgtagaagcaattaaagccgacgttgaatggctaggcttcacttggggcggcgacatcaagtacgcatcgaactatttcgaccaattttatggttgggcacagcatctaattaaaaacggcaaagcttatgtgtgtgacttaaatgccgagcaagctagggaataccgcggtaccttaaaagagggcggtaagccatcgccatatcgcgagcgcagtgttgaggaaaacctcgacctactagagcgcatgaaaaacggtgaattcgacgaaggcgctaaaaccctacgtgcaaaaattgatatgtcgcacggcaatatcaatatgcgcgaccctatcctctaccgcattcgtaagcaaagtcatcaccaaacgggcgataaatggtgtatttatccatcttacgatttcgcccacgggcaagaagatgccatcgagggtgtaacgcactctatctgcacattggaatttgctgatcaccgccctttgtacgagtggttcattgagaaccttcctgtgccgagtaagcccaagcaatatgagtttggccgtttaaacctaaactacacggttacctccaagcgcaaacttaaacagcttgttgatgaaggtgtagttactggttgggatgatccgcgcatgcctaccatagccggttatcgtcgtcgcggttacacgccagcggctattcgcaagttttgcgaaatgattggtgttactaaatctgatggtgtagttgatgtggcgatgcttgagcatgcaatacgcgacgatttagataaaaatgcaccccgtgcaatgtgcgtgcttaaccctctaaaagttactttaactaactacccaagcgataaaaccgaagtgtttaccgctgccggccaccccaaccgcgacgacctacaaagtagggagctgccgtttggccaagtggtgtatatcgataaagaagactttagagaagaagccaataaaaaatacaagcgtttggttattggcaagcgtgttcgcttgcgcaacgcttatgttattgaagctgatgaagctattaaaaatgatgcgggagaaataattgaagtaaaagcgcgcattattgaaaacacggtaggtaacgacccagaagacggcgtcaagcccaaaggcgtaattcactgggttgcagcacatgattgtgtggatgccgaagtgcgtctttacgatcgcctgtttgtagatgaggcgcccgacgcaggtaataaagactttatggaaaccatcaacccagagagcttaactgtacttactaattgtaagttagaaaaaagccttgctatggcaaccgcaggtcaaggctttcagtttgagcgcgaagggtatttttgtcgtgacgctaaagagcctggcttagtgtttaatcgcactattggcctgcgcgatagctggggcaaaaaagacgcataa

SEQ ID NO: 91010 - protein, 564 aa, Microbulbifer degradans 2-40
MTDTPLGSAETEAGNDKPLNFLEQIIKKDIDEGRCNGLVTRFPPEPNGYLHIGHAKSICLNFGLAERFGGVCNLRFDDTNPAKEEMEYVEAIKADVEWLGFTWGGDIKYASNYFDQFYGWAQHLIKNGKAYVCDLNAEQAREYRGTLKEGGKPSPYRERSVEENLDLLERMKNGEFDEGAKTLRAKIDMSHGNINMRDPILYRIRKQSHHQTGDKWCIYPSYDFAHGQEDAIEGVTHSICTLEFADHRPLYEWFIENLPVPSKPKQYEFGRLNLNYTVTSKRKLKQLVDEGVVTGWDDPRMPTIAGYRRRGYTPAAIRKFCEMIGVTKSDGVVDVAMLEHAIRDDLDKNAPRAMCVLNPLKVTLTNYPSDKTEVFTAAGHPNRDDLQSRELPFGQVVYIDKEDFREEANKKYKRLVIGKRVRLRNAYVIEADEAIKNDAGEIIEVKARIIENTVGNDPEDGVKPKGVIHWVAAHDCVDAEVRLYDRLFVDEAPDAGNKDFMETINPESLTVLTNCKLEKSLAMATAGQGFQFEREGYFCRDAKEPGLVFNRTIGLRDSWGKKDA

SEQ ID NO: 91011 - DNA, 1698 bp, Thiobacillus denitrificans ATCC 25259
  CDS (1)..(1698)
atgtcgcacgacaacgctcccgcgcccgccgccaacttcatccgcaacatcatcgacgagcagaacgccgaaggaaaatggggcggccgcgtcgagacgcgcttcccgcccgagccgaacggctacctgcacctcggccacgcgaagtccatcttcctcaacttcgggcttgcgcgcgactacggcggcgtctgccacctgcgcttcgacgacaccaaccccgagaaggaagagcaggaatatgtcgacgcgatcactgaatcggtaaagtggctcggcttcgactggggcgagcatctttactatgcgtcgaactacttcgacaccatgtatgcctgcgccgagcacctgatcacggccggccacgcgtacgtcgattcgctcacggccgaggagatgcgcgaataccgcggcacgctcacggaaaagggcaaggacagcccctatcggagtcgttcaatcgaggagaacctggacctcttccgcaaaatgcgcgccggcgaattccccgatggcgcgcatgtgctgcgggccaagatcgacatggcctcgcccaacatcaacctgcgcgatccggcgatctatcgcatcaagcgcgcccaccaccacaacaccggcgacaaatggtgcatctacccgatgtacacctacgcgcatccaattgaagatgcgatcgagcacatcacccactcgatctgcaccctcgaattcgaggaccagcgcccgttctacgactggctgctggacaagctcgccatcggcggcttcttcagccgcccgctgccgcagcagatcgagttcgcgcggctcaacctcacctacgtcatgctttcgaagcgcaagctgatccaattggtcgaagagaagcacgtctccggctgggacgacccgcgcatgccgaccctcgtcggcgcgcggcggcgcggctacacgcccgaaggcctccgccgcttcaccgaccagatcggcgtgtcgaagtccgacggctggatcgactacagcgtgttcgaagcctgccagcgcgatgtcttgaacgattccgcgccgcgtcgcgtcgccgtcctcgacccggtcaagctcgtcatcgacaactaccccgaaggccagagcgaagactgcttcgcccccaaccacccgcagcagccggagctcggcaagcgcgcgattccgttctcgaaagaactgtggatcgagcgcgaggacttcgaggagacgccgcccaagggctacttccgcctcttcccaggcaactcggtgcgtctacgctacggctacgtcgtcaagtgcaccggctttgaccgcgacgccgacggcaacatcgcagccgtgcactgcgaatacctgcccgacaccaagtccggcacccccggcgccgactcggtcaaggtcaagggaaatatccattgggtgagcgcggcccacgcccacgacgcagaagtccgtctctacgaccgcctgttcaagaccgcgcagcccggcgccgaaaccggcaacttcctcgacgacctcaacgccgactcggtgaaggtcatccgcgcgcaactggaaccggcgctcaaggacgccgcgcccgaagcttcgtttcagttcgagcggcacggctacttcgtcgcggatcgggtcgatacgcagccgggcgcgccggtgttcaaccggaccgtgacgttgaaggattcgtgggtgaaggttggcagttag

SEQ ID NO: 91012 - protein, 565 aa, Thiobacillus denitrificans ATCC 25259
MSHDNAPAPAANFIRNIIDEQNAEGKWGGRVETRFPPEPNGYLHLGHAKSIFLNFGLARDYGGVCHLRFDDTNPEKEEQEYVDAITESVKWLGFDWGEHLYYASNYFDTMYACAEHLITAGHAYVDSLTAEEMREYRGTLTEKGKDSPYRSRSIEENLDLFRKMRAGEFPDGAHVLRAKIDMASPNINLRDPAIYRIKRAHHHNTGDKWCIYPMYTYAHPIEDAIEHITHSICTLEFEDQRPFYDWLLDKLAIGGFFSRPLPQQIEFARLNLTYVMLSKRKLIQLVEEKHVSGWDDPRMPTLVGARRRGYTPEGLRRFTDQIGVSKSDGWIDYSVFEACQRDVLNDSAPRRVAVLDPVKLVIDNYPEGQSEDCFAPNHPQQPELGKRAIPFSKELWIEREDFEETPPKGYFRLFPGNSVRLRYGYVVKCTGFDRDADGNIAAVHCEYLPDTKSGTPGADSVKVKGNIHWVSAAHAHDAEVRLYDRLFKTAQPGAETGNFLDDLNADSVKVIRAQLEPALKDAAPEASFQFERHGYFVADRVDTQPGAPVFNRTVTLKDSWVKVGS

SEQ ID NO: 91013 - DNA, 1839 bp, Polaromonas sp. JS666
  CDS (1)..(1839)
atgacctcccccgccccctccaaagctggccccaagggcactgctgccgcagcccccgccgacaaagaaaaccacaagcccagcaactttttgcgccagatcatcgaaaaagacctggctgaaggcacgtatgccacccgccgctggggcggcagccctggcgatgccgcccaccacgccagcggccagcccgacccggcccgggtgcgcctgcgctttccgcccgagcccaacggctacctgcacatcggccacgccaagagcatttacctgaactttggcctggcgcgcgactacggcggcgtgtgccacctgcgctttgacgacaccaaccccgaaaaagaagacaccgaatacgtcagcagcatcattgaagcggtgaagtggctgggttttgactgggaaaacaacggcccatccggcaacgagtgcaacctctatcaggccagcgactatttcgacttcatgtaccgcgccgccgaatacctgatcgaatccggcaacgcctatgtagacgagcaaaccgccgaggaaatgcgcctcagccgcggcgacttcggccaccccggcaccaacagcccctttcgcagccgcacgccagagcaaaacctggcgcgctttcgcgaaatgcgtgacggcctgcatgaagacggctccatggtgctgcgcgccaagatcgacatggccagccccaacatcaatatgcgcgacccggccatttaccgcattcgccgcgcccaccaccacaacaccggcgacaaatggtgcatctaccccatgtacacctttgcgcaccccatcgaggacgcactggagcagatcacccacagcatctgcacgctggagtttgaagaccagcgcccgttttacgactggctgctcgaccgcctgtgcgaaggcggcctggttgccacgccgcacccgcaccagtacgaatttgcccgcctcaacctcacctatgtgctgaccagcaaacgcaagctggcgcaactggtgtacgaccacaaggtcaccggctgggacgacccccgcatgccaaccatcgtcggcctgcgccgccgcggctacacccccgaagcgctgcacctgttcgccgaacgcattggcgtgaccaagagcgacagctggattgactacagcacgctggaaggcgcactgcgcgacacactggaccccatcgccccccgcgccatggccgtgctcgaccccgtcaagttggtgctgaccaattgggacacggtcatgggcgcaggcaagctcgacgactgcagcgcccccgtgcacccgcaccaccccgagctgggcaagcgcagtttcaaaatcggcaaagaagtgtggattgaacgcaccgactttgaagagacaccccccaaaggcttcttccgcctgttcccgggcaacaaggtgcgcctcaaatacggccacgtcatcgaatgcacaggagctacccgcgacgccaacggccaggtcaccgaagtacaggccacgctgatccccgacaccaagagcggcacccccggctcggacgccatcaaggtcaagggcgtgatcacctgggtaggcgtgaatgatgcggtgcaggccgaagtgcgcctctatgaccgcctcttcaaggaagcccaccccggtacgggcgagaaggactttatggaagagctgaatccggacagcctgaaggtggtgacggcgtatgtggagccttcattggccagcgcgcctgctggccagcgcttccagtttgagcggcatgggtactttgtcacagacattgttgaccacaagccggggaaaaccgtgttcaatcgggtgacggggatgaaagatagctggggaaagtag

SEQ ID NO: 91014 - protein, 612 aa, Polaromonas sp. JS666
MTSPAPSKAGPKGTAAAAPADKENHKPSNFLRQIIEKDLAEGTYATRRWGGSPGDAAHHASGQPDPARVRLRFPPEPNGYLHIGHAKSIYLNFGLARDYGGVCHLRFDDTNPEKEDTEYVSSIIEAVKWLGFDWENNGPSGNECNLYQASDYFDFMYRAAEYLIESGNAYVDEQTAEEMRLSRGDFGHPGTNSPFRSRTPEQNLARFREMRDGLHEDGSMVLRAKIDMASPNINMRDPAIYRIRRAHHHNTGDKWCIYPMYTFAHPIEDALEQITHSICTLEFEDQRPFYDWLLDRLCEGGLVATPHPHQYEFARLNLTYVLTSKRKLAQLVYDHKVTGWDDPRMPTIVGLRRRGYTPEALHLFAERIGVTKSDSWIDYSTLEGALRDTLDPIAPRAMAVLDPVKLVLTNWDTVMGAGKLDDCSAPVHPHHPELGKRSFKIGKEVWIERTDFEETPPKGFFRLFPGNKVRLKYGHVIECTGATRDANGQVTEVQATLIPDTKSGTPGSDAIKVKGVITWVGVNDAVQAEVRLYDRLFKEAHPGTGEKDFMEELNPDSLKVVTAYVEPSLASAPAGQRFQFERHGYFVTDIVDHKPGKTVFNRVTGMKDSWGK

SEQ ID NO: 91015 - DNA, 2187 bp, Arabidopsis thaliana
  CDS (1)..(2187)
atggatgggatgaagctttcgttcccaccggaaagtccaccactttcagtcatcgttgctctttctctctcagcttctccggtgacgattgattcttccgccgctgcaacaaccgtcccttcttttgtcttctccgacgggaggaaattgaatggagccaccgttcttcttcgctatgttggtcgatcagcgaaaaagcttcctgatttctatggcaacaatgcttttgattcttctcaggtctcgattctttgtattaacatgaaaattgatgagtgggtagattacgcatctgtcttctcttctggttcagagtttgagaatgcttgtggtcgtgttgataagtatctcgagagtagcacgtttcttgttggccattctctttccattgctgatgtcgctatttggtcagctcttgctggaactggtcaaagatgggaaagtttgaggaaatctaaaaagtatcagagtcttgttagatggttcaattcgatattagacgagtacagtgaggtgcttaacaaggttctagcaacttatgttaagaaaggatcagggaagcctgttgctgcacctaagtctaaagatagccaacaagctgtgaaaggagatggtcaggataaaggtaagcctgaagtggacttgccggaagcggagattggaaaggttaaactccggtttgctccagagccaagtggttatcttcacataggacatgctaaggctgcgttgctgaacaagtatttcgctgagcgttaccaaggggaagtgattgtgcgttttgatgatactaaccctgctaaagaaagcaatgagtttgtggataatcttgtgaaggatattgggaccttggggatcaagtatgagaaagtgacatacacttcggactattttcctgaattgatggatatggcggaaaaactgatgcgtgagggtaaggcatatgttgatgacacaccgagggagcagatgcagaaagagaggatggatgggattgattcgaaatgtaggaatcatagcgtcgaggagaatttgaagctatggaaggaaatgattgcaggaagtgagagaggattacagtgctgtgttcgtgggaaattcaacatgcaagatcccaacaaagccatgcgtgacccggtttattaccgatgcaatcctatgtctcaccaccgtatcggggataagtataagatatatccaacatatgactttgcttgcccgtttgttgattcccttgaaggtataacgcatgctcttcggtctagtgagtatcatgaccgaaatgctcagtactttaaagttctggaggatatgggactgcgacaggttcagctttacgaattcagccggttaaacctagtttttacacttctcagtaagcgcaagcttctctggtttgtccaaactggattggttgacgggtgggatgatccacgtttcccgacagtccaaggaattgttcgtagaggtttgaaaatcgaggctctgattcaattcattctcgagcagggggcttcgaagaatctaaatttgatggaatgggacaaactttggtctataaataagagaataattgatcctgtgtgccctagacacactgctgtggttgcagaacgtcgtgtactatttaccttaacggatggtcctgatgagccgtttgttcgcatgataccaaagcacaagaaattcgaaggtgctggagaaaaggcgaccactttcactaagagcatttggctcgaggaagctgatgcgagtgccatatccgttggtgaggaagtaactttgatggattggggaaatgctatcgtaaaggaaatcacaaaggacgaggagggtcgtgtcactgccttatctggtgtcttgaatctccaaggttctgtaaagactacaaagctgaagctgacatggcttcctgatactaatgaattggtcaatctcacattaacagagtttgattatctaatcaccaagaagaagctggaagatgatgatgaagttgctgattttgtgaatcctaacacaaagaaggaaacattggcacttggtgattcgaatatgaggaatctgaaatgtggagatgtgattcagcttgagaggaaaggctatttcagatgtgatgtgccttttgtcaaatcttcaaagcccattgtcttattctccattccagatggaagagccgctaagtga

SEQ ID NO: 91016 - protein, 728 aa, Arabidopsis thaliana
MDGMKLSFPPESPPLSVIVALSLSASPVTIDSSAAATTVPSFVFSDGRKLNGATVLLRYVGRSAKKLPDFYGNNAFDSSQVSILCINMKIDEWVDYASVFSSGSEFENACGRVDKYLESSTFLVGHSLSIADVAIWSALAGTGQRWESLRKSKKYQSLVRWFNSILDEYSEVLNKVLATYVKKGSGKPVAAPKSKDSQQAVKGDGQDKGKPEVDLPEAEIGKVKLRFAPEPSGYLHIGHAKAALLNKYFAERYQGEVIVRFDDTNPAKESNEFVDNLVKDIGTLGIKYEKVTYTSDYFPELMDMAEKLMREGKAYVDDTPREQMQKERMDGIDSKCRNHSVEENLKLWKEMIAGSERGLQCCVRGKFNMQDPNKAMRDPVYYRCNPMSHHRIGDKYKIYPTYDFACPFVDSLEGITHALRSSEYHDRNAQYFKVLEDMGLRQVQLYEFSRLNLVFTLLSKRKLLWFVQTGLVDGWDDPRFPTVQGIVRRGLKIEALIQFILEQGASKNLNLMEWDKLWSINKRIIDPVCPRHTAVVAERRVLFTLTDGPDEPFVRMIPKHKKFEGAGEKATTFTKSIWLEEADASAISVGEEVTLMDWGNAIVKEITKDEEGRVTALSGVLNLQGSVKTTKLKLTWLPDTNELVNLTLTEFDYLITKKKLEDDDEVADFVNPNTKKETLALGDSNMRNLKCGDVIQLERKGYFRCDVPFVKSSKPIVLFSIPDGRAAK

SEQ ID NO: 91017 - DNA, 1644 bp, Schistosoma japonicum
  CDS (1)..(1644)
atgctgacaagtggtgatagtgatctggtgggggaagctgttaagtttcacaaaccaggggagaactacaattctcctggttatgttgtgacaaaaaatacgttgcggttattaaaggagcacctgaaacaaacgggtggtaaggtagtcaccaggtttccccctgaaccaaatggtattttacatattggtcatgcaaaggcaatcaattttaattttggctatgcaatgaagaatggtggtataacttacttgcgatacgatgatactaaccctgaaaaagaagaagcagaattttttgaagctattgaggatatggtcaggtggttaggttttacaccatataaaattacgtacgcatcggataattttcatcagttatacgaatggtctgtagaagaaataagaggttttaatccacctccttctccatggagagaaaggccggttgaagaatctcttcgactgtttgaagacatgaaaaatggaaagatcgatgagggaatggcaactttacgtttgaaagtgacgttgggagatggaaaagtggatccagtagcttatcgtatcaaaatgactccccaccaccgtactggtaatgaatggtgtatttatcctacttatgattatactcattgtttatgtgattccatcgagaatattacacattcattatgcaccaaagagttccagtcacggcgtccagcctactattggctttgtaatgcgctagatgtttactgtccagttcaatgggaatatggtcgtctcaatttgtattatagtgtagtatctaagcgcaaaattttaaagctgatagaagctggcattgttagtgattgggatgatccacggttagtaacactgacagcacttcgtcgtcgtggatttccgcctcaagctattaatatgttttgtgaacgtattggcgttactatggcccaaacaatcctcgatccttctgctctagacgcttgcgtacgcgactatttgaatgatcatgctccacgtgtaatggctgtgttagagccagtgttggtaactattactaattggtttgaattatacggcgataagtcatctatcgagcttacagtagcggattttcctgccgttccggatagtaaaactcacagcattactttgcaacatgatctatacatagagaagacggattttcaagaagttgctgagaaaggatatcgtcgtttaacgcccactcaggcagttggtcttcgtcacacaggccttgttttagaattttctgattttaaaaaggattctaatggggaaatagttcatttattcgtaaaagccaaaaaggttgaagattctattaaaccaaaagcttttatacactgggtatctaatccgttgcagtttgaagctcgactgtatgaccgattgttcactgtcaaggaaccagaaagcgcaaaggagggattcttgtctgtcattaataaagattcattagtcgtactctcggatgctttgattgagcagtctgtcatgaatgcaaaagtttacaccgcttatcagtttgaacgtattggtttcttttctgttgatccagatacaacctcgaaacgcatggtcttcaataggactgtagctctcaaagtcgatcctggtaaaacaatttga

SEQ ID NO: 91018 - protein, 547 aa, Schistosoma japonicum
MLTSGDSDLVGEAVKFHKPGENYNSPGYVVTKNTLRLLKEHLKQTGGKVVTRFPPEPNGILHIGHAKAINFNFGYAMKNGGITYLRYDDTNPEKEEAEFFEAIEDMVRWLGFTPYKITYASDNFHQLYEWSVEEIRGFNPPPSPWRERPVEESLRLFEDMKNGKIDEGMATLRLKVTLGDGKVDPVAYRIKMTPHHRTGNEWCIYPTYDYTHCLCDSIENITHSLCTKEFQSRRPAYYWLCNALDVYCPVQWEYGRLNLYYSVVSKRKILKLIEAGIVSDWDDPRLVTLTALRRRGFPPQAINMFCERIGVTMAQTILDPSALDACVRDYLNDHAPRVMAVLEPVLVTITNWFELYGDKSSIELTVADFPAVPDSKTHSITLQHDLYIEKTDFQEVAEKGYRRLTPTQAVGLRHTGLVLEFSDFKKDSNGEIVHLFVKAKKVEDSIKPKAFIHWVSNPLQFEARLYDRLFTVKEPESAKEGFLSVINKDSLVVLSDALIEQSVMNAKVYTAYQFERIGFFSVDPDTTSKRMVFNRTVALKVDPGKTI

SEQ ID NO: 91019 - DNA, 2343 bp, Gallus gallus
  CDS (1)..(2343)
atggcggcgatggcggcgacggaggaagcggaggcgctggatttgttcaccggcatcgggctgaccgaggccaaagcccgcgagacgctgcgcaacgccgcgctgagcgcgcagctccgccaggccgtgctgcaggcccgcgccgcgctgggctcaggcctggataaagccaccggcgctctgctgtacaacgcggccgcccggctccgcgacccggaccgcttggccttcgtggtggggtacatcgggcggagggagatccgcaccgaccaacagttgggcgccgccctgcagtacctccgcagtcacccgctggaaccgctggaaccggcggacttcgagcgggcgtgcggcgtgggagtgcgggtcagccccgagcagatcgaggaggcggtggaggccgtggtcagccggcaccgggaggagctgctggcggagcggtaccacttcaacacggggctgctgatggcggaggcgcggagccggctgcagtgggcggatgggaagagcatcaagaacgaggtggatctgcaggtgctgcatttgctgggaccaaagacagaagctgatctggaaaagaaaccaaaggctgccaaggcccggccagccccagtggagaagcagaaggcagccgtggtggagaatggtgaggtgggcgcagagacaaagtcactgctggagcagctgcgaggagaagctctgaaattccacaagccgggagagaactacaaaacggagggctacgtggtgacacccaacaccatggctctgctgaagcagcacctggcgctcacgggtgggcaggtgcggacgcggttccctcctgagcccaatggcattctgcacatcggccatgccaaggcaatcaacttcaactttggttacgccaaggccaacgggggcatctgcttcttgcgctatgacgacaccaaccctgagaaagaggaggagaagtacttcacggccatccgggagatggtggagtggcttggctaccagccctacgctgtgactcatgcctcagactactttgaccagctctacacctgggctctggagctcatccgcaggggacaagcctacgtctgccatcagaaggttgaggagatcaagggtcacaacccaccaccgtcaccgtggcgggaccggcccgtggaggagtcactagtgctctttgaggacatgcgaaaggggaagtttggggagggggaggccacgctgcggatgaagctggtgatggaggatgggaagatggaccccgttgcctaccgcgtcaagttcacaccacaccaccgcaccggggacaagtggtgcatctacccgacgtatgactacactcactgcctttgcgactccatcgagcacatcacgcactccctctgcaccaaggagttccaggccaggcgctcctcctacttctggctgtgcaacgcgctggacgtgtactgccctgtgcagtgggaatacggccgcctcaacctgctttacaccgttgtctccaagagaaagatcatccgcctggtggagactggggctgtgcgggactgggatgacccacggctcttcacgctgacagccctgcgccggcgaggcttccctcctgaggccatcaataacttctgtgcacgggttggtgtgacagtggcccaggcgacgatggaaccccacttgctggaggcgtgtgtgagggatgtactgaatgagcaggccccccgcgccatggccgtgctggagcccctcaaggtcaccatcaccaacttcccagccccccaggcaatcgatgtcctcgtgcccaactttcctgctgatgagagccggggcttccacaaagtgcccttccagtccgtcgtctacatcgtggagagcgacttcaaggaggaggcagacaggggctacaagcgcctggccctcgggcagccagtggggctgcggcacaccggctacgtcatcgccgtgcagaatgtcatcaaggatgcccgtgggcgtgtcattgagctggaggtgacctgcaccaagtctgacgcagcggagaagcccaaagccttcatccattgggtgtcagagccgcgggtgtgcgaagtgcggctgtatgagcggctgtttttgcacaaaaaccccgaggacccttcggaggtgccgggtggattcctgagcgacctcaaccctgactccctacgtgtggtggacgatgccctggttgacagctctgtcctcggggcacggccctttgataagttccagtttgagcgcttgggctacttctcagtggatcctgacagcactgacagcaagctggtgttcaaccggactgtgacgctgaaggaggaccccggcaaagcctga

SEQ ID NO: 91020 - protein, 780 aa, Gallus gallus
MAAMAATEEAEALDLFTGIGLTEAKARETLRNAALSAQLRQAVLQARAALGSGLDKATGALLYNAAARLRDPDRLAFVVGYIGRREIRTDQQLGAALQYLRSHPLEPLEPADFERACGVGVRVSPEQIEEAVEAVVSRHREELLAERYHFNTGLLMAEARSRLQWADGKSIKNEVDLQVLHLLGPKTEADLEKKPKAAKARPAPVEKQKAAVVENGEVGAETKSLLEQLRGEALKFHKPGENYKTEGYVVTPNTMALLKQHLALTGGQVRTRFPPEPNGILHIGHAKAINFNFGYAKANGGICFLRYDDTNPEKEEEKYFTAIREMVEWLGYQPYAVTHASDYFDQLYTWALELIRRGQAYVCHQKVEEIKGHNPPPSPWRDRPVEESLVLFEDMRKGKFGEGEATLRMKLVMEDGKMDPVAYRVKFTPHHRTGDKWCIYPTYDYTHCLCDSIEHITHSLCTKEFQARRSSYFWLCNALDVYCPVQWEYGRLNLLYTVVSKRKIIRLVETGAVRDWDDPRLFTLTALRRRGFPPEAINNFCARVGVTVAQATMEPHLLEACVRDVLNEQAPRAMAVLEPLKVTITNFPAPQAIDVLVPNFPADESRGFHKVPFQSVVYIVESDFKEEADRGYKRLALGQPVGLRHTGYVIAVQNVIKDARGRVIELEVTCTKSDAAEKPKAFIHWVSEPRVCEVRLYERLFLHKNPEDPSEVPGGFLSDLNPDSLRVVDDALVDSSVLGARPFDKFQFERLGYFSVDPDSTDSKLVFNRTVTLKEDPGKA

SEQ ID NO: 91021 - DNA, 1731 bp, uncultured archaeon GZfos3D4
  CDS (1)..(1731)
atggaagaaacggggaccaggacaaaaataaggaaatatgcgctgcagaatgcagtgaagtatgagaaaccacctaaagaggatgcagtagtgaagaaggttcttgccgaacatccagaattgaggaagaatgcgaaacaggttttgatgtcggtgaaagaggagataaagagaatagagtcaatgagcaaggaagagcgagtagaagaattgaataagatagcaccggaattggtagcggagttaaaactgaaagagaaagaaaaacgtgaacctggactacccgaactgcctcttgcggaaggcgaaaaagttgtgatgcgattcgcacccaaccccaacggcgctgcgacactcggcagtacgcgaggcataatcgtgaattcggagtatgtgaagatgcacggtggtaaattcattctgaggtttgacgacaccgaccctgtattgaagcgacctttactcgaagcttatgactggtatcttgaggattgtgcgtggctggatgccgagccagatgaggtggtagtggcgtcggaacgcatggatttgtattacaaatatgcggaagagctgctaaaaaaaggtgttgcgtatgtctgcttttgtcctgcagagacatttaagcagtataaagaccacaagcgaccctgccctcacagggctgccgatattgaagagaatatgggctgttggaaaaagatgttaaatggcgtctatgaagaaaaagaagcagtgctgcggataaaaacggatatggcaagtgcagatccggctttacgcgattgggtcgcactcagaattttaaaacgggcgcatccgagggttggcgataaatacgtggtgtggccaacgctggatttcgaatccgcaatagaagaccacttgcttggcataacgcacataatacgtggaaaagacctgatgaaatcggaaaagcggcagcggttcttatacgaccatctcggctggcgatatccaaggacaatggtttggggtaggataaaaatgcaggagttcggtaaattaagcacttccgagctgagaaagaggatagaaaacggcgaatacgaagggtgggacgaccctcaactgccaacgctaaaagcacttcgcagaagagggtttcagccagaagcgattcgcagattctttatctctatcggagttactcaaaccgacatcgcagtgagcatgaagaacatgtatgcagagaacaggaaagccgtggatgcgctcgcatcgagatacttctttgtgcgtaatccgaaagaaatgagaataaaccgttctttaaaaaagaaagctttaccaaaggaaggcaattattttgtggctaaggcattaaagcatccttcaaaagaggattatagggagataagaaccagcaatacggtttacataagtggtgatgatttcgttaaaatgaaaaaagggcacgaaataaggttgaaatatctttgcactgtgaaaatagagagtattaagccattagtagccaatgtcatagaagaaccgacagaagatattcctattgttcaatgggcgccatcagaaggtataaaagtcatagtgaaaaagcctgacgggacagatgaaggcataggcgagcctttgattgcttcggaactcgacaatgtggtgcagttcgaaagatacgggttcgtcaggattgactcggtggtggaaaaagaagagggaaaagaagtggtggcatatttcacgcattag

SEQ ID NO: 91022 - protein, 576 aa, uncultured archaeon GZfos3D4
MEETGTRTKIRKYALQNAVKYEKPPKEDAVVKKVLAEHPELRKNAKQVLMSVKEEIKRIESMSKEERVEELNKIAPELVAELKLKEKEKREPGLPELPLAEGEKVVMRFAPNPNGAATLGSTRGIIVNSEYVKMHGGKFILRFDDTDPVLKRPLLEAYDWYLEDCAWLDAEPDEVVVASERMDLYYKYAEELLKKGVAYVCFCPAETFKQYKDHKRPCPHRAADIEENMGCWKKMLNGVYEEKEAVLRIKTDMASADPALRDWVALRILKRAHPRVGDKYVVWPTLDFESAIEDHLLGITHIIRGKDLMKSEKRQRFLYDHLGWRYPRTMVWGRIKMQEFGKLSTSELRKRIENGEYEGWDDPQLPTLKALRRRGFQPEAIRRFFISIGVTQTDIAVSMKNMYAENRKAVDALASRYFFVRNPKEMRINRSLKKKALPKEGNYFVAKALKHPSKEDYREIRTSNTVYISGDDFVKMKKGHEIRLKYLCTVKIESIKPLVANVIEEPTEDIPIVQWAPSEGIKVIVKKPDGTDEGIGEPLIASELDNVVQFERYGFVRIDSVVEKEEGKEVVAYFTH

SEQ ID NO: 91023 - DNA, 2391 bp, Oryza sativa
  CDS (1)..(2391)
atggcgaccggagaagcggcggcggcggcggcgtcgccgccggagctggcgtcgttcctggcgatcgggcttgaccagcgcacggcggagaacgccctcgccaaccgcaaggtcaccgccaacctcaccgccgtcatcgccgaggctggtgttagtgggtgtgacaaatctgtggggaatcttctctacactgtcgcgacgaagtatccggcgaatgccctggtgcatcgtcccgttgtcatccaatacattgtgtcgtcaaagatcaagacccccgcgcaattagatgctgctctgtcgtttctttctactttgggtcctgatccattggacacagcaaagtttgaagagacatgtggagtgggggtggttgtttcaactgaagagattcagtcaatggtcactgatatcctgaaggaaaacatggaagccatagttgaacagcgatatcatataaatgttggcagcttgtgcggacaggttaggaagtggcacccctggggcgatgctaagttcataaaggaggaaattgataaaaggcttacagagattcttggtccaaagacagaagctgacaatgtaaagcctgtgaaaaagaagaaggagaagcccgcaaaagttgaggagaaaaaaactgcggtagctgctcctgctccaccatctgaggaagaacttaatccctactccatatttcctcaaccggaggaaaacttaaaggtccatacagaaattttcttcagcgatggaaatatatggagagcacacaacagaaaggacattttagagaaacatcttaaagcaactggaggaaaagtgatgacccgctttcccccagagcctaatggctaccttcatattggtcatgctaaggctatgtttattgattttggactggctaaagagcgcaacggacattgttaccttaggtttgatgatacaaaccctgaggcggagaagaaagaatatatagatcacattcaagaaattgtccgatggatgggctgggagccttataaagttacctatacaagtgactatttccaagaattatatgaacttgctgtttgtttgataaagaagggactagcttatgtcgatcaccagacaccagaagagataaaggagtatagagaaaagcaaatgaatagtccatggagggataggcctatagaagagtcactaaaactgtttgaagatatgaggcatgggttggttgctgagggaaaggcaactcttaggatgaaacaagacatgcagaatgataacaagaacatggctgacttaatagcatatagaataaagtttacacctcatccccatgctggcgacaagtggtttatctatccaagctatgactatgctcattgtttggttgactctcttgaaaacattacccattcgttgtgcacactagaatttgacatacgtcgtccttcatactactggctgctcgtatccctggaccagtaccagccatatgtttgggaatattcaaggttaaacatatcaaacaatgttatgtccaagcgaaagctaaataaacttgtgacagagaagtgggtagatgggtgggatgatcctcgcctgttgacacttgcaggactacggcggagaggagtatcatcaacagcaattaactcctttattcgtggaatgggcataacaaggagtgacaacagtttgatacgcttagaacgccttgagtatcatattagagaagagctcaacaaagtagctcctcgtgctatggttgttttgcatcccctaaaggttgttataaataatttagactatggaacaataatagaccttgatgcaaaaaagtggcccgatgctccaggagatgatgcttcggcctattacaaggttccattctcaagaactgtctacatcgagcagtctgattttcgtgtaaaggattcaaaagattattatgggcttgctcctggtaaaacagtactactaaggtatgcattcccaataaaatgtacggaagttatctatggtgataattcagataatatcattgaaatccgagctgagtatgacccttcgaaggctacaaaaccaaagggtgtgttgcactgggttgccgaaccttctccaggtgttaacccgctcaaagtggaaatcagattgttcgagaaattatttctttcagagaatcctgtggagcttgaggattggctgggtgatctcaacccacgatcaaaggaagtgataaagggtgcctatgccgtgccttcgcttgcaactgcagcgctgggggacaaatttcagtttgaacgcctcggttactttgctgtggattccgactcgacggctgaggaacttgtgttcaacagaaccgttactctacgggattcctatggaaaagctggacccaagtga

SEQ ID NO: 91024 - protein, 796 aa, Oryza sativa
MATGEAAAAAASPPELASFLAIGLDQRTAENALANRKVTANLTAVIAEAGVSGCDKSVGNLLYTVATKYPANALVHRPVVIQYIVSSKIKTPAQLDAALSFLSTLGPDPLDTAKFEETCGVGVVVSTEEIQSMVTDILKENMEAIVEQRYHINVGSLCGQVRKWHPWGDAKFIKEEIDKRLTEILGPKTEADNVKPVKKKKEKPAKVEEKKTAVAAPAPPSEEELNPYSIFPQPEENLKVHTEIFFSDGNIWRAHNRKDILEKHLKATGGKVMTRFPPEPNGYLHIGHAKAMFIDFGLAKERNGHCYLRFDDTNPEAEKKEYIDHIQEIVRWMGWEPYKVTYTSDYFQELYELAVCLIKKGLAYVDHQTPEEIKEYREKQMNSPWRDRPIEESLKLFEDMRHGLVAEGKATLRMKQDMQNDNKNMADLIAYRIKFTPHPHAGDKWFIYPSYDYAHCLVDSLENITHSLCTLEFDIRRPSYYWLLVSLDQYQPYVWEYSRLNISNNVMSKRKLNKLVTEKWVDGWDDPRLLTLAGLRRRGVSSTAINSFIRGMGITRSDNSLIRLERLEYHIREELNKVAPRAMVVLHPLKVVINNLDYGTIIDLDAKKWPDAPGDDASAYYKVPFSRTVYIEQSDFRVKDSKDYYGLAPGKTVLLRYAFPIKCTEVIYGDNSDNIIEIRAEYDPSKATKPKGVLHWVAEPSPGVNPLKVEIRLFEKLFLSENPVELEDWLGDLNPRSKEVIKGAYAVPSLATAALGDKFQFERLGYFAVDSDSTAEELVFNRTVTLRDSYGKAGPK

SEQ ID NO: 91025 - DNA, 2325 bp, Brachydanio rerio
  CDS (1)..(2325)
atggcggacgtggtgtcttctttcatgtcaattggccttagtgagcagaaagctaaggaaacgttgaagaatgaaacactttcatcaacactcaagaaagccattgatctggctcaagtccagctggggtcttctgccattgacaagatcactggcactctgttgtacagtatggtgacacgacttaaagacacgaacaggcctcaatttctcacaaaatacatcatttcacgaaaaatcacaacagaactgcagctgtcagcggctttggactttgtgaaaagccaccctcagggcgatgtggatcagcacaagtttgaggtggcctgtggtgtgggaatggttgtcacacctgagcagatagaggacgcagtggaattgattatcaggaaacacaaagatcagctgttggcagagagatatcgcttcaacatggggatactcatgggtgaggccagagccactcttaaatgggctgatgggaagattgtcaagaatgaagtggatatgcaggtgttgcaccttctcggtccaaaaactgaggcggatctggaaaaaaagagcaaggcagtcaaacccaaagcaccagaaaaagatgtgaagattgagcaggcttctgcagtaaacggtgatgggaacattgagaataagtcattgatggagcagctgagaggagaagctcttaagttccataagccaggggagaattacaaaacggagggttatgttgtaacacctaacaccatgaacttgctgaagaagcacttggaagaaactggaggacaggtccgcacacgtttccctcctgagcctaatggtattctgcatattggccatgccaaagcaatcaacttcaattttggtttcgccaaggccaacaacggcatctgttttctgcggtatgacgacacaaacccagagaaagaggaggaaaaatacttcaccgccatcaaagacatggtggagtggcttggatatgaaccatatgctgttacacacgcctctgataacttccagcgtctctacaatcttgctgttgatctcattcgcaggggtcatgcatatgtgtgccaccagcgcggagaggagctcaagggtcacaacgtcccttcctctccctggagagagcgacccgtggaagagtctttggttttgtttgagcacatgaggaagggaatgtttgcagaaggggaagccactctcagaatgaagatggtcatggaagatggcaaaatggacccggtggcatatcggatcaaatacacgccacatcacaggacaggagacacttggtgcatataccccacatacgattacacgcactgtctgtgcgactccattgagaacatcacacactctctgtgcaccaaagagtttcaggccagacgatcatcatatttctggttgtgcaatgctctggatgtgtattgcccggtgcagtgggaatatggccgactgaacctcacttatactgtcgtttccaagagaaagatcatcaaattggtggaaacaggagttgttagggattgggatgatcctaggctttttaccctcacagctctcaggagacgtgggttccctccacaagccatcaacaatttctgtgcccgggtgggtgtaactgttgctcagactacaatggagccacacctgctggaggcgtgtgttcgggaggtcctaaatgacactgctcctcgtgccatggccatactcgagcctctcaaggtcacaatcatcaacctgccaactaatgcacagaaggagcttagagtcccagacttcccagccaatgaagcaaggggcagccatgtggttcccttctcaaagaccatctttattgagcagagcgacttcagagaggtgatggagaagggttataagcgcctgactccagatcagtcagtgggcttgagatatgcaggatacgtcatctctgtacagcgtgtcatcaaggatgaccgtggtaaagtatgtgagctcgaggtgacctgcgtcagctccgacactgcagagaaacccaaagcgtttattcattgggtgagcgagccactgctgtgtgaagtgcgcctctatgaaagactgtttcttcataaaaacccagaggacccggcggaagttcctgctggattcctgagtgacattaacccaaattccttaacagttatcgaaagtgccttagtggaccgctctgtgggcaaagccaaagtgtttgacaagttccagtttgagagagtgggctacttttcagtggatgctgacagcacacccgaaaagctggtgttcaacaggactgttacactcaaggaggatccaggaaagatatga

SEQ ID NO: 91026 - protein, 774 aa, Brachydanio rerio
MADVVSSFMSIGLSEQKAKETLKNETLSSTLKKAIDLAQVQLGSSAIDKITGTLLYSMVTRLKDTNRPQFLTKYIISRKITTELQLSAALDFVKSHPQGDVDQHKFEVACGVGMVVTPEQIEDAVELIIRKHKDQLLAERYRFNMGILMGEARATLKWADGKIVKNEVDMQVLHLLGPKTEADLEKKSKAVKPKAPEKDVKIEQASAVNGDGNIENKSLMEQLRGEALKFHKPGENYKTEGYVVTPNTMNLLKKHLEETGGQVRTRFPPEPNGILHIGHAKAINFNFGFAKANNGICFLRYDDTNPEKEEEKYFTAIKDMVEWLGYEPYAVTHASDNFQRLYNLAVDLIRRGHAYVCHQRGEELKGHNVPSSPWRERPVEESLVLFEHMRKGMFAEGEATLRMKMVMEDGKMDPVAYRIKYTPHHRTGDTWCIYPTYDYTHCLCDSIENITHSLCTKEFQARRSSYFWLCNALDVYCPVQWEYGRLNLTYTVVSKRKIIKLVETGVVRDWDDPRLFTLTALRRRGFPPQAINNFCARVGVTVAQTTMEPHLLEACVREVLNDTAPRAMAILEPLKVTIINLPTNAQKELRVPDFPANEARGSHVVPFSKTIFIEQSDFREVMEKGYKRLTPDQSVGLRYAGYVISVQRVIKDDRGKVCELEVTCVSSDTAEKPKAFIHWVSEPLLCEVRLYERLFLHKNPEDPAEVPAGFLSDINPNSLTVIESALVDRSVGKAKVFDKFQFERVGYFSVDADSTPEKLVFNRTVTLKEDPGKI

SEQ ID NO: 91027 - DNA, 2319 bp, Xenopus laevis
  CDS (1)..(2319)
atggctgctgagtcgctgtccctcttcacagccatcggtcttagtgagcagaaggctcgggaaaccttaaagaatgaggcgcttagcttgttgcttcgggacgcgattgtacaggcccagaaaacattgggtccatctgtcgacaaggtgaccggaactctcctgtacaatgtggcaactcgccttaaagatacgaagcggttgggctttctggttgaatacatagccagcaagaagattaccacagacctgcagttaaatgctgccctggactatgtcaaagctcatccactggatcctattgacaccggtcattttgagaaagattgtggcgtgggggtgactgttaccccagaacagatagaagaagctgtggaagctgtgattcagaaattcagagcacagttgttggccgaacgctatcgctttaacatgggcttgttaatgggggaagccaggaaccagctgaagtgggcagatgggaagattatcaagaatgaggtagatatgcaggttttgcacttacttggcccaaagactgaagctgatctagaaaagaaaccaaaggtgacaaagccaaaagctacagaaccagagaagaaaggagatgccactgtgaatggtgacgtgaaactggagtccgtatctctgatggagcagcttaggggagaggcccttaaattccacaaacccggtgagaattacaagactgaggggtacgtggttacaccgaaaaccatggagctgctgaagaaacatcttgaaatcacaggaggacagatcagaactcggttccctccagagccaaatggcattttgcacattggtcacgccaaggccatcaactttaactttggatatgcaaaggcaaatggaggcatctgctttctgcgctatgatgacaccaacccagagaaggaggaagaaaagtattttactgccattaaggatatggtagaatggcttggttacaagccctatgctgtgactcacgcctccgacaactttaaccagctgtatgagtgggcggtggaactcattagaagaggtcaagcttatgtttgccatcagaaagttgaagaaattaaaggtcacaacccaccaccttccccatggagagatcgtccagttgaagaatcccttctgctctttgaaggtatgaaaaagggaaagtttgcagagggagaagcgacactgcgaatgaagcttataatggaagatgggaaaatggatcctgtggcatatcggatcaagtacacaccacatcaccgaactggggacaaatggtgtatatatccaacctatgactacactcactgtctctgcgattctattgaacatataactcactctctgtgtaccaaggagtttcaggctaggcgatcgtcatatttctggctatgtaacaccttagatgtctactgccctgtgcagtgggaatatggacgattaaacctgcactacactgtcgtatcaaagcggaaaatcatcaaactggtcgaaactggagctgtcagggactgggatgaccctcgtctcttcacgctgacagctttacgccgcagaggattcccaccagaagccattaataacttctgtgcaagggttggggtgactgttgctcagactacaatggagccacacttgctggagtcgtgcgtcagagatgtactcaatgagacagccccaagaataatggcagtgctggaacccctgaaagtaaccataacaaatctccctgctgagaaagccatcgatgtctctgttccaaatttcccagcggatgaatccaaaggctttcatgttgttcccttctcctccaccatttacattgagcagtcggatttcagagaggtaatggagaagggatataagcgcctaaccccagatcagccggtaggcctcagacacgctggctatgttatctccttgcaaaatattgtgaaggatcaaagcggcaacgtgattgaactggaagttacgtgcacaaagacagacgtcgctgaaaagccaaaagcattcatccactgggtgtctgatcctctgacgtgtgaagtgcgtctgtacgacaggctgttcctccacaaaaccccagaagatccatctgaagttcctggtggtttcttaactgatctgaatacgaactccttgacgacaatccccagtgctttagtggaacggtctgtgaagaatgccaaagccctggacaagttccagtttgagagacttggttatttttcagtggatccagacactactccggaaaagattgtcttcaacaggactgttaccctgaaggaagatccaggaaagatgtga

SEQ ID NO: 91028 - protein, 772 aa, Xenopus laevis
MAAESLSLFTAIGLSEQKARETLKNEALSLLLRDAIVQAQKTLGPSVDKVTGTLLYNVATRLKDTKRLGFLVEYIASKKITTDLQLNAALDYVKAHPLDPIDTGHFEKDCGVGVTVTPEQIEEAVEAVIQKFRAQLLAERYRFNMGLLMGEARNQLKWADGKIIKNEVDMQVLHLLGPKTEADLEKKPKVTKPKATEPEKKGDATVNGDVKLESVSLMEQLRGEALKFHKPGENYKTEGYVVTPKTMELLKKHLEITGGQIRTRFPPEPNGILHIGHAKAINFNFGYAKANGGICFLRYDDTNPEKEEEKYFTAIKDMVEWLGYKPYAVTHASDNFNQLYEWAVELIRRGQAYVCHQKVEEIKGHNPPPSPWRDRPVEESLLLFEGMKKGKFAEGEATLRMKLIMEDGKMDPVAYRIKYTPHHRTGDKWCIYPTYDYTHCLCDSIEHITHSLCTKEFQARRSSYFWLCNTLDVYCPVQWEYGRLNLHYTVVSKRKIIKLVETGAVRDWDDPRLFTLTALRRRGFPPEAINNFCARVGVTVAQTTMEPHLLESCVRDVLNETAPRIMAVLEPLKVTITNLPAEKAIDVSVPNFPADESKGFHVVPFSSTIYIEQSDFREVMEKGYKRLTPDQPVGLRHAGYVISLQNIVKDQSGNVIELEVTCTKTDVAEKPKAFIHWVSDPLTCEVRLYDRLFLHKTPEDPSEVPGGFLTDLNTNSLTTIPSALVERSVKNAKALDKFQFERLGYFSVDPDTTPEKIVFNRTVTLKEDPGKM

SEQ ID NO: 91029 - DNA, 1596 bp, Schistosoma mansoni
  CDS (1)..(1596)
atggtagtgaatggtgacagtgacgtagtgggagaagctgctaagtttcacaagccaggcgaaaattataattctcccggttatgttgtgactaaagatactatgaggttattgaaagaacacatgaagcaaaccgatggtatagtagttaccaggtttcctcctgaaccaaatggtattttacacatcggccacgcaaaagcaattaattttaactttggttatgcaaagaaacatggtggcataacctacttgcgatatgatgatacaaaccctgagaaggaagaggcagagtttttcgaagctattgaggacatggttcgatggctggggtttactccgcacaaaattacttatgcctcggataatttccaacagttatacgaatgggcaattgagttaatcaaattgaagttagcttatgtttgccatcaggccgtagaagaaatacgaggttttaacccaccaccttcgccatggagagacagaccgattgaggaatccttgcgattgtttgaggatatgaaaaacggcaagattgacgaaggtatggctactttacgtatgaaagtgacattgggcgatggaaaagtcgatccagtagcttatcgcatcaagatgactcctcatcatcgtactggtactgaatggcgtcctgcctactattggctttgtaattcactaaatatttattgtccagttcagtgggagtatggccgcctcaatctgtattatagtgtggtgtcaaagcgcaaaattttaaagctgatagaagccggcattgttaatgactgggatgatccacggttagttactttgacagcactccgtcgtcgtggatttccacctcaagctattaatatgttttgtgaacgtattggcgttactatggctcaaacaatcctagatccttctgctttagatgcttgcgtacgggactatctgaatgatcatgcaccacgtgtgatggctgttttagagccaataatagtcactattacgaattggtgtgaactatatggcaataaatcttctgtcgagcttacagttgcggattttcctgccattccagacagtaaaacccatagtgtactgttgcaacaggagctgtacatagaaagttcagattttcaagaagttgctgagaaaggatatcgtcgtttaacccctaatcaaccagttggtcttcgttacgcgggccttgttatagaatttttcgatttaaaaaaagattccaatgggaaaatatctcatttatttgtgaaagcccagaaggtagaggattctactaagccaaaagcttttatacattgggtgtccaatcctttgcactttgaagctcgactgtatgaccgcttgttcactgtcaaggagccagaaaacgaaaagaatggattcttgtctgtcattaataaaaattcattagtcgtaattccggatgctttgattgaacaatctgtcaaaaatgctgaggtttacactgcctatcaatttgaacgtatcggtttcttctctgtggaccctgatacaaactcaaaacatatggttttcaatcgaactgttgctctaaaagccgatcctggtaaaacgatttga

SEQ ID NO: 91030 - protein, 531 aa, Schistosoma mansoni
MVVNGDSDVVGEAAKFHKPGENYNSPGYVVTKDTMRLLKEHMKQTDGIVVTRFPPEPNGILHIGHAKAINFNFGYAKKHGGITYLRYDDTNPEKEEAEFFEAIEDMVRWLGFTPHKITYASDNFQQLYEWAIELIKLKLAYVCHQAVEEIRGFNPPPSPWRDRPIEESLRLFEDMKNGKIDEGMATLRMKVTLGDGKVDPVAYRIKMTPHHRTGTEWRPAYYWLCNSLNIYCPVQWEYGRLNLYYSVVSKRKILKLIEAGIVNDWDDPRLVTLTALRRRGFPPQAINMFCERIGVTMAQTILDPSALDACVRDYLNDHAPRVMAVLEPIIVTITNWCELYGNKSSVELTVADFPAIPDSKTHSVLLQQELYIESSDFQEVAEKGYRRLTPNQPVGLRYAGLVIEFFDLKKDSNGKISHLFVKAQKVEDSTKPKAFIHWVSNPLHFEARLYDRLFTVKEPENEKNGFLSVINKNSLVVIPDALIEQSVKNAEVYTAYQFERIGFFSVDPDTNSKHMVFNRTVALKADPGKTI

SEQ ID NO: 91031 - DNA, 2361 bp, Arabidopsis thaliana
  CDS (1)..(2361)
atggttctcaaagacgataactccgagaaatctattgagctcttcattagtattggtttggacgagaaaacagctcgtaataccatcaataataacaaggtcaccgccaatctcaccgccgttatccacgaggctgctgttactgatgggtgcgatcgaaatactggcaatctgttatactcggtcgctactaagttccctacaaatgctcttgtgcatcgccctacattgctcaagtacattgttaactctaagattaaaactccagcccaattggaagctgcatttgccttttttgccagtaccggtcctgaggactttaagctgaatgagtttgaagaggcatgtggtgttgggattgaagtttccccagaagatattgagaaagcagttaaaggaatctttgaagagaataagaaaacaatattggagcagcgctatcgaactaatgtgggtgaattatttggacatgtccggaaaagtttgccatgggccgatcctaagattgtaaagaaactcatagatgagaaaatgtatgagctgcttggtgagaaaaccgctgctgataatgaaaaacctacaaaaaagaaggagaagaaggagaagcctgccaaagtcgaggaaaagaaagctgtggtggaaactaccgcagagccatctgaagaggagcttaatccatatactatattccctcagccagaacaaaattttatggttcacacagaagtgtttttcagtgatggctctattctcagatgtagcaatacaaaggaagtacttgacaaacatctcaaggtgactggagggaaagtttatactcggttcccccctgaaccaaatggttatcttcatattggacatgccaaggctatgtttgttgattttggtcttgcaaaggagcgagggggttgctgttatctaaggtatgatgatacaaatccagaggcagaaaaggaagagtatattaatcatattgaagaaattgttaagtggatgggttgggaacccttcaaggaactgtatgatttggcagtggagttgattcggagaggtcatgcttatgttgatcatcagactgctgatgagataaaagagtacagagagaagaaaatgaacagcccctggagggacagacctattgaagaatctctaaaactttttgatgaaatgagacgaggcatcattgaggaagggaaggcaaccctaagaatgaagcaagatatgcagagtgacaattttaatatgtatgatcttattgcctatcgaataaagttcgcacctcatcctaaggctggtgacaagtggtgtatctatccgagttatgattatgcccactgcactgttgattctcttgagaatataacgcattcgctctgtactcttgaatttgaaacccggcgtgcttcatactattggctgttacattccctgagtctctacatgccatatgtgtgggaatattcacggttgaatgtgacaaacactgtaatgtccaagcgtaagttgaattacatagtgacaaacaagtatgttgatggttgggatgatccacgtcttttgacactttctggtttgagacggaggggtgtgacttcaactgcgattaatgcatttgtacgaggcattgggattactagaagtgatggtagcatgatacacgtaagtcgtcttgagcatcatattagagaggaattgaataaaacagcccctcgcaccatggtggtgcttaatcctcttaaagtggtcatcaccaatttggaatcagacaagcttatagagcttgatgccaaaaggtggcctgatgctcagaacgatgatccctcagcattctacaaggtaccgttctctagagttgtatacattgaccaatctgacttccgaatgaaggattcaaaagattattatgggctcgcccctggtaaatctgttttgctaagatatgctttcccaatcaagtgcaccaatgttgtctttgctgatgacaatgaaaccgttcgtgagattcatgcggaatatgaccccgagaaaaagtcaaagccaaagggggttctacactgggtcgctgaatcttccccaggagaagagcccataaaggtggaagtccgattatttgagaaactctttaactccgagaacccggctgaactcaatgatgcttggctcactgacattaacccaaactctaaaatggtaatttctggtgcctatgctgtatcaacccttaaagatgctgcagttggggacagattccaattcgagaggctaggttattacgcggtggacaaggactctgagccaggaaagcttgtgttcaaccggacggtcacactcagagacagctacgggaaaggtggaaagtaa

SEQ ID NO: 91032 - protein, 786 aa, Arabidopsis thaliana
MVLKDDNSEKSIELFISIGLDEKTARNTINNNKVTANLTAVIHEAAVTDGCDRNTGNLLYSVATKFPTNALVHRPTLLKYIVNSKIKTPAQLEAAFAFFASTGPEDFKLNEFEEACGVGIEVSPEDIEKAVKGIFEENKKTILEQRYRTNVGELFGHVRKSLPWADPKIVKKLIDEKMYELLGEKTAADNEKPTKKKEKKEKPAKVEEKKAVVETTAEPSEEELNPYTIFPQPEQNFMVHTEVFFSDGSILRCSNTKEVLDKHLKVTGGKVYTRFPPEPNGYLHIGHAKAMFVDFGLAKERGGCCYLRYDDTNPEAEKEEYINHIEEIVKWMGWEPFKELYDLAVELIRRGHAYVDHQTADEIKEYREKKMNSPWRDRPIEESLKLFDEMRRGIIEEGKATLRMKQDMQSDNFNMYDLIAYRIKFAPHPKAGDKWCIYPSYDYAHCTVDSLENITHSLCTLEFETRRASYYWLLHSLSLYMPYVWEYSRLNVTNTVMSKRKLNYIVTNKYVDGWDDPRLLTLSGLRRRGVTSTAINAFVRGIGITRSDGSMIHVSRLEHHIREELNKTAPRTMVVLNPLKVVITNLESDKLIELDAKRWPDAQNDDPSAFYKVPFSRVVYIDQSDFRMKDSKDYYGLAPGKSVLLRYAFPIKCTNVVFADDNETVREIHAEYDPEKKSKPKGVLHWVAESSPGEEPIKVEVRLFEKLFNSENPAELNDAWLTDINPNSKMVISGAYAVSTLKDAAVGDRFQFERLGYYAVDKDSEPGKLVFNRTVTLRDSYGKGGK

SEQ ID NO: 91033 - DNA, 2151 bp, Schizosaccharomyces pombe
  CDS (1)..(2151)
atgtcagttagtgttgcattaaaagcaaagcccattgcttatggtgcagttgcatgtgcaaattatgtgaatctgtctggtgcaggaagcatttccgtcaagtatgaggacgttgctttattagacaaacaaaacaaggaatcgaacgtctccattcagcttaacggctctgattctcctgtattcggttccaagttggctttacagactttctctcaagtctatcctaaacttttcattggcgaaaacgatcgttctttggttgagagttgggtggaaactgcctctgccttagctggtaaccacaactttcttgagctttcttcacttcttgctcagttagacgaccatttaattatgcgctctctttttgtgggttattccctcacctctgctgatttttctatttggggtgccttaaaatcaaacaacatggcagctggtgccgtacgcactggccagtatttcaaccttgctcgttggtacaagtttatggattctcaaaatgccgtgagtgtcaccatggaagaattcaccaaggcagttaatattagcaaaaaacaaaaatcttctggtcctaactacgagatcggtcttcctgatgccattgatggtaaggtggtcaccagatttcctcccgaacctagtggatatttgcacattggacacgcaaaggccgcacttttaaatcaatattttgctaacaaataccacggaaaactgattgttcgtttcgatgacaccaatcctagtaaagaaaactcagaatttcaagacgccattttggaggatgtcgccttactcggtattaagcccgacgtcgtcacttatacatctgactatcttgacactattcatcaatattgcgttgatatgatcaaatcaggccaagcttatgctgatgatactgacgttgaaactatgcgccatgagcgtaccgaaggaattcccagcaagcatcgtgaccgtcctatcgaggagtccctagagattctctctgaaatggataagggttcagacgtcggtctcaagaactgcattcgtgccaagatttcatatgaaaatcccaacaaagcaatgcgcgaccccgtcatttaccgttgcaatttattacctcaccatcgtactgggaccaagtatcgtgcttatcctacttatgactttgcttgtcccattgtcgactccctcgagggtgtaacacatgcattgcgcactactgagtaccgtgatcgcaatcccttatatcaatggatgattaaggcaatgaacctccgtaaaatccatgtttgggaattttctcgtatgaactttgtacgtacattgttaagtaagcgtaagcttactgagattgttgaccacggtcttgtttggggatgggatgatcctcgtttccccaccgttcgtggtgtccgtagacgtggtatgaccattgaagcattacaacaatacatcgtctctcaaggtcctagtaaaaacatccttactttggattggacttctttctgggcaaccaataagaaaatcattgatcccgttgctccacgccatacagctgtcgaaagcggtgatgttgtcaaagctaccatagttaatggtcctgctgctccttatgccgaagaccgtcccagacataagaagaacccagagttagggaacaagaagagcatttttgctaatgaaattttaattgaacaagctgatgctcaatctttcaagcaggacgaagaggttactctgatggactggggtaatgcatatgttcgcgaaatcaatcgtgatgcttctggtaaagttacctcccttaaacttgaactccacttggatggtgactttaagaaaactgagaagaaagtcacttggttggctgatacggaggacaaaactcctgtcgaccttgttgattttgactatcttattaccaaggacaaacttgaagaaggagaaaactataaggacttcctaactcctcaaactgaattccactctcccgtctttgctgacgttggaatcaagaatttaaagaagggtgatataattcaagttgagcgtaaaggttattacattgttgatgttccatttgatggtacgcaggctgttctcttcaacattccagacggtaagactgtaaatcgttacggcgttaaaaattag

SEQ ID NO: 91034 - protein, 716 aa, Schizosaccharomyces pombe
MSVSVALKAKPIAYGAVACANYVNLSGAGSISVKYEDVALLDKQNKESNVSIQLNGSDSPVFGSKLALQTFSQVYPKLFIGENDRSLVESWVETASALAGNHNFLELSSLLAQLDDHLIMRSLFVGYSLTSADFSIWGALKSNNMAAGAVRTGQYFNLARWYKFMDSQNAVSVTMEEFTKAVNISKKQKSSGPNYEIGLPDAIDGKVVTRFPPEPSGYLHIGHAKAALLNQYFANKYHGKLIVRFDDTNPSKENSEFQDAILEDVALLGIKPDVVTYTSDYLDTIHQYCVDMIKSGQAYADDTDVETMRHERTEGIPSKHRDRPIEESLEILSEMDKGSDVGLKNCIRAKISYENPNKAMRDPVIYRCNLLPHHRTGTKYRAYPTYDFACPIVDSLEGVTHALRTTEYRDRNPLYQWMIKAMNLRKIHVWEFSRMNFVRTLLSKRKLTEIVDHGLVWGWDDPRFPTVRGVRRRGMTIEALQQYIVSQGPSKNILTLDWTSFWATNKKIIDPVAPRHTAVESGDVVKATIVNGPAAPYAEDRPRHKKNPELGNKKSIFANEILIEQADAQSFKQDEEVTLMDWGNAYVREINRDASGKVTSLKLELHLDGDFKKTEKKVTWLADTEDKTPVDLVDFDYLITKDKLEEGENYKDFLTPQTEFHSPVFADVGIKNLKKGDIIQVERKGYYIVDVPFDGTQAVLFNIPDGKTVNRYGVKN

SEQ ID NO: 91035 - DNA, 1725 bp, Aeropyrum pernix
  CDS (1)..(1725)
atgggttcggaggatttagagaggctgcttctagggtatgctctgagggatgctgtaaagcatggcgggagggctagcgtcgggagcgtcatgtcaatgctcctaggggaccatcctgagcttaggagtagggcgagggagatagcctccctggctgcaagggtcgtggagcaggtgaacagcatgcctgctggcgagcagaagaggctcctctcagaacagtatccggagctagcgaggtttgaagagcagcgcgagaaaggcgataaaggcctacccccgctgcccggggccgtggaaggcagggtcaagctgaggttcgcccccaacccagactttgtgatacacatgggcaacgctaggccggccatagtgaaccacgagtacgccaggatgtataaggggaggatggtgctgcggttcgaagacacagaccctaggacaaagactcccctacgggaggcgtacgacctcatccgccaggacctcaagtggcttggcgtttcctgggacgaggagtacatccagagcctcaggatggaggtcttctacagcgtagccagaagggctatagagcgggggtgcgcctacgtcgacaactgtgggagagagggtaaggagctgctctcgcgtggagagtattgtccgaccagggatcttggccccgaggataatctggagctgtttgagaagatgcttgaaggagagttttacgagggggaggctgttgtgaggatgaagacggacccgcgccaccccaaccccagcctgagggactgggtggccatgaggattatagacacggagaaacacccccaccccctcgtggggagcaggtacctggtgtggccgacctataacttcgccgtcagcgtcgacgaccacatgatggagataacccacgtgctcaggggtaaggagcaccagctgaacaccgagaagcagcttgccgtctacaggtgtatgggctggaggccgccgtacttcatccacttcggcaggctaaagctggaggggtttatactgagcaagagcaagataagaaagctcctcgaagagaggccaggagagttcatgggctacgacgacccccgcttcggcacgatagccgggctgaggaggaggggtgtgctggcggaggccataagacagataatactcgaggtgggggtcaagcccacggacgctacaataagctgggcaaacctggcggccgctaataggaagctgctggacgagcgggcggacaggataatgtatgtcgaagaccccgttgagatggaggtcgagctggcccaggtggagtgcagagccgcggagataccgttccacccgagccgcccccagaggaagaggaggataaccttgtgcacgggggacaaggttctcctcacaagggaggacgcagtagagggtaggcaactgaggctcatgggcctatcaaacttcaccgtcagccaaggcatattgagggaggtggatcccagcctcgagtatgcgaggagaatgaagctacctatagtacaatgggtgaagaagggcggagaagctagcgtagaggtactcgagcccgtcgagctggagctcaggaggcaccagggctacgctgaggacgctattaggggctatggggttgacagccgcctacagtttgtaaggtacggttttgtgagggtggacagcgtggaagacggggtctacagggtgatatacacacacaagtag

SEQ ID NO: 91036 - protein, 574 aa, Aeropyrum pernix
MGSEDLERLLLGYALRDAVKHGGRASVGSVMSMLLGDHPELRSRAREIASLAARVVEQVNSMPAGEQKRLLSEQYPELARFEEQREKGDKGLPPLPGAVEGRVKLRFAPNPDFVIHMGNARPAIVNHEYARMYKGRMVLRFEDTDPRTKTPLREAYDLIRQDLKWLGVSWDEEYIQSLRMEVFYSVARRAIERGCAYVDNCGREGKELLSRGEYCPTRDLGPEDNLELFEKMLEGEFYEGEAVVRMKTDPRHPNPSLRDWVAMRIIDTEKHPHPLVGSRYLVWPTYNFAVSVDDHMMEITHVLRGKEHQLNTEKQLAVYRCMGWRPPYFIHFGRLKLEGFILSKSKIRKLLEERPGEFMGYDDPRFGTIAGLRRRGVLAEAIRQIILEVGVKPTDATISWANLAAANRKLLDERADRIMYVEDPVEMEVELAQVECRAAEIPFHPSRPQRKRRITLCTGDKVLLTREDAVEGRQLRLMGLSNFTVSQGILREVDPSLEYARRMKLPIVQWVKKGGEASVEVLEPVELELRRHQGYAEDAIRGYGVDSRLQFVRYGFVRVDSVEDGVYRVIYTHK

SEQ ID NO: 91037 - DNA, 1656 bp, Archaeoglobus fulgidus
  CDS (1)..(1656): transl_table=11
gtgaaagaagtcataatgaaatacgtagttcagaacgccgcaaagtacggaaaagccagtgaaaaggctgtaatggggaaggtgatggcagaaaatccagaactcagaaaaaaagctaaagaggtccttgaactcgtaaaggagtgcattaccgagttcgaagcgctttctgaagaagtaaggaaggagctaatcaaaaaatacagcatggatagcgaagctaaaagggagttggagacgaagaagcttccagagcttgagggggctgagaaagggaaagttgtgatgagattcgctcctaatccaaacggtccacctacactcggttctgctagggggataatcgtcaacggtgaatacgcgaagatgtacgaagggaagtacattatcaggtttgacgatacagaccccagaaccaagagaccgatgattgaggcctacgagtggtacctagaggacattgaatggctcggttacaagcctgacgaggttatttacgcctcaagaaggattcccatctactacgattatgcaagaaagcttatagaaatgggcaaagcctacacctgcttctgcagtcaggaggagttcaagaagttcagggacagtggtgaggagtgcccacacagaaacatcagcgtcgaggatacacttgaagtctgggagagaatgcttgaaggagactatgaggaaggagaagtcgttcttagaattaagacggatatgcgccacaaggatccggcaataagggactgggtggctttcaggataataaaggaatcacatcctctcgttggggataaatatgttgtctatcccacactcgattttgaatctgctatagaggatcaccttttaggcataacgcacattatcaggggtaaggacttaattgattctgagaggaggcagagatacatctacgagtattttggctggatttaccccattacaaagcactggggcagggttaaaatcttcgaattcgggaagctatcgacttcttcaattaagaaggatattgaaaggggtaagtatgagggctgggatgacccaaggctgccaaccttgagagccttcaggaggagaggatttgagcctgaagccataaagagcttcttcctttcgctgggagttggcgagaacgacgtttccgtcagtctcaagaatctttacgctgagaacaggaaaatcatcgatcgcaaggcaaaccgttactttttcatttgggggcccgtgaagattgaaatcgttaacctgccggagaagaaagaggtcgagctcccgctgaatccgcacacgggcgagaagagaaggctgaaaggtgaaagaactatatatgttacaaaagacgacttcgagaggttgaaagggcaggttgtaaggctgaaggacttctgcaacgttctgcttgacgagaaggcagagttcatgggttttgagcttgagggggtcaagaaggggaagaacataatccactggcttcctgagagcgaggctatcaagggcaaggttatcggcgaaagggaagcggaagggcttgtggagagaaacgcagttagagatgtcgggaaagtcgtgcagttcgagagatttgctttctgtaaagtagagtctgctgacgaggaactggtcgcggtgtacacgcacccgtga

SEQ ID NO: 91038 - protein, 551 aa, Archaeoglobus fulgidus
MKEVIMKYVVQNAAKYGKASEKAVMGKVMAENPELRKKAKEVLELVKECITEFEALSEEVRKELIKKYSMDSEAKRELETKKLPELEGAEKGKVVMRFAPNPNGPPTLGSARGIIVNGEYAKMYEGKYIIRFDDTDPRTKRPMIEAYEWYLEDIEWLGYKPDEVIYASRRIPIYYDYARKLIEMGKAYTCFCSQEEFKKFRDSGEECPHRNISVEDTLEVWERMLEGDYEEGEVVLRIKTDMRHKDPAIRDWVAFRIIKESHPLVGDKYVVYPTLDFESAIEDHLLGITHIIRGKDLIDSERRQRYIYEYFGWIYPITKHWGRVKIFEFGKLSTSSIKKDIERGKYEGWDDPRLPTLRAFRRRGFEPEAIKSFFLSLGVGENDVSVSLKNLYAENRKIIDRKANRYFFIWGPVKIEIVNLPEKKEVELPLNPHTGEKRRLKGERTIYVTKDDFERLKGQVVRLKDFCNVLLDEKAEFMGFELEGVKKGKNIIHWLPESEAIKGKVIGEREAEGLVERNAVRDVGKVVQFERFAFCKVESADEELVAVYTHP

SEQ ID NO: 91039 - DNA, 1662 bp, Methanococcus jannaschii
  CDS (1)..(1662): transl_table=11
gtggaagagaagatattgccaattgcattaagaaatgccataaaatacaatggaaaagctaatccaaaggcagttttagggatatttttgtcagaaaatccagaatataggagtaaagcaaaggaggtaatgccaattgttgagaaagttgttgaagaagttaataaactatcattggatgaaattaagaaaaagttggaagaattaggagaagatgttaaaaagaaagaaaaaaaggagaaaggtttagaattaccaaacgttaaagataaggtagttatgagattcgctcctaatccatcagggcctttacatatagggcatgcaagagcagcagttttaaatgactactttgttaaaaaatatggtggaaagttaattttaagattagaggatacagacccaaagagagttctgccagaagcttatgacatgattaaagaagatttggattggctgggggttaaagttgatgaagtggttatacaatcagatagaatagagctttattatgaatatggtagaaaattgattgaaatgggacatgcttatgtttgtgactgcaatccagaagaatttagggaattgagaaataaaggagttccatgtaagtgtagagatagagccattgaggataacttagagctttgggaaaagatgctgaatggagaacttgaaaatgtagctgttagattaaaaacagacataaaacacaaaaacccatcaattagggactttccaatattcagagttgaaaaaactccacatccaagaactggagataaatactgtgtatatcctttaatgaacttctctgttccagttgatgatcatcttttaggaatgactcatgttttgagaggaaaagaccacattgtaaatactgagaagcaagcttatatttacaaatactttggttgggaaatgccagaattcatccactatgggattttgaagatagaggacattgttttaagcacttcatcaatgtataaaggaattaaagaaggtctctatagtggatgggatgacgttagattaggaactttaagagctttaagaagaagagggattaaaccagaggcaatatatgagataatgaaaagaattggaattaaacaggcagatgttaagttttcttgggagaatttatatgcaataaataaggagcttattgataaagatgcaaggagattcttctttgtctggaatccaaagaaacttattatcgaaggggcagagaaaaaggtcttaaaacttagaatgcatccagatagaccagaatttggagagagggagttaatatttgatggagaggtttatgttgttggagatgagttggaagagaataagatgtatagattgatggagttatttaacatagttgttgaaaaagttgatgatatagcattagctaaatatcactcagatgactttaaaatagcaaggaagaacaaagctaagattatacactggattcctgtaaaggatagtgtaaaggttaaagttttaatgcctgatggagagataaaggaaggctttgctgaaaaagattttgctaaagtagaggttgatgatattatccaatttgagaggtttggatttgttagaatagataaaaaagataatgatggattcgtatgttgctatgcacatagataa

SEQ ID NO: 91040 - protein, 553 aa, Methanococcus jannaschii
MEEKILPIALRNAIKYNGKANPKAVLGIFLSENPEYRSKAKEVMPIVEKVVEEVNKLSLDEIKKKLEELGEDVKKKEKKEKGLELPNVKDKVVMRFAPNPSGPLHIGHARAAVLNDYFVKKYGGKLILRLEDTDPKRVLPEAYDMIKEDLDWLGVKVDEVVIQSDRIELYYEYGRKLIEMGHAYVCDCNPEEFRELRNKGVPCKCRDRAIEDNLELWEKMLNGELENVAVRLKTDIKHKNPSIRDFPIFRVEKTPHPRTGDKYCVYPLMNFSVPVDDHLLGMTHVLRGKDHIVNTEKQAYIYKYFGWEMPEFIHYGILKIEDIVLSTSSMYKGIKEGLYSGWDDVRLGTLRALRRRGIKPEAIYEIMKRIGIKQADVKFSWENLYAINKELIDKDARRFFFVWNPKKLIIEGAEKKVLKLRMHPDRPEFGERELIFDGEVYVVGDELEENKMYRLMELFNIVVEKVDDIALAKYHSDDFKIARKNKAKIIHWIPVKDSVKVKVLMPDGEIKEGFAEKDFAKVEVDDIIQFERFGFVRIDKKDNDGFVCCYAHR

SEQ ID NO: 91041 - DNA, 1716 bp, Methanosarcina mazei
  CDS (1)..(1716): transl_table=11
atgaccttaagtcctgaagatattaaaataattgaaaaatacgctcttcaaaatgctgtaaaatacggaaaagccccacagcccaaagctgttatgggtaaagttatgggggaatgtccccagttgagggctgaccccagcggggtatctgctgcccttgaaaatatagtttcagaaattgctaaaggaaaccctgaagcctgggaagcccgcctgtcggaaatcgctcccgagcttatagaggctctgagtgtaaagaaagagcctgacaaaggcttaaaacctcttgagggagccgaaaccggtaaggttgtaatgcgctttgccccaaatcccaacggacccgcaaccctgggaagttcaaggggaatggttgtcaattccgagtatgtaaaagtgtataaaggaaagtttatcctgcgctttgatgacactgaccctgatataaagcgtcccatgctcgaagcctatgactggtacatggacgactttaaatggctcggggttgtgcctgaccaggttgtacgtgcctctgaccgtttcccgatttattacgattatgcaagaaaactgattgagatgggaaaagcctatgtctgtttctgtaaaggagaagacttcaaaaggttaaaagactccaaaaaggcctgccctcacagggacacagaccctgaagaaaaccttatgcactgggaaaagatgcttgccggagaatatgaagaccagcaggctgttctgcgcataaagaccgatatagagcacaaagaccctgcacttcgggactggggagcattcaggattagaaaaatgtcccacccacgccctgagattggaaataaatacatcgtctggccccttctggactttgcaggtgctatcgaagaccacgagctcggtatgacccacatcatccggggtaaagaccttatcgacagtgaaaaacggcagacatacatttacaaatacttcggctggacatacccgaaaacaactcactggggcagggtaaagatccatgagttcggaaagttcagcacaagtaccctgcgtaaagctatcgaatccggagaatacagcggctgggacgacccccgcctgccgacaataagggcaatcaggcgccgtggaattagggctgaagctctcaaaaagttcatgatagaaatgggagtcgggatgaccgatgtgagcatcagcatggaatctctttatgccgagaaccgcaaaatcgtggacccggttgcaaaccgctatttctttgtctggaaccctgtggagcttgaaattgaaggtatgaaacctgtggtcgcaaaggtcccccgtcacccaacagaccatgcaagaggaatgagggaaatctctatcgaaaataaggttcttgtctgtgccgaggacattgaaaagctcaatgtaggttctgtcctccgcttaaaagatctctgcaacgttgaaattacttccctttccccgctgcgggttaagcgctccgaaacctctctcgaagacctcaaaaaagcaaaaggaaaaatcatccactgggtgccggttgatggaattcctgtgaaagtctgcgggccagagggcgatatcgaagggacaggagaacgcgggatcgagaccgagcttgataatattgtccagtttgaacgcttcggtttctgcaggatcgacgccgtagacggagaaaatgtcgtggcgtactttgctcacaaatga

SEQ ID NO: 91042 - protein, 571 aa, Methanosarcina mazei
MTLSPEDIKIIEKYALQNAVKYGKAPQPKAVMGKVMGECPQLRADPSGVSAALENIVSEIAKGNPEAWEARLSEIAPELIEALSVKKEPDKGLKPLEGAETGKVVMRFAPNPNGPATLGSSRGMVVNSEYVKVYKGKFILRFDDTDPDIKRPMLEAYDWYMDDFKWLGVVPDQVVRASDRFPIYYDYARKLIEMGKAYVCFCKGEDFKRLKDSKKACPHRDTDPEENLMHWEKMLAGEYEDQQAVLRIKTDIEHKDPALRDWGAFRIRKMSHPRPEIGNKYIVWPLLDFAGAIEDHELGMTHIIRGKDLIDSEKRQTYIYKYFGWTYPKTTHWGRVKIHEFGKFSTSTLRKAIESGEYSGWDDPRLPTIRAIRRRGIRAEALKKFMIEMGVGMTDVSISMESLYAENRKIVDPVANRYFFVWNPVELEIEGMKPVVAKVPRHPTDHARGMREISIENKVLVCAEDIEKLNVGSVLRLKDLCNVEITSLSPLRVKRSETSLEDLKKAKGKIIHWVPVDGIPVKVCGPEGDIEGTGERGIETELDNIVQFERFGFCRIDAVDGENVVAYFAHK

SEQ ID NO: 91043 - DNA, 1662 bp, Methanobacterium thermoautotrophicum
  CDS (1)..(1662): transl_table=11
gtggtgccagtggaggaccttgtctacaggtacgcactcctgaacgctgtgaaacacaggggaagggcaaacccgggggccgtcatgggggccgtcatgagcaacgaacctgaactcaggaagatggcgccccaggttaaggaagcagttgaggccgctgttgagagggttaacagtttaagccccgaggagcagcagcaggagatggagaggctgggccttgagatcaccgagaggaaacagaagaagcggaagggtctaagggaactggccggggtgaagggtgaggtggtcctcaggttcgcccccaaccccagcggacccctccacataggccatgcaagggccgcgatcctcaaccatgaatatgcaaggaaatatgacggcaggctcatcctcaggatagaggacacggacccccgcagggttgacccggaggcctacgatatgattccagccgaccttgagtggctgggcgttgaatgggatgagacagttatccagagcgaccgcatggaaacctactatgagtacacagagaaactcatagagaggggtggtgcgtatgtatgcacatgcaggccggaggagttcagggaactcaagaacaggggagaggcctgtcactgcaggtcccttggtttcagggagaacctccagcgatggagggaaatgttcgagatgaaggagggctcagccgttgtgagggttaaaacggacctgaaccacccaaaccctgccataagagactgggtctcaatgaggatcgttgaggcagagcacccacgcaccggtacacgctacagggtctaccccatgatgaacttctcagtggcggttgatgaccacctccttggcgtgacacacgtcctgaggggtaaggaccacctggcaaacagagagaagcaggagtacctctacaggcaccttggctgggagccccccgaattcatacactacgggcgcctgaagatggacgacgttgcactcagcacctcgggggcccgtgagggcatcctcaggggtgagtattctggatgggacgacccacgcctcggaaccctgagggccattgcaaggaggggtatacgaccggaggccataagaaagttaatggttgaaatcggcgtaaagatagcagattccacaatgagctggaagaagatctacggcctcaacaggagcatcctcgaagaggaggccaggaggtacttctttgctgcagatcctgttaaacttgaagtggtgggtttacccggacctgtcagggttgaaaggcccctacacccggaccaccctgaaatcgggaacagggtacttgaactgaggggtgaggtgtacctgccgggcgatgaccttggggaaggaccgctgcgcctcatagacgcggttaacgtgatctactctgggggtgaactgaggtaccacagtgagggcatcgaggaggcccgtgaactcggcgcttcaatgatacactgggtccctgcagagtccgcccttgaggccgaggtcatcatgccggacgcctccagggtgaggggagtcatcgaggctgacgcatcagaactggaggttgatgatgttgtgcagcttgagaggttcggcttcgcccgcctggattctgcaggcccaggaatggtcttctactatgcccacaaatga

SEQ ID NO: 91044 - protein, 553 aa, Methanobacterium thermoautotrophicum
MVPVEDLVYRYALLNAVKHRGRANPGAVMGAVMSNEPELRKMAPQVKEAVEAAVERVNSLSPEEQQQEMERLGLEITERKQKKRKGLRELAGVKGEVVLRFAPNPSGPLHIGHARAAILNHEYARKYDGRLILRIEDTDPRRVDPEAYDMIPADLEWLGVEWDETVIQSDRMETYYEYTEKLIERGGAYVCTCRPEEFRELKNRGEACHCRSLGFRENLQRWREMFEMKEGSAVVRVKTDLNHPNPAIRDWVSMRIVEAEHPRTGTRYRVYPMMNFSVAVDDHLLGVTHVLRGKDHLANREKQEYLYRHLGWEPPEFIHYGRLKMDDVALSTSGAREGILRGEYSGWDDPRLGTLRAIARRGIRPEAIRKLMVEIGVKIADSTMSWKKIYGLNRSILEEEARRYFFAADPVKLEVVGLPGPVRVERPLHPDHPEIGNRVLELRGEVYLPGDDLGEGPLRLIDAVNVIYSGGELRYHSEGIEEARELGASMIHWVPAESALEAEVIMPDASRVRGVIEADASELEVDDVVQLERFGFARLDSAGPGMVFYYAHK

SEQ ID NO: 91045 - DNA, 1716 bp, Pyrococcus abyssi
  CDS (1)..(1716): transl_table=11
atggaagttgaaagaatcgcgcttaagtatgccttgataaacgcaattgaacacggggggaaggcaaatcccaaggcagttataggcaaggttctcggcgagaatccagagcttagatccaaggcgagggagatagttcccataataaacaaggtcgttgaggaggttaactccctatcattggacgagcaaaaggcaaagctcatggagatctatcccgagtacttcgagaagaaggaggagaaaaaggaggaaaagaaaggccttccaccccttccaaaggccgagaaaggtaaggttgtcacgcgttttgcacctaaccctgatggggcctttcacctaggaaacgcgagggcggcgatactaagctacgagtacgctaagatgtacggtggtaagttcatacttcgctttgatgacaccgatccaaaggtgaagaggccagagcctatattctacgagatgataattgaggacttggagtggctcggaataaagcccgatgagatagtttacgccagcgataggcttgagctgtactacaagtacgctgaagagctcataaagatgggcaaagcctacgtctgcacttgtaaaccagagaagttcagggagcttcgcgataagggaattccgtgtcctcatagagatgagccagtagaggttcagcttgaacgctggaggaaaatgctgaacggcgagtataaagagggggaagctgtggttagaattaagaccgacttaaaccacccgaatccagctgtcagggactggccagctttgaggatagttgataatcctaaccaccctagggccgggaataagtacagggtctggccgctctacaactttgcctccgccatagatgaccacgagctcggcgttacccatatattcaggggtcaggagcatgccgagaacgagacgaggcaacgctacatctacgagtacttcggctgggagtacccagttaccgttcaccacgggaggctcagcatagagggggtaatactcagcaagtcgaagacgaggaagggaatagaggagggcaagtacctcggctgggacgatcccaggttagggactataagggccctgaggaggaggggaatacttccagaggccataaaggaattaataatagaggttgggctgaagaagagcgacgcaacggttagctgggataacttggccgcgataaacaggaagcttgtcgatccgatagcaaacaggtacttcttcgttgccgatccggtgcccatggaagttgaaggcgctccagagttcatagctaagatccctctacaccctgatcaccctgagaggggcacgagggagctgaggtttactcctggaaagccgatatacgtttcaaaggatgaccttgacttgctcaagccaggtagctttgtaaggctaaaagacctgttcaacgttgagatagttgaagttggagagaaaataaaagctaagttccacagcttcgagtacgaaatcgctaggaagaacaagtggaggatgatccactgggttcctgaaggcaggccttgtgaggtcataattccagaaggcgatgagctcatagtgaggaagggattgctggagaaggacgctaacgttaaggctggtgagatagttcagttcgagcgcttcggcttcgttaggatagataagatagagggggagaaggttgtcgcaatttacgcccacaagtga

SEQ ID NO: 91046 - protein, 571 aa, Pyrococcus abyssi
MEVERIALKYALINAIEHGGKANPKAVIGKVLGENPELRSKAREIVPIINKVVEEVNSLSLDEQKAKLMEIYPEYFEKKEEKKEEKKGLPPLPKAEKGKVVTRFAPNPDGAFHLGNARAAILSYEYAKMYGGKFILRFDDTDPKVKRPEPIFYEMIIEDLEWLGIKPDEIVYASDRLELYYKYAEELIKMGKAYVCTCKPEKFRELRDKGIPCPHRDEPVEVQLERWRKMLNGEYKEGEAVVRIKTDLNHPNPAVRDWPALRIVDNPNHPRAGNKYRVWPLYNFASAIDDHELGVTHIFRGQEHAENETRQRYIYEYFGWEYPVTVHHGRLSIEGVILSKSKTRKGIEEGKYLGWDDPRLGTIRALRRRGILPEAIKELIIEVGLKKSDATVSWDNLAAINRKLVDPIANRYFFVADPVPMEVEGAPEFIAKIPLHPDHPERGTRELRFTPGKPIYVSKDDLDLLKPGSFVRLKDLFNVEIVEVGEKIKAKFHSFEYEIARKNKWRMIHWVPEGRPCEVIIPEGDELIVRKGLLEKDANVKAGEIVQFERFGFVRIDKIEGEKVVAIYAHK

SEQ ID NO: 91047 - DNA, 1713 bp, Pyrobaculum aerophilum
  CDS (1)..(1713): transl_table=11
atgaacgttgaggaaatagcgtttaaatacgccctagcaaacgcagtgaaatacggcggcaaagccgacgtcaaggccgttatggcaaagctcatggcagaggtgccggagttaagagcccgggccagagaggttaagcaaatagtagacgccgttgtggcgcgggtcaactcaatgcctctagaagagcagaggagaattctaagagagcgctggccggagttgctagaggagaggagggcggagcagaggaggccggggctggaaggtttgccggagctcccaaacgtgcgcgggggggttgtagtgcgcttcgcccccaatcccgactttgttttacacttaggcagtgcgcggcctgctattttaaactacgcctataggattaaatacggggggaagttcatattgcggtttgaagacacagatcccaggattaagagtccgcttgtgactgaggaggtaaacgcctatgaatccattagggaggacttaaggtggctgggcgtgaggtgggacgaggagtatatacagtcccaacggatggagatatactacgaacacgccaagaagctactagaaatgggcgccgcctatgtggacttgtgcaaacctgaggagtggagaaggcttagaaatgagaaaaaggcgtgtccccacagagagcaaccgcccgaagttaatttagagctgtgggataaaatgctggaggggaggtttaaagagggggaggccgtgttgagaataaagacagatttgacgcaccccgatcccagcgtcagagactgggtggcctttagaattatagacacgtctaagaccccacaccccctgacgggcgacaagtacatcgtgtggccgacttataacttcgcggtttctatagatgaccacttaatgggagttacccacgtgttgagagcacaggaacacagcgttaataccattaaacagtcatacgtatttagacacttcggctgggagcaaccggtcactatccacttcggcaggctgagaattgagggggctactctgagtaagtctaagctaaaggccatgaggattaaatacgacgacttgactctgcccacgttggcgggtcttagaaaccgcggcattgtgccggaggcgatatgggacctcatactgtccgtcggcattaagccctcggactcaactgtggctcttgccaacctatttgcctttaatagaaaacacatagagccaatagccgataggtatatgtacgtggccgaccccgtaaagctcgtatttgaggccgacaaagagctcacagcccacgtgccgtttcaccccagttttaaagagaggggggagaggacgtaccggctgggccccgggcgggttgaagtgtatatacaacggcgcgatgctgtcgcgggaaaagtggtgaggcttatggagttggccaatgttgagatagtgcgagttgaaggcgacgtggcctacgggcggatacacagttacagcctcgacgaggctaaaaaaattggcgcgcccataattcaatgggtctgggatcccgttgagatcaccgtcataaagcctgcgggcgtggggaggaaagaggtggaggtagggcttggagagggctggctggagagagtagaggtgggcaagtacgtccagttttttagatacggctatttgaaaaagagagggccaagggaatttgtattcctccatgactaa

SEQ ID NO: 91048 - protein, 570 aa, Pyrobaculum aerophilum
MNVEEIAFKYALANAVKYGGKADVKAVMAKLMAEVPELRARAREVKQIVDAVVARVNSMPLEEQRRILRERWPELLEERRAEQRRPGLEGLPELPNVRGGVVVRFAPNPDFVLHLGSARPAILNYAYRIKYGGKFILRFEDTDPRIKSPLVTEEVNAYESIREDLRWLGVRWDEEYIQSQRMEIYYEHAKKLLEMGAAYVDLCKPEEWRRLRNEKKACPHREQPPEVNLELWDKMLEGRFKEGEAVLRIKTDLTHPDPSVRDWVAFRIIDTSKTPHPLTGDKYIVWPTYNFAVSIDDHLMGVTHVLRAQEHSVNTIKQSYVFRHFGWEQPVTIHFGRLRIEGATLSKSKLKAMRIKYDDLTLPTLAGLRNRGIVPEAIWDLILSVGIKPSDSTVALANLFAFNRKHIEPIADRYMYVADPVKLVFEADKELTAHVPFHPSFKERGERTYRLGPGRVEVYIQRRDAVAGKVVRLMELANVEIVRVEGDVAYGRIHSYSLDEAKKIGAPIIQWVWDPVEITVIKPAGVGRKEVEVGLGEGWLERVEVGKYVQFFRYGYLKKRGPREFVFLHD

SEQ ID NO: 91049 - DNA, 1719 bp, Pyrococcus furiosus
  CDS (1)..(1719)
atggaagtagaaaagcttgcactcaagtacgctctaataaatgcaatagagcacgacggtaaagctaatccaaaggcagtcatagggaaaatactcggagaaaaccccgagctcagaaagaaggccagagaaattgttccaatagttaataaaattgtagaggaagttaataccctctcactggaagagcagaaaaagaaacttgaagaaatttatccagagtacttcatggaaggcactaaaaaagaaaaagaggagaaaaagcaactccccccactacctaaagcagaaaagggtaaggttgtaacaagatttgctccaaatccagacggtgcttttcacctggggaatgctagagcagcaatattaagctatgagtatgccaaaatgtacgatggaaagtttattctaaggttcgatgacacggatccaaaggtaaagaggccagagctaatattctacgacatgataatagaagacttagaatggttagggataaaaccagacgaaattgtttatgcaagtgataggcttgaaatttattacaaatacgcagaagagctcataaaaatgggaaaggcatatgtatgtacttgcccaccagatgagtttaggaagttaagggatcaaggaattgcttgcccccatagagatgaacccgtagaggtgcaactggaaagatggaaaaaaatgctaaatggagaatatagagagggagaggccgtagttagaattaaaactgatttaaaccacccaaatccagcggttagagattggcccgctcttagaattgttgatgagccaaatcacccaaggactggaaataagtatagggtatggcctctctacaactttgcttcggcaatagatgaccacgaattaggagttactcacatcttcagagggcaagaacactcagaaaatgagacgaggcaaaggtatatctacgagtattttggatgggaatatccagtaacagttcatcacggaagactgtcaattgaaggagtaattctcagcaagtcaaagactagaaaggggatagaggaagggaaatatctaggatgggatgatcccaggttgggaaccataagggccttaagaaggagaggaatcttgccggaagcaataagagagctaatcctggaggttggacttaaaaagagcgacgcaaccgtaagctgggataacctagctgcaataaatagaaaactcgttgatccaatagcaaatagatacttctttgttgcagacccgattcccatgtatatagaggaggccgaagagtttgaggcaaagatacctcttcacccagatcatccagaaaggggatacagagtgctaaaattcgaaccgggaaagccaatttatgtctcaaaagacgatctaagcttgttaaagccaggaggatttattagactaaaggacttatttaacgtcgaaattttagaggtaggggatacaataaaggcgagattccacagccatgaatatgaagtcgcgaggaaaaacaagtggagaatgattcactgggttccagagggtaaagagtgtgaggtaataattccagaaggagaagagctaataatcagaaagggcctactggaaaagaatgccaacgtaaaagaaggagaaatagtgcagtttgaaagatttggatttgtaaggattgacaaaatagaaaacgacaaagttatcgcaatatatgcccacaaatga

SEQ ID NO: 91050 - protein, 572 aa, Pyrococcus furiosus
MEVEKLALKYALINAIEHDGKANPKAVIGKILGENPELRKKAREIVPIVNKIVEEVNTLSLEEQKKKLEEIYPEYFMEGTKKEKEEKKQLPPLPKAEKGKVVTRFAPNPDGAFHLGNARAAILSYEYAKMYDGKFILRFDDTDPKVKRPELIFYDMIIEDLEWLGIKPDEIVYASDRLEIYYKYAEELIKMGKAYVCTCPPDEFRKLRDQGIACPHRDEPVEVQLERWKKMLNGEYREGEAVVRIKTDLNHPNPAVRDWPALRIVDEPNHPRTGNKYRVWPLYNFASAIDDHELGVTHIFRGQEHSENETRQRYIYEYFGWEYPVTVHHGRLSIEGVILSKSKTRKGIEEGKYLGWDDPRLGTIRALRRRGILPEAIRELILEVGLKKSDATVSWDNLAAINRKLVDPIANRYFFVADPIPMYIEEAEEFEAKIPLHPDHPERGYRVLKFEPGKPIYVSKDDLSLLKPGGFIRLKDLFNVEILEVGDTIKARFHSHEYEVARKNKWRMIHWVPEGKECEVIIPEGEELIIRKGLLEKNANVKEGEIVQFERFGFVRIDKIENDKVIAIYAHK

SEQ ID NO: 91051 - DNA, 1701 bp, Sulfolobus tokodaii
  CDS (1)..(1701): transl_table=11
atggaagaaattgaggaattaatatataaatacgcgctacaaaatgcttataaacacggtggtaaagcgcaagataaagctgttgtaagtaaaatttttgttgagcgtcctgatttaagatctagagctaaggaaatatctgagatagcaaagaaaatagtagaaaaagtaaattcaatgagtattcaagaccaagagagagaacttaaagaaaaatatccagatttactcgaagagaaaaaaaaggaagaaccagaaaagaagactcttcctccaattaaagttgaagggaaatttgttacaagatttgcgccaaacccagatggtccaattcacttaggcaatgctagagcggctattatatcttataaatatgctgaaatgtataaaggtgagtttatcctaaggtttgacgatactgatccaaaggttaaaaagccaataaaagaggcgtacgattggattaggaaagatcttaaatggttaggtataaagtgggataaggaagttaaagcgtcagaaagactagaattctattacagtatggctaaagagcttataagtaaaggttttgcatatgttgatacttgctcagaggaagagttcaaaaaaatgagagatgctagtaaaccttgtccaaataggttaaaatcagcggaggataatctttacttatttgagaagatgcttaatggagagtttaaagaaggagaagctgtagtaaggataaaaactgatctctctttacctgatccatcgcaaagagattgggttttacttcgaataatagatgttaagaaaaaccctcatcctatcactggagataaatattggatttggcctacttataatttcgcaagtgccttagacgatcatgacttaggtataactcacattttcagaggtaaagaacatgaagtaaatgcagaaaaacagaaatggatatacaactacatgggctggaaatatccttatgttgaagaatttggtaggcttagattagaaggatttatgatgagtaaatcaaagattagaacagtattagagaaaggcgtaagcattgatgatcccagattacctacgttggctggattgaggagaagaggaattctaccagaaacaataatagaaactataattacagtaggtttaaaggttagtgatgcaactataagttttgacaatttagctgcacttaatagaaagaagttggatccaatagctaagagacttatgttcgttcaacagcctaaggagtttattattgagttatcagaaccaattagggcaaaaataccatataaccctagtaaaccttcagaatatagagaaattctagtaaatcctggagataagattcttcttgacgcgaaggatgcagaagaaggtgcggtagtaaggttaatggaactttgcaatgtcacaatttctggaaataaattaatatttcatagcaaaactttggaagacgcgaagaaattaaatgcaaaaatcatacaatgggtaaaaaaagatgaagcttctaacgttgaggtaattataccagatccgaatgaagagaagccacctatatccggttatggagaaaaagaaattgggaatctaaaaatcaatgaaatagtacagttcataagatttgggttcgttagggtcgataataagatcgataataaggttaccgtaatattctcacatgagtaa

SEQ ID NO: 91052 - protein, 566 aa, Sulfolobus tokodaii
MEEIEELIYKYALQNAYKHGGKAQDKAVVSKIFVERPDLRSRAKEISEIAKKIVEKVNSMSIQDQERELKEKYPDLLEEKKKEEPEKKTLPPIKVEGKFVTRFAPNPDGPIHLGNARAAIISYKYAEMYKGEFILRFDDTDPKVKKPIKEAYDWIRKDLKWLGIKWDKEVKASERLEFYYSMAKELISKGFAYVDTCSEEEFKKMRDASKPCPNRLKSAEDNLYLFEKMLNGEFKEGEAVVRIKTDLSLPDPSQRDWVLLRIIDVKKNPHPITGDKYWIWPTYNFASALDDHDLGITHIFRGKEHEVNAEKQKWIYNYMGWKYPYVEEFGRLRLEGFMMSKSKIRTVLEKGVSIDDPRLPTLAGLRRRGILPETIIETIITVGLKVSDATISFDNLAALNRKKLDPIAKRLMFVQQPKEFIIELSEPIRAKIPYNPSKPSEYREILVNPGDKILLDAKDAEEGAVVRLMELCNVTISGNKLIFHSKTLEDAKKLNAKIIQWVKKDEASNVEVIIPDPNEEKPPISGYGEKEIGNLKINEIVQFIRFGFVRVDNKIDNKVTVIFSHE

SEQ ID NO: 91053 - DNA, 1677 bp, Bradyrhizobium japonicum
  CDS (1)..(1677): transl_table=11
atgacagaaccggtggcagctgaggttgggcgcgatttcattcgtgacatcatccaggccgacctcgatcaggccaaatacagggagatcgtgacccggttcccgccggagccgaacggctacctgcatatcggccacgccaagtcgatcgcgctcaatttcggcatcgcccaggagtttccgggtcgctgccatctgcgtttcgacgacaccaatccggtcaaggaagagcaggaatatatcgattccatccaggccgacgtgcactggctcggcttcgactggggcaagaacctgttctttgcctcggattatttcgaccgcctgtacgaatgggcggagacgctgatccgcgacgggctcgcctatgtcgacgaccagacccaggaggagatccgcacctcccgcggcacgctgaccgagcccggcaagaactcgccattccgcgaccgcagcgtggatgagaacctcgacctgttccgccgcatgaaggcgggcgaattccccaacggcgcgcgcgtgctgcgggccaagatcgacatggccgcgggcaacatcaatctgcgcgatcccgtgctgtaccgcatcctgcatgcgcatcatccgcgcaccggcaacgcatggtgcatctatccgagctacgactatgcccacggccagtcggacgcgatcgagggcatcacgcactcgatctgcacgctggagttcgaggaccaccggccgctctacgactggttcatcgagaagctgccggtgccgtcgaagccgcaccagtacgagttcgcgcggctgaacctgacctacacgctgctctcgaagcgcgtgctgacccagctcgtgcgcgagggccatgtcgcgggttgggacgatccgcgcatgccgaccatggcgggcatgcgccgtcgcggtgtgccgccggcggcgctgcgtgaattcgtcaagcgcatcggcgtcgccaaggccaacagcgtggtcgatgtcggcatgctcgaattctgcatccgcgaggagctgaaccgcaccgcgcagcgtcgcatggcggtgctgaagccgctcaaggtcgtgatcgagaactatccggaagggcagaccgaggagctcgaggcgatcaaccatccggacgatccctccgccggcacgcggaagatcacgttcggccgcgagctctatatcgagcaggacgacttcatggagaaccctcccaagaagttcttccgcctgtcgcccggcaacgaggtccggctgcgctacgcctatttcgtcaaatgcaccggcgtgatcaagaacgagagcggcgaggtggtggagctgcgctgcacctacgatcccgcgaccaggggcggcaatgcgcccgacggccgcaaggtcaaggcgaccatgcactggctgtcggcggcagcgtcgaagccggcggagatccgcatctacaaccagctgttcgcgaacccgagcccggacgcctcgaactttgccgccgatctcaatccgcagtcgctggagattctcagcaatgcccgagtcgaggcatcggtcgcggagagcaattccaccgagccgatgcagttcgagcgccagggatatttcgtgcgcgacaaggactcgacgcccggcaagccggtgttttcacgcaccatcggcctgcgcgacacgttcgcgaaggaagtcgcgaaaggttga

SEQ ID NO: 91054 - protein, 558 aa, Bradyrhizobium japonicum
MTEPVAAEVGRDFIRDIIQADLDQAKYREIVTRFPPEPNGYLHIGHAKSIALNFGIAQEFPGRCHLRFDDTNPVKEEQEYIDSIQADVHWLGFDWGKNLFFASDYFDRLYEWAETLIRDGLAYVDDQTQEEIRTSRGTLTEPGKNSPFRDRSVDENLDLFRRMKAGEFPNGARVLRAKIDMAAGNINLRDPVLYRILHAHHPRTGNAWCIYPSYDYAHGQSDAIEGITHSICTLEFEDHRPLYDWFIEKLPVPSKPHQYEFARLNLTYTLLSKRVLTQLVREGHVAGWDDPRMPTMAGMRRRGVPPAALREFVKRIGVAKANSVVDVGMLEFCIREELNRTAQRRMAVLKPLKVVIENYPEGQTEELEAINHPDDPSAGTRKITFGRELYIEQDDFMENPPKKFFRLSPGNEVRLRYAYFVKCTGVIKNESGEVVELRCTYDPATRGGNAPDGRKVKATMHWLSAAASKPAEIRIYNQLFANPSPDASNFAADLNPQSLEILSNARVEASVAESNSTEPMQFERQGYFVRDKDSTPGKPVFSRTIGLRDTFAKEVAKG

SEQ ID NO: 91055 - DNA, 2361 bp, Caenorhabditis elegans
  CDS (1)..(2361)
atggcaacaaaggaggagcttctctctttgggcctctctgattcaaaagtagctgaaacgctgaaaaatgtgaagctcaccgaaacgatcggttcaattgtgaagcttgcgagcgagtctggcgagatttccaagcaaaaaggaacacttttgtaccagttggcgacaaagttgaagccacaagtcgctgctcacactccactagttgtcaagtatattatgaatgacgggattaagacagagccacagctctccgcagcgatcgagtatcttctctcgcacaccgttaaaggtatccaagtgcctgatttcgagaaatcatgcggagtcggcgttgttgtcacaatcgacgacatcgaagcggccgttaccaaggtgattggccaacaccgcgagaaaatcgtcgccgagcggtactcgttcccggccggaaagttgctcggcgagctacgagctctgcttccatgggctgatggtgcgattacgaagaaggaggtggatttgagattcttggagctgctcggaccgaagactgcggaggatttggctccgaagaagaaggagaagaagccggaaggcccgaaaccttccaaagacgctgccgctgccgccaccgctccaggaaccaaaaatcaaaaggaagctagccccgaagaattcgctgatggcgccgaaaccatggacgagctgctccgcacccgtgcgcatttccacaaagtcggagaaaacttcaagcaagacggctacgtgaccactccaaaaaccgcagagcttctcaaggctcacgtggcggctgtcggagggaaggtggtgacccgattcccgcctgaaccaaatggtgttcttcatattggacacgcgaaggcgattaacatcaattttggatatgctaaagctatgggtggtgtgtgtaatttgagatttgacgatacaaatccggaaaaggaagaggaaaagttcttctctgcaattgaggatattgttcattggcttggatatgatccggctagagttactcactcttcggataattttcagcagctttatctttgggctgttaagcttattcagaaaggactcgctttcgtatgccatcaaaaagtcgaagaaatgcgcggtttcgaagttcaactgagcccgtggcgtgagcgaccaatcgaagagaacatccaactcttcgaagacatgaaaaatggaaaattcgacgaaggagaagccacactccggctcaagttgacactggaagaaggaaaagtcgatccagtcgcctaccgtatcaaatatgttccacatcatcgaactggaaatcaatggtgcatctacccgacctacgattatacccattgcctttgtgattcaattgaaaatatcactcattctctgtgcaccaaagagttccagtcgagaagaagctcatattactggctctgtaatgctctagatatctattgtcctgttcaatgggagtacggtagactaaatgtcaactatactgtggtctcgaagcgaaagattctcaaacttatcaccacaaaaaccgtcaacgattgggatgatccacggttgttcacactgacagcactccgacggcgtggtatcccatctgaggcgattaatcgattcgttgcgaagctcggattgacaatgtcacagatggttattgatccacacgttcttgacgcaactgttagggattatttgaatattcacgcgccaagaacaatggccgtgctcgagggattgaagctgacaatcgaaaacttttccgaactcaatctcccatcatccgtcgacgttccagacttcccatctgatccgactgatccacgaaagcactcggtatccgtcgatcgggagattttcattgaaaagtccgactataagccggatgattcggacaaatccttcagaaggctgacgccgaaacaagccgtcggcctgaaacacattggattggtgctccgattcgtgaaagaagtcaaagatgccgagggtcacgtcacagaagttgtggtgaaggctgagaagttgtcggagaaggataagccgaaagcatttattcattgggttgcaaagcctgtctcgtgtgaagttcggctctatgatagactattcaagagtaagaatccagaggatgctcaactagttccaggtggattcctgtcggatatcaatccagattcattgacagttgtctacaatgctctaattgatcagtctattgcaaaatcaaaggtttatgatagattccaattcgaacgcatcggattcttctgtgtcgatcgtgattcgacgtcttcaacgttggtcttcaaccgaactgtcatgctgaaagacggaggagcttctggaaagaattga

SEQ ID NO: 91056 - protein, 786 aa, Caenorhabditis elegans
MATKEELLSLGLSDSKVAETLKNVKLTETIGSIVKLASESGEISKQKGTLLYQLATKLKPQVAAHTPLVVKYIMNDGIKTEPQLSAAIEYLLSHTVKGIQVPDFEKSCGVGVVVTIDDIEAAVTKVIGQHREKIVAERYSFPAGKLLGELRALLPWADGAITKKEVDLRFLELLGPKTAEDLAPKKKEKKPEGPKPSKDAAAAATAPGTKNQKEASPEEFADGAETMDELLRTRAHFHKVGENFKQDGYVTTPKTAELLKAHVAAVGGKVVTRFPPEPNGVLHIGHAKAININFGYAKAMGGVCNLRFDDTNPEKEEEKFFSAIEDIVHWLGYDPARVTHSSDNFQQLYLWAVKLIQKGLAFVCHQKVEEMRGFEVQLSPWRERPIEENIQLFEDMKNGKFDEGEATLRLKLTLEEGKVDPVAYRIKYVPHHRTGNQWCIYPTYDYTHCLCDSIENITHSLCTKEFQSRRSSYYWLCNALDIYCPVQWEYGRLNVNYTVVSKRKILKLITTKTVNDWDDPRLFTLTALRRRGIPSEAINRFVAKLGLTMSQMVIDPHVLDATVRDYLNIHAPRTMAVLEGLKLTIENFSELNLPSSVDVPDFPSDPTDPRKHSVSVDREIFIEKSDYKPDDSDKSFRRLTPKQAVGLKHIGLVLRFVKEVKDAEGHVTEVVVKAEKLSEKDKPKAFIHWVAKPVSCEVRLYDRLFKSKNPEDAQLVPGGFLSDINPDSLTVVYNALIDQSIAKSKVYDRFQFERIGFFCVDRDSTSSTLVFNRTVMLKDGGASGKN

SEQ ID NO: 91057 - DNA, 1683 bp, Chromobacterium violaceum
  CDS (1)..(1683): transl_table=11
atgagcacggaaaacaacgcgccggttgtcaacaacttcattcgcagcatcatcgacgaggatttggccaccggccgccgcagctcggtggtgacccgcttcccgcccgagccgaacggcttcgcccacatcggccacgccaaggcgatctgcatcaacttcggcctggccgaggactacaacggccagtgcaatctgcgcatggacgacaccaatccggaaaaggaatcggacgagttcgtcgaggcgttcaagcaggacatctcctggctgggcttcaagtggaacggcgaggtgcgctacgcatccgactacttcgaccgcctgtacgactacgcggtggagttgatccaggccggcaaggcctacgtggacgacctgtccgccgaggaaatgcgccagtaccgcggcaatctgaccgagccgggcaagaacagcccctaccgcgaccgcacgccggaagagaacctggacctgttcacccgcatgaagaacggcgagttcccggatggcagcaagacgctgcgcctgaagatcgatatggcttccggcaacatcaatctgcgcgatccggccatctaccgtatccgccgcgtgcatcaccatcgcactggggacaagtggtgcatctacccgatgtacgactacacccactgcatctccgacgcgatcgagggcatcacccattcgctgtgctcgctggagttcgaggaccaccgcccgctgtacgactgggtgctggacaacatcagcatcgagcaccatccgcagcagatcgaattctcgcgcctggaactgctgtacgcgctgacctccaaacgcaagctgcaggcgctggtcaacgacggcgccgtcaccggctgggacgatccgcgcatgcccaccatcgccggcatgcgccgccgcggctacagcccggccggcatcaagctgttcgcccagcgcatcggcgtgtcgaagagcgaaaacatcatcgacatggccatcctggaaggcgcggtgcgcgagacgctggaaaacgattcgccgcgcgtgatggccgtggtcaatccgctgaaagtgacgctgaccaactacgacgccgccgtcaccgccagccgcagcgcgccgttccacccgcaccatccggaattcggcgagcgcgacgtgccgatcgcccgcgagatctggatcgagcgcgacgacttcgccgaaacgccgccgccgaagtggcagcgcctgaccgccggcggcgaagtgcgcctgcgctactcgtacgtgatcaagtgcgacgaggtggtgaaggacgccgccgacgagatcgtcgagctgaagtgctcgatcgaccacgacacgctgggcaagaacccggaaggccgcaaggtcaagggcgtgatccactgggtgtcggccgagcatgcgatccaggccgacgtgcgctggtacgagcgcctgttcaccgagcagcgtccggacgcggtgcgcggcgaggacggcgaatacgtcgatttccgccagttcctgaacccggagtcgctgaaactggtgccggcctatgtcgaggcctcggtgctgcaggcggagccggagtcgcgtttccagttcgagcgtctgggctacttcgtcaccgaccgctacgagcaccggaagggcgacaaggcggtgttcaaccgcaccgtcgggctgaaagacagctggaagtaa

SEQ ID NO: 91058 - protein, 560 aa, Chromobacterium violaceum
MSTENNAPVVNNFIRSIIDEDLATGRRSSVVTRFPPEPNGFAHIGHAKAICINFGLAEDYNGQCNLRMDDTNPEKESDEFVEAFKQDISWLGFKWNGEVRYASDYFDRLYDYAVELIQAGKAYVDDLSAEEMRQYRGNLTEPGKNSPYRDRTPEENLDLFTRMKNGEFPDGSKTLRLKIDMASGNINLRDPAIYRIRRVHHHRTGDKWCIYPMYDYTHCISDAIEGITHSLCSLEFEDHRPLYDWVLDNISIEHHPQQIEFSRLELLYALTSKRKLQALVNDGAVTGWDDPRMPTIAGMRRRGYSPAGIKLFAQRIGVSKSENIIDMAILEGAVRETLENDSPRVMAVVNPLKVTLTNYDAAVTASRSAPFHPHHPEFGERDVPIAREIWIERDDFAETPPPKWQRLTAGGEVRLRYSYVIKCDEVVKDAADEIVELKCSIDHDTLGKNPEGRKVKGVIHWVSAEHAIQADVRWYERLFTEQRPDAVRGEDGEYVDFRQFLNPESLKLVPAYVEASVLQAEPESRFQFERLGYFVTDRYEHRKGDKAVFNRTVGLKDSWK

SEQ ID NO: 91059 - DNA, 1659 bp, Clostridium perfringens
  CDS (1)..(1659): transl_table=11
atgtcaaatgctgagcactcatcaaactttataagaaatataataatagatgatttagatagcaaaaaacatgatacaataataactcgttttccacctgaacctaatggatatttacatataggtcatgcaaagtctatagttttaaactttgaattaggaaaagagtttaacggaagaactaacctaagatttgatgatacaaatccaactaaagaggatactgaatacgttgaatctattaaagaagatgttcattggttaggttataactggagcgaattacattttgcatcaaactactttgatgaaatgtataaaagagctctacttttaattaaaaaaggtaaagcttatgtttgtgatttaactccagaagaaataaaagaatatagaggtactcttactgagcctggtaaggaaagtccatatagaaatagatcaattgaagaaaacttagatctatttgaaagaatgagaaaaggtgaatttgaggacggttcaaaagttttaagagctaaaatagatatgagctcacctaacataaactttagagatcctataatttatagaattgctcatgctagtcaccataatacaggtgataaatggtgtatctaccctatgtatgactttgctcatccattagaagatgctattgaaggaataactcactctatttgtactttagaatttgctgatcacagaccattatatgattggttcgttaaagaatgtgaaatggaaagtgttccaagacaaattgagtttgcaagacttaatatcacaaacactgttatgagtaaaagaaagttaaagcaattagttgatgaaggcatagttgatggttgggatgacccaagaatgcctactgttgctggacttagaagaagaggttatactcctaagtcaataagaaacttctgtaaagctataggagttgctaaggcagattctactgttgattctcaaatgcttgagcatttcataagagaagaccttcaagaaactgctccaagagctatggctgttataaatccacttaaattagttataacaaactatcctgaaggagaatcagaaattcttgaaatagaaaataatcctaaagatgaatcagctggtaaaagagctgttacattctcaagagaagtttatattgaaagagaagatttcatggaaaatcctccaaagaaatatttcagattattcccaggaaacgaagtaagattaaaaggtgcttattttgtaaaatgtaacgaagtaataaaagatgaaaatggggaagttacagaaattcactgtacttatgacccagaaactaagagtggaactggatttactggaagaaaagttaaaggaacaatccactgggttgatgctaataactgtattcctgctgaatttagattatatgaaccattaatcttagatgattgtgaagaaaatgaaggaaagcacttccttgagcaaataaatcctaactcattaactatatgtaagggattcattgaaccaagcgctaaagatgctaaacctcaagataaatatcaattatttagacatggttacttcaatgttgatcctaatttcacaagtgatgataatttagtattcaacagaatagtttcattaaagagttcatttaaattaaaataa

SEQ ID NO: 91060 - protein, 552 aa, Clostridium perfringens
MSNAEHSSNFIRNIIIDDLDSKKHDTIITRFPPEPNGYLHIGHAKSIVLNFELGKEFNGRTNLRFDDTNPTKEDTEYVESIKEDVHWLGYNWSELHFASNYFDEMYKRALLLIKKGKAYVCDLTPEEIKEYRGTLTEPGKESPYRNRSIEENLDLFERMRKGEFEDGSKVLRAKIDMSSPNINFRDPIIYRIAHASHHNTGDKWCIYPMYDFAHPLEDAIEGITHSICTLEFADHRPLYDWFVKECEMESVPRQIEFARLNITNTVMSKRKLKQLVDEGIVDGWDDPRMPTVAGLRRRGYTPKSIRNFCKAIGVAKADSTVDSQMLEHFIREDLQETAPRAMAVINPLKLVITNYPEGESEILEIENNPKDESAGKRAVTFSREVYIEREDFMENPPKKYFRLFPGNEVRLKGAYFVKCNEVIKDENGEVTEIHCTYDPETKSGTGFTGRKVKGTIHWVDANNCIPAEFRLYEPLILDDCEENEGKHFLEQINPNSLTICKGFIEPSAKDAKPQDKYQLFRHGYFNVDPNFTSDDNLVFNRIVSLKSSFKLK

SEQ ID NO: 91061 - DNA, 2559 bp, Deinococcus radiodurans
  CDS (1)..(2559): transl_table=11
ttgggggcgtttgggtgggagcaggaccggggcgcccctttttcagggcgctcgccgcgtatcctgacccgcatgaccgatgccccccgcccaaccgccggggccgacgccccagcccggccccccgctgccccactcgtcgcgcccaacttcatcaccgaaatcatcgagcgcgaccttgaggccggcaagtacccccgcgtcgtgacccgttttccgcccgaccccagcggctacgcgcacctggggcacgtctttgccagcctgctcgacttcaacacggcgcggcagtacggcgggcagttcaacctgcgcatggacgacaccaaccccgagctggcgcggcaggagtacgtggactccatcgccgacgacctgaagtggttggggctcgactggggcgagcacttctactacgccagcgactatttcgaccgctactacgcctatgccgagcaactcattcgccagggcgacgcctacgtggaaagtgtaagccccgaggaactgtcgcggctgcgcggcaacgcgaccacgcccggcacgccgagtccttaccgtgaccgctcggttgaagaaaatctcgacctgctgcgccgcatgaaggccggcgaatttgccgacggtgagcacgtcctgcgcgccaagattgacctcaccgcccccaatatgaagctgcgcgacccggtgctgtaccgcatcgtcaacaagccgcacttccgcaccagcgacgagtggcacatctaccccgcctacgacttcgagcaccccttgcaagacgccatcgagggcgtgacccactccatgtgcagcctggaattcgtggacaaccgcgccatctacgactggctgatggaaaaactgaacttcgacccgcgcccccaccagtatgaattcgggcgccgggggctggaatacaccatcaccagcaagcgcaagctgcgcgaactggtgcaggcgggccgggtgagcggctgggacgacccccgcatgcccaccctgcgtgcccagcgccgcctgggggtcacgccggaagcggtgcgggccttcgccgcccagatcggggtgagccgcaccaaccgcacggtggacatcgccgtgtacgaaaacgcggtgcgcgacgacctcaaccaccgtgccccccgcgtgatggcggtgctggacccagtgaaggtcacgctgaccaatttggacggcgaaaagacgctctcgcttccctactggccgcacgacgtggtgcgcgactcgcccgacggtctggtcggaatgcccggcggcgggcgggtggcccccgaggaagctgtgcgcgacgtgccgctcacccgcgagctgtacatcgagcgcgacgacttcagccccgcgccgcccaagggcttcaagcgcctgacccccggcggcacggtccggctgcgcggcgccggcatcattcgcgccgacgacttcgggaccgacgaggcggggcaggtcacccacatccgcgccaccctgctgggtgaggacgccaaagcggcgggcgtcatccactgggtgagcgccgagcgtgccctgccggccgagtttcgcctctatgaccgcctgttccgggtgccgcaccccgagggcgaaaacgcggacgtggaggacgacagcgccggccccgccgaacacgaggccgagccgggcgccgggcaggaaacggcgccggtcagccagggcttcatgcgctacctcacccccgatagcctgcgcgtgctgcgcggttacgtggagccgagcgtggccggcgacccggcagacacccgctaccagttcgagcgtcagggctacttctggcgcgaccctgttgaattggaacgggtagacagccgcgaggacgcgctggtgttcgggcgcatcatcaccctgaaagacacctggggcaagcagggcggcggcacccagcagaaggcggaaggcaagaagcgaccctctaccaaggggagagggcctgacgaagtcaggggtgaggggtcttcttccccagctaaagcccatgcgcccaaagcccagcccctcacccccgaacaggacgccgaattcacccggctgctcggcctcggtgcctcggagggggacgcccgcaccatcgcccgtgacccggcgctgctcgccttcgtggggggggcggcgccgggggacaccttcgctcaggtcgcctcgtggacagtcaacgaactcgtcgcgggcctgcgtgccggggaggtgaaggtgcgggccgccgacctcgcgccgctcgccgagggggtggcgagtgggcaactcagcgcgcgcattgcgcgtgaggccctcgcccgcgccgccgccagcggggacgcgccgctcaccatcatcgagcgcgagggtctgaatgccggcctgagcgccgaggccctgcaacaggtagtggcccaagtcatcgccgccaatcccgacaaggcggaggcctaccgcggcggcaagaccgcgctgctcggttttttcaccgggcaggtcatgcgcgcgaccgccggcaaggccgacccgcaggcgctcgcggcggcgctcaaagacgctctcgcctga

SEQ ID NO: 91062 - protein, 852 aa, Deinococcus radiodurans
MGAFGWEQDRGAPFSGRSPRILTRMTDAPRPTAGADAPARPPAAPLVAPNFITEIIERDLEAGKYPRVVTRFPPDPSGYAHLGHVFASLLDFNTARQYGGQFNLRMDDTNPELARQEYVDSIADDLKWLGLDWGEHFYYASDYFDRYYAYAEQLIRQGDAYVESVSPEELSRLRGNATTPGTPSPYRDRSVEENLDLLRRMKAGEFADGEHVLRAKIDLTAPNMKLRDPVLYRIVNKPHFRTSDEWHIYPAYDFEHPLQDAIEGVTHSMCSLEFVDNRAIYDWLMEKLNFDPRPHQYEFGRRGLEYTITSKRKLRELVQAGRVSGWDDPRMPTLRAQRRLGVTPEAVRAFAAQIGVSRTNRTVDIAVYENAVRDDLNHRAPRVMAVLDPVKVTLTNLDGEKTLSLPYWPHDVVRDSPDGLVGMPGGGRVAPEEAVRDVPLTRELYIERDDFSPAPPKGFKRLTPGGTVRLRGAGIIRADDFGTDEAGQVTHIRATLLGEDAKAAGVIHWVSAERALPAEFRLYDRLFRVPHPEGENADVEDDSAGPAEHEAEPGAGQETAPVSQGFMRYLTPDSLRVLRGYVEPSVAGDPADTRYQFERQGYFWRDPVELERVDSREDALVFGRIITLKDTWGKQGGGTQQKAEGKKRPSTKGRGPDEVRGEGSSSPAKAHAPKAQPLTPEQDAEFTRLLGLGASEGDARTIARDPALLAFVGGAAPGDTFAQVASWTVNELVAGLRAGEVKVRAADLAPLAEGVASGQLSARIAREALARAAASGDAPLTIIEREGLNAGLSAEALQQVVAQVIAANPDKAEAYRGGKTALLGFFTGQVMRATAGKADPQALAAALKDALA

SEQ ID NO: 91063 - DNA, 1671 bp, Haemophilus ducreyi
  CDS (1)..(1671): transl_table=11
atgagcgaagaaactttaacaactgaggttgaaactaggaccaattttattactcatattattgatgaagatttagccagtggtaaacataataatgtttatactcgtttcccaccagaaccaaatggttatttacatatcggccacgctaaatcaatctgtttaaactttggtatcgctcaagaatatcatggcaaatgtaatttacgttttgatgatactaaccctgttaaagaagacattgaatatgttgcgtcaattaaacaagatgttgaatggttaggctttaagtggcaaggtgagccacgctatgcctcagattattttgatcaattacatggctatgccattgaattaattgaaaaaggattagcttacgttgatgagctatcgccagaagaaatgcgcgaatatcgtggtacgctcactgaagcgggtaaaaatagcccatatcgcgaccgcagtattgctgaaaacttagcattattcgagaaaatgaaaaatggtgagtttaaagaaggtacagcttgtttaagagccaaaattgatatggcttctcctttcattgtaatgcgagatcctgttctttaccgtgttaaatttgcacatcatcaccaaactggcgataaatggtgtatttatccaatgtatgatttcacacattgtatttcagatgcgattgaacgcattacgcactcactttgtacacttgaattccaagataatcgccgtttatatgattgggtattagagaatatttcgattgaacgcccattaccacatcaatatgaattttcacgcttaaatttggaaggcacattaacttcaaaacgtaaattgttacaattagtcacagatggaattgtcgatggttggaatgatccacgtatgcccaccatttcaggcttacgtcgacgcggctatactccggcttctctgcgtgaattttgtcgccgaattggcgttaccaaacaagataatgttgttgaatacgctgcgttagaagcctgtattcgtgaagacttaaatgagaatgctccgcgtgcaatggcggtaattaatcctgtacgtgtagttattgaaaacgttgctgaaccagaaatattaaaagcaccaaaccatcctaatcgaccagagctaggcgaacgtgatctaccttttacccgtgaaatatatatcgatgaagcagatttccgtgaagaagccaataagcaatataagcgtttagtcttaggtaaagaggttcgtttacgcaatgcctatgttattaaagcagaacgtgttgaaaaagatgcaagcggtaaaattactactattttttgtagttatgatcctgaaacattaggcaaaaaccctgcagacggtcgtaaagtcaaaggcgttattcattgggtttctgcgacacaaaataaagttgctgaatttcggatttataaccgcttgtttaatgtagcaaatcccggagatgaagaagatattaatgcagtgataaatccatcttcattaatcgttaaacatggttttgttgaagttaatttggcaaatgctcaaaaagaacaaggctatcaatttgaacgggaaggctattattgtttagacagtaaagagggttcagccgataacttaatctttaacttaaccgttagcctaaaagaaggttttacggcataa

SEQ ID NO: 91064 - protein, 556 aa, Haemophilus ducreyi
MSEETLTTEVETRTNFITHIIDEDLASGKHNNVYTRFPPEPNGYLHIGHAKSICLNFGIAQEYHGKCNLRFDDTNPVKEDIEYVASIKQDVEWLGFKWQGEPRYASDYFDQLHGYAIELIEKGLAYVDELSPEEMREYRGTLTEAGKNSPYRDRSIAENLALFEKMKNGEFKEGTACLRAKIDMASPFIVMRDPVLYRVKFAHHHQTGDKWCIYPMYDFTHCISDAIERITHSLCTLEFQDNRRLYDWVLENISIERPLPHQYEFSRLNLEGTLTSKRKLLQLVTDGIVDGWNDPRMPTISGLRRRGYTPASLREFCRRIGVTKQDNVVEYAALEACIREDLNENAPRAMAVINPVRVVIENVAEPEILKAPNHPNRPELGERDLPFTREIYIDEADFREEANKQYKRLVLGKEVRLRNAYVIKAERVEKDASGKITTIFCSYDPETLGKNPADGRKVKGVIHWVSATQNKVAEFRIYNRLFNVANPGDEEDINAVINPSSLIVKHGFVEVNLANAQKEQGYQFEREGYYCLDSKEGSADNLIFNLTVSLKEGFTA

SEQ ID NO: 91065 - DNA, 2385 bp, Lupinus luteus
  CDS (1)..(2385)
atgccggcgaaggatgacacctcctccgataaggagaagtctttggaactgtttctcaagatcggattagacgagcgcactgccaaaaacaccgtcgctaacaacaaagtcaccaccaatctcacttccgttatcaacgatgctggtgttaccgatggatgcagccgcactgttggaaaccttctttacacggttgcgacgaagtaccctgcaaatgccttgccacatcgcccaacattgctgcaatatattgttaattcaaaggtgaaaacaacagcacagttagacgcggcactatcttttctcagtgccacgggttcggagaatcttgatttgaacaagtttgaagaagcttgtggtgttggtgtcgaggtttcaacagaagatatcaaacatgctgttgatgaagttgttgaagagaataaggctacaattttggagctacgttatcgagtgaacgtgggtgagttacttgggcatgtccggaagaggctcccatgggctgatgcaaaagttgtcaagcaactagttgatgcaaaattatatgagatacttggtgataggacagcagcagataatgaaaagcctaaaaagaagaaagagaaacctgctaaagtagaggacaaggcagctcctgttgctacttccgaaaagccacttgaagaagatctgaatccatatttgatattccctaacccggaggacaactttaaggtgcatactgaagtaccttttagtgatggtaatattctgagatgttgcaatacaaaggcactccttgaaaaacacctgaaagcaacaggtggcaaagttttgacccgctttcctcctgaaccaaatggatatttgcatattggtcatgccaaggcaatgtttgttgattttgggttggcgaaagatagaaatggagggtgttatttgaggtttgatgatacaaatcctgaagcagaaaagaaagagtatattgatcacattgaagaaattgtccagtggatgggctgggaaccattcaagattacttacaccagtaattacttccaagaattgtatgaatttgccgtggaacttataagaaggggtcatgcttatgttgatcatcagacggcagatgagataaaggagtatagggagaagaaattaaacagtccttggagggatcgaccaatttcagaatcattgaaactctttgaggatatgaggcgtggctttatagaagaaggaaaagcgacacttagaatgaagcaagacatgcagagtgataactacaatatgtatgaccttattgcataccgtattaagtttactccacaccctcatgctggagacaaatggtgtatctatccaagctatgactatgctcactgcattgtagattctattgagaatgtcacgcattcactgtgtactcttgagtttgagacacgtcgtgcatcgtactattggttgttacatgcgttgggcatctaccaaccatatgtatgggaatattcaaggttgaatgtctcaaacacagttatgtcaaagcgtaagctaaatcgtttggtgacagagaagtgggttgatgggtgggatgatcctcgtctgatgacactagctggtttgcggcgtagaggcatgactcccactgcaatcaatgcctttgtccgaggaatgggaatcactagaagtgacggcactttgatatctgtggaacgtcttgagtatcatgttagggaagaattgaataaaacagctcctcgtgcaatggttgtcctgcatccactcaaggttgtcattactaatcttgaagccaaatcagcaattgaggttgatgcaaagaaatggcctgatgctcaagctgatgatgcttctgctttctacaagattccattttccaatgttgtatatattgaacgttcggatttccggatgcaagattcaaaagattattatggccttgctcctggcaaatctgtgatactcagatatgcatttcctataaagtgcactgaagttattctagctgatgataatgagaccattcttgaaattcgggctgagtatgatccttcaaagaagacaaagcctaagggtgtgcttcattgggtttctcaaccttctccgggagttgatccattaaaggtggaagtgaggttgtttgagaggctattcctatcagagaatcctgctgaacttgacaactggctcggggacctaaaccctcattccaaagtggaaatttcgaatgcatatggtgtgtccttgctgaaggatgcaaaactcggggacaggttccagtttgaaagattaggatattttgcagtcgaccaggactctaccccagaaaaacttgtatttaatcggactgtcacccttaaagacagctatggtaagggcggaaagtag

SEQ ID NO: 91066 - protein, 794 aa, Lupinus luteus
MPAKDDTSSDKEKSLELFLKIGLDERTAKNTVANNKVTTNLTSVINDAGVTDGCSRTVGNLLYTVATKYPANALPHRPTLLQYIVNSKVKTTAQLDAALSFLSATGSENLDLNKFEEACGVGVEVSTEDIKHAVDEVVEENKATILELRYRVNVGELLGHVRKRLPWADAKVVKQLVDAKLYEILGDRTAADNEKPKKKKEKPAKVEDKAAPVATSEKPLEEDLNPYLIFPNPEDNFKVHTEVPFSDGNILRCCNTKALLEKHLKATGGKVLTRFPPEPNGYLHIGHAKAMFVDFGLAKDRNGGCYLRFDDTNPEAEKKEYIDHIEEIVQWMGWEPFKITYTSNYFQELYEFAVELIRRGHAYVDHQTADEIKEYREKKLNSPWRDRPISESLKLFEDMRRGFIEEGKATLRMKQDMQSDNYNMYDLIAYRIKFTPHPHAGDKWCIYPSYDYAHCIVDSIENVTHSLCTLEFETRRASYYWLLHALGIYQPYVWEYSRLNVSNTVMSKRKLNRLVTEKWVDGWDDPRLMTLAGLRRRGMTPTAINAFVRGMGITRSDGTLISVERLEYHVREELNKTAPRAMVVLHPLKVVITNLEAKSAIEVDAKKWPDAQADDASAFYKIPFSNVVYIERSDFRMQDSKDYYGLAPGKSVILRYAFPIKCTEVILADDNETILEIRAEYDPSKKTKPKGVLHWVSQPSPGVDPLKVEVRLFERLFLSENPAELDNWLGDLNPHSKVEISNAYGVSLLKDAKLGDRFQFERLGYFAVDQDSTPEKLVFNRTVTLKDSYGKGGK

SEQ ID NO: 91067 - DNA, 1671 bp, Nitrosomonas europaea
  CDS (1)..(1671): transl_table=11
gtgaatacaccttcatccccagctcatttcatccgcaacatcatcgaggaagacaaccgtaccggtaaatggaatggacgggtggaaacacgttttccgcccgaaccgaacggttatctgcatatcggtcatgcaaagagcatttgcctgaattttggacttgcccttgaatatggcggcgtctgccatctgcgattcgatgatacaaaccctgaaaaagaagcccaggaatatgtcgatgccattatcgaatcagtccgctggctgggtttcgactggaaggaacatctctattacgcttctgattactttgatcagttatacgaatttgcagaatatctgatcacacagggtaaagcatacgtggacagcctgtcggctgatgaaatccgcagattgcgcggaaccctgactgaggcaggtaccaacagtccttatcgtgaccgctctgcagaagaaaatctcgatttgttccgccgtatgcgcgcaggagaattcccggacggagtgcatgtgttacgtgccagaatcgatatggcttcacccaatatcaatctgcgcgacccggtcatttatcgtatccgccatatccaccaccagcgcacaggtgacaaatggtgcatctacccgatgtacgattacacccattgcatttccgatgcgctggaacgtattacccactcactctgtacgctggagttcgaagatcatcgaccgctgtacgactgggtactggatcagctggcagaaaaaattccctgccatccgcagcaaatagaatttgcacggctgaacctgacctacagcgtgatgagcaaacgcaagctgatcgatctggtagaaaacaaactggtagatggctggaacgatccacgtatgaatacactggctggtttgcgtcgccgtggttatacaccggaatcgatccgcctgttcgcggaacgcattggcatcagcaaggcggattcctggatcgatatgactatcctggaagattgcctgcgtgaagatctcaatgagcgcgccctgcgccgcattgccgtgctcgatccggtatcgctgatcatcgataatttcccggatggccatgaagaaacctgctacgcacccaatcatcctcagaaacccgagcttggcacacgcgagctgcgcctgacgaaacaactttatatcgatcgtgaagatttcatggagataccgaacaaaggctttttccgcctggctcctggggcagaagtacggctacgctatgcgtttatcataaagtgcacccatgtcgtcaaggatgatcaggggaaaatcctggaaatccactgtgtttatgatccggacaccaaaagtggcactgccggagctgaaacccgcaaggtgcgcggcaatattcactggttgtcggccacgtatgccaaggctgttgaaatcaggttgtatgaccgcctgttcatcgactcacaccccgatacagaaggcaaggatttcaaaatttcgctgaatccgaattccaaagaagtcattaccgggtatgttgaaccttcgttatgcgaagcacagccggaacagcgattccagttcgagcgccacggctatttcgtggcagatctggcagataccggaccggggaaaccgatattcaaccgtactgtatccctgcgtaatacctggaaaaaatga

SEQ ID NO: 91068 - protein, 556 aa, Nitrosomonas europaea
MNTPSSPAHFIRNIIEEDNRTGKWNGRVETRFPPEPNGYLHIGHAKSICLNFGLALEYGGVCHLRFDDTNPEKEAQEYVDAIIESVRWLGFDWKEHLYYASDYFDQLYEFAEYLITQGKAYVDSLSADEIRRLRGTLTEAGTNSPYRDRSAEENLDLFRRMRAGEFPDGVHVLRARIDMASPNINLRDPVIYRIRHIHHQRTGDKWCIYPMYDYTHCISDALERITHSLCTLEFEDHRPLYDWVLDQLAEKIPCHPQQIEFARLNLTYSVMSKRKLIDLVENKLVDGWNDPRMNTLAGLRRRGYTPESIRLFAERIGISKADSWIDMTILEDCLREDLNERALRRIAVLDPVSLIIDNFPDGHEETCYAPNHPQKPELGTRELRLTKQLYIDREDFMEIPNKGFFRLAPGAEVRLRYAFIIKCTHVVKDDQGKILEIHCVYDPDTKSGTAGAETRKVRGNIHWLSATYAKAVEIRLYDRLFIDSHPDTEGKDFKISLNPNSKEVITGYVEPSLCEAQPEQRFQFERHGYFVADLADTGPGKPIFNRTVSLRNTWKK

SEQ ID NO: 91069 - DNA, 1680 bp, Pasteurella multocida
  CDS (1)..(1680): transl_table=11
atgagtcatccagttgaaaatgttgtcgcagctgaaaatacagaaaaacgtcccaccaattttattcgtcaaatcattgatgaagatttagcatccggcaaacataccggtgtccaaacacgttttccacctgaacccaatggctatttgcatattggtcatgccaaatcaatttgcttaaattttggtatcgctgaagattatcaagggttgtgtaatttacgtttcgatgatacgaatcccgtcaaagaagatgtggaatatgtggattcgattaaacaagatgtagaatggttaggtttcaagtgggaaggagagcctcgttatgcctccgactattttgatcaactctatggctatgcgattgagttaatcgaaaaagggttagcttatgtggatgaactttcgccagaagaaatgcgtgaataccgtggtacgttaacggaaccgggtaaaaatagcccttatcgtgatcgttctattgaagaaaacctcgcgttatttgagaaaatgaagaacggagaaattgcagaaggcaaagcctgtttacgtgcgaaaattgatatggcgtctccgtttattgtcatgcgcgatccagtaatttatcggattaaatttgcgacccatcaccaaacaggtgataaatggtgcatttacccaatgtatgattttactcattgtatctctgatgccattgagcgcattactcattcgctttgtacattggaattccaagataatcgtcgtttgtatgactgggtattagaaaatatttcgattgcgcgtccattgccgcaccagtatgagttttcacgtttaaatttagaatcgaccctcacttctaaacgtaaattattacaactggtgaatgaaggtattgtcgatggctggaatgacccacgtatgccaacgatttcgggcttacgtcgtcgtggttatacgccagcttcattgcgtgagttttgtcgtcgtattggcgtcactaaacaagataatatggtggaattcagtgcactagaagcttgcattcgtgaagacttaaatgagaatgcgccacgagcaatggcggtgattaatccacttaaaattgtgattgagaatttcagtggcaaagaaatgctgactgcaccaaaccaccctaatcgtgatgaactaggtgtacgcgaattaccctttacgcgtgaactatatattgatcaagcggatttccgtgaagaagcaaataaacaatataaacgcttagtgcttggtaaagaagtgcgtttacgtaatgcttatgtgattaaagccgaacgtgttgaaaaagatgcagaggagaatatcacaaccgtttattgtacttatgaccctgacacgctagggaaaaatccagcagatggacgtaaagtgaaaggcgtgattcaatgggtgtctgcggaagattatttaccagctgaatttcgtcaatatgggcgtttatttacggtggcaaacccaggagccgcagaggatattcaccaagtactgaacccagattcattggtgattaaacaaggtgtggtggagaagagtttagccaatgcacagccagaaaaagcttaccaatttgagcgtgaaggttattattgtgcagacagcaaagatagccgcccagatcatttggtcttcaatttaaccgtgagtttaaaagaaggcttctaa

SEQ ID NO: 91070 - protein, 559 aa, Pasteurella multocida
MSHPVENVVAAENTEKRPTNFIRQIIDEDLASGKHTGVQTRFPPEPNGYLHIGHAKSICLNFGIAEDYQGLCNLRFDDTNPVKEDVEYVDSIKQDVEWLGFKWEGEPRYASDYFDQLYGYAIELIEKGLAYVDELSPEEMREYRGTLTEPGKNSPYRDRSIEENLALFEKMKNGEIAEGKACLRAKIDMASPFIVMRDPVIYRIKFATHHQTGDKWCIYPMYDFTHCISDAIERITHSLCTLEFQDNRRLYDWVLENISIARPLPHQYEFSRLNLESTLTSKRKLLQLVNEGIVDGWNDPRMPTISGLRRRGYTPASLREFCRRIGVTKQDNMVEFSALEACIREDLNENAPRAMAVINPLKIVIENFSGKEMLTAPNHPNRDELGVRELPFTRELYIDQADFREEANKQYKRLVLGKEVRLRNAYVIKAERVEKDAEENITTVYCTYDPDTLGKNPADGRKVKGVIQWVSAEDYLPAEFRQYGRLFTVANPGAAEDIHQVLNPDSLVIKQGVVEKSLANAQPEKAYQFEREGYYCADSKDSRPDHLVFNLTVSLKEGF

SEQ ID NO: 91071 - DNA, 1668 bp, Photorhabdus luminescens
  CDS (1)..(1668): transl_table=11
atgagtgaggcagacgcccgcccgacaaactttattcgtcagataattgacgaagatttggcaactggtaaacatacatcggtacatactcgtttcccgcctgaacccaatggttatctgcatattggtcatgcaaaatctatctgtttgaacttcggtgttgcaaaggactatcaggggcagtgtaatctgcgctttgatgataccaatccagttaaggaagatgttgaatacgtcgattctattaaaaatgatgttcagtggttaggttttgagtggagcggtgatattcgctactcttctaattatttcgatacgctgtatcagtatgctattgaattgatcaacaaaggtctggcttatgttgatcaattgagtccagaagagatccgtgaatatcgtggtacgttaaaagagccgggcaaaaatagcccatatcgtgaccgcactattgaagaaaacttggtgttgttcgaaaaaatgcgtgccggtgaatttgacgaaggtaaagcttgtctgcgcgctaaaattgatatggcatccccttttattgtgatgcgtgatccggttttgtaccggattaaatttgcagagcatcatcagtgtggtaacaaatggtgcatctacccaatgtacgattttactcactgtatttctgatgcgcttgaaggtattacacattcgctgtgtacgctggagttccaggataaccgccgcctgtacgactgggtgctggaaaatatcaccattgattgtcgtccacgccaatatgaattctcgcgtttgaaccttgaatatacggttatgtctaagcgtaagctgaatctgctggtggcagataagattgttgaaggttgggatgacccacgtatgccaacgatctcaggcttgcgtcgtcgtggttatactgccgcgtctattcgtgaattctgtcgtcgtattggtgtcaccaagcaggataataatgtggaaatggcagcattggaatcttgtatccgtgatgatctgaacgaaaatgcgcctcgcgcaatggctgttcttgatccggtcagattagtgatcgaaaacatgccagaaggggagcagattttgagtatgcctaatcatccgaacaaaccggagatgggcagccgtgaagtgccatttagtcgtgagatctatattgaccgagcagatttccgtgaagaggcgaatcgtcaatataagcgtctggtattgggtaaagaagttcgtctgcgtaacgcttatatcattaaagcggagcgcgttgagaaagatgctgacgataatatcacgacaatctattgcagctacgatgatcaaacgttgaataaagatccagcggatggtcggaaagtgaaaggtgttattcattgggttagtgcggttcatgcggttgctgctgaattccgtctgtatgatcgtctgttctgcgtgccgaacccaggtgcggaggatgattttctggcgacaatcaacccagaatcactggtgatccgtcagggctttgttgagccaagtttagctgatgctaaatcagaacaaacttatcagtttgagcgtgaaggttatttctgtgctgatagttgtcattccagtgcagaaaatctggtatttaaccgtaccgctggcctgcgtgatacttgggcaaaaatttctcaggattaa

SEQ ID NO: 91072 - protein, 555 aa, Photorhabdus luminescens
MSEADARPTNFIRQIIDEDLATGKHTSVHTRFPPEPNGYLHIGHAKSICLNFGVAKDYQGQCNLRFDDTNPVKEDVEYVDSIKNDVQWLGFEWSGDIRYSSNYFDTLYQYAIELINKGLAYVDQLSPEEIREYRGTLKEPGKNSPYRDRTIEENLVLFEKMRAGEFDEGKACLRAKIDMASPFIVMRDPVLYRIKFAEHHQCGNKWCIYPMYDFTHCISDALEGITHSLCTLEFQDNRRLYDWVLENITIDCRPRQYEFSRLNLEYTVMSKRKLNLLVADKIVEGWDDPRMPTISGLRRRGYTAASIREFCRRIGVTKQDNNVEMAALESCIRDDLNENAPRAMAVLDPVRLVIENMPEGEQILSMPNHPNKPEMGSREVPFSREIYIDRADFREEANRQYKRLVLGKEVRLRNAYIIKAERVEKDADDNITTIYCSYDDQTLNKDPADGRKVKGVIHWVSAVHAVAAEFRLYDRLFCVPNPGAEDDFLATINPESLVIRQGFVEPSLADAKSEQTYQFEREGYFCADSCHSSAENLVFNRTAGLRDTWAKISQD

SEQ ID NO: 91073 - DNA, 1704 bp, Pseudomonas putida
  CDS (1)..(1704): transl_table=11
atgagcaagcccactgccgacaacgcgcccaacgccgctgccaaaggcgcccccgctgtccctgcgaacttcctgcggccgatcatccaggccgacctggactcgggcaagcacagcagcatcgtcacccgtttcccgccggagcccaatggttacctgcacatcggccacgccaagtcgatctgcgtcaacttcggcctggccaaggaattcggcggcgtctgccacctgcgtttcgacgataccaacccggccaaggaagaccaggagtacatcgacgccatccagagcgatgtcaaatggctgggcttcgagtggggcggcgacgtgcgttacgcctccgactacttcgaccagctgcacgactgggcggtcgagctgatcaagcgcggcaaggcctacgtctgcgaccttactcccgagcaagccaaggaataccgcggcaacctcaaggagccgggcaagaacagcccgttccgcgagcgcagcgtggaagaaaacctcgacctgttcgcccgcatgaaggccggcgagttcaaggacggcgagcgtgtgctgcgggccaagatcgacatggcctcgccaaacatgaacctgcgcgaccctatcctgtaccgcattcgccatgctcaccaccaccagaccggcgacaagtggtgcatctaccccaactacgacttcacccacggccagtcggacgccatcgagggcattacccactcgatctgcaccctggagttcgaagggcatcgtccgctgtacgactggttcctcgacaacctgccggtgccggcacacccgcgccagtacgagttcagccgcctgaacctgaactacaccattacctccaagcgcaagctcaagcagcttgtggacgagaagcacgtcgacgcctgggacgacccacgcatgtcgaccctgtccggcttccgtcgccgtggctacacgccggcttctatccgcaacttctgcgaaatgatcggcaccaaccgttccgacggtgtggtcgacatgtcgatgctcgagttcagcatccgtgacgacctggaccgcaccgcgccacgcgcgatgtgcgtgctgcgcccgctgaaagtggtcatcaccaactacccggaaggccaggtcgagcagcttgagctgccacgtcacccgaaggaagacatgggcgtgcgtgtgctgccgttctcccgcgagctgtacatcgaccgcgacgacttcatggaagaaccgccgaagggctacaagcgcctggaaccggccggtgaagtgcgcctgcgcggcagctacgtgattcgtgctgacgaagcgatcaaggacgccgacggcaacatcgtcgaactgcgttgctcgtacgaccccgacaccctgggcaagaaccctgaaggccgcaaggtcaagggcgtgatccactgggtgccggccgaaggcagcgtcgagtgcgaagtgcgcctgtacgaccgcctgttccgctcgccgaacccggaaaagaccgaggagggcggcagcttcctggacaacatcaaccctgcttcgctgcaagtgctcagcggttgccgtgccgagccgtcgctggcccaggcgcagcccgaggaccgcttccagttcgagcgcgaaggctacttctgcgccgacctgaaagacagccagccgggtcgcccggtgttcaaccgcactgtcaccctgcgtgactcctggggcagctga

SEQ ID NO: 91074 - protein, 567 aa, Pseudomonas putida
MSKPTADNAPNAAAKGAPAVPANFLRPIIQADLDSGKHSSIVTRFPPEPNGYLHIGHAKSICVNFGLAKEFGGVCHLRFDDTNPAKEDQEYIDAIQSDVKWLGFEWGGDVRYASDYFDQLHDWAVELIKRGKAYVCDLTPEQAKEYRGNLKEPGKNSPFRERSVEENLDLFARMKAGEFKDGERVLRAKIDMASPNMNLRDPILYRIRHAHHHQTGDKWCIYPNYDFTHGQSDAIEGITHSICTLEFEGHRPLYDWFLDNLPVPAHPRQYEFSRLNLNYTITSKRKLKQLVDEKHVDAWDDPRMSTLSGFRRRGYTPASIRNFCEMIGTNRSDGVVDMSMLEFSIRDDLDRTAPRAMCVLRPLKVVITNYPEGQVEQLELPRHPKEDMGVRVLPFSRELYIDRDDFMEEPPKGYKRLEPAGEVRLRGSYVIRADEAIKDADGNIVELRCSYDPDTLGKNPEGRKVKGVIHWVPAEGSVECEVRLYDRLFRSPNPEKTEEGGSFLDNINPASLQVLSGCRAEPSLAQAQPEDRFQFEREGYFCADLKDSQPGRPVFNRTVTLRDSWGS

SEQ ID NO: 91075 - DNA, 1743 bp, Ralstonia solanacearum
  CDS (1)..(1743): transl_table=11
atgagccaagataacgccaccggcgccgctgccgcctccacgtccaacttcctgcgccagatcatcgataccgacctggagcagggcacctacgccgggcgccaggacaccgccggccacgccctgccgcccatcatcacgcgcttcccgccggagcccaacggttacctgcacatcggccacgccaagagcatctgggtgaacttcggcctggccaaggaatacggcggccgctgccacctgcgcttcgacgacaccaacccggtcaaggaagacaccgagtacgtcgactccatcatcgacgccgtgcactggctcggctactcgtggcagaacggcaccggcgagcacctctactacgccagcgactacttcgagcagctctacggctttgccgaggtgctgatccagcgcggcgccgcctatatcgacagccagagcgccgagcagatcgccgccaaccgtggcgacttcaccaggccgggcacgccgtcgccgttccgcgaccgttcggtggaagagaacctcgcgctgttccgcgacatgcgagccggcaagtaccaggacggccagcacgtgctgcgcgcccggatcgacatggccgcgcccaacatcgtgatgcgcgatccggtgctgtaccgcatccgccacgcacaccaccaccgcaccggcgacgcatggtgcatctacccgatgtacgacttcacgcattgcatctccgatgcgctggagaacatcacgcattcgctgtgcacgctggagttcgagaacaaccgcccgctgtacgactgggtgctcgaccacctgcgcgacgccggcgcgctgcccgcgccgctgccgcaccagtacgaattcgcgcgcctgcacctcacgtacgccatcaccagcaagcgcaagctgctgcagctggtgaacgaaaagcgcgtggacggctgggacgacccgcgcatgcccaccctggtgggcatccgccgccgcggctacacgccggaatcgatccagctgttctgcgagcgcgtgggcgtctcgaaggccgacagctggatcgacatgagcatcctggaggccgccgtgcgcgacgacctcgatgcgcgcgcgccgcgctcggtggcggtgctggacccggtcaagctcatcctcgacaacgtgccggcggacttcaacgagccgtgctcggcccccgtgcacccgaagcagcccgagctgggccgccgcgagttcccgctcacgcgcgagctgtggatcgagcgcgaggacttcaccgagacgccgcccaagggctacttccgcctgttcccgggcaacaaggtgcgcctgcgctacggctacgtgatcgaatgcacgggctgcgacaaggatgccgacggcaacatcaccgccgtgcacgccaacatcatcccggacaccaagagcggcacgccgggtgcggacagcgtcaaggtcaagggcaacatccactgggtcagcgccgcgcatgcgctcgaggccgaggtgcgcctgtacgatcgcctgttcaccgacccgcagccggactcgggcgacaagaacttcctggacgcgctcaaccccgacgccaagcgggtcgtcacggcctacctggaaccgacgctggcaaccgccaagccggaagaccgcttccagttcgagcgccacggctacttcgtggccgaccgcatcgactcgcagccgggcaagcccgtgttcaaccgcgtggtcggcctgaaggacagctggggcaagtaa

SEQ ID NO: 91076 - protein, 580 aa, Ralstonia solanacearum
MSQDNATGAAAASTSNFLRQIIDTDLEQGTYAGRQDTAGHALPPIITRFPPEPNGYLHIGHAKSIWVNFGLAKEYGGRCHLRFDDTNPVKEDTEYVDSIIDAVHWLGYSWQNGTGEHLYYASDYFEQLYGFAEVLIQRGAAYIDSQSAEQIAANRGDFTRPGTPSPFRDRSVEENLALFRDMRAGKYQDGQHVLRARIDMAAPNIVMRDPVLYRIRHAHHHRTGDAWCIYPMYDFTHCISDALENITHSLCTLEFENNRPLYDWVLDHLRDAGALPAPLPHQYEFARLHLTYAITSKRKLLQLVNEKRVDGWDDPRMPTLVGIRRRGYTPESIQLFCERVGVSKADSWIDMSILEAAVRDDLDARAPRSVAVLDPVKLILDNVPADFNEPCSAPVHPKQPELGRREFPLTRELWIEREDFTETPPKGYFRLFPGNKVRLRYGYVIECTGCDKDADGNITAVHANIIPDTKSGTPGADSVKVKGNIHWVSAAHALEAEVRLYDRLFTDPQPDSGDKNFLDALNPDAKRVVTAYLEPTLATAKPEDRFQFERHGYFVADRIDSQPGKPVFNRVVGLKDSWGK

SEQ ID NO: 91077 - DNA, 1806 bp, Rhodopirellula baltica
  CDS (1)..(1806): transl_table=11
ttggcgagggcgaatcgcggcgagcattctaccctttcaacgttttggcaatcgcgtcacaatgcggcatcttttgatcccttgtaccggcgaatcgacgtgaacgcacccgaaccatctgactcggccacacctgaaaaaacgccgtccaaacacttcattcgccaagcgattgatgcggatctggcgagtggacgctttgacggagttgccacgcgatttccgccggaacccaacggttatctccacatcggacacgcaaaaagcatctgcctgaactttggtctggccaaagacatgggcggcacatgcaatttgcgattcgatgacaccaacccaatcaaagaagacaccgaatacgtcgactcgattcaagaagacgtccgttggttggggtttgagtgggacaacttgcacttcgccagcgactacttcgatcagctttatgattgggcggagcaactggtcaaagacggcaaggcttacgtttgtgacctgaccgctgaggagactcgcgagtatcgcgggacgttgactgaaccgggcaagaattcacctcatcgcgatcgcactcccgagaaaaacttggaattgctgcgggcgatgaaggcgggcaagttcaaagacggtgagaaaacgttgcgagccaagatcgacatggcgtcgccaaacatcaatcttcgcgatccggtgatgtaccgaatcgctcatgtgccgcaccatcgcactggcgacaaatggtgcatctatcccatgtatgactgggcccacggtcagtccgattcgctggaaaagatcacattctcgatttgcacgctcgagttcgaacatcatcggccgctttacaattggtactgcgagaaccttggtattcatcatcctcgccaaatcgagttcgctcgcttgaacatgactttcaccgtcatgagcaaacgaaaactattgcaattggtgaaggaaaatcacgtcaccggttgggatgatcctcgaatgccgaccttggttggtttgcgtcgtcgcggctacacacccgaatcgattcgctcgttctgcgccgacatcggcgtggccaagttcaacagcacgattgatgtcattcggttggagaattcggttcgcgaacacctgaactcggtcgcgccgcggcggatggcggttttggatccgatcaaactcaccatcacgaattggcccgagggcaaagtcgaaatgatgaacgcgatcaacaaccccgaagacgaatccgccggtagtcgcgagattccatttagcggtgaactgtacatcgagaccgaagattttcgcgaagaggctcctcgcaagtttttccgtttgaagaagggcggttcggttcgtttgcgttcgggctacatcgtggactgtcacgacgtggtgaaggacgccgatgggaacgtcaccgaagtcctctgcacctacgatccagaaaccaagagcggtgaagatacctcgggtcgcaaggtcaagggcacaattcactgggtcagtcgtgagcacgcccaaaaggtgacggtccggaactacgatcggctgttcaaagtcgagaacccagacgcatcatctgacacgggatcgttcctggatcacttgaacccagactctttgacgacgttgaccgctcacgtggaacccgcgctggcggaagccgccgttggtgatcgcgtgcagttcgaacgacttgggtactacgtcgtcgatcccgattcgactgatggcgagatcatcttcaaccgcattgttccgctgcgtgatacttggggaaagatcgaagcgaagggcaagaagtag

SEQ ID NO: 91078 - protein, 601 aa, Rhodopirellula baltica
MARANRGEHSTLSTFWQSRHNAASFDPLYRRIDVNAPEPSDSATPEKTPSKHFIRQAIDADLASGRFDGVATRFPPEPNGYLHIGHAKSICLNFGLAKDMGGTCNLRFDDTNPIKEDTEYVDSIQEDVRWLGFEWDNLHFASDYFDQLYDWAEQLVKDGKAYVCDLTAEETREYRGTLTEPGKNSPHRDRTPEKNLELLRAMKAGKFKDGEKTLRAKIDMASPNINLRDPVMYRIAHVPHHRTGDKWCIYPMYDWAHGQSDSLEKITFSICTLEFEHHRPLYNWYCENLGIHHPRQIEFARLNMTFTVMSKRKLLQLVKENHVTGWDDPRMPTLVGLRRRGYTPESIRSFCADIGVAKFNSTIDVIRLENSVREHLNSVAPRRMAVLDPIKLTITNWPEGKVEMMNAINNPEDESAGSREIPFSGELYIETEDFREEAPRKFFRLKKGGSVRLRSGYIVDCHDVVKDADGNVTEVLCTYDPETKSGEDTSGRKVKGTIHWVSREHAQKVTVRNYDRLFKVENPDASSDTGSFLDHLNPDSLTTLTAHVEPALAEAAVGDRVQFERLGYYVVDPDSTDGEIIFNRIVPLRDTWGKIEAKGKK

SEQ ID NO: 91079 - DNA, 2436 bp, Schizosaccharomyces pombe
  CDS (1)..(2436)
atggaccaggattatgaggagttacgtgccaagtttacaaaaataggattaaatgaaacaacggtaaaagatacgttaaaaaataaaaagctttcttcttcattaaataaggtcattgaggaaactaacgttggttcttcgggatgtgatagaacaattggaaatttgctatttacattggccaacgcttctttaaaacaaaaagacccgaaatccaatgctcatgaggcattcatagcttccaaaattgtatctggagacttaaaaacaaacctccaagtcaatgcggctattacctattgcaaggacaaagacacgatcgacgaatctgagttcgataaagaaactggtgttggtgtagtcttaacacctgaacaaattgaacaactcgtcggtgattatgtcgctgagaataagtcaaaaattttggagcaaagataccagctgttaaatccttctgcctctgctttacgtcagcatgctttattgaaatgggctcctcaactggaggtcaagcagacccttgataggaaattccttgaactcttgggaccaaaaaccgaacaagatgctgccgctggtaaaaaaaaaggcgcaaaagccaagaattcgaagcagaagactgttgattctgggaaagctaaggaacaaaaaattgtttctgaacagtctaagaaatataatatgtttgaggaagggtttttagcaaagctacataaaccaggtggtaatacgcagctgattcctgaaaggatgaaggagcacctgcaggctactggaggcggcgttgtaaccaggtttcctccggaaccaaatgggtacctccatattggccattccaaagcaatcgctgttaattttgggtttgctcgctatcataacggcgtttgttatttacgctttgatgatactaatccggaagctgaagaagagcgttactttgaaagcatcaaggatttggtagcctggttgggattccaaccttataagatcacctattccagtgattactttgataagttatatgagttagccgaagagctcattaagcgggacaaggcatatgtttgtcattgtaccgatgctgaaattaaaaaagctagaggtggtgaggagcgcggtcctcgttatgcttgtgttcatcgggaccgcccgatagaagaatcgcttcttgaatttcgtaatatgcgtgatggaaagtatcaaccgaaggaggctattttacgtatgaaacaagatctcagtgatggaaatcctcaaatgtgggaccttattgcctaccgtgttcttaattctcctcatcctcgtactggagacaagtggaaaatttacccaacttatgattttacccattgtttagttgattcgttcgagaacatttctcactctttgtgtacgactgagtttatattatctagagtaagttatgagtggttatgtaatgccttggaagtttattgtcctgctcagcgtgagtacggtcgtttgaacgttgtcggaaccctcatgagcaaacgaaaaataatgaaattggtaaaggaaggatacgttcatggttggaatgatcctaggctatatacccttgtagctcttcgccgccgaggtgttcctccaggtgctatccttgagtttgttagtgaagtcggtgtcactactgccgtcagcaatatagaagttgctcgatttgagaactgtgttcgaaaatttctcgaaaacagtgtaccacgtcttatgtttcttcctgatcctatcaaggttacattagaaaatctagacgactcttacagagagcaaattgagataccctttaatcctaaagatccttctatgggatctcgttctgcttttcttacaaagcatatatacattgaccgttctgattttcgtgaggaagcatcttctgactttttccgtttgacattaggtcaaccggttggcttgttccgtgcctctcatcctgtagttgccaaaagggttgtaaaaaatgatgaaggggaaccaatagaaatcatcgctgagtacgacgctagctcttcaaagaagcctaagacctttattcaatgggtgtctagggacaaagaaagtaatagtccagtacttattgctgaaacccgcctctttaataatcttttcaaatgtgataaccctgccgccctaaaagaacaagagctcgctgcacaattgaatccagagagcgaagtcgtactaaaaaattccattattgaacctggcatttatgatttaattaaatcggcaccttggcctaagactgattcatcggctggtgtcgacaaagccgaaaatcctgaaagtgtccgttttcaagctatgcgggttggatatttctgtttagatgaggatactaagaaaccaaatcatcttgtattgaatagaattgtatccctcagagaagattcggctaagaataaaaattag

SEQ ID NO: 91080 - protein, 811 aa, Schizosaccharomyces pombe
MDQDYEELRAKFTKIGLNETTVKDTLKNKKLSSSLNKVIEETNVGSSGCDRTIGNLLFTLANASLKQKDPKSNAHEAFIASKIVSGDLKTNLQVNAAITYCKDKDTIDESEFDKETGVGVVLTPEQIEQLVGDYVAENKSKILEQRYQLLNPSASALRQHALLKWAPQLEVKQTLDRKFLELLGPKTEQDAAAGKKKGAKAKNSKQKTVDSGKAKEQKIVSEQSKKYNMFEEGFLAKLHKPGGNTQLIPERMKEHLQATGGGVVTRFPPEPNGYLHIGHSKAIAVNFGFARYHNGVCYLRFDDTNPEAEEERYFESIKDLVAWLGFQPYKITYSSDYFDKLYELAEELIKRDKAYVCHCTDAEIKKARGGEERGPRYACVHRDRPIEESLLEFRNMRDGKYQPKEAILRMKQDLSDGNPQMWDLIAYRVLNSPHPRTGDKWKIYPTYDFTHCLVDSFENISHSLCTTEFILSRVSYEWLCNALEVYCPAQREYGRLNVVGTLMSKRKIMKLVKEGYVHGWNDPRLYTLVALRRRGVPPGAILEFVSEVGVTTAVSNIEVARFENCVRKFLENSVPRLMFLPDPIKVTLENLDDSYREQIEIPFNPKDPSMGSRSAFLTKHIYIDRSDFREEASSDFFRLTLGQPVGLFRASHPVVAKRVVKNDEGEPIEIIAEYDASSSKKPKTFIQWVSRDKESNSPVLIAETRLFNNLFKCDNPAALKEQELAAQLNPESEVVLKNSIIEPGIYDLIKSAPWPKTDSSAGVDKAENPESVRFQAMRVGYFCLDEDTKKPNHLVLNRIVSLREDSAKNKN

SEQ ID NO: 91081 - DNA, 1671 bp, Shewanella oneidensis
  CDS (1)..(1671): transl_table=11
atgagtcatgtggacactgaagtacgtccgagtaactttattcgtaatatcattgatgaggatctgaaaagcggtaagcacaccaatgtgcagacgcgttttccacccgagccaaatggttatttacatataggtcatgctaagtccatctgtttgaactttggcatcgcccgcgattaccaaggtctctgtaacttacgatttgatgataccaaccctgaaaaagaagacatcgattatgttaattctattcaggcggatgtgcgttggttgggattccagtgggatggtgaggtgcgttattcctctaattatttcgaccaattacatcaatatgccgttgagttaattaataaaggcctagcctatgtgtgtttcctcaatgccgatgaaacccgtgaataccgtggtacgttaaaagaaccaggcaaaaatagcccttatcgtgatacacctgtggaagaaaacctgcgcttatttggaaaaatgcgtctgggtgaattcaaagaaggtgagtgtgcgctgcgtgctaaaatcgacatggcatcgccttttatgtgtatgcgcgatccggtgatttatcgtattcgttttgctcatcatcaccaaacgggcgataagtggtgcatttacccaatgtacgactttactcactgtatctctgacgccctggagcatattacccattctctgtgtacgcttgagttccaagataaccgtcgtctatatgactgggtgctggacaatttagatgatttccaagcgccaaatcgtactcgtcaatatgagttttctcgcttaaatcttgaatatacgctgatgtctaagcgtaaattaaatgacttagttacgcgtaaattagtgactggctgggatgatccgcgtatgcctacgattgctggtcttcgtcgtcgtggttatacccctgcgtctattcgtgaattttgccaacgtattggtatcaccaagcaagaaaacatgattgaagcggcgatgctcgatgcctgtatccgtgaagagctaaacgagcatgcaccccgtgcgatggccgtattgcgtccattaaaagtggtgattgagaactaccctgaaggtcaaatcgagactattcaagcggcttctcaccctagcgatgaaagtatggggacgcgtgagttggcttttggtcgtgagatctttattgatgtggcagatttcagagaagaagccaataagcaatacaagcgtttagtgatgggcaaagaagtgcgtctgcgtaacgcttatgtgatcaaggctgagcgttgtgataaagacagcgaaggcaatatcaccacagtttactgtagctatgatgctgatactttaggtaaaaatcctgccgatggtcgcaaggtgaagggcgtaatccattgggttgaagctactacggctaaacctgcacagttccgcttataccaacgtttgttcactgatccaaatccagctgcggctgagacagtggatgaagtactcaaccctaactcacttgaagtggttaatggtttagtcgaagcaagccttgcgaatgcgccagcggaaaaagcttatcagtttgaacgtgaaggttatttctgtgcggacaacaaagactcatcagccgatcatttagtgtttaacctaacggttgcactgcgtgactcgtttgaatag

SEQ ID NO: 91082 - protein, 556 aa, Shewanella oneidensis
MSHVDTEVRPSNFIRNIIDEDLKSGKHTNVQTRFPPEPNGYLHIGHAKSICLNFGIARDYQGLCNLRFDDTNPEKEDIDYVNSIQADVRWLGFQWDGEVRYSSNYFDQLHQYAVELINKGLAYVCFLNADETREYRGTLKEPGKNSPYRDTPVEENLRLFGKMRLGEFKEGECALRAKIDMASPFMCMRDPVIYRIRFAHHHQTGDKWCIYPMYDFTHCISDALEHITHSLCTLEFQDNRRLYDWVLDNLDDFQAPNRTRQYEFSRLNLEYTLMSKRKLNDLVTRKLVTGWDDPRMPTIAGLRRRGYTPASIREFCQRIGITKQENMIEAAMLDACIREELNEHAPRAMAVLRPLKVVIENYPEGQIETIQAASHPSDESMGTRELAFGREIFIDVADFREEANKQYKRLVMGKEVRLRNAYVIKAERCDKDSEGNITTVYCSYDADTLGKNPADGRKVKGVIHWVEATTAKPAQFRLYQRLFTDPNPAAAETVDEVLNPNSLEVVNGLVEASLANAPAEKAYQFEREGYFCADNKDSSADHLVFNLTVALRDSFE

SEQ ID NO: 91083 - DNA, 1671 bp, Vibrio parahaemolyticus
  CDS (1)..(1671): transl_table=11
atgagtgaagctgatgctcgtccatcaaactttattcgccagatcattgataaggatctagcggatggcaaacacactagcgtgcatactcgattcccgccggagccaaatggctacctgcacatcggtcatgctaagtctatctgtttgaacttcggtattgctcaggactaccagggtcaatgtaacttacgtttcgacgatacaaaccctgaaaaagaagacatcgaatacgttgagtctatcaagaaagatgtaaactggttaggcttcgagtgggatggtgaagtatgttactcatcaaactacttcgacaagctttacgaatatgcaattgaattgattaacaaaggcttagcgtacgtagatgagctaagtccagagcagattcgtgagtaccgtggcacgctaaaagagccaggtaagccaagcccataccgcgaccgttctgttgaagaaaacttagcgctatttgaaaaaatgcgcgcaggtgaatttgaagaaggtaaagcgtgtcttcgtgcgaagatcgatatgggttcgtcattcatggttatgcgtgatccagttctataccgtgtacgttttgctactcaccatcaaacgggtgataagtggtgcatttacccaatgtacgacttcacacactgtatctctgatgcgctagaaggcattacacattctatctgtacgctagagttcatggacaaccgtcgtttgtacgactgggtactagacaacatcacaattgattgtcgtcctcatcaatacgagttcagccgtctaaacctagaatacacagtgatgtctaagcgtaagctaaaccaactagtaaccgaaaaattggttaacggttgggatgatcctcgtatgccaacagtatctggtttacgtcgccgtggtttcacacctgcgtcaatccgtgaattctgtaagcgtatcggtgtgacgaagcaagaaaacatgatcgagtttagctcgcttgaatcttgtattcgtgacgacctaaatgaaaatgcacctcgtgcgatggctgtgttggaccctgttaaagttgttattgagaactttgaagtgggcgctgtagaaaatctaacgctggctaaccatccaaataaacctgaaatgggtgagcgtgaagtaccgtttactcgtgaagtttggatcgagcgtgaagatttccgtgaagaagcgaacaaaaagtacaagcgtctagttcttggcaaagaagttcgtttacgtggtgcttacgtgatcaaagctgagcgtgttgaaaaagacgcggaaggcaacatcacaacgatttactgtacttacgatcctgaaacgctaggcaaaaacccagcagatggtcgtaaagttaaaggcgtaattcactgggtatctgcggataaagcgctaccagcagaaattcgcctatacgatcgtttgttcactgttccaaatcctgcagcagcagaagacttcgcttcaaccattaacactgattcactcgttgtgatcaacggtttcgttgagccgagcctggcatctgcagaagcagagcaaggctaccagttcgagcgtatgggttacttctgtgcggattctaaagattcaactgcagataacctagtgttcaaccgcacggttggcctacgtgatacatgggcgaaaattgagaaccaataa

SEQ ID NO: 91084 - protein, 556 aa, Vibrio parahaemolyticus
MSEADARPSNFIRQIIDKDLADGKHTSVHTRFPPEPNGYLHIGHAKSICLNFGIAQDYQGQCNLRFDDTNPEKEDIEYVESIKKDVNWLGFEWDGEVCYSSNYFDKLYEYAIELINKGLAYVDELSPEQIREYRGTLKEPGKPSPYRDRSVEENLALFEKMRAGEFEEGKACLRAKIDMGSSFMVMRDPVLYRVRFATHHQTGDKWCIYPMYDFTHCISDALEGITHSICTLEFMDNRRLYDWVLDNITIDCRPHQYEFSRLNLEYTVMSKRKLNQLVTEKLVNGWDDPRMPTVSGLRRRGFTPASIREFCKRIGVTKQENMIEFSSLESCIRDDLNENAPRAMAVLDPVKVVIENFEVGAVENLTLANHPNKPEMGEREVPFTREVWIEREDFREEANKKYKRLVLGKEVRLRGAYVIKAERVEKDAEGNITTIYCTYDPETLGKNPADGRKVKGVIHWVSADKALPAEIRLYDRLFTVPNPAAAEDFASTINTDSLVVINGFVEPSLASAEAEQGYQFERMGYFCADSKDSTADNLVFNRTVGLRDTWAKIENQ

SEQ ID NO: 91085 - DNA, 1743 bp, Xylella fastidiosa
  CDS (1)..(1743): transl_table=11
atgtccgaaatcaccagcaccgacgcccgagcccagcctgagaagaaagactttatccggcagatcatcagagaagacttagcccacggcacacacactcacatccgcacccgtttccccccagaacccaacggttacctgcacattggccacgccaaagcaatctgcctggattttggcgtcgccgcggaattcggcggacactgcaccctccgcatggacgacaccaatccgagcaaagaagaccccgcgttcgccgctgcaatccaggacgacgtctcttggctaggcttccattggaacgcactacgacatacatcggattatttcgaagtgctgtacctggccgcagaaaaactcattaccgatggaaaagcctacgtctgtgacctcaatagcgaacaggtacgcgaataccgcggcaccctgacagaagcgggccgtccctcaccatggcgtgaacgcagccctgatgaaaatttagaactattccgacagatgcgcgccggcacgtttccagacggaacacgtaccctgcgagccaaaatcgacatggctagcggcaacatcaacctgcgggacccagcgctctaccgcattaaacacgtcgaacatcaaaacaccggcaacacctggccgatctaccccatgtatgacttcgcacacgcactgagcgatgcgatcgaaggcattacccattcattatgcaccctcgagttcgaagaccaccgccccctgtacgactggtgcgtcaaccacgtcgacctaccgaacaactcacacctactcaaaccgttactggacaaaggctttcctcaagaacccagccaacctcggcaaatcgagttttcgcgcctgaacatcaactacaccgtgatgagcaaacgcaagctcaccgcactggtggacgaaaaactcgtcgaagggtgggacgaccctcgcatgtacactctgcaaggcctacgccgccgcggctacaccccagcggccatgcgcctattcgtagagcggatcggcatcagcaaacagaactcgatcattgatttttcagtactagaaaactgcttacgcgagaacttggacaccattgcaccacgccggatggcaaccattgcaccactgaaactcgtgctgaccaacctacccgaagaccatgaagaacagctgattttccccaaccatcccaaagacgacacacaaggcacccgaacaatgccgttctcacgcgaactatggatcgaacgcgacgatttttcagaaatcccccccaagggctggaaacggctggttccaggcggagaagtacgcctacgcggcgccggcatcgcacgtgtagatgaggtggtgaaaaacgcagcaggcgacatcatcgcactacacggctggcttgatccgacctcacgtcccggtatggaaggcgctcaccgcaaagtcaaaggcaccatccactgggtcagcgcaccacacgctgtagcagcagaaatccgcctgtacgaccggctgttctccgttgaaaaacctgacgacaacaccgacggaaaaacctaccgcgacgtcctcaacccagattccaaacgcgtcgtgcatggctacatcgaaccagcggcggcacaaaccgcaccagaacacgcattccaatttgaacgcttgggctacttcgtcacagaccggcatgaccacgatgccgcacaccccgtctttaatcgcagcgtcacgctacgcgacacctggcaacgcgactga

SEQ ID NO: 91086 - protein, 580 aa, Xylella fastidiosa
MSEITSTDARAQPEKKDFIRQIIREDLAHGTHTHIRTRFPPEPNGYLHIGHAKAICLDFGVAAEFGGHCTLRMDDTNPSKEDPAFAAAIQDDVSWLGFHWNALRHTSDYFEVLYLAAEKLITDGKAYVCDLNSEQVREYRGTLTEAGRPSPWRERSPDENLELFRQMRAGTFPDGTRTLRAKIDMASGNINLRDPALYRIKHVEHQNTGNTWPIYPMYDFAHALSDAIEGITHSLCTLEFEDHRPLYDWCVNHVDLPNNSHLLKPLLDKGFPQEPSQPRQIEFSRLNINYTVMSKRKLTALVDEKLVEGWDDPRMYTLQGLRRRGYTPAAMRLFVERIGISKQNSIIDFSVLENCLRENLDTIAPRRMATIAPLKLVLTNLPEDHEEQLIFPNHPKDDTQGTRTMPFSRELWIERDDFSEIPPKGWKRLVPGGEVRLRGAGIARVDEVVKNAAGDIIALHGWLDPTSRPGMEGAHRKVKGTIHWVSAPHAVAAEIRLYDRLFSVEKPDDNTDGKTYRDVLNPDSKRVVHGYIEPAAAQTAPEHAFQFERLGYFVTDRHDHDAAHPVFNRSVTLRDTWQRD

SEQ ID NO: 91087 - DNA, 25 bp, Primer
atgtcttctgtagaagaattgactc

SEQ ID NO: 91088 - DNA, 24 bp, Primer
tcacttggaagttgcgtccttcaa

SEQ ID NO: 91089 - protein, 698 aa, consensus
  MISC_FEATURE (1)..(698): consensus for the disclosure of xaa see table XV
TRFXPEPXGXLHXGHAXXXXXNXXXAXXXXXXXGXXXLRXDDTNPXXEXXXXXXXXXXXXXIXXXXXWLGXXXXXXXXXXXXXXXXXXXXXSXXFXXXYXXAXXLIXXGXAYVXXXXXXXXXXXRXXXXXXXXXXXXXXXXXRXXXXEXXLXXFXXXMXXGXXXXGXXXLRXKXDXXXXXXXXXDXXXXRXXXXXXXXXXXHXXXGXXXXXYPXYXXXXXXXDXXEXXTHXXXXXEXXXXXXXYXXXXXXXXXXXXXXXXXXXXXXXXXXXXXXPXXXXXXRLXXXXXXXXXSKRKXXXXXXXXXXXVXXWDDPRXXTXXXXRRRGXXXXXXXXFXXXXGXXXXXXXXXXXXXXXXXXRXXXXXXXXRXXXVXXPXXXXXXXXXXXXXXXXXXXXXXXXXXXXXXXXXXXXXXXXXXXXXXXXXXXXXGXXXXXXXXXXXXXXXXXXDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQXXRXGYXXXD

SEQ ID NO: 91090 - protein, 72 aa, consensus
  MISC_FEATURE (1)..(72): consensus for the disclosure of xaa see table XV
XXXRXXPXPXXXXXXGXXXXXXXXXXXXXXXXXXXXXXXXRXXDTXPXXXXXXXXXXXXXXXXXXXXXXXXX

SEQ ID NO: 91091 - protein, 100 aa, consensus
  MISC_FEATURE (1)..(100): consensus for the disclosure of xaa see table XV
XXXXXXXXXXXXXXXXXXXXXXXXXXXXXXXXXXXXXXXXXXXXXXXXXXXXXXXXXXXXXXXXXXMXXXXXXXXXXXXXXXXXXXXXXXXXXDXXXXRX

SEQ ID NO: 91092 - protein, 45 aa, consensus
  MISC_FEATURE (1)..(45): consensus for the disclosure of xaa see table XV
XXXXXXXXXXXPXXXXXXXXXDXXXXXXHXXXXXXXXXXXXXXXX

SEQ ID NO: 91093 - protein, 101 aa, consensus
  MISC_FEATURE (1)..(101): consensus for the disclosure of xaa see table XV
XXXXXXXXXXXXXXXXXXXXXXXXXXXXXXXXXDXXXXXXXXXXXXGXXXXXXXXXXXXXXXXXXXXXXXXXXXXXXXXXXXXXXXXXRXXXXXXXXXXXX

SEQ ID NO: 91094 - DNA, 936 bp, Escherichia coli
  CDS (1)..(936)
atggcactgccaattctgttagattgcgacccaggtcatgacgacgctatcgcaatagttctcgccctcgcctcaccagagcttgatgtcaaagcaattacgtcttccgccggaaaccagacaccagaaaaaaccttacgcaatgttctgcgtatgctgaccttgcttaatcgcaccgatattccggtagcaggcggcgcggtaaaaccgttaatgcgtgagttgattatcgcggacaatgtgcacggcgaaagcggtctcgacggcccggcattaccggaaccgacattcgcaccgcaaaactgtacggcggtagagctgatggcgaaaacgctgcgtgaaagtgcggaacctgtcaccattgtgtctaccggaccgcaaactaacgttgccttgctgctcaatagccatccggaactgcatagcaaaattgcccgtatcgtgattatgggtggcgctatggggctgggtaactggacgcctgcggctgaatttaatatttacgttgacccggaagcggcagaaattgtcttccagtcagggatcccggtggtgatggccggtctggatgttactcataaagcacaaatccacgttgaagacaccgagcgtttccgcgcgattggtaaccctgtttcaaccattgttgccgaactgctggatttcttcctcgaatatcataaagacgaaaaatggggctttgtcggcgcaccactgcatgacccatgcaccatcgcctggctgttgaaaccggagttatttacctctgttgagcgctgggttggcgtggaaacacaggggaaatatacccagggtatgacggttgttgattattattatctgacaggcaataaaccgaatgccaccgtaatggtcgatgttgatcgtcagggctttgttgatttactggctgatcgtctgaaattttacgcttaa

SEQ ID NO: 91095 - protein, 311 aa, Escherichia coli
MALPILLDCDPGHDDAIAIVLALASPELDVKAITSSAGNQTPEKTLRNVLRMLTLLNRTDIPVAGGAVKPLMRELIIADNVHGESGLDGPALPEPTFAPQNCTAVELMAKTLRESAEPVTIVSTGPQTNVALLLNSHPELHSKIARIVIMGGAMGLGNWTPAAEFNIYVDPEAAEIVFQSGIPVVMAGLDVTHKAQIHVEDTERFRAIGNPVSTIVAELLDFFLEYHKDEKWGFVGAPLHDPCTIAWLLKPELFTSVERWVGVETQGKYTQGMTVVDYYYLTGNKPNATVMVDVDRQGFVDLLADRLKFYA

SEQ ID NO: 91096 - DNA, 972 bp, Danio rerio
  CDS (1)..(972)
atggcacagaagctgctgataatcgacacagactgtggtatagatgatgctctggcaatcatagttgctctggcagctccgaatgtgaaggttttgggcatcacctgctgcttcgggaacaccaatgtggacaatgtgtgtatgaatgtaatgcgggtcctgacagtctgtcaacaaacccagattccagtatttaaaggttctgcgggtcctttacttgggccagagctgccactgaaagatcactttggcacagatgggcttggaggcgttttggagaactctgaggaatggaagcagcagatacagaaagagcatgcggttcatgccatattaaggctggtcaatgaaaacccaggacaggtatctctcatagctcttggtccactcaccaacttggctttggctgttagattagatcccggtctccctcagaaactcaaggatctgtatgtaatgggcggtaacatggaaggcaaggggaatatgacgccatcgtcagagtttaatttcaggatggatgctgaatcagcttatgtagtcttggaggaatacacctgcccgacacacatcgcaacctgggagtttacttgcagaaacaaactatcttgggagtattttgaggaactggttaatcagaaaacatcagttgctcaattcataaagaagatcacatccaagtgctgggcctactctagagattttaactccagcaacaacaaagacgtgctcttcgggaaagggtttgtcccctatgatgccttcgctgtggcagcctgtctggacagcagtgtgatcacagagagtttgcggtgtgctgtacgtgtggaggtacgaggtgaactgggacgaggcatgatgattgtggacgcagccaatacactgaaaaaaggccatcttgcttttgtgatgaagacatgtgaccttaaaaagttcagctcaatgctcaatgcttcttttcaaatatcatag

SEQ ID NO: 91097 - protein, 323 aa, Danio rerio
MAQKLLIIDTDCGIDDALAIIVALAAPNVKVLGITCCFGNTNVDNVCMNVMRVLTVCQQTQIPVFKGSAGPLLGPELPLKDHFGTDGLGGVLENSEEWKQQIQKEHAVHAILRLVNENPGQVSLIALGPLTNLALAVRLDPGLPQKLKDLYVMGGNMEGKGNMTPSSEFNFRMDAESAYVVLEEYTCPTHIATWEFTCRNKLSWEYFEELVNQKTSVAQFIKKITSKCWAYSRDFNSSNNKDVLFGKGFVPYDAFAVAACLDSSVITESLRCAVRVEVRGELGRGMMIVDAANTLKKGHLAFVMKTCDLKKFSSMLNASFQIS

SEQ ID NO: 91098 - DNA, 1023 bp, Saccharomyces cerevisiae
  CDS (1)..(1023)
atgactgttagtaaaatacccatatggctagattgtgatcctggtcatgatgatgccatagccattttattaggctgtttccatccagctttcaatcttctaggaatcagcacgtgttttggtaacgcaccgccagagaatactgactacaacgcccgttctcttttgactgcgatgggcaaagcacaagcgattccagtttataaaggcgcacagagaccttggaaaagggaacctcattatgctcctgacattcatggtatatcaggtttagacggcacttctttgctacctaagccaacatttgaggcaagaactgataaaacgtatattgaggccattgaagaggcgattctagctaacaatggagagatatcctttgtgtctactggtgcacttaccacattagcaacagtttttaggtgtaaaccatacctaaaaaaatctgtcaaatatattagcattatggggggtggactccatggtctaggaaactgtaacccaaatctttctgctgaattcaacgtttggattgatcctgacgcagcgaattacatattccgtgatcccgatgtaaaggacaaatgtatagtagttcctctaaatttaactcacaaggccatagctacttacaaggttaacgaaatgatatacaacgaaaagaataacagcaagttacgagaattgtttttggagctttttcaattttttgctcatacctacaaggatatgcaaggatttgaatcgggcccacctatacatgatccggtagctttgatgccgcttttggaattttatgggtgggatccatcgtctgcggttggatttcgctacaagagaatggacatatcctgcattgatgatgttttcaacgaaaactcagggaaaattatcattgaaaaagaatatccaaatgacagtgatgttggtacaataattggtctcgatttgaatatccagtacttttgggatcagatttttgaagcattaaatagagcagacaaaatgtcaacgattggataa

SEQ ID NO: 91099 - protein, 340 aa, Saccharomyces cerevisiae
MTVSKIPIWLDCDPGHDDAIAILLGCFHPAFNLLGISTCFGNAPPENTDYNARSLLTAMGKAQAIPVYKGAQRPWKREPHYAPDIHGISGLDGTSLLPKPTFEARTDKTYIEAIEEAILANNGEISFVSTGALTTLATVFRCKPYLKKSVKYISIMGGGLHGLGNCNPNLSAEFNVWIDPDAANYIFRDPDVKDKCIVVPLNLTHKAIATYKVNEMIYNEKNNSKLRELFLELFQFFAHTYKDMQGFESGPPIHDPVALMPLLEFYGWDPSSAVGFRYKRMDISCIDDVFNENSGKIIIEKEYPNDSDVGTIIGLDLNIQYFWDQIFEALNRADKMSTIG

SEQ ID NO: 91100 - DNA, 975 bp, Mesorhizobium loti MAFF303099
  CDS (1)..(975): transl_table=11
atggaaaagatcatcctggactgcgaccctgggcacgacgatgccatcgccattctgctcgcggccggaaacccgaagatcgacctcctcggcatcaccacggtttcgggcaaccacaatgtcgagaacaccacgcgcaatgcgctttccgtgtgcaccgcctatggcatcaaggtgccggtggcgaagggctctcccggcccgcttatcatcgatcaggtgctggccgtcgagattcacggcgataccgggctcgacggccccgtgctgccgcccgcctcgttcgagctcgacaggcggcatgccgtcgacttcatcatcgacacggtcatggcgcatgagccgaagacggtgacgctggtgccggtcggtccctacaccaacatcgcgcttgccgtgcgcaaggacccgcgcatcgtcgaacgggtgaagcgggtcgtcgcgatgggcggcagttttacccgcggcaacatcacgccggcggcggagttcaacgtctatgccgacccggaagccgccgacgtggtgttccgcgccggctgggacgtgaccatggtggggctcgacctcacccaccaggcgctggccacccccgacctgcaggatcgcgtgcgcgccgtcggcggcccgatggccaagttcatcctcgatatctgggcgttcatcgcgaccacgcatggcggcctgctgcagatcgagtttcccgccatccatgacgcctgctgcgtcgcggccatgatcgacggaagcgtcttcaccaccgagaaggccgacatccgcgtcgaaattgccggccggtggaccaaggggatgacggtctgcaatttcgagaagatgggcggcatgcgccatttcggcggcacggcgagcgagcagaccgacttccgccacaccgtggcgatgaagctcgaccatgcgaagttctgtgacctgatcgtggacgcgctggagcggctaaccaggcagaaggcgtga

SEQ ID NO: 91101 - protein, 324 aa, Mesorhizobium loti MAFF303099
MEKIILDCDPGHDDAIAILLAAGNPKIDLLGITTVSGNHNVENTTRNALSVCTAYGIKVPVAKGSPGPLIIDQVLAVEIHGDTGLDGPVLPPASFELDRRHAVDFIIDTVMAHEPKTVTLVPVGPYTNIALAVRKDPRIVERVKRVVAMGGSFTRGNITPAAEFNVYADPEAADVVFRAGWDVTMVGLDLTHQALATPDLQDRVRAVGGPMAKFILDIWAFIATTHGGLLQIEFPAIHDACCVAAMIDGSVFTTEKADIRVEIAGRWTKGMTVCNFEKMGGMRHFGGTASEQTDFRHTVAMKLDHAKFCDLIVDALERLTRQKA

SEQ ID NO: 91102 - DNA, 942 bp, Mesorhizobium loti MAFF303099
  CDS (1)..(942): transl_table=11
atgccccaaccacgcaagatcatcatcgacaccgatcccggccaggatgatgccgtcgccattctcttggcgctcggcagcagcgaactggagatcgtcggcatcaccgccgttgccggcaacgtgccgctgaagcttaccgaaaagaatgcccgcaagatttgcgaactggccggccggccagaaatgaaagtctatgccggtgccatccgccccctggcgcgcacactggtcaccgcagaggaagtgcatggcaagaccggcctcaacggcccacagctgcccgaaccgacgatgaaactgcaggagcagtatgccgtcgacttcatcgtcgagacgctgatgaaggaggagagcggtaccattacgctctgcccgctcgggccgctgaccaacatcgcactggcgctgatccgcgaaccacggatcgcgccgcgcatcaaggaaatcgtgctgatgggcggcggtttcttcgagggcggcaacgtcacgcccgcggccgaattcaacatttatgtcgatccgcaggccgccgatctggtgttcaagtccggcatcccgatcgtgatgatgccactcgacgtcacccacaaggcgttgaccaccaccaagcgcacgcaggccttccgcgcgctcggcaccaaggtcggtatcgcgaccgccgagatgctggaattcttcgagcgctacgacgagggcaaatacggcaccgatggcggcccgctgcacgacccctgcgtcatcgcctatctcctgaagccggagctgttcaagggccgcaactgcaatgtcagcgttgagaccgcctcggaactgaccatgggcatgaccgtgatcgactggtggggtgtcaccaagcgggaaaagaacgccatggtgatgcgcgaaatcgaccatgacggcttcttcgcgttgctggtggagaggctggggcggctttag

SEQ ID NO: 91103 - protein, 313 aa, Mesorhizobium loti MAFF303099
MPQPRKIIIDTDPGQDDAVAILLALGSSELEIVGITAVAGNVPLKLTEKNARKICELAGRPEMKVYAGAIRPLARTLVTAEEVHGKTGLNGPQLPEPTMKLQEQYAVDFIVETLMKEESGTITLCPLGPLTNIALALIREPRIAPRIKEIVLMGGGFFEGGNVTPAAEFNIYVDPQAADLVFKSGIPIVMMPLDVTHKALTTTKRTQAFRALGTKVGIATAEMLEFFERYDEGKYGTDGGPLHDPCVIAYLLKPELFKGRNCNVSVETASELTMGMTVIDWWGVTKREKNAMVMREIDHDGFFALLVERLGRL

SEQ ID NO: 91104 - DNA, 1653 bp, Arabidopsis thaliana
  CDS (1)..(1653)
atgagaaactctgctagtagtaataagaacaacaataaaggtcagaatgatttcgcggagatggagtatatgaacataaccgttgttacttcaaacgaaccttatggattattcgacagttcaaatccattcttttataaaagaagaactccaaagtttaacctaacccttggaggagttcacagtggccatgttcagaggggtttgcgcgacccaatctgcatatcgactagcggaaaaggaaactgcagggatggttacacaaaagagacctccggacctgattcagttcgtgtacttgtcgcaacacgagctaaaccgagcaagaacttgaatagtgaactggatagagaattttatgatcattttttggaagttttgaataggcctgaagaaacggggaggtttcacttttcaactcagtttctgtattacagagaagaattgttcatagcagaacttaataactcacggctgggaggaaagcctgttgttttcgatatggacatgagcgccggagatttcctctctctcttttatctccttaaagttccagtggaaatcatagatttgaaggcggttatcgtgagcccaaccggttgggctaatacagcgacaattgatgtggtctacgatctgctgcatatgatgggacgcgatgacattccggtcggtttaggagatatgttcgccattaaccaatctgaaccggtttttccatctgctggtgactgcaagtacgccaaagcggttccacaaggttgtggcggttttcttgattccgacactctctatggccttgctcgtgacctcccaagaagccctcgcaggtatgagaactcagtggcacatggagctccgagcgacactgatcggcctgaactccgacaacctctggcccttgaagtttggcaaaatctgaccaaatctgttgatgaagtgtctaagatcaccgtactaaccaatggaccattaactagcttagccaaaatcatctcatcagataaaaactcatcctcaataatcaaggaagtttacatcgtgggtggacatataagccgtggaaaatcagacaaagggaacatattcacagttccttcgaattcctacgctgaattcaatatgtttcttgatcctttagcagctaagactgttcttgaatccggtctaaacatcacactcatccctctagcaacccaacgcgagttttctttccaagcaatgcttaatagactctattcctcgacgaaaacacccgaagctcggtttgtgaaacggctgcttacaagattgcaagctcttcatcagaaacagaggagatacatgcacatggacatgttcttaggggaaattcttggagcaattttcttgggaggagatcacgctttattgaagccgaaaatgcgaactgagtacataaaagtgatcgctgaaggagatgaatcgaaagatggccacatattgattgacaaactgcgcggaaaacaaataaagatactcgaaagagtggatttgagaggctgctatgagagttttgcttctagactcgatgataagaaacaatctgcagtcataggaagctttgaagaacaaaggatgaaatggaacacaccaccaagttacaaacctataaccgctcgaatatttcactga

SEQ ID NO: 91105 - protein, 550 aa, Arabidopsis thaliana
MRNSASSNKNNNKGQNDFAEMEYMNITVVTSNEPYGLFDSSNPFFYKRRTPKFNLTLGGVHSGHVQRGLRDPICISTSGKGNCRDGYTKETSGPDSVRVLVATRAKPSKNLNSELDREFYDHFLEVLNRPEETGRFHFSTQFLYYREELFIAELNNSRLGGKPVVFDMDMSAGDFLSLFYLLKVPVEIIDLKAVIVSPTGWANTATIDVVYDLLHMMGRDDIPVGLGDMFAINQSEPVFPSAGDCKYAKAVPQGCGGFLDSDTLYGLARDLPRSPRRYENSVAHGAPSDTDRPELRQPLALEVWQNLTKSVDEVSKITVLTNGPLTSLAKIISSDKNSSSIIKEVYIVGGHISRGKSDKGNIFTVPSNSYAEFNMFLDPLAAKTVLESGLNITLIPLATQREFSFQAMLNRLYSSTKTPEARFVKRLLTRLQALHQKQRRYMHMDMFLGEILGAIFLGGDHALLKPKMRTEYIKVIAEGDESKDGHILIDKLRGKQIKILERVDLRGCYESFASRLDDKKQSAVIGSFEEQRMKWNTPPSYKPITARIFH

SEQ ID NO: 91106 - DNA, 930 bp, Bacillus halodurans C-125
  CDS (1)..(930): transl_table=11
atggaaaaagtgctcttattttgtgatccaggcattgatgactctgttgccattatgtatgcgttgctccatccaggccttgatgtcgttggcattgtaacagggtacgggaatgtaacccaagaacaagcaacagcgaatgccttttatttgctttcacttgcaggacgttctgatattcctgtctacgccggagcacagttcccactaaccggtgaaatcgccacctattatcccgaaattcatggtgagaatgggcttggtccgatacgtccccctatagatttagaaggggagttgctaaacttcaccgatttatttgatttgattatatcctaccctaatgacattacgatcattgatgttgggcggttaacctccttaagtattgcatatatactaggcgaggagacaatgggaagagtgaagcaagtgattgtcatgggaggtgctttttttgtacctggaaatgtatctcccgtggctgaagcgaattttattggagatccggttgcggctaacttaattatggaacgagcgcggccgttgaccgtcgttccgctaaatgtgacgagttattcggtcgttaccgatgagcatataagagcgatcaccgaccgatattataatccattcactcctttcattcagccaatctatcactattatgcaacggcttattctgcattaatccctgggctagaaggggccttatttcatgatgtgctggctgtcatggcgctcgttcatcctgagatgttccagatgatgaaacgggatgtttccgtttcgatcgctccactgacgagaggacagagcgttgctgattttcgcccgtttgctccagaaggggaactaaagatcgcggttgactttcactatcctacattcattcaaagctttatccaagtgctacggcgagagttataa

SEQ ID NO: 91107 - protein, 309 aa, Bacillus halodurans C-125
MEKVLLFCDPGIDDSVAIMYALLHPGLDVVGIVTGYGNVTQEQATANAFYLLSLAGRSDIPVYAGAQFPLTGEIATYYPEIHGENGLGPIRPPIDLEGELLNFTDLFDLIISYPNDITIIDVGRLTSLSIAYILGEETMGRVKQVIVMGGAFFVPGNVSPVAEANFIGDPVAANLIMERARPLTVVPLNVTSYSVVTDEHIRAITDRYYNPFTPFIQPIYHYYATAYSALIPGLEGALFHDVLAVMALVHPEMFQMMKRDVSVSIAPLTRGQSVADFRPFAPEGELKIAVDFHYPTFIQSFIQVLRREL

SEQ ID NO: 91108 - DNA, 933 bp, Pasteurella multocida subsp. multocida str. Pm70
  CDS (1)..(933): transl_table=11
atgaaaaaaattattctagattgtgatccagggcatgatgatgccattgcgattctgttagcgcatggcaatccagaaattgatctgttagcaatcacgactgtggtaggtaatcaaacgctagaaaaagtcagtcgtaatgctttagcagtagctgaaatagccaatatccttaacgtacctattgccaaaggttgtgtgcgacctttagtgcgagaagtagaagttgcaccaagtatccatggtgaatcggggatggatggacctgttttgcccgaacccacactgagtttagattcacgtcatgccgtcgatttaattattgagttagtgatgacccacccgccaaaaacaattacgttggtgcctaccggtggtttaacgaatattgccatggcggtgagaaaagaacctcgtattgtggaacgcgtgaaggaaattgtcttaatgggaggaggctatcacacaggcaattggagtgctgttgccgaatttaatattaagattgatcctgaagctgcacatattgtgttcaatgaaaaatggtcattaactatggtgggattggatctgacgcatcaagctttagccacagaagatgtgattaaaaacattgaaaaaattcaaacaaaaccagctaagtttgttctcgaattgttggcgttttttcgcaaaatgtataagcaagcacaaaattttgattatccgccagtacatgatccttgcgctgtggcttatgtgattgatccgacggtttgtacgacgaaagtggtgcccattaatattgagttaacaggcactcacacattggggatgacagtggcagattttcgttatccgattcctgaaaattgtcacacacaggtggcaatgcaactggataaagcgaaattttggggcttgatttacgatgctttgcaacgtattggttaa

SEQ ID NO: 91109 - protein, 310 aa, Pasteurella multocida subsp. multocida str. Pm70
MKKIILDCDPGHDDAIAILLAHGNPEIDLLAITTVVGNQTLEKVSRNALAVAEIANILNVPIAKGCVRPLVREVEVAPSIHGESGMDGPVLPEPTLSLDSRHAVDLIIELVMTHPPKTITLVPTGGLTNIAMAVRKEPRIVERVKEIVLMGGGYHTGNWSAVAEFNIKIDPEAAHIVFNEKWSLTMVGLDLTHQALATEDVIKNIEKIQTKPAKFVLELLAFFRKMYKQAQNFDYPPVHDPCAVAYVIDPTVCTTKVVPINIELTGTHTLGMTVADFRYPIPENCHTQVAMQLDKAKFWGLIYDALQRIG

SEQ ID NO: 91110 - DNA, 990 bp, Pseudomonas aeruginosa PAO1
  CDS (1)..(990): transl_table=11
atgcccgccagccttcctctgtccgctgccgaaacggtggcgccgccatcgccgcggacgctgatcatcgacaccgatccgggcgccgacgatgtgatcgccctgctgttcgccatggcctcgccgaaggagctgaagatccaggcgctgaccaccgtcgccggcaacgtgccgctggaaaagaccgcgcgtaacgcccggctggcccgcgagtggggcaagcgcccggatatcccggtctacgccggcgccccgcgaccgctgctgcgcacgccgatctacgccgccgacgtgcacggcagcgaaggcatcagcggcgtcgaggtgcatgagccgaagcagccgctggccgaaggtaacgccgtggactacctgatccgcaccttgcgtgcggcgccggagaagagcgtgaccctggccatgctcggcccggagaccaacctcgcgctggccctgacccaggccccggacatcgtcaagggcgtccgcgagatcgtgatcatgggcggcgcccacttcaacggcggcaacatcaccccggccgccgaattcaatatcttcgccgacccccacgcggcggaaatcgtgctcaagagcggggcgccgatcaccatgctgccgctcgacgtgacccacaagatcctcaccagccccgagcgcatcgccaagctgcgcaacctcggcaaccaggccggcaagaccgtcgccgacatcctcgacgcctacgtccagtacgacatcaagtactacggcctgaagggcggcccggtgcacgacgccacggtggtcgcctacctgctcaagccctcgctgttcaagggcaagcggatcaacgtgcaggtcgacagccgcgagggcatcaccttcggccagaccgtggccgactggtacggcggcctcaagcagccggccaacgtcgagtggatcaacgagggcgatgcccaggggttcttcgacctgctcaccgagcgtatcgcccgcctgccctga

SEQ ID NO: 91111 - protein, 329 aa, Pseudomonas aeruginosa PAO1
MPASLPLSAAETVAPPSPRTLIIDTDPGADDVIALLFAMASPKELKIQALTTVAGNVPLEKTARNARLAREWGKRPDIPVYAGAPRPLLRTPIYAADVHGSEGISGVEVHEPKQPLAEGNAVDYLIRTLRAAPEKSVTLAMLGPETNLALALTQAPDIVKGVREIVIMGGAHFNGGNITPAAEFNIFADPHAAEIVLKSGAPITMLPLDVTHKILTSPERIAKLRNLGNQAGKTVADILDAYVQYDIKYYGLKGGPVHDATVVAYLLKPSLFKGKRINVQVDSREGITFGQTVADWYGGLKQPANVEWINEGDAQGFFDLLTERIARLP

SEQ ID NO: 91112 - DNA, 945 bp, Deinococcus radiodurans R1
  CDS (1)..(945): transl_table=11
atggtttcttccttgcccgtccttctcgatggtgaccccggcctggacgacgcggtggcgtggctgctcgcctttgccagccccgaaacgcaggtgctgggcgtcacggcggtgcacggcaacgtgccgcttcagcaaggagtgcgaaataccggcgtggtgcttgcgctggccggcgagcgggcggcgggcgtgccgtactttgccggagctgaccgccccctgctgcgcgagggaatgaccgcgacgcaggtgcacggcgccaccggcctccccgccgcccacctgccagagcctgtgcgcgggccggaagccgagcacgcggtggacttcatcatccgcacggtgcgggcgaatccggggcaaatcacgctggtcgccagcggcccgctgacgaacgtggcgctcgcgtttcggttggcgcccgacctgccggggctgctgcgtgaggtcgtgtggatgggcggcagcaccgcgcagggcaaccgcacccccgccgccgagttcaacgcgctcgccgacccgcacgccgcgcacatcgtgctgcacagccccgtgccggtccgcatggtgggcctgaacgtcaccatgcagtgcatcgccacgccggagcggctggagcaactgcgtgccctcggcaaccgcgccggggcggtgtcggcggagatgctggagttctacgccggggtctaccgcgagcgctatgggctcagcggcggcgccctgcacgacccgctggcggtggcggcggcgctgagccccgagctgctcacctggcaggccatgaacgtcgaagtcgagctgagcgagggcctgaacgtgggccgcactgtctgcgacctctacggcgtgaccgaccgggaaaaaaacgtccaggtcgcggtgggcgtggacgacgcggcttttttcaagctgttgctggagcggctggggacgctgccctaa

SEQ ID NO: 91113 - protein, 314 aa, Deinococcus radiodurans R1
MVSSLPVLLDGDPGLDDAVAWLLAFASPETQVLGVTAVHGNVPLQQGVRNTGVVLALAGERAAGVPYFAGADRPLLREGMTATQVHGATGLPAAHLPEPVRGPEAEHAVDFIIRTVRANPGQITLVASGPLTNVALAFRLAPDLPGLLREVVWMGGSTAQGNRTPAAEFNALADPHAAHIVLHSPVPVRMVGLNVTMQCIATPERLEQLRALGNRAGAVSAEMLEFYAGVYRERYGLSGGALHDPLAVAAALSPELLTWQAMNVEVELSEGLNVGRTVCDLYGVTDREKNVQVAVGVDDAAFFKLLLERLGTLP

SEQ ID NO: 91114 - DNA, 927 bp, Mycobacterium tuberculosis CDC1551
  CDS (1)..(927): transl_table=11
gtgagcgtcgtattcgccgacgtcgacaccggcatcgacgacgcgctggccgtgatctatctgctggccagtcccgacgccgatctggtcggcatcgcctcgaccggcggaaacatcgcggtaggtcaagtgtgcgcgaacaacctgagcttgctcgaattgtgcggtgccgcagacatccccgtgtccaaaggcgccgatgagccgctcggcggccggtggcccgatcacccaaagtttcacggccccaaggggataggctatgccgagctgccggccagcaatcgccggctcaccgattatgacgccacgacggcctggatcgcggcggcgcactcccacgccggcgacctgatcggtctggtcaccggcccgctgaccaacctggcgctggcgctgcgcgccgaacccgcgctgccgaggctgctgcgccggctggtgatcatgggcggcatgttcgacggccagccgatcaccgaatggaacatccgggtggatcccgaggcggccagcgaggtgttcaccgcgtgggccggacaacgacaactgccgatcgtgtgcggtttggatctcacccggcgggtcgcgatgacaccggacattctcgcccggctggcgtccgtctgcggctcgtctccggtgatgcgggtgatcgaggacgcgctgcggttctacttcgagtctcatgaggcgcgcggacatgggtacctggcatatatgcacgacccgctggccgccgcggtcgcaatggacccggaactcctgacgacccggaccgcgacggtggatgtcgacccgacgggggcgacggtcaccgactggtccgggaagcgaaatcccaacgcgcggatcggcatgagcgtcgatccggcggtgttcttcgaccggttcgtcgaacggatcggacgattcgcgcgccgaacgtga

SEQ ID NO: 91115 - protein, 308 aa, Mycobacterium tuberculosis CDC1551
MSVVFADVDTGIDDALAVIYLLASPDADLVGIASTGGNIAVGQVCANNLSLLELCGAADIPVSKGADEPLGGRWPDHPKFHGPKGIGYAELPASNRRLTDYDATTAWIAAAHSHAGDLIGLVTGPLTNLALALRAEPALPRLLRRLVIMGGMFDGQPITEWNIRVDPEAASEVFTAWAGQRQLPIVCGLDLTRRVAMTPDILARLASVCGSSPVMRVIEDALRFYFESHEARGHGYLAYMHDPLAAAVAMDPELLTTRTATVDVDPTGATVTDWSGKRNPNARIGMSVDPAVFFDRFVERIGRFARRT

SEQ ID NO: 91116 - DNA, 936 bp, Sulfolobus solfataricus P2
  CDS (1)..(936): transl_table=11
atgagacactttataatagattgtgataccgctgaagacgacgtattaagcctatatcttttattaaagaacaacattgacgtagttgcagtaactattgttgaaggtaatatatcgtacgaacaagaggtaaagaacgcactatgggctttagaacaagtcaaccgtgaaattccagtttatcccggtgcgaataagccattattaaaaaattacataacagttgagaaggtacatggaaaaggtggaataggcgatgtaacggttgaacctaaaaggttaaaagcccaagagaaacatgcggcattagcgatcatagatttagcaaatgaatatgcgggagaattggaatttttagcgatttcacctctaactaacttagctttagcctacttattggataattcgatcgtaaagaaaattaagaaagtctgggtaatgggtggtgcagtattcggaataggtaatattacaccagtagcagagtttaacatttgggtagatccagatgcagctaaaatagtatttaacgctggtttcgatattacaatgataccgtgggatgtaataatcaattacccagtaacggatgaagagtggaatgtaatcaaaaatatgaagactagaatgagcgaactttacgtttcaatgtatttacactacagacaatactcttcaacggtacagaagataaatggtcatcctcatcctgatgcaattacaactgccatagctatcgatggaagtatagcaacgagaagagaaaaaaggtttgtagtaatagacaacaccgataatattaccagaggtatgacactagtggatagatttgatgccgacactagttggtctgacaaacctaatgctgaaatagtttatgaaataaataagaaaagctttatggaaaaaatttatgatttattaaattggttttag

SEQ ID NO: 91117 - protein, 311 aa, Sulfolobus solfataricus P2
MRHFIIDCDTAEDDVLSLYLLLKNNIDVVAVTIVEGNISYEQEVKNALWALEQVNREIPVYPGANKPLLKNYITVEKVHGKGGIGDVTVEPKRLKAQEKHAALAIIDLANEYAGELEFLAISPLTNLALAYLLDNSIVKKIKKVWVMGGAVFGIGNITPVAEFNIWVDPDAAKIVFNAGFDITMIPWDVIINYPVTDEEWNVIKNMKTRMSELYVSMYLHYRQYSSTVQKINGHPHPDAITTAIAIDGSIATRREKRFVVIDNTDNITRGMTLVDRFDADTSWSDKPNAEIVYEINKKSFMEKIYDLLNWF

SEQ ID NO: 91118 - DNA, 924 bp, Sulfolobus solfataricus P2
  CDS (1)..(924): transl_table=11
atgaggaaagttatagtggattcagatactgccactgatgatactatagcgatattacttgcatccagattttttcaattattaggtgtaaccatagttgctggaaatgtaaattataatcaagaggttaagaatgccctttttactttagagtatattggtaagcaggatgtaccagtttatttaggctcacaaagacctatcttaggaaattggagaactgttgaagaggttcatggaagtaatggaatgagtaattggaactaccctgaacctaataaaaggccagagaaagagcatgctatagatgccatactcagattatcaaaagaacatgaaggtgagttggaaatacttgcaatttcccctttaacaaatattgcattagcctatcttaaggatccatcagttgttaaacgagtgaaaaagatttggataatgggtggtgcattttcaaagggtaacactacccccatagcagagttcaatttttgggtagatcctgaggctgctaaaatagttttagatgcaggatttgacatcaccatagttccttgggaagttgccgaaataagtggttctttgaatgagagagactgggaatatatctctaagcttaatactaagctttcaaacttttttattaacgttaataagacgctaaaggaatataccactaagaatcaaggcatatctggcagtatccatccagattccttaacagtttcgatagctcatgacaactctattatcttagattcttctctaaagtatgttgatgttgaattatgttcaaaatctagaggagcaatgttaatagactggtacagtttacataaaaacaagcctaatgctgaaattgtactaaaggcagatggtggtaagtttaaaaatcttctattcaactctctttcccagctttga

SEQ ID NO: 91119 - protein, 307 aa, Sulfolobus solfataricus P2
MRKVIVDSDTATDDTIAILLASRFFQLLGVTIVAGNVNYNQEVKNALFTLEYIGKQDVPVYLGSQRPILGNWRTVEEVHGSNGMSNWNYPEPNKRPEKEHAIDAILRLSKEHEGELEILAISPLTNIALAYLKDPSVVKRVKKIWIMGGAFSKGNTTPIAEFNFWVDPEAAKIVLDAGFDITIVPWEVAEISGSLNERDWEYISKLNTKLSNFFINVNKTLKEYTTKNQGISGSIHPDSLTVSIAHDNSIILDSSLKYVDVELCSKSRGAMLIDWYSLHKNKPNAEIVLKADGGKFKNLLFNSLSQL

SEQ ID NO: 91120 - DNA, 1002 bp, Agrobacterium tumefaciens str. C58
  CDS (1)..(1002): transl_table=11
ttgacaagtgagcacccgccgctcgaaaaaagcgctcatctcaacggcgggcaagacatggcagaacgcagaaaaatcatcatcgacaccgatccgggccaggacgacgcggcggcaatcatgctcgcctttggaagtcctgaggaaatcgacattctcggactgtgcgccgttgccggcaacgttccgctgaagctgaccagccgcaacatccgcatcatctgcgaattgtgcggccgcaccgatattcccgtctatgagggcgcggagaagccgctggtgcgcaagcccatcaccgccgagcatgttcacggcagcaccggccttaacggcccggttctcgatgaaccgaccatggaggcgcaaaagcagcatgcggtcgatttcatcatcgaaacgctgatgcgggaacccgccggcaccgtaacgctctgcacgcttggcgcgctgaccaatgtggcgctggctctcctcaaggcgccggaaattgccgatcgcgtcaaggaactggtgatgatgggcggcggcttcttcgaaggtggaaacatcacgccggcggcggaattcaacatctatgtcgacccgcaggccgccgacatcgttttccgttccggcatgcctgtcgtcatgatgccgctcgacgtcacccacaagctgctgaccaccaaggcgcgcgtcaaccgcattcgtgacattggcacgcgccctgccatcgccatggcggaaatgctggaattcttcgagcgttttgacatcgagaaatacggttcggatggcggcccgctgcatgatccgagcgtcattgcctatctcctcaagcccgaactgttcgagggccgcgagtgcaatgtcgaaatcgaggtcatttccgaactgaccatgggcatgactgtcgtggactggtggcgggtgactgaccgtcccgccaatgcccgcgtgatgcgcaatgtggatgccgacggcttctttgaattgctgaccgaacgtttcgcccggctctga

SEQ ID NO: 91121 - protein, 333 aa, Agrobacterium tumefaciens str. C58
MTSEHPPLEKSAHLNGGQDMAERRKIIIDTDPGQDDAAAIMLAFGSPEEIDILGLCAVAGNVPLKLTSRNIRIICELCGRTDIPVYEGAEKPLVRKPITAEHVHGSTGLNGPVLDEPTMEAQKQHAVDFIIETLMREPAGTVTLCTLGALTNVALALLKAPEIADRVKELVMMGGGFFEGGNITPAAEFNIYVDPQAADIVFRSGMPVVMMPLDVTHKLLTTKARVNRIRDIGTRPAIAMAEMLEFFERFDIEKYGSDGGPLHDPSVIAYLLKPELFEGRECNVEIEVISELTMGMTVVDWWRVTDRPANARVMRNVDADGFFELLTERFARL

SEQ ID NO: 91122 - DNA, 1137 bp, Agrobacterium tumefaciens str. C58
  CDS (1)..(1137): transl_table=11
atgtccgggcaggcggaaggagagggcttcttctttcaccgaaagtgcgaccaagcaatctctttctgtgcgtttggctgcgggcagggggattgcggtgtggccgcttatcgttatgtttccgtggcgcgtcgccggaagaacggatggcgctcgagacatatggatgagggcattatgcataaagtgatattcgatacggaccccggtgtggatgatgccatggcgcttcttttcctgcaccgtcaccccgatatcgatctgatcggtgtcaccacggttttcggtaatgcgcccatcgacatcaccacccgcaatgcgcttttcctcaagcgggaatggcagatgaccgcgcctgttgcgaaaggcgctggcgtgacctttgatcccgcccgcaaggaaggccactggccgaccttcattcatggcgaaaatggcctcggtgatatcgatattcccgagaccatcgacctgccgctcgatccgcgtcccgcgcatcgcttcattatcgagaccgtgaaggccaatcccggcgaggtgacgctgatcgccgttggccgcatgaccaatctggcgctggcattgcgcgaggagccggattttgcagcattggtgaagcaggtcatcgtcatgggcggcgccttcgatatcaacggcaatgtttcgccggcggccgaggccaatattcacggtgatccggaagcggccgatctcgtcttcaccgccccgtggcgcgtggtggtcgtcggtctcgatgtcaccacaaaaacggtaatgaccagcgctttcatggcggagatggctgaagccggcggcaagcccgtacagctgctttctgacctgtcgcaattctacatcgatttttacaagacccgcaccggcgatggcatggtggtgcatgacagctgcgcctgcgtctatctcgtggcgcctgagctgtttacgacccgcagcggcccggtgcgcgtcgtctgcggtggccttgccgatggcgagacgatccagaagccggatggccgcgcctttccaccgggtgactgggatgggcatccaagccagctcatctgcacggatatcaagccggagcgcgtgctttcggtcatccgcgcggcaattgtgaagggcgagcgcggctga

SEQ ID NO: 91123 - protein, 378 aa, Agrobacterium tumefaciens str. C58
MSGQAEGEGFFFHRKCDQAISFCAFGCGQGDCGVAAYRYVSVARRRKNGWRSRHMDEGIMHKVIFDTDPGVDDAMALLFLHRHPDIDLIGVTTVFGNAPIDITTRNALFLKREWQMTAPVAKGAGVTFDPARKEGHWPTFIHGENGLGDIDIPETIDLPLDPRPAHRFIIETVKANPGEVTLIAVGRMTNLALALREEPDFAALVKQVIVMGGAFDINGNVSPAAEANIHGDPEAADLVFTAPWRVVVVGLDVTTKTVMTSAFMAEMAEAGGKPVQLLSDLSQFYIDFYKTRTGDGMVVHDSCACVYLVAPELFTTRSGPVRVVCGGLADGETIQKPDGRAFPPGDWDGHPSQLICTDIKPERVLSVIRAAIVKGERG

SEQ ID NO: 91124 - DNA, 927 bp, Sulfolobus tokodaii str. 7
  CDS (1)..(927): transl_table=11
atgaggcatttcataatagattgtgatacagctgaagatgacataatgagcctttttatgttactcagaaataatatagatgtccaaggaataactattgttgaaggaaacatatcttatgagcaagaaataaataacgcattatggagcttagagtttgtaggaaaagatatcccagtttatcctggtagtgatagaccgctagttaaacaattcagaagtgtcccagaggttcacggcaagggaggaattggagatgaggtagtaaaacccagtaaacttaaaccacaaaataagaaagctgtagatgccattgttgagattgctgacagatatgctggtgaattagagttcttggcaatatccccgttaacaaatcttgccttagcttacttaaaagacaagtcagtagttgaaaagataaaaaaggtttggataatgggaggaacagtgtgggggagaggaaacataaccccagttgccgaatataatatttgggtagacccagattcagcaaaaattgtttttaactctggtttcgatattaccatggtaccgtgggatgttattgttaactatccaatcaccgatgaagaatgggaacaaataaagacgatgaagactaagatggctcaattttacgttaagatttacactcattatagaaaatattctatggaaaaagagaaaataaaggggactcctcaccccgacttaattacaacttctgtggctctcaatagaaatgtagtattaaaatcggaaaggcaatatgtggatattgaaaattgtgattgcttaaccagaggaatgactgttattgactatttaggaatttggggtaaagaacccaatgctgaaataatttatgagataaacaagaaagagttctattcaatgttaatcgacttactcaattggttctag

SEQ ID NO: 91125 - protein, 308 aa, Sulfolobus tokodaii str. 7
MRHFIIDCDTAEDDIMSLFMLLRNNIDVQGITIVEGNISYEQEINNALWSLEFVGKDIPVYPGSDRPLVKQFRSVPEVHGKGGIGDEVVKPSKLKPQNKKAVDAIVEIADRYAGELEFLAISPLTNLALAYLKDKSVVEKIKKVWIMGGTVWGRGNITPVAEYNIWVDPDSAKIVFNSGFDITMVPWDVIVNYPITDEEWEQIKTMKTKMAQFYVKIYTHYRKYSMEKEKIKGTPHPDLITTSVALNRNVVLKSERQYVDIENCDCLTRGMTVIDYLGIWGKEPNAEIIYEINKKEFYSMLIDLLNWF

SEQ ID NO: 91126 - DNA, 945 bp, Sinorhizobium meliloti 1021
  CDS (1)..(945): transl_table=11
gtgtcaagcgcaagaaaaatcatcatcgacacggatccgggccaggacgacgcggcggcaatcatgctggccctcggcagcccggaggaaatcgaggtcctcggcatcaccgcggttgccggcaatgtcccgctgacactgacagcccgcaacgcccgcatcgtctgcgagctctgcaacaggaccgacgtcaagatcttcgcaggtgccgagcggccggtcgcacgcccgctcgtcacggccgagcacgtgcacgggaagacggggctcgatggccctgcgctcgacgagccgacgatgccgcttcaagagcagcacgccgtcgacttcatcgtcgaaacgctgcgcgcggaggcgccgggtgccgtgacgctttgtacgctcggaccgctgacgaatatcgccctggccctgacaaaggctccggaaatcgcaccatcggtacgcgagctcgtgatgatgggcggcggcttcttcgagggcggcaacataacgcctgcggcggaattcaacatctatgtcgatccggaggcagccgagatcgtcttccgctccggcatcccgatcgtcatgatgcccctcgacgtcacccatcgcgttctgacacggaagactcgcgtggagaaaatccgtgcgatcggcagtccggcggcagtggcccttgctgagatgctggaattcttcgagcgtttcgacatcgagaaatacggtaccgacggcgggccgctgcacgatccgaccgtcatcgcctatatcttgcggccggagctcttcacagggcgggactgcaacgtcgagatcgaaacggcgtctccgctcaccacgggtatgaccgtggtcgactggtggcaggtcaccggccgtgcgcacaacgccaaggtcatgcggcacatcgacgacgagggcttcttcgagcttttggccgagcgccttgcgcggatctga

SEQ ID NO: 91127 - protein, 314 aa, Sinorhizobium meliloti 1021
MSSARKIIIDTDPGQDDAAAIMLALGSPEEIEVLGITAVAGNVPLTLTARNARIVCELCNRTDVKIFAGAERPVARPLVTAEHVHGKTGLDGPALDEPTMPLQEQHAVDFIVETLRAEAPGAVTLCTLGPLTNIALALTKAPEIAPSVRELVMMGGGFFEGGNITPAAEFNIYVDPEAAEIVFRSGIPIVMMPLDVTHRVLTRKTRVEKIRAIGSPAAVALAEMLEFFERFDIEKYGTDGGPLHDPTVIAYILRPELFTGRDCNVEIETASPLTTGMTVVDWWQVTGRAHNAKVMRHIDDEGFFELLAERLARI

SEQ ID NO: 91128 - DNA, 954 bp, Sinorhizobium meliloti 1021
  CDS (1)..(954): transl_table=11
atgcacaaggttattttcgatacggatccgggcgtcgacgatgcgatggccctcctctttctgcaccgtcacccggcgatagagctggtcggcatcaccacggtcttcggcaatgcctcgatcgagacgacgacgcgcaatgcgttgttcctcaaaggggcatggaatattgccgcaccggtcgccaagggcatcggcgagacgctcgatgccggccggccgcatgtcggatggccgacaggcattcacggcgatgacgggctcggcaatatcgatgtgccggcgcagatagacctgccgctcgaccctcgtcctgcccaccgcttcatcatcgacacggtgcgcgccaatcccgggcaagtgacgctcatcgccgtcggccggatgaccaacctggcgcgcgcattgcgcgacgatccggaaatcgccacgctcgtcaaggcggtagtgatcatggggggcgccttcgatgttcccggcaacatcacgccggcggcggaagcgaatatccacggcgacccggaagcggccgatgtggtgatgacggcgccatggccggtgaccgtcattggtctcgacgtgacgacgaagacggtgatgagccgtgccatgctctccgatatcgccgaacgcggcggcgcaccggcgaggcttctttccgacatctcgcaattctacatcgacttctacgagcaccatgtggatgacggcatgatcgtgcacgacagctgcgcctgcgcctatgtcgtcgcgcccgaactcttccagacccgcagcggcgccatccgagtgctttgcggcggcatcgccgatggccagaccattcaaaagccggatgcacgcctgtttccaccgaacgcctgggacggcttcccaagccagcaggcgtgcatcggaatcgatgccgaagcggtgctgaaactcatcggcgatacgctcgcggacggcaattga

SEQ ID NO: 91129 - protein, 317 aa, Sinorhizobium meliloti 1021
MHKVIFDTDPGVDDAMALLFLHRHPAIELVGITTVFGNASIETTTRNALFLKGAWNIAAPVAKGIGETLDAGRPHVGWPTGIHGDDGLGNIDVPAQIDLPLDPRPAHRFIIDTVRANPGQVTLIAVGRMTNLARALRDDPEIATLVKAVVIMGGAFDVPGNITPAAEANIHGDPEAADVVMTAPWPVTVIGLDVTTKTVMSRAMLSDIAERGGAPARLLSDISQFYIDFYEHHVDDGMIVHDSCACAYVVAPELFQTRSGAIRVLCGGIADGQTIQKPDARLFPPNAWDGFPSQQACIGIDAEAVLKLIGDTLADGN

SEQ ID NO: 91130 - DNA, 960 bp, Caulobacter crescentus CB15
  CDS (1)..(960): transl_table=11
atgcgcctgatcatcgacacagacacggcgggagacgacgtcttctccctgatgctcgccctcacccgcacgggtgttgagttggaggccatcaccatcgcgcacggcaatgtgggcttcgagcagcatgccgagaacgccctggtgaccctggatcgctgcgggcgggccggcgaggttccggtctatctgggcgcccagtttcccctgatgcgcgcgccgctggacgccgcctatgtgttcggccgcgacggcatgagcgatagcggctttgcgcggacctcccagcgccccgccgagggccatgccgtggatgagctggtgcgccggatcatggccgcgcccggcgagatcaccctgatcgcccaagcgccgctgaccaacatcgccctcgcctaccaacgagagccacgcatcgccaaggcgctgaagcatctgtgggtgatgggcggtacagacaacggcgtgggcaatgtgaccccggcggcggagtacaatttctatgccgacccggaagccgccaagatcgtcgtcaatgcgggcttcaacctctccatcgccacctggaccctgaccctgaaggacggtctatggacgacagagaaactggacgcgcttgacgcgttgggcaccgagaaagcccggttcttcaccgatgtgaaccgcgcatcgctggctttcgcgcgcgagaccgagggtctggacggcagcctacatcccgatgcgctgacctgtgcgatcgcactggacgagggactgatcctggaggcggaaacctgtgtcgtcgacgttgaaacggtgggcgagctcacgcgcggctatctgagcgtctcgcactcgatcctgccggacatcgagatcgctgacccggcgctcaagcgtcgcccgccgaacgcccgcgtgatcaaggccatcgaccgcgaaggcttcttcgcggcgatgcggaccgcactgctctaa

SEQ ID NO: 91131 - protein, 319 aa, Caulobacter crescentus CB15
MRLIIDTDTAGDDVFSLMLALTRTGVELEAITIAHGNVGFEQHAENALVTLDRCGRAGEVPVYLGAQFPLMRAPLDAAYVFGRDGMSDSGFARTSQRPAEGHAVDELVRRIMAAPGEITLIAQAPLTNIALAYQREPRIAKALKHLWVMGGTDNGVGNVTPAAEYNFYADPEAAKIVVNAGFNLSIATWTLTLKDGLWTTEKLDALDALGTEKARFFTDVNRASLAFARETEGLDGSLHPDALTCAIALDEGLILEAETCVVDVETVGELTRGYLSVSHSILPDIEIADPALKRRPPNARVIKAIDREGFFAAMRTALL

SEQ ID NO: 91132 - DNA, 972 bp, Caulobacter crescentus CB15
  CDS (1)..(972): transl_table=11
atgacgaccccgaccaagatcatcttcgacaccgatcccggcatcgacgacgcgatggccctgctgttcatcgaggcgagccccgccctcgacctgatcgcggtgacgaccatcttcggcaacgccgatatcgagaccaccacccgcaacgcgctgtacctgaaggaccgcttcggcctgacggcgccggtctacaagggcacggacaagccgctgacgcggccgcgcaacccctcgcccaccttcgtgcatggcgtgaatggtctgggcgatgtggagttgacgggtctggtcccagcccagccggaagccaagcccgcccatcaggcgatcatcgacctggcccgccagtatccgggcgaagtggtgctgtgcgccgttggtcccctgaccaacctggccttggccctgcaggccgatcctgaggtcgccaccctgctgaagtcggtggtgatcatgggcggcgcgttcggcgtggccggtaagccgggcaatgtcacgcctgtggccgaggccaatatctggaacgatccggaagccgccgatcaggtcttcaccgccccctggaacctgaccgccgtcagcctggacgtgacgacccaggtcgtgatgtcgcccgactatatggacgccctggcggccggcggcagcgacgcctgcggtttcctgaacgccatctccaagccctatgcggccttctatggcgagcgggacggcgtggtcggctgctgcgtgcacgatgcggcggcggtggcctatgtgatcgatccgagcttgttcacggtgcgtcgcggttcggtgcgcgtggtcaccgaaggcatcgcgcttggccagacctgccagaaggccgagggcgagctgttcggccccagcgcctgggacgaccagccgatccaggccgcgaccgtggccgtcgacggcgcgcgactgctgacgctgtacgcacagacgatggcggcgaagtacggttga

SEQ ID NO: 91133 - protein, 323 aa, Caulobacter crescentus CB15
MTTPTKIIFDTDPGIDDAMALLFIEASPALDLIAVTTIFGNADIETTTRNALYLKDRFGLTAPVYKGTDKPLTRPRNPSPTFVHGVNGLGDVELTGLVPAQPEAKPAHQAIIDLARQYPGEVVLCAVGPLTNLALALQADPEVATLLKSVVIMGGAFGVAGKPGNVTPVAEANIWNDPEAADQVFTAPWNLTAVSLDVTTQVVMSPDYMDALAAGGSDACGFLNAISKPYAAFYGERDGVVGCCVHDAAAVAYVIDPSLFTVRRGSVRVVTEGIALGQTCQKAEGELFGPSAWDDQPIQAATVAVDGARLLTLYAQTMAAKYG

SEQ ID NO: 91134 - DNA, 924 bp, Sinorhizobium meliloti 1021
  CDS (1)..(924): transl_table=11
atgggcatctggatcgacaccgatatgggcttcgacgacatcgccgcgatgctcgtcgtccttcacgccggtgaggccgtcgacggcgtctcgctggtctacggcaatgtgccgctcgggcaggttaaacgcaacgccgcggcagcagcgcaggccttcggctggacctttccgatccatcagggacgggcgctccccgtgctcggaaagctcgagacggcggagcgtatcctcggacagaccggcatgccgacgtcggggctgagcctccccgatgcacccgccctgccggatagcgatgcgttccttgcgctctgccgctggctggaggacggcgaaggtccgcatcgtatcctggcgctcgggccgcttaccaatatcgctgcccttgccctggcacgccccgacctcgccgcgcggatcgacgagctcacctggatgggcggcggtgtttccagcggcaatcatacggcgtccgccgagttcaacgcctttgccgatccggaggcgctcgccatcgtgcttgcccacggcgtgccgttcaggatggtcgatctcgacctctgccggaaggtcatcgcctatccgaaggatgtggaggcgatacgcaccgcaggtggcgcaaaggccgcgctgcttgccgatcttctcgccggctacgtcgcgatcggcacgagccgtggacggaccgggatggcgatctacgatccctgtgcagccgttgcgctggtggatggaaacgctgtgtcgtttcgcccggcgcgtatcgatgtcgagcttgccggtgccttgacgcggggccggacggtggtcgagacccgggcgaaccacgcgacattcaacgcccattatgcgatcgacgtagacgcggaacgtgcccgccggcacctgctcgctgcgctcaccaaggaagccgccagatga

SEQ ID NO: 91135 - protein, 307 aa, Sinorhizobium meliloti 1021
MGIWIDTDMGFDDIAAMLVVLHAGEAVDGVSLVYGNVPLGQVKRNAAAAAQAFGWTFPIHQGRALPVLGKLETAERILGQTGMPTSGLSLPDAPALPDSDAFLALCRWLEDGEGPHRILALGPLTNIAALALARPDLAARIDELTWMGGGVSSGNHTASAEFNAFADPEALAIVLAHGVPFRMVDLDLCRKVIAYPKDVEAIRTAGGAKAALLADLLAGYVAIGTSRGRTGMAIYDPCAAVALVDGNAVSFRPARIDVELAGALTRGRTVVETRANHATFNAHYAIDVDAERARRHLLAALTKEAAR

SEQ ID NO: 91136 - DNA, 936 bp, Salmonella typhimurium LT2
  CDS (1)..(936): transl_table=11
atggcactgcccattattattgattgcgatccgggtcatgatgacgcgatcgccctcgttctcgccctcgcctcccctgaactggaagtgaaagcgatcacctcttccgccggtaaccagacgccggagaagaccctgcgcaacgtgctgcggatgctgacactgctcaaacgcctggatattccggtggcgggcggcgcggtgaaacctctcatgcgcgaactgattatcgccgataacgttcacggcgaaagcggcctcgacggcccggcgctgcccgagccgtcattcgccccgcaaagcggcactgccgttgagctgatggcaaaaacgctgcgcgagagcgcacaaccggtcaccatcgtctccactggcccacagaccaacgtggcgctgctgctgaatagccatccggaactgcatacgaaaatcgcccgcattgtgatcatgggcggcgcgatggcgctgggtaactggacgcccgctgcggaatttaatatttacgtcgacccggaagcggcagaaattgtcttccagtcaggcattccggtggtgatggccgggctggacgtcactcataaggcacagattcacgccgccgatatcgaacgctttcgcgccatcggtaacccgatttccaccatcgtcgccgaactgctggacttctttatggagtaccacaaagacgaaaaatggggatttgtcggcgcaccgctgcacgacccgtgcaccatcgcctggctgctcaagcccgagattttcaccaccgttgagcgttgggtcggcgtggaaacccaggggaaatacacccaggggatgacggtggtggattattatttcctgacggggaataagccgaatgcgacggtgatggtcgatgtagaccgccagggatttgtcgatttgctggcggaacggctgcaatactacgcataa

SEQ ID NO: 91137 - protein, 311 aa, Salmonella typhimurium LT2
MALPIIIDCDPGHDDAIALVLALASPELEVKAITSSAGNQTPEKTLRNVLRMLTLLKRLDIPVAGGAVKPLMRELIIADNVHGESGLDGPALPEPSFAPQSGTAVELMAKTLRESAQPVTIVSTGPQTNVALLLNSHPELHTKIARIVIMGGAMALGNWTPAAEFNIYVDPEAAEIVFQSGIPVVMAGLDVTHKAQIHAADIERFRAIGNPISTIVAELLDFFMEYHKDEKWGFVGAPLHDPCTIAWLLKPEIFTTVERWVGVETQGKYTQGMTVVDYYFLTGNKPNATVMVDVDRQGFVDLLAERLQYYA

SEQ ID NO: 91138 - DNA, 1188 bp, Nostoc sp. PCC 7120
  CDS (1)..(1188): transl_table=11
atgctcaaaattcctaatgtgcagaagttattttctgctgctacatttttagtatcgatcacaacgattttttgtagccaacctgcacttgcagcctcttttaagccaacacccctaattattgacgacgatggcagccaagacggcatgactgcattggcttatatgctagccaatcccaaatttgacattcaggcaattaccatcgcccaaggtattgcccgcccacaaagttttgcgaacaacctggaacgaatgctaggcagactagatatctctggtatccctattggcattggcagatcaactcccctggcaggaaacaatacttttccagaacctattcgtgctggtgcagacactttttggtctcccttcgtccaactacctaatacagcaccactggtgataactcgaccagccgcagaactgattgtggaaaaagtgaagcggtcattaacacctgtggcaatcttggcaactggccccctaaccaatattgctgaagcattacgccttgaccccacaattatcaacaacattgccgtcatcgaaatcatgggaggtgcagttttcgtacccggaaatctcccagtcctgccatatcccccattttccaccaacactacagctgaatttaacatctgggctgaccccttagcagcacaagaagtatttgcagccggagggcaaggattaaaaattcagttgaccccccttgatgctacaaaccagattgccttctctcgtgccgatcaacaagcatggctagctactgcaacaccagaaagtaagttagcagcagaatttttagactttgccttgacagtaattcaaagtaacaatgaccccaacccagcttgggatctagttgcagccattaacctgagtgaaccagatttctcagtagaaacttccttatacctggaagttgatacgacctcagatcctggaaatactcaagggcaaactcgtgctattcctaatttgcctcccaatgttctagtttccctcaaccccagttttaataatttgcccttccaacctggccaagtcttctcttacctacaaatccagtcggttccggaaccaacattaatcccaggaatcttagttctagctacagtcagtgctggtatgatgacgcgacgttctcaaaaaaaagttaataacaaattgcgggcataa

SEQ ID NO: 91139 - protein, 395 aa, Nostoc sp. PCC 7120
MLKIPNVQKLFSAATFLVSITTIFCSQPALAASFKPTPLIIDDDGSQDGMTALAYMLANPKFDIQAITIAQGIARPQSFANNLERMLGRLDISGIPIGIGRSTPLAGNNTFPEPIRAGADTFWSPFVQLPNTAPLVITRPAAELIVEKVKRSLTPVAILATGPLTNIAEALRLDPTIINNIAVIEIMGGAVFVPGNLPVLPYPPFSTNTTAEFNIWADPLAAQEVFAAGGQGLKIQLTPLDATNQIAFSRADQQAWLATATPESKLAAEFLDFALTVIQSNNDPNPAWDLVAAINLSEPDFSVETSLYLEVDTTSDPGNTQGQTRAIPNLPPNVLVSLNPSFNNLPFQPGQVFSYLQIQSVPEPTLIPGILVLATVSAGMMTRRSQKKVNNKLRA

SEQ ID NO: 91140 - DNA, 924 bp, Nostoc sp. PCC 7120
  CDS (1)..(924): transl_table=11
atgacaaaacaactagtgttaatggatcatgatggtggtgtagatgattatctagcaactatgctgctgttgacgatggataatgtgcaactcatgggtgttgttgttactcctgctgattgttatgtccagcctgcggtgagtgctacgcgtaaaattattgatttgatgggattttctcatatcccagtggcagaaagtactgtacgcgggattaatccgtttcctcggctgtatcggcgtgattcgtttattgttgaccatctgcctattctcaatcaaaccgaattgattcatacacctttggttgaggaaactggtcaagattttatggtcagagtattgcaagaagcactagaacccgtaacattaatggttacaggcccactcacaacggttgcagttgctttagaccaagcaccagacattgaagccaagattgacaagattgtctggatgggtggcgctttgaatgttcctggtaatgtggaaaaaagtttagaggctggacaagatgggtctgccgaatggaatgtctattgggatgcagtttcagctgcacgagtatggcaaagggaaattaagattattatgtgtcccttagatttgactaacgatgtaccagtgacatctgagttagtatacaaaatggggcgacaaagacattatcccgtatctgatttagctggacaatgttatgccttagttatcccacaagattattatttctgggatgtgttagcaacggcttatttaggacacccagaattttatcaactccgcgaatgggagacagaaattattactagtggtttgagtcagggacggactaaagttgtcactggtgggcgcaagattttagctatggataaagtggataaggatgctttttatgcttacattttgcaacagtgggcaaggtaa

SEQ ID NO: 91141 - protein, 307 aa, Nostoc sp. PCC 7120
MTKQLVLMDHDGGVDDYLATMLLLTMDNVQLMGVVVTPADCYVQPAVSATRKIIDLMGFSHIPVAESTVRGINPFPRLYRRDSFIVDHLPILNQTELIHTPLVEETGQDFMVRVLQEALEPVTLMVTGPLTTVAVALDQAPDIEAKIDKIVWMGGALNVPGNVEKSLEAGQDGSAEWNVYWDAVSAARVWQREIKIIMCPLDLTNDVPVTSELVYKMGRQRHYPVSDLAGQCYALVIPQDYYFWDVLATAYLGHPEFYQLREWETEIITSGLSQGRTKVVTGGRKILAMDKVDKDAFYAYILQQWAR

SEQ ID NO: 91142 - DNA, 1056 bp, Ralstonia solanacearum GMI1000
  CDS (1)..(1056): transl_table=11
atggctacgtttccgaatgtcccccgtcgcgcattcctgaacctggtcagcctgtttgccggcggcgcgctgctgccggcaagctcgcaagccgttggcctgagcgcccccgctcccgcctccgtgatcatcgatgccgatccaggacaggacgacgcgatcgcgatcctgttcgcgctcggggcgagggggcgcctcgacgtgcgtgccctgaccgtcgtggcgggcaatgtgccgctgggcctgaccgagcgcaatgcgcgcatcattcgcgactgggcgggccgcacgcatgcgttgccggtctacgccggctgcgcggggccgctgacgcgcgagctggtcacggctgcccacgtgcatggcaagaccggtcttgaaggtgtcgatctgcccgcgccgttggcaccgctggcgtcgcagcacgcggtgtcgtacctggttgatacgctcacgcaggcggcgccgaacagcgtgacgctgtgtgcgctcggaccactgaccaacatcgccagcgcgctgagcgaggctccgcagatccgccccgcgctgcgcgagatcgtgctgatgggcggtgcgcatttcgagcgcggcaacatcacgccggccgcggagttcaacatctacgtcgacccgcaggccgccgagatcgtgttcggcagcggcgtgccgatcgtcgtgctgccgcgcgacgtcgccatgaaggcgcagatcacgctggcgcgggttgcaccgttccgcgggctcggcaaccgctgcggcgcgatcgtcgccgacatcatggcggccgagatcgcgtaccagaagacgcgccgcggcgtcgagcgggcgccgatgtacgatccgaccgcggtcggttatctgttcgacccgtcgatgttcaacgggcgcaaggtgaacgtggtggtcgaaaccgccggccagtggacgctgggcgagaccgtcgtcgactgggaaggccgcagcggccgcgcaccgaacgcgatgtggatccacgacgtcgatgcggaccgcttctatgccgcgctgctcgacagcgtcgcgaagctgccctaa

SEQ ID NO: 91143 - protein, 351 aa, Ralstonia solanacearum GMI1000
MATFPNVPRRAFLNLVSLFAGGALLPASSQAVGLSAPAPASVIIDADPGQDDAIAILFALGARGRLDVRALTVVAGNVPLGLTERNARIIRDWAGRTHALPVYAGCAGPLTRELVTAAHVHGKTGLEGVDLPAPLAPLASQHAVSYLVDTLTQAAPNSVTLCALGPLTNIASALSEAPQIRPALREIVLMGGAHFERGNITPAAEFNIYVDPQAAEIVFGSGVPIVVLPRDVAMKAQITLARVAPFRGLGNRCGAIVADIMAAEIAYQKTRRGVERAPMYDPTAVGYLFDPSMFNGRKVNVVVETAGQWTLGETVVDWEGRSGRAPNAMWIHDVDADRFYAALLDSVAKLP

SEQ ID NO: 91144 - DNA, 921 bp, Agrobacterium tumefaciens str. C58
  CDS (1)..(921): transl_table=11
atgggcgtgtggatcgataccgatatgggctttgacgatatcgccgccatcatggtggtgcaatcggcaggccttgccatcgacggcatctctttggtgttcggcaatgccacgctggatgcggtctgccgcaatgccgcaggcgccgtagcaagcttcggctggtcgatgccgatccatcagggccgcgccatgcccgtcctcggcgcgctcgaaaccgcgcagtccatcctcggtgaaagcggcattccgaccgccggccaaagcctgccggatgcgccggctctgccaaaaagcgatgcctttaccgctctctgcaactggctggagggtgaaggcgaaaagcgcatcctcgcgctcggcccgctcaccaatatcgccgcactttgtctcgctcggcccgatcttgccgccagaatttccgacctcacctggatggggggcgggcttaccagtggcaaccacacggcatcggccgaattcaacgccttcgccgatcccgaggcactggccatcgtgctcgcccatggcctgccgctgcgcatggtcgatctcgatgcttgccgcaaggtcatggcctcgcccgccgatgtcctgccgatccgcaccgccgacggcaggaatgcgggccttattgccgatctgtttgatggtttcatcggcatcgccaccagtcgcggtagggctgccatggcgctttacgatcccgtcgccgcagtcggctttacctccgatcatctcggctggcagcaggcgcgcatcgatgtcgaactccatgcctcgctgacgcggggaagaaccgtggtcgagacacgcgcggagaaggtgacagactttaacgcccagtttgccgtgaccgttgatgctggagccgcaaaggccgccatattggaagcattgcgccgggaggctgcccgatga

SEQ ID NO: 91145 - protein, 306 aa, Agrobacterium tumefaciens str. C58
MGVWIDTDMGFDDIAAIMVVQSAGLAIDGISLVFGNATLDAVCRNAAGAVASFGWSMPIHQGRAMPVLGALETAQSILGESGIPTAGQSLPDAPALPKSDAFTALCNWLEGEGEKRILALGPLTNIAALCLARPDLAARISDLTWMGGGLTSGNHTASAEFNAFADPEALAIVLAHGLPLRMVDLDACRKVMASPADVLPIRTADGRNAGLIADLFDGFIGIATSRGRAAMALYDPVAAVGFTSDHLGWQQARIDVELHASLTRGRTVVETRAEKVTDFNAQFAVTVDAGAAKAAILEALRREAAR

SEQ ID NO: 91146 - DNA, 996 bp, Brucella melitensis 16M
  CDS (1)..(996): transl_table=11
ttgagcaaacatgcagtatcatgcgcaatcccctcccaacgaactcatcaggaaaccaccatggcccgtaaaatcattatcgataccgatcccggtcaggacgatgccgtcgccattttgctggcgcttgcaagccctgaactcgacattctcggcattaccgccgttgcaggaaatggcccgctggcgcgcacagaagtcaatgcccgcacggtctgcgaagtggcgaaaaagccggacacaaaagtatttgcaggctccatccgcccattggtgcgcccgcttgtcaccgctgaaaacgttcatggcaagaccggcctcgatggctatgacctgcccgcccccaccatgccgcttcaagcccagcatggcgttgatttcatcattgaaacactgatgaaggaagaaccgggcaccgtcacactctgcccgatcgggccgctgaccaacatcgcttccgcgctgatccgcgagtcgaagattgccgggcgcgtcaaggaaatcgtgctgatgggcggcggctatttcgagggcggcaacatcacgccatcggcggaattcaacatctatgtcgatccgcatgccgcatcggttgtcttcagctccggcatcaagatcaccatgttgccgctcgatgtcacgcacaaggttctcaccactgaaaagcgcatcgccgccattcgcaacataggcagccatgtcggcgaagtggtcgcggcctggcttgagtttttcgagcgttatgatgaagccaaatacggcaccgatggtgccccactgcatgacccgaacgtcatcgcctatctcatcaagccggagctttattcaggccgtgcatgcaatgtggaaatcgagatcaattcggaactgaccatcggcgaaacagtcgttgactggtgggaggtgacagaccgtccgaagaatgccttcttcatcaaggatgtggatgccgatggcttcttcagcctgctgacggagcgtctggcgacgctttga

SEQ ID NO: 91147 - protein, 331 aa, Brucella melitensis 16M
MSKHAVSCAIPSQRTHQETTMARKIIIDTDPGQDDAVAILLALASPELDILGITAVAGNGPLARTEVNARTVCEVAKKPDTKVFAGSIRPLVRPLVTAENVHGKTGLDGYDLPAPTMPLQAQHGVDFIIETLMKEEPGTVTLCPIGPLTNIASALIRESKIAGRVKEIVLMGGGYFEGGNITPSAEFNIYVDPHAASVVFSSGIKITMLPLDVTHKVLTTEKRIAAIRNIGSHVGEVVAAWLEFFERYDEAKYGTDGAPLHDPNVIAYLIKPELYSGRACNVEIEINSELTIGETVVDWWEVTDRPKNAFFIKDVDADGFFSLLTERLATL

SEQ ID NO: 91148 - DNA, 981 bp, Clostridium perfringens str. 13
  CDS (1)..(981): transl_table=11
atggataagagaaaggtaattattgattgtgatccagggatagacgatgctttagccattattcttgcattaaagtcaaaagagattgaggttgttggaataaccaccgtatcaggaaatgttgaaagtttacagggagctaaaaatgccttaaaggtacttaagcttttaggtagattggatattcctgtttacttaggagaaggtaagccagttaaaagagagcttgtaacagcacaggatactcatggggaagatggcttaggagaaacttttttagaagaggtctctagtgagtatattagagaaaatggtgttgattttattttaaatactttaaaaaatcatgaaaatgttagtattattgctcttggacccctaacaaacctatgtagagctatagaaaaggattcagaaagttttcatagagttaaggaaatagtttctatgggtggagcttataagagtcatggaaattgttcaccagtagctgaatttaattactgggtagatcctcatggagcaagggagtttctaaaaaagtttaatggtgaatttaccatggttggtttagatgttacaagagagatagttttaacaccaaatttaagagaaatgatacatcaatttaaagatgaaattggtgattttatatatgatattactagattctacgttgatttccattgggaacaagagagaacacttggatgtgttataaatgaccccttagcagtagagtattttataaatagagagctttgtgagggttttaaggcttatgtggacatagcttgcgaagatatatcaatgggacaaagtgttgttgatgttgcagatttttataagaaaagaaaaaatgtatttgttttagataaagttaatagcaaagaatttatggtaagttttcttaataaaatatttccgatccataaagaggatattaaaaatgtacttaataatccaaagtatggtatttaa

SEQ ID NO: 91149 - protein, 326 aa, Clostridium perfringens str. 13
MDKRKVIIDCDPGIDDALAIILALKSKEIEVVGITTVSGNVESLQGAKNALKVLKLLGRLDIPVYLGEGKPVKRELVTAQDTHGEDGLGETFLEEVSSEYIRENGVDFILNTLKNHENVSIIALGPLTNLCRAIEKDSESFHRVKEIVSMGGAYKSHGNCSPVAEFNYWVDPHGAREFLKKFNGEFTMVGLDVTREIVLTPNLREMIHQFKDEIGDFIYDITRFYVDFHWEQERTLGCVINDPLAVEYFINRELCEGFKAYVDIACEDISMGQSVVDVADFYKKRKNVFVLDKVNSKEFMVSFLNKIFPIHKEDIKNVLNNPKYGI

SEQ ID NO: 91150 - DNA, 969 bp, Arabidopsis thaliana
  CDS (1)..(969)
atggcgataggagaccgcaagaagattatcatcgatactgatcctggaatcgatgatgcaatggcgatattcgtagctttaaattcacctgaagttgatgtcattggcctcactactatctttggaaacgtgtataccactctcgccactcgaaacgccttgcatttgttggaggttgcgggtaggaccgatattccggtggctgaaggaacacataaaaccttcttgaacgatacgaagcttcgaatagctgactttgttcatggaaaagatgggcttggcaaccaaaacttccctccacctaaaggaaaaccaattgaaaagtctggacctgagtttttagttgaacaagcaaagctttgccctggtgaaatcacggttgttgctttgggaccactaacaaatctcgcgttggctgttcagcttgatccagagttttcgaaaaatgtcggacaaattgttcttcttggtggagcatttgcagtaaacggaaatgtaaatccagcttcggaagctaatatttttggcgatcccgaagctgcagatattgtgttcacatgtggggccgatataattgctgtgggaatcaatgtgacccatcaagttattatgacagctgatgacaaggacaaactagcatcatcgaaggggaaattagctcaatatctctgtaaaatccttgatgtgtactatgattatcatctcacggcttacgaaatcaaaggtgtgtaccttcatgatcctgcgacgatccttgcggctttccttccttctctattcacttatacagaaggagttgctagagtgcagacaagtggtatcactaggggactcactttactgtacaacaatcttaagaggtttgaggaagcgaacgagtggtcagacaaaccaacggtaaaagtggcagtgacggttgatgctcctgcagtcgtgaagctcataatggataggcttatggagtcttaa

SEQ ID NO: 91151 - protein, 322 aa, Arabidopsis thaliana
MAIGDRKKIIIDTDPGIDDAMAIFVALNSPEVDVIGLTTIFGNVYTTLATRNALHLLEVAGRTDIPVAEGTHKTFLNDTKLRIADFVHGKDGLGNQNFPPPKGKPIEKSGPEFLVEQAKLCPGEITVVALGPLTNLALAVQLDPEFSKNVGQIVLLGGAFAVNGNVNPASEANIFGDPEAADIVFTCGADIIAVGINVTHQVIMTADDKDKLASSKGKLAQYLCKILDVYYDYHLTAYEIKGVYLHDPATILAAFLPSLFTYTEGVARVQTSGITRGLTLLYNNLKRFEEANEWSDKPTVKVAVTVDAPAVVKLIMDRLMES

SEQ ID NO: 91152 - DNA, 1011 bp, Arabidopsis thaliana
  CDS (1)..(1011)
atggattgtggtatggagaattgtaatggtgggatctcaaacggtgacgttttgggtaagcatgagaagctcattatcgatacagacccaggaattgatgatagcatggcgatattgatggcgtttcaaacaccggagctggagatattaggattaactactgtgtttggtaatgtttctacacaagatgctactcgcaacgctttactcttgtgtgagattgctggcttccctgatgttcccgttgcagaaggaagttccgaacctttaaagggtggaattccgcgtgttgctgattttgtgcatggtaaaaacggactaggagatgtctctcttcctcctccgagtagaaagaaatctgagaaaagtgcagctgagtttctagatgagaaggtcgaagaatatccgggtgaagtcaccattctcgccctcggacctctaaccaacctggcattagccatcaaacgcgatagttcatttgcgagcaaggtgaagaaaattgttattcttggtggagctttcttttctttgggaaatgtcaatcctgcagctgaggctaatatatatggtgacccggaagcagctgatgttgttttcacatctggagcggatatcactgttgtcggtataaacatcacaacccaacttaaactatcagatgatgacctcttggagcttggtaactgcaaggggaaacactctaaattgataagcgatatgtgcaaattttatagagattggcacgtcaaatctgatggtgtttacggagtgtacctccatgacccagtcagctttgtggctgtagtacggcctgatttattcacatataagaaaggcgttgttcgggtggagactcaagggatatgtgttggccacacgctcatggatcaaggcctcaagagatggaacggaagcaatccgtgggtgggatattcaccgatatcagttgcttggacggttgacgtagaaggagttttggaatatgtcaaagcaaagctgatgaagccataa

SEQ ID NO: 91153 - protein, 336 aa, Arabidopsis thaliana
MDCGMENCNGGISNGDVLGKHEKLIIDTDPGIDDSMAILMAFQTPELEILGLTTVFGNVSTQDATRNALLLCEIAGFPDVPVAEGSSEPLKGGIPRVADFVHGKNGLGDVSLPPPSRKKSEKSAAEFLDEKVEEYPGEVTILALGPLTNLALAIKRDSSFASKVKKIVILGGAFFSLGNVNPAAEANIYGDPEAADVVFTSGADITVVGINITTQLKLSDDDLLELGNCKGKHSKLISDMCKFYRDWHVKSDGVYGVYLHDPVSFVAVVRPDLFTYKKGVVRVETQGICVGHTLMDQGLKRWNGSNPWVGYSPISVAWTVDVEGVLEYVKAKLMKP

SEQ ID NO: 91154 - DNA, 1089 bp, Drosophila melanogaster
  CDS (1)..(1089)
atggcggacggacgcatagtggaaaacggcagaggaggaggcggtgaaggagtagcagcagcaccatcgcccagatacgcgatcctcgactgtgatgggggtagcgacgatgcctgggcactgctcctgcttctgcatgcggctaagagccatgggattcatctgctggccatcaccacaatgggatgcggcaataccagcagggagaatgcggcacgcaatatgcgacggattctggatgcctgcaagcgcacagatattcccatatacctgggcgccgtagatgccctcattccctctctggaggatgaaaaaaagtatttccatggccgcgacggattcggtgactgtctcaccgacgactgcgctcttcagttggaggacatcgtgcaggcggagcacgcagtgacagccatccatgatctctgccgttccaggcccaaacagatcaccatatttgccgtgggcccgctgacgaatcttgccctgggctatacgatgtacggtccggagtttgggaataactttcgtgatctgttcattatgggcggcaactatcagggcgtgggcaactcctcgcgttcggcggagttcaactttcactcggatccggaggcggcgcacacggtgctgctgaggacacgctgtcccatcaccatactgccgtgggaggcctgcctcccggagagattcaatatacacattaactggcgcctgaaggatttcgccgcaagggccaaggaagccggacatccagcaattaccatgctcaaccaggtggaagccgcccagtggctgccaatgatcgagcagtacgggatcgatacgtggaatccatgcgatgccattgccgtggccgtttggctattcgaggatcacttgatccggaggcacaacacctggcacgccaccgtggatctgcggggcacccacactcgcggccagatggttctcgatcatttgcgggagcgcgaaaagtatccggagaacgtgcgcattatcgagctggtggatgtcgagttctttaaacggatctgcgaatggatcgccggcttggatgacggcgccctactccgcgacactcaataa

SEQ ID NO: 91155 - protein, 362 aa, Drosophila melanogaster
MADGRIVENGRGGGGEGVAAAPSPRYAILDCDGGSDDAWALLLLLHAAKSHGIHLLAITTMGCGNTSRENAARNMRRILDACKRTDIPIYLGAVDALIPSLEDEKKYFHGRDGFGDCLTDDCALQLEDIVQAEHAVTAIHDLCRSRPKQITIFAVGPLTNLALGYTMYGPEFGNNFRDLFIMGGNYQGVGNSSRSAEFNFHSDPEAAHTVLLRTRCPITILPWEACLPERFNIHINWRLKDFAARAKEAGHPAITMLNQVEAAQWLPMIEQYGIDTWNPCDAIAVAVWLFEDHLIRRHNTWHATVDLRGTHTRGQMVLDHLREREKYPENVRIIELVDVEFFKRICEWIAGLDDGALLRDTQ

SEQ ID NO: 91156 - DNA, 933 bp, Schizosaccharomyces pombe
  CDS (1)..(933)
atgaaaataataattgatacagatccaggtcaagatgatgccataactgctctactggctattgctagcccagaaattgagctgttgggtgtgacaacagttgctggaaatgttcctgtatccatgaccacaagaaatgcgcttcaaatgttggatttagcaggacgcccggacattccagtatatgccggatcaaacaagcctctgctacgggctccaattacagctactcatgttcatggtgctagtggttttgaaggggcagttcttcctcctccctctagaaaagagaacgaaggacatgctgtcgatttcatcattgatacactacggaacaatgaacctggaaccatcacaatttgtaccattggccctttaactaatattgctttagcattaaataaagcacccgaggtcatacagcgtgctaaacaaattgtaatgatggcaggtgctttttcagaagttggcaacattacacctgctgcggagtttaacatatacgtggatcctcatgcggcacagatggttctttcttctggaatacctatcgttatgatgccgttggatataacacatcaattgcatacaagcgccaaacgaattgcacgcatggaagctttgccaaatagagttggtcctgtagtagctgcttggttacgtatggaaaaagcatacgaagctaaaaaatacgggactgatggagggcctcttcatgatcccaataccgttatgtggcttttacgcccagacatctattctggtagaaaggttaatgtgcaaatagaaacacaaagtgaactaactatgggtatgagcgttgtggattggtggcaggttggtcttttaccagctaatgtgacatttttaaggacagttgatgatgatgagttttacgaagttttgatagaaagacttggacgtcttccttag

SEQ ID NO: 91157 - protein, 310 aa, Schizosaccharomyces pombe
MKIIIDTDPGQDDAITALLAIASPEIELLGVTTVAGNVPVSMTTRNALQMLDLAGRPDIPVYAGSNKPLLRAPITATHVHGASGFEGAVLPPPSRKENEGHAVDFIIDTLRNNEPGTITICTIGPLTNIALALNKAPEVIQRAKQIVMMAGAFSEVGNITPAAEFNIYVDPHAAQMVLSSGIPIVMMPLDITHQLHTSAKRIARMEALPNRVGPVVAAWLRMEKAYEAKKYGTDGGPLHDPNTVMWLLRPDIYSGRKVNVQIETQSELTMGMSVVDWWQVGLLPANVTFLRTVDDDEFYEVLIERLGRLP

SEQ ID NO: 91158 - DNA, 939 bp, Corynebacterium glutamicum ATCC 13032
  CDS (1)..(939): transl_table=11
atgaccaccaagatcatcctcgactgcgatccaggacacgacgacgctgtagccatgctgctcgcagccggcagcccagaaattgaactgcttggaatcaccacggtcggcggcaaccagaccttggacaaggtcacccacaatacgcaggtcgtagccaccatcgctgatatcaatgcgcccatctaccgcggtgtcacccgaccattggtgcgccccgttgaggtagccgaagatatccacggcgataccggcatggaaatccacaagtacgaactgcctgaaccaaccaagcaggtagaagacacccacgcggtggatttcatcatcgataccatcatgaataacgagcccggcagcgtagcgctggttcccaccggaccactgaccaacatcgcgctggcagtccggaaagaaccacgcatcgccgagcgagtcaaggaagttgtcctcatgggcgggggctaccacgtaggaaactggaccgccgtagctgaattcaacatcaagatcgaccccgaagcagcccacatcgtattcaacgaaaagtggccactgactatggtcggcctcgaccttacccaccaggcgctcgcaacacctgagatcgaagccaagttcaacgagctgggcaccgacgtcgccgacttcgtcgtcgcgcttttcgacgctttccgcaagaattaccaggacgcacagggttttgataacccaccagtacacgacccttgtgctgttgcataccttgttgacccaaccgtattcaccacccgcaaagcaccactcgatgtggagctgtacggcgcactcaccacaggcatgaccgttgctgatttccgcgcaccggctccagcagattgcaccacccaagtagctgttgacctggactttgataaattctggaacatggtgatcgatgcagtaaagcgcatcggatag

SEQ ID NO: 91159 - protein, 312 aa, Corynebacterium glutamicum ATCC 13032
MTTKIILDCDPGHDDAVAMLLAAGSPEIELLGITTVGGNQTLDKVTHNTQVVATIADINAPIYRGVTRPLVRPVEVAEDIHGDTGMEIHKYELPEPTKQVEDTHAVDFIIDTIMNNEPGSVALVPTGPLTNIALAVRKEPRIAERVKEVVLMGGGYHVGNWTAVAEFNIKIDPEAAHIVFNEKWPLTMVGLDLTHQALATPEIEAKFNELGTDVADFVVALFDAFRKNYQDAQGFDNPPVHDPCAVAYLVDPTVFTTRKAPLDVELYGALTTGMTVADFRAPAPADCTTQVAVDLDFDKFWNMVIDAVKRIG

SEQ ID NO: 91160 - DNA, 951 bp, Corynebacterium glutamicum ATCC 13032
  CDS (1)..(951): transl_table=11
atgagcaaaaaagccatccttgatatcgacaccggcatcgatgatgccctcgcacttgcctacgcactgggctcacctgaactagagctcattggtgtcaccaccacctacggtaacgtgctactcgaaaccggtgcagtcaatgacctggcactgcttgatctgttcggtgcaccagaagtacctgtgtacttgggtgagccacacgcacagaccaaggatggctttgaagttcttgagatctccgcgttcattcacggacaaaacggcatcggcgaagtcgagctgccagcaagcgagtcaaaggcactccccggcgcagtggatttcctcattgattccgtcaacacccacggcgatgacctggtgatcatcgcaactggtcccatgaccaacctgtctgcggcaatcgcaaaggatccaagctttgcttccaaggctcacgtggtcatcatgggtggcgccttgactgtcccaggcaacgtcagcacatgggcagaagcaaacatcaaccaggacccagatgcagcaaacgatctgttccgttccggtgcagatgtcaccatgatcggtcttgatgtcaccctgcagacccttcttaccaagaagcacactgcgcagtggcgcgaactgggcactccagctgctatcgcactggccgacatgactgattactacatcaaggcatatgagaccaccgcaccacacctgggcggttgcggcctgcacgacccactggcagtaggcgttgcagtggacccaagcctggtcactttgctccccatcaacctcaaggtagacattgagggcgagacccgtggacgcaccattggcgatgaagtccgcctcaacgatccagtgcgcacctcccgcgcagctgtcgccgtagacgtggatcgtttcctttctgaattcatgacccgcatcggccgagtcgcagcacagcagtaa

SEQ ID NO: 91161 - protein, 316 aa, Corynebacterium glutamicum ATCC 13032
MSKKAILDIDTGIDDALALAYALGSPELELIGVTTTYGNVLLETGAVNDLALLDLFGAPEVPVYLGEPHAQTKDGFEVLEISAFIHGQNGIGEVELPASESKALPGAVDFLIDSVNTHGDDLVIIATGPMTNLSAAIAKDPSFASKAHVVIMGGALTVPGNVSTWAEANINQDPDAANDLFRSGADVTMIGLDVTLQTLLTKKHTAQWRELGTPAAIALADMTDYYIKAYETTAPHLGGCGLHDPLAVGVAVDPSLVTLLPINLKVDIEGETRGRTIGDEVRLNDPVRTSRAAVAVDVDRFLSEFMTRIGRVAAQQ

SEQ ID NO: 91162 - DNA, 1068 bp, Drosophila melanogaster
  CDS (1)..(1068)
atggagaacgatacaagaaagttggagcgcttagtggtcttcgactgcgacattggaacggacgacgcctgggctttggctctcctactgcgtggagaacaattgtccttggcgagtgggaggcggtacaagctgattgcgattacttgtgtacagggcaatacggatgtggtgaatggagcccagaacgccctaaaaatacttcgattattggaaaggcgtgatgtgccagttttcaggggctgtgccaatcccattgtaactcggacatggttggacatttcccgcttccacggcactgacggccttaatgacattggcggctacccagatgtgagtgatctgcaggagcaactgcagcaggagcacgccgtgaatgccatgtatcggctagtgtgtcaatatccaaaacaagttgactttctactttgcgggccactaactaattttgccagctgcattaatctatatggcgatgattttttggacaaaatcggtggaatatttataatgggtggaaatatatatggtcgcggaaatatcatgaagtgtgcagagttcaattttatgatggatccggaggcggcgcatacaacattggagcgtttgaaggtgccagctgttattcttccctgggaacccagcattgatgacgacttcaatctgtcacttgactggcggctggatgtcttgggctctgtagaccatcccctagtcgagcttttgtccagggtggagcgatccatgttggtgccacgtgacataaagcattggattaatcccgatgccgctcttgcagcagcctatatcttcccaaaggcgatgattgccgagcagttggattaccatgccacagtggagttggccggagtccacacccgtggccagatggtactggatcatctgcgaggtcgccgtgtggatgctatccatgggaaaaagagcaatgtgcggatcataacacatctcaatagagaaccatttcgcactattatgtcctggacgggattccttccgggcgtagatatcacagagctctgcgagcaggaacaacgtaataatctttaa

SEQ ID NO: 91163 - protein, 355 aa, Drosophila melanogaster
MENDTRKLERLVVFDCDIGTDDAWALALLLRGEQLSLASGRRYKLIAITCVQGNTDVVNGAQNALKILRLLERRDVPVFRGCANPIVTRTWLDISRFHGTDGLNDIGGYPDVSDLQEQLQQEHAVNAMYRLVCQYPKQVDFLLCGPLTNFASCINLYGDDFLDKIGGIFIMGGNIYGRGNIMKCAEFNFMMDPEAAHTTLERLKVPAVILPWEPSIDDDFNLSLDWRLDVLGSVDHPLVELLSRVERSMLVPRDIKHWINPDAALAAAYIFPKAMIAEQLDYHATVELAGVHTRGQMVLDHLRGRRVDAIHGKKSNVRIITHLNREPFRTIMSWTGFLPGVDITELCEQEQRNNL

SEQ ID NO: 91164 - DNA, 981 bp, Streptomyces coelicolor A3(2)
  CDS (1)..(981)
atgcgcaccgtctccgagcagcagcagcccattccggtgatcatcgactgcgacaccggcatcgacgacgccctggccctgctgctggcggtccggcacccgcgcctcgacctgcgcgcggtgacctgcgtggccgggaacacggacgtggcgggggtcgtccggaacacgctgacggtgctggagcgggccggtgccccggacgtccccgtcgcccggggtgccgagcggccgctgatcgagggcgtgcgcaccgcgcggcacgtgcacggggccgacggcatgggcgacctcgggctgcccgcgcccacccgcgcccccgccgacgtggacgcggtgacactgctgcgccgggagatcctcgcctccccgcggccggtcaccctgatccccaccgcgccgctgaccaacatcgcgctgctgctgcgcacccacccggaggtcaccggcaacatcgagcggatcgtgttcatgggcggcgcggtggccaccgggaacgcgacgccggtcgccgagttcaacgtgtggcacgacccggaggccgccgcgatcctgctcaccgccggggtgccgatcaccatgtacggcctcgacgtgttcgagcgggtgatcgtgcccggcaccgacgtacggcggctgcgcgcgagcgccgagcccggcacccggctcgccggggaactgctcgcccaccggggcccggccaccgacgccgcggaccccggcggcgggctcggcgacgcgggcgcggtctgcgcggtgatcgacccggcgggcctgaccacgcaccggctgcccgtcgaggtgtccctggcccccgggccgtcccgcggccagaccctggtcgaccggcggctgcgcgtcggcgagtccgaactgcacgacggcatgcgcgaacagcccctggtggacgtggcgttggacgtggacgtgacccggtacgtggagctgtacctgggcacggtcgagcgcacgggagcgtag

SEQ ID NO: 91165 - protein, 326 aa, Streptomyces coelicolor A3(2)
MRTVSEQQQPIPVIIDCDTGIDDALALLLAVRHPRLDLRAVTCVAGNTDVAGVVRNTLTVLERAGAPDVPVARGAERPLIEGVRTARHVHGADGMGDLGLPAPTRAPADVDAVTLLRREILASPRPVTLIPTAPLTNIALLLRTHPEVTGNIERIVFMGGAVATGNATPVAEFNVWHDPEAAAILLTAGVPITMYGLDVFERVIVPGTDVRRLRASAEPGTRLAGELLAHRGPATDAADPGGGLGDAGAVCAVIDPAGLTTHRLPVEVSLAPGPSRGQTLVDRRLRVGESELHDGMREQPLVDVALDVDVTRYVELYLGTVERTGA

SEQ ID NO: 91166 - DNA, 951 bp, Xanthomonas campestris pv. campestris str. ATCC 33913
  CDS (1)..(951): transl_table=11
atgctggtgtgcagcggtgtgcaggcagcggcggcgcaggcgcagacagtgccggccatcgccgcggccgagcgcgtggtggtgtccaccgacatcggcgatgacatcgacgacgccttcgcgctgggcctgctgctgcgcagcccgcagctgcaggtgctgggcatcgcctcggcctggggcgacaccacgctgcgcgcgcagttgctgcagcggctgttgcagctggccggacgcagcgagattccgttggcggtgggcgagcgcaccaccagcacgattcccttcagccaggcgcgttgggcggccaaggggcagctaccaggcaagctgccggatgcggcggcgatgatcctgcagcaggcgcgcctgcatcccggcgagctgaccttgctggtgctggggccgatgaccgatgcggcacgtgcacagcagcgcgacccggcagggtttgccaagctcaagcgcatcgtggcgatgggcggctcggtgcgggtgggctacggcaagtcagcgtaccgcccggccagcgcaccggcgccggagtacaacctgctggccgatgtacccgccgcacaacgggtgttcgccgctggcgtgccgatcgtgctgctaccgctggacgccacccagatcacgctggaagaatccgagcgcgtggccctgtttgcacagggcgatggcctgaccgatgcactcacccagctgtactaccagtggcgcaataccgaccagccctgggccagcgccacgccaacgttgttcgacgtggtgccggtggcctggctgctgcaaccgcagctatgcccgaccacgccattgcatctggaagtcgatgcgcaggggtacacgcgcgaaggcaccggcacgccgaacgtgcaagcttgcctgcgcgcggacaagccggcgttgatcgatatgtacatgcgcacgttgttgcagtcgcactaa

SEQ ID NO: 91167 - protein, 316 aa, Xanthomonas campestris pv. campestris str. ATCC 33913
MLVCSGVQAAAAQAQTVPAIAAAERVVVSTDIGDDIDDAFALGLLLRSPQLQVLGIASAWGDTTLRAQLLQRLLQLAGRSEIPLAVGERTTSTIPFSQARWAAKGQLPGKLPDAAAMILQQARLHPGELTLLVLGPMTDAARAQQRDPAGFAKLKRIVAMGGSVRVGYGKSAYRPASAPAPEYNLLADVPAAQRVFAAGVPIVLLPLDATQITLEESERVALFAQGDGLTDALTQLYYQWRNTDQPWASATPTLFDVVPVAWLLQPQLCPTTPLHLEVDAQGYTREGTGTPNVQACLRADKPALIDMYMRTLLQSH

SEQ ID NO: 91168 - DNA, 939 bp, Xanthomonas campestris pv. campestris str. ATCC 33913
  CDS (1)..(939): transl_table=11
atgacaaaaaagataccgctgctgatcgacaccgacccgggcgtggatgacgcgctggcgctgctgatggcgttcaacgatacccgccatgacgtggtcggcctgaccatcgccgcaggcaatgtcggtctggagcacaccgtgcgcaatgcgctcaaagtgtgcgaggtggccggtcgcgccgatgtgccggtgtatgcgggctgcccgcaaccgctgctgcacccgtcggtggacgcggcgcatgtgcatggcatcgacggcttcggcgatgtcggcctgccgcctgccgcgcgggctgcggacgccgagcatgccgcgctggccatcctgcggctgtcgcacgtgcatgcaggcgagttgttgctggtggcacttggcccgctgaccaacctcgccctggctctgaccctggacccgaccctgccacagcgtgtggcgcggctggtggtgatgggcggggcgctgaccgggcacggcaacattaccgccgcggctgaattcaatatcggcttcgacccggaggcggcgcatatcgtgttccgcgggtttccccagttcgatgtggccgattgggaggcgaccgccgcgcacggcctgctgcaccgtgatgtggagcagtggctggcggccgattcgccgcgtgcgcgcttctacgaagaaatctcgcgcaagacccggctgtggtcggaggacagtcgtggcgagtactggtatgccgcagacgcgttggcgatggccttcgccctgcagccggacggcgcgcagcgcctggagcagcggccggtgcacatcgaactgtcgggcacgcacacccgcggcatgaccctggtggactggaaccggcagggcggggcggccgacaacgccaccctgttgctggactacgaccgccagcgcttctacggcctggtcgggcaggcgcttgcggccggctag

SEQ ID NO: 91169 - protein, 312 aa, Xanthomonas campestris pv. campestris str. ATCC 33913
MTKKIPLLIDTDPGVDDALALLMAFNDTRHDVVGLTIAAGNVGLEHTVRNALKVCEVAGRADVPVYAGCPQPLLHPSVDAAHVHGIDGFGDVGLPPAARAADAEHAALAILRLSHVHAGELLLVALGPLTNLALALTLDPTLPQRVARLVVMGGALTGHGNITAAAEFNIGFDPEAAHIVFRGFPQFDVADWEATAAHGLLHRDVEQWLAADSPRARFYEEISRKTRLWSEDSRGEYWYAADALAMAFALQPDGAQRLEQRPVHIELSGTHTRGMTLVDWNRQGGAADNATLLLDYDRQRFYGLVGQALAAG

SEQ ID NO: 91170 - DNA, 1170 bp, Xanthomonas axonopodis pv. citri str. 306
  CDS (1)..(1170): transl_table=11
atgcctcactccatcgccggtgcaatgccttcaaccttccacgacaaaaacgcaatgaccgacccgcacctcccctcatccagacgccgcgtcattctcgaagacgacatcgatggcttcacccccgcacagctgctgctgttgcagtcgcccgacgtcgaggtgctgggtatcagtgccgtcagcggcaatatctggcgcgatgaggtgctggcgcatacctgccgcctgctggaactggctggccatccgcagattccggtgcttcccggcccggtgcatccgctgatcaacagcgagttggccaccgaacgctgggaagcgctgtacggcaaactcgtgtggaaaggcgcatggaccaagcactgggtggacggcgacaccgtgcaaagcgcgccgcgctatcacgcccacgatgtggtgcccgatctggcattgggcaatcccagtgtggtgcgtccctcagacgagccggccgcgttgttcatgctgcgcatggtgcgtcagtacccgggcgaggtcagcatcattgccactggcccgttgaccaatctggcactggcgcaatcgctggacccggcctttgccacgctggcgcgcgagctggtctatatgggtggcagcctcaatccgcggcagcaacgcaacagcgtgagtgcgcagcaattcgcacgcgaattcatcaattcgccgcgacgcgagttcaatatccgctgggaccccgaagcggccagcatcgtcatgcgcgcgccgtggcgccggatcaccatggtgccggtcgacccgtccaccgccaccgaactcaccgccgagttgctggcgcgcatgagtgcggccgacaccacgattggccacgcactgcgccgccgcgagccgggctttccgatgtgggacgaactggccacggccgtgtggctgcgcccggaattggcgaggcatacggaaacgctgtacgtcgacaccaacactgccttcgatgccgggtacggcgatatcttgtcgtgggcgccggggtatcagcccgggctgggcgagcaggcgcagacggtggtgcatgcggtggatgtgccggcattggagcagctgctggtcgaccgcctcaccgcgccacagccgccggcagtgggatcgcccctcccccttcgcccatcgggacctcggtccccttga

SEQ ID NO: 91171 - protein, 389 aa, Xanthomonas axonopodis pv. citri str. 306
MPHSIAGAMPSTFHDKNAMTDPHLPSSRRRVILEDDIDGFTPAQLLLLQSPDVEVLGISAVSGNIWRDEVLAHTCRLLELAGHPQIPVLPGPVHPLINSELATERWEALYGKLVWKGAWTKHWVDGDTVQSAPRYHAHDVVPDLALGNPSVVRPSDEPAALFMLRMVRQYPGEVSIIATGPLTNLALAQSLDPAFATLARELVYMGGSLNPRQQRNSVSAQQFAREFINSPRREFNIRWDPEAASIVMRAPWRRITMVPVDPSTATELTAELLARMSAADTTIGHALRRREPGFPMWDELATAVWLRPELARHTETLYVDTNTAFDAGYGDILSWAPGYQPGLGEQAQTVVHAVDVPALEQLLVDRLTAPQPPAVGSPLPLRPSGPRSP

SEQ ID NO: 91172 - DNA, 891 bp, Xanthomonas axonopodis pv. citri str. 306
  CDS (1)..(891): transl_table=11
gtgcagaccgagaaagtggtggtctccaccgacatcggcgacgatatcgacgatgcgttcgcgttgggattgctgctgcgtcgtccgcagttgcaggtgctgggcatcgcatcggcatggggcgacaccacgttgcgcgtgcagttgctgcagcggttgttgcagcaggccgggcgcagcgagatcccgctggcggtgggcgcgcgtaccaccagcagcattgcgtttagccaggcaggctgggcggccaagggacaggtaccggcggcactgcctgatgcggctgcgatgatcctgcagcaggcgcgccagcatccgggcgaggtcaccttgctggtgctggggccgatgaccgatgcggcgctggcgcaacaacgcgacccggccggctttgccaagctcaagcgtgtggtggcgatgggcggatctgtgcgggtgggctatggcaagtctgcgtatcgtccggccagtacgccggtgccggagtacaacatcctggccgacgtgccggcagcgcagcgcgtgttctcatctggtgtgccgatcgtgttgttgccgctggatgccacgcagatcacgctggaagagcccgagcgcgtggccttgttcgcgcacggtgacggactgaccgatgcgctgacgcagctgtactaccagtggcgcaacaccgaccagccctgggccagtgccacgcccacattgttcgatgtagtgccggtggcctggctgctacgcccggcgctgtgcccgaccacgccgctgcatctggacgtggatgcgcaaggctatacccgcgaaggcgctggtgcgcccaatgtgcaggcctgtctgcgcgtggataagccggcgctgatcgaactgtacatgcgtgcgttgctggagttgccctga

SEQ ID NO: 91173 - protein, 296 aa, Xanthomonas axonopodis pv. citri str. 306
MQTEKVVVSTDIGDDIDDAFALGLLLRRPQLQVLGIASAWGDTTLRVQLLQRLLQQAGRSEIPLAVGARTTSSIAFSQAGWAAKGQVPAALPDAAAMILQQARQHPGEVTLLVLGPMTDAALAQQRDPAGFAKLKRVVAMGGSVRVGYGKSAYRPASTPVPEYNILADVPAAQRVFSSGVPIVLLPLDATQITLEEPERVALFAHGDGLTDALTQLYYQWRNTDQPWASATPTLFDVVPVAWLLRPALCPTTPLHLDVDAQGYTREGAGAPNVQACLRVDKPALIELYMRALLELP

SEQ ID NO: 91174 - DNA, 939 bp, Xanthomonas axonopodis pv. citri str. 306
  CDS (1)..(939): transl_table=11
atgacaaaaaagataccgctgctgatcgacacggaccccggcgtggacgacgccttggcgctgctgatggccttcaacgacaaccgccatgaggtcgtcggcctgaccatcgccgccggcaacgtgggcttggagcacaccgtgcgcaacgccttgaaggtctgcgagatcgctggccgtcccgatgtgccggtctacgccggctgcccgcagccattgctgcacccgtcggtggatgcggcacacgtgcacggtctcgacggattcggcgatgtgggcctggcaccggccaagcgcaccgccgaggccgaacacgccgcgctcgccatcctgcgtctgtcgcacgaacacgccggcaagctgctgctggtggcgctcggtccactgaccaatcttgccctggcactcactctggacccgaccctcccgcaacgcgtggcgcggctggtggtgatgggcggggcgttgaccgggcacggcaatatcaccgccgcggccgagttcaacatcgggttcgacccggaagcggcgcatatcgtgttccgaggttttccgcagttcgacgtggccgattgggaagccaccattgcgcacgggctactgcaccgggacgtggagcactggctggcggccgattctgcccgcgcccggttctacgaggatatctcgcgcaagacccggctgtggtccgaagacagccgcggcgagtactggtatgccgccgacgcgctggcgatggctttcgccttgcacccggaaggcgcgcagcggctggagcagcgcccggtacacatcgaactgtccggtgcgcatacccgtggcatgaccctggtggactggaaccggcagggcggggcgcccgacaatgccaatctgctgctggcctatgacatccagcagttctaccggctggtaggggcggccctggcggcgaactga

SEQ ID NO: 91175 - protein, 312 aa, Xanthomonas axonopodis pv. citri str. 306
MTKKIPLLIDTDPGVDDALALLMAFNDNRHEVVGLTIAAGNVGLEHTVRNALKVCEIAGRPDVPVYAGCPQPLLHPSVDAAHVHGLDGFGDVGLAPAKRTAEAEHAALAILRLSHEHAGKLLLVALGPLTNLALALTLDPTLPQRVARLVVMGGALTGHGNITAAAEFNIGFDPEAAHIVFRGFPQFDVADWEATIAHGLLHRDVEHWLAADSARARFYEDISRKTRLWSEDSRGEYWYAADALAMAFALHPEGAQRLEQRPVHIELSGAHTRGMTLVDWNRQGGAPDNANLLLAYDIQQFYRLVGAALAAN

SEQ ID NO: 91176 - DNA, 984 bp, Streptococcus agalactiae 2603V/R
  CDS (1)..(984): transl_table=11
atgaataaagaaaaaattattatcgattgcgatcccggtattgatgataccttagcactgatgtatgctattcagcatcctaagttagaagttgttgctattactataacagcaggcaattcgcctgttgagctaggactaaagaatacctttgtaacgcttgaattactaaaccgtcacgacattccagtttatgttggtgataacttgcctttacaacgtgaatttgtatctgctcaggatactcatggaatggatggccttggagagaataactttacattggcgcaaccaattatctttcaagaagaatcagcagattgttttttagcaaactattttgaacacaaaaatgatacttctattatagctctcggacctctgaccaatatcgctcgagccttacaaactaatcccaaattaggcaaacattgcaagcgatttattagcatgggaggaagttttaaatcacatggcaattgttctccagttgctgaatacaactattggtgtgatcctcatgctgcacaatatgtatttgaaaaccttgacaaaaaaatagagatggttggactagacatcacacgtcatattgtattaacccccaatcatttatcttatatggagcgtattaatccagacgtatcaagttttatccaaaaaatcacaaagttctacttcgattttcactggcaatatgagcatattattggatgtgtgataaatgatcctttagctattgcttactttgttaatgaaaatatcgctactggttttgatagctataccgatgttgcttgtcacggaatcgccatgggacaaacaattgtagatcagtatcatttttataaaaaagatgctaacagtaagattttaacctcagtcaatactaatttattttggaatgattttatgaccgtcctattacatgcacaaaattcagtcatcattgaagacttagaaatgttaggacttaacaaatga

SEQ ID NO: 91177 - protein, 327 aa, Streptococcus agalactiae 2603V/R
MNKEKIIIDCDPGIDDTLALMYAIQHPKLEVVAITITAGNSPVELGLKNTFVTLELLNRHDIPVYVGDNLPLQREFVSAQDTHGMDGLGENNFTLAQPIIFQEESADCFLANYFEHKNDTSIIALGPLTNIARALQTNPKLGKHCKRFISMGGSFKSHGNCSPVAEYNYWCDPHAAQYVFENLDKKIEMVGLDITRHIVLTPNHLSYMERINPDVSSFIQKITKFYFDFHWQYEHIIGCVINDPLAIAYFVNENIATGFDSYTDVACHGIAMGQTIVDQYHFYKKDANSKILTSVNTNLFWNDFMTVLLHAQNSVIIEDLEMLGLNK

SEQ ID NO: 91178 - DNA, 984 bp, Oceanobacillus iheyensis HTE831
  CDS (1)..(984): transl_table=11
atggtaaagaaagtattgttatttggtgatataggtattgatgatattattacgctcatttatgccgcattagatgaagaaatagaagttattgcagtagtcgcatcatatggaaatataagtcgtgagaaagccacaaatacaattagttacatacaagatctattaaattataaaaatctacaggtaccattaatattgggggcacaacgtccaatgacgggggaaataccaaaagaagtatcggatattcatggtgagtacggtatgggcccgattattcctcctataaatgatgcggaggttgttgaaaactttttacagataatcgatataattgaaaaaaatgaagatatatacatagctaatattggcagactaaccgatttagcaacattatttatattatatgaagatttaatgggaaaagtaaaaggaatttatattatggggggagcattttgggttcctggaaatattacagctgtagctgaagctaattttcacggggatccagtagccgcacaattagtgatgcgctttgcttctaacctgaagattttaccacttaatgtatcaaatcaagcaatagttactcctgaaatggtaaattatattgatcaggtcggacaaatttctattgtaaagccaatgattgattattactatgatttttataaaaaaagagacccatcaattataggaagtcccatgcatgatgtattagtattaatggcaataaaaaataaagatatgtttcaattttttagtagaccgattacgattgtccagtcattgttaggtgaggagaggggacaaagtattgccgatatacgctcctatgaagatggatattatactattacggagacgaatcaccatcaaatagcttttcaaatggattatcagcaattctttttcgattttatgacaaatatgtcgaatggtcaatttgatcggtcgttatataaaaaagaaaaatag

SEQ ID NO: 91179 - protein, 327 aa, Oceanobacillus iheyensis HTE831
MVKKVLLFGDIGIDDIITLIYAALDEEIEVIAVVASYGNISREKATNTISYIQDLLNYKNLQVPLILGAQRPMTGEIPKEVSDIHGEYGMGPIIPPINDAEVVENFLQIIDIIEKNEDIYIANIGRLTDLATLFILYEDLMGKVKGIYIMGGAFWVPGNITAVAEANFHGDPVAAQLVMRFASNLKILPLNVSNQAIVTPEMVNYIDQVGQISIVKPMIDYYYDFYKKRDPSIIGSPMHDVLVLMAIKNKDMFQFFSRPITIVQSLLGEERGQSIADIRSYEDGYYTITETNHHQIAFQMDYQQFFFDFMTNMSNGQFDRSLYKKEK

SEQ ID NO: 91180 - DNA, 921 bp, Bifidobacterium longum NCC2705
  CDS (1)..(921): transl_table=11
atgaagcagatccctctgattatcgacactgaccccggcatcgatgacgccgtcgccatcgcactggcagtgttcaacccgcgcttcgacgtgcggctgattactacggttgctggcaatgtcagcattgaagcgacaacgacgaacgcgctcaagctgatggcctactacggtaaggatgtaccggtcgctcgtggcgctgctgaaccgctgatccgtcagcttgatgatgcaagcgatatccacggtaaaaccggtatggagggattcgatttccctgagcccaaaactgaacttctgctggataagcatgctgtcgaagcaatgcacgacgagatcatggcttctgctgaacccgtcaccgtcatgccaatcggtccgctgaccaacatcgcactgttgctaaaaacttttccggaagtcaagtcgcgtattgagcgcattgtgctcatgggtggttcggtcactcgcggcaacaagggtgttatggccgaattcaatattttcgttgaccctgaagccgccaagattgtgctcacttctggtcttgacattactatggccacactggacgccggcttgggaactgtgattccgccggagaaaaccgctcagcttaaggatatgggcaaggtcggtctgatggctcatgacctgttccagcgctaccgcaagcgcagcttcggcaccggtctcaaaatgtatgacgcttgcgcagtcgcatgcttgctggagcctgacctattcgacatgactaaggcatttgtggacgtagaaatcgctggcgaactcactgcagggtgtacggtcgttgatcttaagggctaccttaagcgcgaaccgaatgccaccgtcaccaccggcgttcacgcagatcgattctgcgactggttcatggacggcatcgcccattgtgcatag

SEQ ID NO: 91181 - protein, 306 aa, Bifidobacterium longum NCC2705
MKQIPLIIDTDPGIDDAVAIALAVFNPRFDVRLITTVAGNVSIEATTTNALKLMAYYGKDVPVARGAAEPLIRQLDDASDIHGKTGMEGFDFPEPKTELLLDKHAVEAMHDEIMASAEPVTVMPIGPLTNIALLLKTFPEVKSRIERIVLMGGSVTRGNKGVMAEFNIFVDPEAAKIVLTSGLDITMATLDAGLGTVIPPEKTAQLKDMGKVGLMAHDLFQRYRKRSFGTGLKMYDACAVACLLEPDLFDMTKAFVDVEIAGELTAGCTVVDLKGYLKREPNATVTTGVHADRFCDWFMDGIAHCA

SEQ ID NO: 91182 - DNA, 999 bp, Brucella suis 1330
  CDS (1)..(999): transl_table=11
ttgttgagcaaacatgcagtatcatgcgcaataccctcccaacgaactcatcaggaaaccaccatggcccgtaaaatcattatcgataccgatcccggtcaggacgatgccgtcgccattttgctggcgcttgcaagccctgaactcgacattctcggcattaccgccgttgcaggaaatggcccgctggcgcgcacagaagtcaatgcccgcacggtctgcgaagtggcgaaaaagccggacacaaaagtatttgcaggctccatccgcccattggtgcgcccgcttgtcaccgctgaaaacgttcatggcaagaccggcctcgatggctatgacctgcccgcccccaccatgccgcttcaagcccagcatggcgttgatttcatcattgaaacactgatgaaggaagaaccgggcaccgtcacactctgcccgatcggaccgctgaccaacatcgcttccgcgctgatccgcgagccgaagattgccgggcgcgtcaaggaaatcgtgctgatgggcggcggctatttcgagggcggcaacatcacgccatcggcggaattcaacatctatgtcgatccgcatgccgcatcggttgtcttcagctccggcatcaagatcaccatgttgccgctcgatgtcacgcacaaggttctcaccactgaaaagcgcatcgccgccattcgcaacataggcagccatgtcggcgaagtggtcgcggcctggcttgagtttttcgagcgttatgatgaagccaaatacggcaccgatggtgccccactgcatgacccgaacgtcatcgcctatctcatcaagccggagctttattcaggccgtgcatgcaatgtggaaatcgagatcaattcggaactgaccatcggcgaaacagtcgttgactggtgggaggtgacagaccgtccgaagaatgccttcttcatcaaggatgtggatgccgatggcttcttcagcctgctgacggagcgtctggcgacgctttga

SEQ ID NO: 91183 - protein, 332 aa, Brucella suis 1330
MLSKHAVSCAIPSQRTHQETTMARKIIIDTDPGQDDAVAILLALASPELDILGITAVAGNGPLARTEVNARTVCEVAKKPDTKVFAGSIRPLVRPLVTAENVHGKTGLDGYDLPAPTMPLQAQHGVDFIIETLMKEEPGTVTLCPIGPLTNIASALIREPKIAGRVKEIVLMGGGYFEGGNITPSAEFNIYVDPHAASVVFSSGIKITMLPLDVTHKVLTTEKRIAAIRNIGSHVGEVVAAWLEFFERYDEAKYGTDGAPLHDPNVIAYLIKPELYSGRACNVEIEINSELTIGETVVDWWEVTDRPKNAFFIKDVDADGFFSLLTERLATL

SEQ ID NO: 91184 - DNA, 957 bp, Shewanella oneidensis MR-1
  CDS (1)..(957): transl_table=11
atgacttgccctattattctggattgcgatcccggccatgacgacgccattgcgctcattttagcgctagcccatcctgatctcgttccactcgccgtcaccaccagcgccggtaaccaaacgccagataaaaccctcaataatgccttgcggatcttaaccttattaaatcgcagtgatattcctgtcgcgggcggcgccgccaaaccattagcccgtgatttaattattgccgataatgtccacggcgaaaccggactcgacggccctgcattgcctaatccaagttttagtcctcaagccattaccgcagttgaattaatggcgcagcaaattcgcaaaagtcatcagccagtaaccttaattcccacagggccgctgactaacatcgcccttttactcgcgagtcatagcgagttacacgataaaattgaacgcattgtgctgatgggcggcgcagccggcgtcggcaattggacgcctgccgccgagtttaatatttttgtcgacccagaagccgccgatattgtgtttaaatccggtattcccataaccatgtgcggccttgatgtaacccatcaagcgcagatcatggacgaagatatcgaacgtattcgggcaattcccaaccctgtggctaaatgcgtcgccgaattactggatttctttatgatttaccatagggatcctaaatggggatttgttggcgcgccgctgcacgatccatgtactattgcttggttactcaaacctgaactgtttgatgcccaagactgctgggtaggaatcgaaacccaaagcgagttaacgctggggatgacggtcgtcgatcgctatcagcttacgggtaagcccgccaatgccacagtgctgtttggactcaatagacaaggctttgttgacttgttagttcacagcttagcagcctacactccaacgtatctcaaccgcagatga

SEQ ID NO: 91185 - protein, 318 aa, Shewanella oneidensis MR-1
MTCPIILDCDPGHDDAIALILALAHPDLVPLAVTTSAGNQTPDKTLNNALRILTLLNRSDIPVAGGAAKPLARDLIIADNVHGETGLDGPALPNPSFSPQAITAVELMAQQIRKSHQPVTLIPTGPLTNIALLLASHSELHDKIERIVLMGGAAGVGNWTPAAEFNIFVDPEAADIVFKSGIPITMCGLDVTHQAQIMDEDIERIRAIPNPVAKCVAELLDFFMIYHRDPKWGFVGAPLHDPCTIAWLLKPELFDAQDCWVGIETQSELTLGMTVVDRYQLTGKPANATVLFGLNRQGFVDLLVHSLAAYTPTYLNRR

SEQ ID NO: 91186 - DNA, 960 bp, Corynebacterium efficiens YS-314
  CDS (1)..(960): transl_table=11
ttgagaattaggagtttcaccatgaccaccaagatcatcctcgactgcgatcccggacacgatgacgccgtcgccatgctgctcgcccacggcaacccggacatcgagctgctcggcatcaccaccgtcggcggcaaccagaccctggccaaggtcacccacaacgcccgtgtcgtggccaccatcgccggcatggacaccccgatctacccgggcgtgacccgcccgctggtccgcccagtcgaggtcgccgaggacatccacggcgacaccggcatggagatccacaactatgacctccccgagccgaccgtgggcgttgaggacacccacgcggtggacttcatcatcgacacggtgatgaacaacgaaccgggcaccgtcgccctggttcccaccggcccgctgaccaacatcgccctggcggtgcgcaaggaaccccgcatcgccgagcgcgtcaaggaggtcgtcctcatgggtggcggctaccacgtgggcaactggaccgccgtcgcggaattcaacatcaagatcgacccggaggccgcccacatcgtcttcaacgagtcctggcccctgaccatggttggtctggatctcacacaccaggcgctggccaccccggaggtggaggagaaactcgccgcactgggcaccgagacgggcgacttcgtcgtcgcgcttttcgacgccttccgcaagaactatcaggacgcccagggattcgacaacccacccgtccacgacccctgcgccgtggcctacctcatcgaccccaccgtgttcaccacccgcaaggcaccactggatgtggaactgtccggcgcgctgaccaccggcatgaccgtcgctgatttccgcgcccccgccccggaggactgcaccacccaggtggcggtggatctggacttcgataagttctggaccatggtcgtcgatgcggtgaagcgcatcggttag

SEQ ID NO: 91187 - protein, 319 aa, Corynebacterium efficiens YS-314
MRIRSFTMTTKIILDCDPGHDDAVAMLLAHGNPDIELLGITTVGGNQTLAKVTHNARVVATIAGMDTPIYPGVTRPLVRPVEVAEDIHGDTGMEIHNYDLPEPTVGVEDTHAVDFIIDTVMNNEPGTVALVPTGPLTNIALAVRKEPRIAERVKEVVLMGGGYHVGNWTAVAEFNIKIDPEAAHIVFNESWPLTMVGLDLTHQALATPEVEEKLAALGTETGDFVVALFDAFRKNYQDAQGFDNPPVHDPCAVAYLIDPTVFTTRKAPLDVELSGALTTGMTVADFRAPAPEDCTTQVAVDLDFDKFWTMVVDAVKRIG

SEQ ID NO: 91188 - DNA, 951 bp, Corynebacterium efficiens YS-314
  CDS (1)..(951): transl_table=11
atgaccaagaaggccatcctggacctggacaccggcatcgatgatgctctcgcactggcctacgccctgggctccccggagctggaggtcatcggcgtgacctgcacctacggcaacgtcctgctggacaccggcgctgcgaacaacctcgcgctgctggaactgttcggggcccccgatgttccggtttacctcggtgagccccatgccctcatgcgcgacgggttcgaggtcctggacatctccgccttcatccacggtgccaacggtatcggcgaggtcgccctggagaaggcccgcgccgaggcccgcgaaggtggtgtggatttcctcatcgattccgtgcgtgaacacggcgacgatctggtcatcatcgccaccggtccgctgaccaacatcgcggcggccgccgcgaaggatgcggccttcgcggacaacgcccacatcgtcatcatgggcggtgcgctcaccgtcccgggcaatgtcagcccctgggccgaagccaacatcaaccaggacccggatgccgccaacaatgtcttccgtgcggcggccgatgtgaccatgatcggcctggatgtcaccctgcagaccctgctgacctccaggcacaccgcgcagtggcgtgagctgggcaccccggctgccatcgccctggcggacatgaccgactactacatcaaggcctatgagaccaccgccccgcacctgggtggctgtggtctccatgacccgttggccgtgggtgtggccgtcgacccgtccctggtcaccctgttgccgatcaacctcaaggtcgatgtggagggtgagacccggggccgcaccatcggtgatgaggtccgcctcaacgatcccgtgcgcaccgctcgtgcggccgtggcagtcgatgtggaccggttcctgtccgagttcatgacccgcgtgggtcgggtggccgcaaacaactag

SEQ ID NO: 91189 - protein, 316 aa, Corynebacterium efficiens YS-314
MTKKAILDLDTGIDDALALAYALGSPELEVIGVTCTYGNVLLDTGAANNLALLELFGAPDVPVYLGEPHALMRDGFEVLDISAFIHGANGIGEVALEKARAEAREGGVDFLIDSVREHGDDLVIIATGPLTNIAAAAAKDAAFADNAHIVIMGGALTVPGNVSPWAEANINQDPDAANNVFRAAADVTMIGLDVTLQTLLTSRHTAQWRELGTPAAIALADMTDYYIKAYETTAPHLGGCGLHDPLAVGVAVDPSLVTLLPINLKVDVEGETRGRTIGDEVRLNDPVRTARAAVAVDVDRFLSEFMTRVGRVAANN

SEQ ID NO: 91190 - DNA, 969 bp, Pseudomonas putida KT2440
  CDS (1)..(969): transl_table=11
atggccgcagcctccaccctccaggccgcacccatcgatctgatcatcgacaccgatcccggcgccgacgatgtggtggcgctgtttctggccatggcttcgccccacgaactcagtatccgcgccatcaccaccgtggccggcaacgttcgcctggacaagacctcgcgcaatgcccgcctggcccgcgaatgggcggggcgtgaagacatcccggtgtacgctggtgccggccgcccattggtgcgcacgccgatctacgccgccgacgttcatggcgaagaaggcctcaccggcgtacaggtgcacgagccgaaagcgcccctggcccagggcaatgccgtgcaatacctggtcgataccctcggcgcagccgaaccacacagcatcaccgtcgccatgctcggcccgcagaccaacctggccctggcgctgatccagcgcccgagcatcgtcaaaggcatcaaggaggtggtggtcatggggggagcgcatttcaacggcggcaacatcaccccggtggcggagttcaacctctacgccgacccgcacgccgccgaagtggtgctggccagcggcgtgcagctgacctacctgccgctggatgtcacgcacaagctgctgaccagtaacgcccgcctgaagcagttggcagccgtgaacaaccaggcgagcaagcgcgtggtggatatcctcaatgcctacatcacccacgacatggacgtgtatggcatacctggcggccctgtgcacgacgccagcgtcatcgcctacctgttaaagcccgagctgttcagcggccggcgtatccacatgagcatcgacagccgcgaaggacccactttcggccagacaattgcagactggtacggtgtgctcaagcggccggcgaatgtgctgtgggtggagcagggtgatgcccaggggctgttcgacctgctcagtgcccgtctggcgcgattggaatag

SEQ ID NO: 91191 - protein, 322 aa, Pseudomonas putida KT2440
MAAASTLQAAPIDLIIDTDPGADDVVALFLAMASPHELSIRAITTVAGNVRLDKTSRNARLAREWAGREDIPVYAGAGRPLVRTPIYAADVHGEEGLTGVQVHEPKAPLAQGNAVQYLVDTLGAAEPHSITVAMLGPQTNLALALIQRPSIVKGIKEVVVMGGAHFNGGNITPVAEFNLYADPHAAEVVLASGVQLTYLPLDVTHKLLTSNARLKQLAAVNNQASKRVVDILNAYITHDMDVYGIPGGPVHDASVIAYLLKPELFSGRRIHMSIDSREGPTFGQTIADWYGVLKRPANVLWVEQGDAQGLFDLLSARLARLE

SEQ ID NO: 91192 - DNA, 927 bp, Bradyrhizobium japonicum USDA 110
  CDS (1)..(927)
atgacactcacggacgcagtgcgcctcaagctcctggaaccgccggtcggccggttgcgtgtcgtgctcgacaccgacacctataacgagatcgatgaccagttcgcgctcgtgcagatgctgctgtcaccggagcgcttcgaggtcgaggcgatctacgccgcaccgttcttcaatgcgcgcgcggacagtcccggccacggcatggagctgagctaccaggaaatcctccgcctgctggagcgtctgagcgtcgcgtcggaaggcctggttcatcgcggcgtcaccgactatgtcggcccaggcaagacggcgcggacggcacccgccgtggacgacctcatcgcccgggcacgcgcgggcacgcaggacaatccgctctacgtcatcgccatcggcgctatcagcaacgtcgcctccgcccttctgaaggcacccgatatcatcgaccgtatcgtcgtggtctggctcggcggccatgcgctggaatggcccgacaccatcgaattcaacctcaagcaggatgtcggcggtgcgcaggtgctgctcgacagcggcgtgccgctcgtgctggtgccgtgcaggggcgtcacctcgcgcctccacagcaccgtgccggagatcgagcgctacgtcgaaccgcatggcagcatcggcgcattcctcgcgatgcggttcaaggagtattcgtccgaccacatgggctgggccaaggagatctgggacatggcgccggtcggctggctgctgaaccccatgtgggcgccgagcgtgatcatccccgctccggtcctcacggaccagatgacgtggagcatcgaccgcaggcggcatccgatccgctacgtgacctacgtggatcgcaacccgatcctgaaggacttcttcctgaagctgcgggatttcaccgcgtcgaaagtgccgtag

SEQ ID NO: 91193 - protein, 308 aa, Bradyrhizobium japonicum USDA 110
MTLTDAVRLKLLEPPVGRLRVVLDTDTYNEIDDQFALVQMLLSPERFEVEAIYAAPFFNARADSPGHGMELSYQEILRLLERLSVASEGLVHRGVTDYVGPGKTARTAPAVDDLIARARAGTQDNPLYVIAIGAISNVASALLKAPDIIDRIVVVWLGGHALEWPDTIEFNLKQDVGGAQVLLDSGVPLVLVPCRGVTSRLHSTVPEIERYVEPHGSIGAFLAMRFKEYSSDHMGWAKEIWDMAPVGWLLNPMWAPSVIIPAPVLTDQMTWSIDRRRHPIRYVTYVDRNPILKDFFLKLRDFTASKVP

SEQ ID NO: 91194 - DNA, 933 bp, Clostridium tetani E88
  CDS (1)..(933): transl_table=11
gtgattttgaaaatgaataagaaaactaaaattattttagatacagatccaggaattgatgatgctgtagccatagtagccgcattatttagtcctaaaattcaagtggaattaataactactgtatctggaaatgtagatgtagataaaacaacagaaaatgcactgaaaatattagaatttttaaataaagatgtacctatagcaaaaggtgctagaaaaccattaatgagagaattagatgatgcaagtgatatacatggagattctggattagatggttacaattttggtaaaattacaagaaaaacagatgaaaaacccgctatagataagatgagagaagttataattaattcagaagagaaaataactttagtagcaataggacctttaactaatattgcattacttttaagttcatatccagaagttaaagataaaatagacaagttagttataatggggggatctgcatctagaggaaataaaacacctgctgcggaatttaacatttatgttgacccagaaagtgctaatatagtatttaaatctggaataaatatagtaatgtgtgggttagatattacaaacaacgctatatttaaagaagaagatataaattatataaaaaatctaaataaaacaggatatatgctttattcattatttaaatgttacagaagtggaagttttaagaagggattaagaatgcatgatttatgtgcaatagcttatttagataaacctgaaatatttaaagcggtttctgcaaaggttgatatagaaaccaaaggagaacatacattaggtgccacagtggtagactttgataattactctaatggtaaggcacaagtgaaagtatgcatggaacttgatgtagaagatttaaaaaagtggttctttagtatattgaataaagtaaattag

SEQ ID NO: 91195 - protein, 310 aa, Clostridium tetani E88
MILKMNKKTKIILDTDPGIDDAVAIVAALFSPKIQVELITTVSGNVDVDKTTENALKILEFLNKDVPIAKGARKPLMRELDDASDIHGDSGLDGYNFGKITRKTDEKPAIDKMREVIINSEEKITLVAIGPLTNIALLLSSYPEVKDKIDKLVIMGGSASRGNKTPAAEFNIYVDPESANIVFKSGINIVMCGLDITNNAIFKEEDINYIKNLNKTGYMLYSLFKCYRSGSFKKGLRMHDLCAIAYLDKPEIFKAVSAKVDIETKGEHTLGATVVDFDNYSNGKAQVKVCMELDVEDLKKWFFSILNKVN

SEQ ID NO: 91196 - DNA, 921 bp, Lactobacillus plantarum WCFS1
  CDS (1)..(921): transl_table=11
atgtcaacaaagattatcatggacactgaccctggtattgatgatgccgccgcaattacctttgcgttaaatcatcctgacttggacttacaattaattacaacggtcgccggcaatgtgacggtcgacaaaacgacgctgaatgcgctcaaactaacgcgcttctttaacagtgacgttcccgtagcgggtggggctgcccaaccgctgatcaaaccgtttgaagatgccgtccgaattcacggtgtttcaggaatgccgggttacgacttcccgactgaccttgcggaaccattaccagaaacagccgttgaagcgctccgtgactacatcatggctgctgaacaaccgattacgttagtgccaacgggagcctataccaacattgcgctcttatttaagacctaccccgaagtaatgccacacattaaagaaatcgttgcgatgggtggggccttaggcaaaggtaatatgaccagcgccgcagagttcaacgtctttaccgacccgcacgcggctgaaatcatgtaccaatccggcgttccaattaccatggtcggcttagacgtgacgatgaaggcccttttaacgcgcaaatcgattgaacagttaccgaccctcggtaaaactggcgaaatgctccacgccctctttggtcattacaacgaccgcaaccagactggcgttgcgatgcatgatgtcaatacgctcttctacttactacatccagaagccttcacgactgaaaagatgtggattgatgtccagacggagggccccgctaatggcgagaccgttggcgatattcgtggtgcttaccatgacggcaaaaccaacgcgaccgtttgtgtcgatattgatgcggcggctttcaataaatggttcctagaaaccgtggcagccattgaccaatctaaataa

SEQ ID NO: 91197 - protein, 306 aa, Lactobacillus plantarum WCFS1
MSTKIIMDTDPGIDDAAAITFALNHPDLDLQLITTVAGNVTVDKTTLNALKLTRFFNSDVPVAGGAAQPLIKPFEDAVRIHGVSGMPGYDFPTDLAEPLPETAVEALRDYIMAAEQPITLVPTGAYTNIALLFKTYPEVMPHIKEIVAMGGALGKGNMTSAAEFNVFTDPHAAEIMYQSGVPITMVGLDVTMKALLTRKSIEQLPTLGKTGEMLHALFGHYNDRNQTGVAMHDVNTLFYLLHPEAFTTEKMWIDVQTEGPANGETVGDIRGAYHDGKTNATVCVDIDAAAFNKWFLETVAAIDQSK

SEQ ID NO: 91198 - DNA, 957 bp, Lactobacillus plantarum WCFS1
  CDS (1)..(957): transl_table=11
atggcaaaacgtaaaatgattttagacttagacaccgggattgacgacgcaatggccattgcctacgcagtcggtgcacccgacgttgatttaattgggattatcagttcttatgggaactgcctagtggatcaggcggcgattaacagtttacaaattctagaactactaggtgccactgacgtacccgtctttctaggtgaaccccactccagtacgacggaacactttgacgttatgccgatttcacagcagattcatggcatgaacggtatcggcgacgtgaaccttcctgaaccgaaacgcgccgtggaaaagcagtccggtgtcgacttcttaattgatgccgttcaccaatatggcgccgatctgaccctagtgccaaccggtcccttaaccaacttggccgaagcactcgaaaaagcaccagacattgccagcaccattggtaatgtgaccttaatgggtggtgcactgactgttccaggtaatgtcagtcactacgctgaagccaatattaatcaagatgccgaagcggccaacgccgtcttcaccagtacgatgcctcttacgatggtcggactcgacgtaacgttacggacattattaaccaagactgaaacacaacaatggcgggacttaaagacaactgcgggcgaaaaatttgctgacattgttgactattacattgcggcttacgatattacgagtcctgacttacacggttgtgccttacacgatccactggcagtcggcgtttcactcgatccaagttttgtcaccacgttagacctgaatatgtacgtccaggctagtggtgaagattatggccggacaattggtgaccctgcgcgactcaatgacccaactaacgtcacggttgcgttaacggtcgacaaggatcgttatttgaagacattcatgaattacctgacgacattatttaaagcccattag

SEQ ID NO: 91199 - protein, 318 aa, Lactobacillus plantarum WCFS1
MAKRKMILDLDTGIDDAMAIAYAVGAPDVDLIGIISSYGNCLVDQAAINSLQILELLGATDVPVFLGEPHSSTTEHFDVMPISQQIHGMNGIGDVNLPEPKRAVEKQSGVDFLIDAVHQYGADLTLVPTGPLTNLAEALEKAPDIASTIGNVTLMGGALTVPGNVSHYAEANINQDAEAANAVFTSTMPLTMVGLDVTLRTLLTKTETQQWRDLKTTAGEKFADIVDYYIAAYDITSPDLHGCALHDPLAVGVSLDPSFVTTLDLNMYVQASGEDYGRTIGDPARLNDPTNVTVALTVDKDRYLKTFMNYLTTLFKAH

SEQ ID NO: 91200 - DNA, 981 bp, Lactobacillus plantarum WCFS1
  CDS (1)..(981): transl_table=11
atgaatgcgacgcgtaacgttattattgactgtgatcccgggatcgatgatagtttagcactattattggcgcttaaatcaccggcacttaatgtgattggaattacaattgtttgtgggaacgtgccaacccatatcggtgcggaaaatgcactgaaaattttagatttggctgaccgattggatattccagtctatttgggcgctaatcgcccattggaagtcgcctacacgagtgcgcaagacacccacggcgatgacggcttagggaatagtcagattccagcggtaacggcggtacgaccgattcaagatgccgctggttttattgaagagacgctgattgaagcgcctgatacttcgattttagcgttgggaccgttgacgaacattgcgacggtattgcaacgtgatccacacttatttgaacaagtcgatcaatttacactgatgggtggaagttatcggagtcacgggaattgttcgccagtagctgaatacaacttctggtgtgacccggatgcggccaaggtcgtctttgacttgatgcctgttcccattcagatggttggtttagacgtcacgcgtaacatcgtgttgacacccagtttattaacgtatattaaagacgtcaatccagcaatgggggcgtttgttgagaaaattacaaagttctattttgactttcattgggaatatgaacgggttattggttgtgtgatcaatgatccgttggccgtggccggaatgcttgatccaacgattctgagtggctttgaaagctacacgacggtcgtgacggatggtgtcgcgcgtgggcagtcaatcgtggatgatcatgatttctggcacaacacacccaatagtcaaatcatgacgaaggttgacgtcgtcgccttttggcggttatttttaacgaccgtggtcggtgcgactgatcctgatttaacgcaagtcttgcaccaattggtgagtgcatga

SEQ ID NO: 91201 - protein, 326 aa, Lactobacillus plantarum WCFS1
MNATRNVIIDCDPGIDDSLALLLALKSPALNVIGITIVCGNVPTHIGAENALKILDLADRLDIPVYLGANRPLEVAYTSAQDTHGDDGLGNSQIPAVTAVRPIQDAAGFIEETLIEAPDTSILALGPLTNIATVLQRDPHLFEQVDQFTLMGGSYRSHGNCSPVAEYNFWCDPDAAKVVFDLMPVPIQMVGLDVTRNIVLTPSLLTYIKDVNPAMGAFVEKITKFYFDFHWEYERVIGCVINDPLAVAGMLDPTILSGFESYTTVVTDGVARGQSIVDDHDFWHNTPNSQIMTKVDVVAFWRLFLTTVVGATDPDLTQVLHQLVSA

SEQ ID NO: 91202 - DNA, 936 bp, Lactobacillus plantarum WCFS1
  CDS (1)..(936): transl_table=11
ttggaagatattattttagattgtgacccaggacatgatgacgccgtagccttaatgattgcaattgcatcaaaggatattaacctactcgctgtaacgacttcagctggaaatcagcgtcacagtcaaacattacgtaacgcgatgtcccttcttactttaatgaaacgtcaagatattccagttgcttcaggaaacacgaagcctttaatgcgttccctaatctccggcgttagtatgcatggtgttacagggttagatggtgcagatttaccatccccagatttcttttctcaaggaataccagctatcgagctaattgctaagatcctcactgatcacccacagaaagtcactctagttgtcacagggccttgcacaaatatcgcattattcctatctgtgcatcctgagttacgttctcgtatcaagcagattgttattctagggggtggcatgggactcggaaactggggaccaaccactgagttcaacattcaggtggatccagaagctgcgaaaatcgtcttagattccggaataccgattattttagcgccgttaaatgtcgcatttgaagcacagctacttcctaacgaaatcgaaaaaattcataatattgataattcagtagctcagacaattagcggccttatggacttctatggaatttcatttggtcgtcaacgatggggatttaaaggtctcccattatacgacccttgtacagttgcttggctcatcgatccttcaaagtttacaagtaaacgttgcaatgttgaagtagagactaaaggagagctcactactggggagaccgttatcgattattatcatattaccaaccgtaagcctaatgctgaggtattgtttcatattgatcgccagtggtttgccgatctaaccattagtagcattaaatccttcgatttttaa

SEQ ID NO: 91203 - protein, 311 aa, Lactobacillus plantarum WCFS1
MEDIILDCDPGHDDAVALMIAIASKDINLLAVTTSAGNQRHSQTLRNAMSLLTLMKRQDIPVASGNTKPLMRSLISGVSMHGVTGLDGADLPSPDFFSQGIPAIELIAKILTDHPQKVTLVVTGPCTNIALFLSVHPELRSRIKQIVILGGGMGLGNWGPTTEFNIQVDPEAAKIVLDSGIPIILAPLNVAFEAQLLPNEIEKIHNIDNSVAQTISGLMDFYGISFGRQRWGFKGLPLYDPCTVAWLIDPSKFTSKRCNVEVETKGELTTGETVIDYYHITNRKPNAEVLFHIDRQWFADLTISSIKSFDF

SEQ ID NO: 91204 - DNA, 921 bp, Salmonella enterica subsp. enterica serovar Typhi Ty2
  CDS (1)..(921): transl_table=11
atgacagcatccctacacattattcttgataccgatccgggcattgatgacgcggctgcgattgccgctgcgctgttcgccccccagcttgatctgcaactaataaccaccgtcgcaggcaatgtttccgttgaaaaaacgacccgtaatgcgttgcagcttctgcatttctggaacagcgatatcccacttgcccagggggccgcgacgccgctgctgcgtccgttacgcgatgcggcatacgtccacggcgaatccggtatggaaggctatgattttgtcgaccatcagcgtcaaccgttggcgaagcctgcgtttatcgctatccgggatgtgttgatgaacgccccggagcccatgacattggtggcgattgggccattgaccaatattgcgttgctactgatgcactatccggagtgtgcgtgtaacattcgccgtctggtgttgatgggcggttccgcagggcgcggcaattttacgcctaatgctgaatttaacattgctgtcgatccggaggccgcggcgctggtgttccgcagcggtctggagattgtgatgtgtgggcttgatgtcacgaatcaggcaatgctctcgccagattttctgaataaactgcctgcgctgaatcgcaccggtaagatgttgcacagcctgttcaaccattatcgcagcggtagtatgcgcactggcgtccggatgcacgatctctgtgcgatcgcctggctggtgcgtccggagctttttaccctgcaatcctgttttgtggccgtagaaacgcagggggaatataccgcaggcacgacggtcgttgatattgaagggcgtctggggcagcccgccaacgcgcaggtggcgctggcgctggatgtggacggttttcgtcagtgggtggctgaggtgtttgcctatgtgccgtaa

SEQ ID NO: 91205 - protein, 306 aa, Salmonella enterica subsp. enterica serovar Typhi Ty2
MTASLHIILDTDPGIDDAAAIAAALFAPQLDLQLITTVAGNVSVEKTTRNALQLLHFWNSDIPLAQGAATPLLRPLRDAAYVHGESGMEGYDFVDHQRQPLAKPAFIAIRDVLMNAPEPMTLVAIGPLTNIALLLMHYPECACNIRRLVLMGGSAGRGNFTPNAEFNIAVDPEAAALVFRSGLEIVMCGLDVTNQAMLSPDFLNKLPALNRTGKMLHSLFNHYRSGSMRTGVRMHDLCAIAWLVRPELFTLQSCFVAVETQGEYTAGTTVVDIEGRLGQPANAQVALALDVDGFRQWVAEVFAYVP

SEQ ID NO: 91206 - DNA, 921 bp, Enterococcus faecalis V583
  CDS (1)..(921): transl_table=11
atggatacaaagaaaagaccgatcattattgatacggacccaggaattgatgatgctgtagctttagcgattgcactgaatcatcctaacctagaagttcgcttaataacgacggttgcagggaatgtagatgtagaaaaaacaacaaataatgccttgaaacttgtcgatttttttgggaaaaaggttcctgtagccaaggggtgtaattgtccgttacttattcaattagaagattctgctgagattcatggggagactggtatggatggctttgagtttccgcaacctatctctacgtgtttagatattcatgcagtggaagctatgcgaaaagaaattctgtctagtgatgttcctttgaccattgttccaattgctgcattaacgaatattgctttgttactgaccctctatccagaagtcaaagaaaatattgcagaaatcgtcatgatgggtggctcattagcaaggggaaatacaaatacaagtgccgaatttaatacgtatgtcgatccacacgctgcacaaattgttttccaatcaggtgtcccgctaacaatggtaggattagatgttacaagtcaagctgtgttaacgaatcatgaagtaacagccatcagagcgcttggtagagttggggaaatgttttatggtcttttccgtcattatagaggcggcagtctaactacaggtttgaaaatgcatgatgtctgtgcgattgcctatttaacttcaccagaattatttgagacaactgaaacgttcattgaagttgctttggaaggtccagctgcgggagctactgttgcggatttaaaaatgaagtatcataaaaacacgaatgccgttgcctgtatagatgtaaatgttgaagcttttcaaaaatgggttgtcgaaaaaatgaaagcggttaattaa

SEQ ID NO: 91207 - protein, 306 aa, Enterococcus faecalis V583
MDTKKRPIIIDTDPGIDDAVALAIALNHPNLEVRLITTVAGNVDVEKTTNNALKLVDFFGKKVPVAKGCNCPLLIQLEDSAEIHGETGMDGFEFPQPISTCLDIHAVEAMRKEILSSDVPLTIVPIAALTNIALLLTLYPEVKENIAEIVMMGGSLARGNTNTSAEFNTYVDPHAAQIVFQSGVPLTMVGLDVTSQAVLTNHEVTAIRALGRVGEMFYGLFRHYRGGSLTTGLKMHDVCAIAYLTSPELFETTETFIEVALEGPAAGATVADLKMKYHKNTNAVACIDVNVEAFQKWVVEKMKAVN

SEQ ID NO: 91208 - DNA, 924 bp, Bacillus cereus ATCC 14579
  CDS (1)..(924): transl_table=11
ttggaaaaagtattatttttcggagatccaggtattgatgactcatttgccattatgtatggtttactgcatcccgaaattgaaattgtcggtattgtaaccggatacggaaatgttgagcatatacatgctgcacataatgcagcgtatattttacagttagcaaatagacaaaacattcctgtcattagtggtgcaacaaaaccactgacagaagaaatcactacgtactatcctgaaattcacggagcagaaggattagggcccatccatgttccagaaaatatattatctattccaatatataatttcggcagtattgctgcgattcttataaagtacggaaaagatttaacgattgttgatgtaggaagatctacctcgttagcaattgcttttaatttatggaatgatttaatgctaaatgtaaaaggaatctatttcatgggtggtgtttttttagaagtaggaaacgttacgccattagcagaggcaaacgtgtatggagatccgatagcaagtaaaattgttttccatcaagcaaagaatttattcatattccctttaaatgtaacaaacaaagctgtgttaacaccaaatgtatttaactatattcaagctaatgcaaagaatccatttcatatgataatgaaaccaatgtatgactactatctatccgcataccaaaaacttaatccatctatggaaggacctttgctacatgatgtggttgcaataagcggattagtaaatccaagtttttttgaatttgtgcatcgtacagtaaatgtagatacatacggagatacgaaaggacaaacatttgctgattttcgccctaactctaaatctgaaggagcccgtatagctttagaaatagatgcagaaaaattcattcaagattttataaaaattatgttataa

SEQ ID NO: 91209 - protein, 307 aa, Bacillus cereus ATCC 14579
MEKVLFFGDPGIDDSFAIMYGLLHPEIEIVGIVTGYGNVEHIHAAHNAAYILQLANRQNIPVISGATKPLTEEITTYYPEIHGAEGLGPIHVPENILSIPIYNFGSIAAILIKYGKDLTIVDVGRSTSLAIAFNLWNDLMLNVKGIYFMGGVFLEVGNVTPLAEANVYGDPIASKIVFHQAKNLFIFPLNVTNKAVLTPNVFNYIQANAKNPFHMIMKPMYDYYLSAYQKLNPSMEGPLLHDVVAISGLVNPSFFEFVHRTVNVDTYGDTKGQTFADFRPNSKSEGARIALEIDAEKFIQDFIKIML

SEQ ID NO: 91210 - DNA, 933 bp, Bacillus cereus ATCC 14579
  CDS (1)..(933): transl_table=11
atgaaaaaagtgttatttttaggagacccgggaattgatgactctttagcaattatgtatggattgttgcatcctgatattgatattgttggtgtagtaacgggatatggaaatgtaacacaagaaaaggcgacaagtaatgccgcatatttattgcaaatggcaggacgggaagatatacctgttattaatggtgcgaaaattcctttatccggagatattacgacgtattatccagaaattcatgggacagacggtttagggccaattaaacctccaaaaactttttcaccaaatataaagcctttttgtacattttttgatcttcttgaaaaatataaaggagaattaataatagtcgatgctggtagatcgacaacattagcgacagcatttattttagaaaagccgatgatgaagtatgtgaaagaatattatataatgggcggtgctttcttaatgcctggcaatgtaacaccagtcgcagaggcgaattttcatggtgatcccattgcgtcacaattagttatgcaaaatgccaaaaatgtgacattagtgccacttaacgttacatctgaagcaattattacaccggaaatggtaaaatatattacgaaacactctaaaacgagttttaataagttaatcgagccgatatttacgtactattataaagcttatagaaagttaaatccgaaaataaaaggaagtccagtacatgacgtcgttacaatgatggttgcggcaaatccatcccttttagattatgtatatcgtcgtgtcgatgtagatacagctggaattgcaaaaggagagagtattgctgattttcggcctcaacctgatgcaaaagcattaaaaaattgggtgcgaattggttggtcgttacattataaaaagtttcttgaggattttgtgaaatttatgacgtag

SEQ ID NO: 91211 - protein, 310 aa, Bacillus cereus ATCC 14579
MKKVLFLGDPGIDDSLAIMYGLLHPDIDIVGVVTGYGNVTQEKATSNAAYLLQMAGREDIPVINGAKIPLSGDITTYYPEIHGTDGLGPIKPPKTFSPNIKPFCTFFDLLEKYKGELIIVDAGRSTTLATAFILEKPMMKYVKEYYIMGGAFLMPGNVTPVAEANFHGDPIASQLVMQNAKNVTLVPLNVTSEAIITPEMVKYITKHSKTSFNKLIEPIFTYYYKAYRKLNPKIKGSPVHDVVTMMVAANPSLLDYVYRRVDVDTAGIAKGESIADFRPQPDAKALKNWVRIGWSLHYKKFLEDFVKFMT

SEQ ID NO: 91212 - DNA, 945 bp, Rhodopirellula baltica SH 1
  CDS (1)..(945): transl_table=11
atgagcagaaagatcatcatcgactgtgaccccggaatcgacgacgccattgcaatcacgatggcgttgtttgatccacgactcgacgttgtcgcgatcactcccaccgccggaaccgttgacgcggcccaagcgagcatcaatgcgatgggaatcgtcgatttgctcgatccggctcgatacccacaattgggaaccgcggtcgcgccaaccgatccgccaatgctggacgacagtcatctgaacggcccggatggattggcgggattgaactttccttcggcgactcgccaaaacgatcattccagcgacaagttgatggcggatttgattcgacgccatcctgacgagatcaccatcgtttgcttgggaccgctgaccaacttggctcgcgtttgccgcatggatcctgccgtgttgccgttgattgacaaagttgtcatcagtggcggagcggtctcgcacagcggcaatgcgacggcggtttccgagatgaactttttctttgatccgtccagtgccaaacaagtcatcgcatcggcaacgacgaagagcttggttccactcgatgtgaccgacgcggtcaccttcggcgtggacctgcttgaaaagttgcctcctgaaacaacacgtgcgggagccctgctgcacaagatcctgccttacaaatttcggatctcgcatcaaaaactgggacgcgaagtcattccattgcaagacgcgaccgcgttgatctcagtcattgaacccgagatgtttcagtgggatgaaatggccggcgacgttgaagtcaatggcgccctgacccgcggcatgaccgttttcgaccggcgtctacgaccggagtggagcgtcaacatggaagtggctcgtcgagccagcatcaccgatgttcgagatgccatcgtgcgtagcattcgttacgccggccaacaaacccgctag

SEQ ID NO: 91213 - protein, 314 aa, Rhodopirellula baltica SH 1
MSRKIIIDCDPGIDDAIAITMALFDPRLDVVAITPTAGTVDAAQASINAMGIVDLLDPARYPQLGTAVAPTDPPMLDDSHLNGPDGLAGLNFPSATRQNDHSSDKLMADLIRRHPDEITIVCLGPLTNLARVCRMDPAVLPLIDKVVISGGAVSHSGNATAVSEMNFFFDPSSAKQVIASATTKSLVPLDVTDAVTFGVDLLEKLPPETTRAGALLHKILPYKFRISHQKLGREVIPLQDATALISVIEPEMFQWDEMAGDVEVNGALTRGMTVFDRRLRPEWSVNMEVARRASITDVRDAIVRSIRYAGQQTR

SEQ ID NO: 91214 - DNA, 912 bp, Gloeobacter violaceus PCC 7421
  CDS (1)..(912): transl_table=11
ttgcgaaagccggtcatccacgaccaagacggtcacgccgacgatctggtcgccacattgctgttggcgctctacccggctgtggatctgagggccgtcgtcgtcaacagcggagactgtatcccccaggtttccgccgccgttctggcggccctgctcgatcgcctgggaaaaggcgcggtgccggtggcctggcagcaccatgccctgccccatccctttcccaccgcctggcagcgcgagagcctcaactatctgcgggcctttccggaagccgaacggtactacccggccgccgccggcacgcggctgctcaccgagacgatcctggcggcgggcgaaccggtgactttgctggtcaccggcccctgcacgaatctggcggcggctctgcgcgccgctcccgagattgcccggcacctggagcgggtggtgttgatggccgggggcctggaggcgggcggcaacgtcgcaggcgagcaagaccatgacggcagcgccgagtggaatctttactgcgaccctcctgccgccgcctactgcctgcaggccgggctcgccctggactttgtcagcctcgatgtcaccaattttgtaccgatgaccgcccgcttcgtggagacactgcgctcgcgcggcggcgcctgccgccttgccgccgaactgctcgcaggcgtcgagcagcagaactattttttctgggacaccctggccgctctgctgacctgcgagcccgactttttgccccgcgggcgccggacgctcaccgtgcgcaccgacccacccgccgcgggacggctcgaaaaaaccgcctcgggtgtacccgcgcgggtcttcgagcccgatgccgacgtggaaagcctgggagcgcgggtggaggtgcgggtggccgaaattttgagcgccctctag

SEQ ID NO: 91215 - protein, 303 aa, Gloeobacter violaceus PCC 7421
MRKPVIHDQDGHADDLVATLLLALYPAVDLRAVVVNSGDCIPQVSAAVLAALLDRLGKGAVPVAWQHHALPHPFPTAWQRESLNYLRAFPEAERYYPAAAGTRLLTETILAAGEPVTLLVTGPCTNLAAALRAAPEIARHLERVVLMAGGLEAGGNVAGEQDHDGSAEWNLYCDPPAAAYCLQAGLALDFVSLDVTNFVPMTARFVETLRSRGGACRLAAELLAGVEQQNYFFWDTLAALLTCEPDFLPRGRRTLTVRTDPPAAGRLEKTASGVPARVFEPDADVESLGARVEVRVAEILSAL

SEQ ID NO: 91216 - DNA, 930 bp, Photorhabdus luminescens subsp. laumondii TTO1
  CDS (1)..(930): transl_table=11
atgagacatttcattattgatacagatacggcttccgatgatgcagttgcattatttatggcgctccgtgaaccctcagtttttattgaaggtattactattgttgctggtaattgtgctgttgcgcagtgcaggaaaaatgcattagttagtattgaaaaagcagggacatatattcctccggtatatgaagggatgagtaaaccattatttagagagcattatgcttcatatcatattcatggaaaagatggtatgggtaatatgaatttaccagagtcttcgttaatagtagaagataaacatgcagtagatgccattattgatatcgtgaaaaaatttcctggtgagatagagataatcactttgggaccattgacaaatatagcaatggctgtcttaaaagagccaaatttatataaatctgtcaaagtgatatatattatgggtggctctgggttgaagtcaggtaatattacgccattggctgaattcaatctctattctgatgctgaagcagcacatatagtattgaattctggattacctcttatattttgtggatgggagttaggtatggaggaggcttttattaatgaattcgatatggataaattaaattctttaggtgatcttggtcagtttgcagtgagctgtaatagaacattgattgaattcaatgcgggaagaacgaatagaaaaggatttgatctgcctgatcctataacaatggctattgctttatatccgaatgaaatgatagaggataaattagcggtgtatggttatgttgaatatcaaagcgcacgttcatatgggcatttagtgattgattcaaccgatcttctcaatcatccccataatatgagtgtggtgactaaaatcaagggtgaggtatttaagaataaactatttacattattatcgtaa

SEQ ID NO: 91217 - protein, 309 aa, Photorhabdus luminescens subsp. laumondii TTO1
MRHFIIDTDTASDDAVALFMALREPSVFIEGITIVAGNCAVAQCRKNALVSIEKAGTYIPPVYEGMSKPLFREHYASYHIHGKDGMGNMNLPESSLIVEDKHAVDAIIDIVKKFPGEIEIITLGPLTNIAMAVLKEPNLYKSVKVIYIMGGSGLKSGNITPLAEFNLYSDAEAAHIVLNSGLPLIFCGWELGMEEAFINEFDMDKLNSLGDLGQFAVSCNRTLIEFNAGRTNRKGFDLPDPITMAIALYPNEMIEDKLAVYGYVEYQSARSYGHLVIDSTDLLNHPHNMSVVTKIKGEVFKNKLFTLLS

SEQ ID NO: 91218 - DNA, 951 bp, Photorhabdus luminescens subsp. laumondii TTO1
  CDS (1)..(951): transl_table=11
atgaccaccaaaaaaattattcttgattgcgatccgggacatgatgatgccattgcgatgttattggcgcatggcaaccctaatattgagctattagccgtcacgacggttgtcgggaatcagacactggataaagtcactcgcaatgcgctggcgatagcgcatattgccggtattaccggcgtgccctttgcctcaggctgtcatcggccactcgttcgcgatatcgaaacggcatcggatattcacggcgaatctggtctgggtggcgtgaagttgcctaaacactcccgaacacttgatccccgccacgcaacggatctgatcattgataccatcatgtctcacccgcccaaaacggtgactttagtccccgttggcagcttaaccaatattgctctcgccgtccgtaaagcaccgcagatcgttgagcgggtaaaagaagtggtattaatggggggtggatatcacaccggcaacagaagtgcagtggcagaattcaatatcaaaaccgatccggaagccgcacatattgttttcaatgaaaaatggccgctgaccatggtcggtcttgatctgacacatcaagctcgcgccacaccagaaatcaccaaagcaatttcacgtatcaataccaaagtgtctcggtttgtcgtagaactactggattactatggtcaacgttatcaagagagacatggtttcaactgcccgccaatacatgatccttgtgccgtcgcctatgttattgatcctacagtgatgacaacgcaaaaagtccccgtcaatattgaactgaacggtaccttaaccgtaggaatgacagtggcggatttccgttacccgccaacagaagattgccatacccaagttgctgtcaaactcgatcaacagcgattctggcaattgattattgatgcattgaaaaacatcggcgatacctgcgattaa

SEQ ID NO: 91219 - protein, 316 aa, Photorhabdus luminescens subsp. laumondii TTO1
MTTKKIILDCDPGHDDAIAMLLAHGNPNIELLAVTTVVGNQTLDKVTRNALAIAHIAGITGVPFASGCHRPLVRDIETASDIHGESGLGGVKLPKHSRTLDPRHATDLIIDTIMSHPPKTVTLVPVGSLTNIALAVRKAPQIVERVKEVVLMGGGYHTGNRSAVAEFNIKTDPEAAHIVFNEKWPLTMVGLDLTHQARATPEITKAISRINTKVSRFVVELLDYYGQRYQERHGFNCPPIHDPCAVAYVIDPTVMTTQKVPVNIELNGTLTVGMTVADFRYPPTEDCHTQVAVKLDQQRFWQLIIDALKNIGDTCD

SEQ ID NO: 91220 - DNA, 960 bp, Corynebacterium diphtheriae NCTC 13129
  CDS (1)..(960): transl_table=11
atgaaaaaaattatccttgatttggacactggtatcgatgatgctctggcattggcctatacgttaggttctcctgaacttgatctcatcggtgtgaccgccacttatggaaacgtcttggtagaaacaggcgtacgaaacgatcttgctcttcttgaacttttcgggcgtagcgacgttcctgttttttctggtgaaccgcatgcgctgacgaaagatggctttgaagttctggaaatctctgcattcatccatggcaaaaatgggattggtgaggccgaggttgcggaaccagttggtgttgtacaggaactcagcgcggtcgatttcttgattgaatccgttgagcgttacggagatgaactcatcattgttcccactggcgcaatgaccaacatagctgcagctatgaaaaagagtgagacttttgcaagggatgcacagatcgtatttatgggtggtgcgcttacggttcctggcaatgtcagtcagtgggcagaagccaatgtcaatcaagaccctgaggctgcggatatcatggtgcgcaatgctggagatattacgatggtgggccttgatgtgactctgcaaacgcttctcacgtatgcggaaaccgctacgtggcgagcgcttggtacacctgctggcaatttcttggctgatgcgacggactattacatcaaggcatatgacaccacagcccctcaccttggcggctgcggtttgcacgatccattggctgtgggtgtcgcgatcgatccatcgctggtgaccttgctacctattaacctcaaagtggacactgaggggcccacacgtggacgtaccattggtgacgaagtccgccttaacgatccacataagaactgtaaggttgctgttggggtagacgtcgatcgattcctcaaggaattcatggaacgaattactcgggttgctcaaggtagcaatgcgcgatga

SEQ ID NO: 91221 - protein, 319 aa, Corynebacterium diphtheriae NCTC 13129
MKKIILDLDTGIDDALALAYTLGSPELDLIGVTATYGNVLVETGVRNDLALLELFGRSDVPVFSGEPHALTKDGFEVLEISAFIHGKNGIGEAEVAEPVGVVQELSAVDFLIESVERYGDELIIVPTGAMTNIAAAMKKSETFARDAQIVFMGGALTVPGNVSQWAEANVNQDPEAADIMVRNAGDITMVGLDVTLQTLLTYAETATWRALGTPAGNFLADATDYYIKAYDTTAPHLGGCGLHDPLAVGVAIDPSLVTLLPINLKVDTEGPTRGRTIGDEVRLNDPHKNCKVAVGVDVDRFLKEFMERITRVAQGSNAR

SEQ ID NO: 91222 - DNA, 939 bp, Corynebacterium diphtheriae NCTC 13129
  CDS (1)..(939): transl_table=11
atgacccgaaaaattattctcgactgcgacccaggacacgacgacgccgtagccatgctactcgccgcagcaaaccccaacatcgaactgctgggaatcaccaccatcggcggcaaccaaaccctgcccaaagtcacccacaatgcgcaggttgttgccacgatcgcaggaatcaccgcacctatccatgcaggttgttcccgcccactcgtgcgtgacgtcgaggtcgccgagagcatccacggcgatactggaatggaaatccacaactacacgctgccagagccagcagtaggagtatctgatacccacgccgtggactttattatcgacaccatcatgtcccacgagccaggaactgtcacccttgttcctaccggcccgcttaccaacattgctatggcggcgcgcaaagagccccgcattgtcgaacgagtccaagaagtcgtgctcatgggcggcggataccacgtaggtaactggtcccctgttgcagaattcaacatcaagatcgaccccgaagcagcgcacatcgttttcaacgaaaaatggccactgaccatggtgggcctcgaccttactcaccaagcgcttgcaaccccagaagtagaagcacgcctgagcgcaatcggctccgacgttgccgactttgtagtcgcactcttcggcgcattccgtaagaactaccaagacgcacaaggctttgataacccaccagtccacgacccgtgcgcagtggcctacgtgatcgacccgacggtatttactacggtcaaggtacctatcgacgtcgagctgaccggggcactgaccaccggcatgaccgtcgcggacttccgcgcaccagcacctgccgactgccacactcaagcagctgtcgccctcgactttgacaagttctggggtttggttgaaagcgctgtcaaagaactaagctag

SEQ ID NO: 91223 - protein, 312 aa, Corynebacterium diphtheriae NCTC 13129
MTRKIILDCDPGHDDAVAMLLAAANPNIELLGITTIGGNQTLPKVTHNAQVVATIAGITAPIHAGCSRPLVRDVEVAESIHGDTGMEIHNYTLPEPAVGVSDTHAVDFIIDTIMSHEPGTVTLVPTGPLTNIAMAARKEPRIVERVQEVVLMGGGYHVGNWSPVAEFNIKIDPEAAHIVFNEKWPLTMVGLDLTHQALATPEVEARLSAIGSDVADFVVALFGAFRKNYQDAQGFDNPPVHDPCAVAYVIDPTVFTTVKVPIDVELTGALTTGMTVADFRAPAPADCHTQAAVALDFDKFWGLVESAVKELS

SEQ ID NO: 91224 - DNA, 996 bp, Corynebacterium diphtheriae NCTC 13129
  CDS (1)..(996): transl_table=11
atgtttcacgtgaaactcacactgaccactatgttggacaccatgaatagctcagcacatcgccccgtagttgttgccgacgttgataccggcattgacgacgccctcgccatcacatacctcggctacctgcaccgacgcggactcatcgagctacgcattaccacctcggccggcaactgcaccgccgagcaagccgcagccaactcagcagagatcatgaactcgctcacactcagcgacgtaccgatcacacccggcgcgccgaaaccacgcgcactgccgctaaccaccaccccagaaacccacggccccacgggtttgggttatcacaccacccgcgcgaccataccgcagcttagcaacgcagcggccgccgtcgatctgtggaaaggtgctgattatctcctcgtagcgggccctgccaccaacgtcgcgtgggcagcagaaaacgcccctgaggttctcaacgccatcccgcacgtgacctttatgacgggcgctttccattacccaggcaacaccacacccaccgccgagtggaatgcgtgggttgatccgcatgcactcaaagaggcgctcgcgcattaccgcggccacgctgtccggcccacgatatgtccactcaacgttacggagtccgtgctccttaccccacaacgccttaagcaatggtgccagcgcagccaggaaccagtccttccgatacttagcgacgccctccgcttctacttcgaattccatgaatcggtcggggtggggtacatggcccaaatccatgatctcgccgctgcgatggtgctcctcaaccgcgtcccacacaccacccgcccagggtttgtggatgtggaagcagacgcggaactgacccgcggcaccaccgtggtggattgggacagtaactatggcgatcatcctgccaacgctcagattctcacagccctccaatcggaggatgtgttcgcagagttcgaacgggttgtattagagtactaa

SEQ ID NO: 91225 - protein, 331 aa, Corynebacterium diphtheriae NCTC 13129
MFHVKLTLTTMLDTMNSSAHRPVVVADVDTGIDDALAITYLGYLHRRGLIELRITTSAGNCTAEQAAANSAEIMNSLTLSDVPITPGAPKPRALPLTTTPETHGPTGLGYHTTRATIPQLSNAAAAVDLWKGADYLLVAGPATNVAWAAENAPEVLNAIPHVTFMTGAFHYPGNTTPTAEWNAWVDPHALKEALAHYRGHAVRPTICPLNVTESVLLTPQRLKQWCQRSQEPVLPILSDALRFYFEFHESVGVGYMAQIHDLAAAMVLLNRVPHTTRPGFVDVEADAELTRGTTVVDWDSNYGDHPANAQILTALQSEDVFAEFERVVLEY

SEQ ID NO: 91226 - DNA, 1032 bp, Mycobacterium avium subsp. paratuberculosis str. k10
  CDS (1)..(1032): transl_table=11
gtgactccagttttcgtcgatgtcgacaccggcgtggatgatgcgctggcgctgatgtacctgttcgccagcccggacgccgacgtggtcggcatcgcatcgaccggcggaaacgttgcggtggagcaggtttgcgaaaacaacctgggcctgctgcagctgtgcgggctgaccggcatcccggtgtccaagggttccgggcagaccctgaccggcccgatgcggctgccatcaaaagtccacggccccaggggattgggctatgccgagctgccgcccagcgaccaccgggtcaccgaccacgactcggcaaccgcctgggtgtgcgccgcgcacgcccaccccggggagctgatcggggtggcgaccgggccgctgaccaacctggcgctggcgctgcgggccgagcccgcgctgccgaccctgctgcgccggctggtgatcatgggcggctcctacgaccatcggggcaacaccaccgcggtggcggaatggaacatcagcgtggaccccgaggccgcggccgaggtgctggccggctggggtggcgccgacgtcgggcgggagcggctgccgatcctgtgcgggctggacctgacccgcaaggtggcgatgacgccgggtcacctgacgcggctggccaccgccgcggactccagcacccgcccgctgagcgccgacgacgaacccggaacccggtcggcggccgccaacccgctgatccgggtgatcgaggacgcgatgcggttctacctggaggcctatcacgacctcggccacggctatcaggcgcacatgcacgacccgttggccgccgccgtcgcgctggaccccacgctggtggccacgcgtccggcgacggtggagatcgagctgaccggcaccctgacccgcgccatgacggtcaccgactggtcgggtcgtcgagaacccaacgcgctcatcgggattgatgtggactcggcggcattcttcgaccggttcatcgaacgggtggggccgttcgcccgccgggtgggcggcggccggtga

SEQ ID NO: 91227 - protein, 343 aa, Mycobacterium avium subsp. paratuberculosis str. k10
MTPVFVDVDTGVDDALALMYLFASPDADVVGIASTGGNVAVEQVCENNLGLLQLCGLTGIPVSKGSGQTLTGPMRLPSKVHGPRGLGYAELPPSDHRVTDHDSATAWVCAAHAHPGELIGVATGPLTNLALALRAEPALPTLLRRLVIMGGSYDHRGNTTAVAEWNISVDPEAAAEVLAGWGGADVGRERLPILCGLDLTRKVAMTPGHLTRLATAADSSTRPLSADDEPGTRSAAANPLIRVIEDAMRFYLEAYHDLGHGYQAHMHDPLAAAVALDPTLVATRPATVEIELTGTLTRAMTVTDWSGRREPNALIGIDVDSAAFFDRFIERVGPFARRVGGGR

SEQ ID NO: 91228 - DNA, 951 bp, Bacillus cereus ATCC 10987
  CDS (1)..(951): transl_table=11
atgcccaaaaaagttctcattttttgtgatcctgggattgatgatacgatggctctcctcttagcattctttattgatgaaatagaaatcatcggcattgttgctgattacggcaatgttccaaaagagatggccgtacaaaatgctcattttcttaagaatgaaacaatgaatagaaatattaagatatttggtgggtcagagcgtccacttactggtgccccacctgctttttttaccgatgtacatgggaaacaagggctcgggccaattattccaaaagggaatgtaactaacggggaaatggagaattttttcgaagttattcctcttattgaacagtataaagatgaagtaatcattgtaagtttaggaagacttacctccctcgcaattttattcatcgtatgtaaacagttaatgaagcaaattaaatcttactacataatgggcggtgcctttttacacccgggtaatgttacccctatttctgaagcaaacttttatggtgatcctgctgccgctaatatagtccttcaatcctcacctaacatgtacatctatccattaaacgtcacccaatattccatcattacaccagaaatggctgaatatattgaagcaaaaggaaaagccccactcgtcaaacctttattcgatcattattactatagttattataaaaatgctctaccacatttaaagggtagccccttccatgacacaatgccaatactcgctttacttgataactctatgtttacgtatcacaaatcacctatcgttatcatgaccgaatcttatgcacaaggggcaagcattggggaattccgctctttagaagaatctaaaccatttattgatcggccgattcatcaaatcgcaattgattttgattataaccgcttctttaaacatttcatgtcacttatgacgggggaagaattttaa

SEQ ID NO: 91229 - protein, 316 aa, Bacillus cereus ATCC 10987
MPKKVLIFCDPGIDDTMALLLAFFIDEIEIIGIVADYGNVPKEMAVQNAHFLKNETMNRNIKIFGGSERPLTGAPPAFFTDVHGKQGLGPIIPKGNVTNGEMENFFEVIPLIEQYKDEVIIVSLGRLTSLAILFIVCKQLMKQIKSYYIMGGAFLHPGNVTPISEANFYGDPAAANIVLQSSPNMYIYPLNVTQYSIITPEMAEYIEAKGKAPLVKPLFDHYYYSYYKNALPHLKGSPFHDTMPILALLDNSMFTYHKSPIVIMTESYAQGASIGEFRSLEESKPFIDRPIHQIAIDFDYNRFFKHFMSLMTGEEF

SEQ ID NO: 91230 - DNA, 951 bp, Bacillus cereus ATCC 10987
  CDS (1)..(951): transl_table=11
atgcccaaaaaagttctcttgtttacagatttgggaattgatgatgtgtttgctattctgtacaccttttttcgtaaggatatccaacttgtggggattgtagcggattatggaaatgtatcgagagagaatgctataaaaaatattaactatttgaagtatatttcgggaagaaaagagatacccgtatttctcggtgcttctgtacctttaacaggtatattggttcaatattttcctgaagtacatggaaaagtaggactaggacctatcattccacctgaaatcccttatccaatttatcccataaatgatatttacaaaattataaactcaaatttagacgatcttacaattatcaatttgggaagactttcatcattggctacgtcatttattttgaatttagaagcaatgcggaatgtgaaagaatacatttgcatgggtggagcctttttttaccccggaaacgtgactgctgtggctgaagctaacttttacgcagacccttatgcagcaaacttaattctgcagcatgcgaagaatttgacaattattccattaaacgtcacccaacacgcgattgttacacctgaaatggttcaacaaattgatgcatttcaccggaatacacaagaccttgcaggactcatcatcaaacctatgttagactactactataatttctactctaaatcgaatcctggcataggaggaagccctatgcatgattttgtaacaatatggtatttgttgaatccagatgcagttcgtctgtcaaaagtgcccatcaaagtaattcccgatcaaggagaaggatttggtcaaagtatcgcagactttcgttttgtgacaaatccaggttataaaacacataatatcgcttttcagttcaattatgaaagatttaagagagatattatggaaacatttttaaggaaaagactatag

SEQ ID NO: 91231 - protein, 316 aa, Bacillus cereus ATCC 10987
MPKKVLLFTDLGIDDVFAILYTFFRKDIQLVGIVADYGNVSRENAIKNINYLKYISGRKEIPVFLGASVPLTGILVQYFPEVHGKVGLGPIIPPEIPYPIYPINDIYKIINSNLDDLTIINLGRLSSLATSFILNLEAMRNVKEYICMGGAFFYPGNVTAVAEANFYADPYAANLILQHAKNLTIIPLNVTQHAIVTPEMVQQIDAFHRNTQDLAGLIIKPMLDYYYNFYSKSNPGIGGSPMHDFVTIWYLLNPDAVRLSKVPIKVIPDQGEGFGQSIADFRFVTNPGYKTHNIAFQFNYERFKRDIMETFLRKRL

SEQ ID NO: 91232 - DNA, 1008 bp, Eremothecium gossypii
  CDS (1)..(1008)
atgaccgtttcagagtcggaacagataccagtgtggctagactgcgatcctggccacgatgatgcagttgcaattttgctcgcggcattcagtcccaagttcaggttgctaggggtatcggcgtcttacggaaatgccgcgccagaacacaccacttacaatgcgttagctttgttgacagcattggggaagactgacattaaggtgtatcagggagcgaaaaggccgtgggttcgtgagccggtgtacgcagaagatatccacggggagtcggggttggagggatcgagcctcctccccgtgccgcgcatcgagttggagaaagaaagttacttggacgctatggagagggctatcttgaagtacagtggcaggatatcgttgatttgcaccggggcgctcacgtctgcggcgacgctacttcgtgacagaccgcacctaaagaagcacatcaagttcatctcggtgatgggtggagggattgaccagggcaactgcaacccacgcaagtctgcggagttcaatatatgggttgatccccacgctgcggaatctgtgttgtgcgacgaagacattcgcgaccggtgtatattggttccgttagacttgacgcacaaagcgatagcgacagcagaaatccaggaacgagtcctcggcaatggctgcaatatccgcagactatactatgagctctttctcttttttggagctacctacaagaatgtgcagggttttgagcgcggccctcccgtgcacgacccgctaactttgctacccttgatggccttttacgatcccagctttgcagcgacagttggttttgtgtataggcggatggaccttcgcgtcacgacagcgctgagcgaagatgagggcaagcttattggggtggttcccgacactgagggaaaaggcgtgatagtcgggtttgatctgaactttgagttcttctggcagcagatatacaatgcgcttgcagctgcagagggtacgtcgacgattgagtag

SEQ ID NO: 91233 - protein, 335 aa, Eremothecium gossypii
MTVSESEQIPVWLDCDPGHDDAVAILLAAFSPKFRLLGVSASYGNAAPEHTTYNALALLTALGKTDIKVYQGAKRPWVREPVYAEDIHGESGLEGSSLLPVPRIELEKESYLDAMERAILKYSGRISLICTGALTSAATLLRDRPHLKKHIKFISVMGGGIDQGNCNPRKSAEFNIWVDPHAAESVLCDEDIRDRCILVPLDLTHKAIATAEIQERVLGNGCNIRRLYYELFLFFGATYKNVQGFERGPPVHDPLTLLPLMAFYDPSFAATVGFVYRRMDLRVTTALSEDEGKLIGVVPDTEGKGVIVGFDLNFEFFWQQIYNALAAAEGTSTIE

SEQ ID NO: 91234 - DNA, 939 bp, Anopheles gambiae str. PEST
  CDS (1)..(939)
atggatatctttgattttgtcaagcttctttcactgctatgcgcattagtggctaatgtaaacagtgcagatcgcaccaaggtggtgataagcacggatgcaggtgcagatgatgcatgggcgttgtattatctgctggaagccaaacaagaagtagacgtactcgctatttgctgcacgaagggcaacaccaatgttacaaatgtggccacaaacgtgctgcgagtgctcgatgccctacagcgtacggatattccggtatacattggttcgaatgagcggatactgcttcccgagccatcggtaaacccggacgagatgtactttggcgccgatggcttttcagatgtcgtcttcgaacgggtaccgacacgcgctcctttacaggagcgacaacacgcactgcaagagctatacacgctgataaaccagcatccaaacgaagtgatatttgttaacctaggtccgctgacggatcttgcattgctgttgaaagtttaccctgctacacgcacgctcttgaaggccatctacctgatggggggaaatcgtcacggcatcggtaacacgcagagtgcagctgaatttaacttctacaacgatcccgaatcggctagcatcacgtttaatgcctaccaaggtccgatcgttgttataccatgggaaacggccttgcgccctaaccttgttaccagcttcgagtggcggatggacgtgctggggaatagcaacaaaacaatcgtcgacattttgaaccaggtcgaacgtgtagcgctagaaaagctgccggaaaaggatcgcatttggatgccttgcgatttgctggtttcgatgctgctggtacaccctcacctgctcgtggaaagtaaacggtacagcggagacgttgagttgaatggccggctaacccgcggccaattggtgctggatcacatgtag

SEQ ID NO: 91235 - protein, 312 aa, Anopheles gambiae str. PEST
MDIFDFVKLLSLLCALVANVNSADRTKVVISTDAGADDAWALYYLLEAKQEVDVLAICCTKGNTNVTNVATNVLRVLDALQRTDIPVYIGSNERILLPEPSVNPDEMYFGADGFSDVVFERVPTRAPLQERQHALQELYTLINQHPNEVIFVNLGPLTDLALLLKVYPATRTLLKAIYLMGGNRHGIGNTQSAAEFNFYNDPESASITFNAYQGPIVVIPWETALRPNLVTSFEWRMDVLGNSNKTIVDILNQVERVALEKLPEKDRIWMPCDLLVSMLLVHPHLLVESKRYSGDVELNGRLTRGQLVLDHM

SEQ ID NO: 91236 - DNA, 942 bp, Anopheles gambiae str. PEST
  CDS (1)..(942)
atggccgcaccaaggaaggtaattatcgatctggatgtcggtacagacgacgcatgggccctgtggatgctgctgcagtgtgagaagacgtacggctacgaggtgatcgccatcacgtgcgtgaacggcaatacgggcgtggagaatgtggtggaaaacacgctcaccgtgctgtccgcgatgggccgtacggatgtgcccgtgtaccggggtgcccacgaaccgctggtccatccgcggggaacgaaatacgacggcaacttccacggccagaatgggctcggtgatatcgacttcgggatcgaggtgaaccgcactcccctgcaagaggaacacgcggtcactgccatccagcgtctgctgaacgcgcacaaaggaagcatcgatttgatctttatcggtccgctgacgaatttggcactggccatgaagctacggccggggctgctgaagcaggcgagccatctctacatcatgggcggcaaccggcacggagtcggcaatatcacgtggtcggccgagttcaacttccacaccgatccggaggcggcccatattgtgctgcagagcgattgctgcccgatctcgatcgtaccgtgggagacgtgtcagcggcacgccgttccgctggcctggcgaatggaggagctgggtgcggatgaaaccaaaccgatgctgcggatactgaacgcagtggagcgcaaagtgtacggccagcggccaaactggatgccgtgcgatgcgtacctggtggcggcgttcattcaaccggactgtgtgctgaaggcccacagctatacggttgacgtggagctgcacggtgcgcttacccgcggtcagatggtgctggatcaccgcggtgctggcgcgggccacgtgcgcatcatcgacgatattgatgagggcaagtttaaggagctgtgctggaagacggtcgcctga

SEQ ID NO: 91237 - protein, 313 aa, Anopheles gambiae str. PEST
MAAPRKVIIDLDVGTDDAWALWMLLQCEKTYGYEVIAITCVNGNTGVENVVENTLTVLSAMGRTDVPVYRGAHEPLVHPRGTKYDGNFHGQNGLGDIDFGIEVNRTPLQEEHAVTAIQRLLNAHKGSIDLIFIGPLTNLALAMKLRPGLLKQASHLYIMGGNRHGVGNITWSAEFNFHTDPEAAHIVLQSDCCPISIVPWETCQRHAVPLAWRMEELGADETKPMLRILNAVERKVYGQRPNWMPCDAYLVAAFIQPDCVLKAHSYTVDVELHGALTRGQMVLDHRGAGAGHVRIIDDIDEGKFKELCWKTVA

SEQ ID NO: 91238 - DNA, 1023 bp, Anopheles gambiae str. PEST
  CDS (1)..(1023)
atgcttatgctaatggtggcactgctggctggggcatcgctggcgatcaaatgcccgccggaggacacgctggcagaaggtgggccacgccgagtgatactcgatctggacggaggtggcgatgatgcttgggcactggtgatgctgttgtccaacgaggcagagtacaacatttgcgtgcaggccgtcacttgctcgcacggcaatgctcgcgtatcggacgtgctggtgaatgtgttgcgcatactcgatagtttggatcggctcgatgtgccggtgtacgttggagccagtgagccactaattacgccggggccgaaccgaaacacttctcactatttctggggcaacaatggctttggagatgtcgcgtttgacagtccattcgcggtagactcgttggtatcgctgcatgcagtggaggcgatgaacgaactgtttgaaaagtaccccaacaagatcacattgctcgctgttggacctctgacgaatgtggcgctgctctacaaaatgtatccagagacgagggataaaatcggtgacttgtacattctgggtggaaaccgtcatggtgtgggcaatacggcactggccgccgagtttaacttctttcgcgatccagaagcggcccatattgtgctgaacaactcccccaagatcgtgcgcgtgtttccatgggaaacggtcctgctgcagacgtttaccaccagatggcgcttcgagacgttcaagcacacgacgaaccctgccgtagagctgctgaaccaggtggaatatgtagtgtacgcgcaggaagaaatatggaccccgtgtgatatgtatgttgcggcgatcttcctgaatagcagcattctccggacggtgaagacgtatcgcgccgaggtagagttgacgggttgggtgaccagaggaatgatggccatactgcatcacgtaaaagacagcagtcagcacaatgtggccgtcatagatgagattgatacggaagaagtgcagcgcatgttggttgcattaaacctctag

SEQ ID NO: 91239 - protein, 340 aa, Anopheles gambiae str. PEST
MLMLMVALLAGASLAIKCPPEDTLAEGGPRRVILDLDGGGDDAWALVMLLSNEAEYNICVQAVTCSHGNARVSDVLVNVLRILDSLDRLDVPVYVGASEPLITPGPNRNTSHYFWGNNGFGDVAFDSPFAVDSLVSLHAVEAMNELFEKYPNKITLLAVGPLTNVALLYKMYPETRDKIGDLYILGGNRHGVGNTALAAEFNFFRDPEAAHIVLNNSPKIVRVFPWETVLLQTFTTRWRFETFKHTTNPAVELLNQVEYVVYAQEEIWTPCDMYVAAIFLNSSILRTVKTYRAEVELTGWVTRGMMAILHHVKDSSQHNVAVIDEIDTEEVQRMLVALNL

SEQ ID NO: 91240 - DNA, 1194 bp, Neurospora crassa
  CDS (1)..(1194)
atgggatcgtcagtcgacaacagaattcccgtttggctagattgcgatccgggtcacgatgacaccttcgccattctcctagccgcctaccacccagccatccgcatcctgggtatctctacagtctttggcaatgcatccttggaaaaaacaacccgcaacgcctgctctatccttacctccatctcccgctcgcactctatccccgtctacatcggcgcctcacacgccctccaccggccccacctgcacgcgcctaccgacatacacggcgaatccggcctagatggaaccaagctgctccccacgcctctcgtcggccccgacacctccgtcgacgccgtaaccgccatgtcgaccgccttacgctcctgcgcccctggaaccgcctgggtggtagccaccggcagcttcaccaacgccgcacagctcttttcaagccacccagatctcgtcagccacatcaagggcctctccctcatgggcggcgcgttcggcaccggcttcacccccgccatcctgggcaccgtcgacggcgtgccccgcgtgggcaactggacgcagtttgccgagttcaacgtcctcgccgacccggaagcagcacacgcgattttctccaacaaggagctggcagggaagacgacgctgatcccgctggatttgacgcacatggttttgacgacggagcaagtccgcgatttgattctctatgggcccgaaggcaaggaggcgcacccggaactgccgcaagatggaagaagccaagggaagaccaccctgagaaccatgttggtggagctgctcatgttcttcgccaagacgtatgcggacgtgtttgggatcacggaaggcccgccgctgcatgatccgttggcggtggcggctgtgttgacgggattggtgggcaccccgctcgaggagtatcagattcctttttgggacttttctccagggactgtggagaagcacagagagaggtttgaggttacggtggtgaccgaggggagttatgaggatgcgagggtcaacggggcgaagacgggtatgacggttgccaagcccctgcccgagggtgaggagggtgtgaggataccgaggggattggatattccgctgttttggaaggtgttggaggagtgtgtgagcagagcggatgaggcgaatgcgcggggggatgatgtgcttcctaactaa

SEQ ID NO: 91241 - protein, 397 aa, Neurospora crassa
MGSSVDNRIPVWLDCDPGHDDTFAILLAAYHPAIRILGISTVFGNASLEKTTRNACSILTSISRSHSIPVYIGASHALHRPHLHAPTDIHGESGLDGTKLLPTPLVGPDTSVDAVTAMSTALRSCAPGTAWVVATGSFTNAAQLFSSHPDLVSHIKGLSLMGGAFGTGFTPAILGTVDGVPRVGNWTQFAEFNVLADPEAAHAIFSNKELAGKTTLIPLDLTHMVLTTEQVRDLILYGPEGKEAHPELPQDGRSQGKTTLRTMLVELLMFFAKTYADVFGITEGPPLHDPLAVAAVLTGLVGTPLEEYQIPFWDFSPGTVEKHRERFEVTVVTEGSYEDARVNGAKTGMTVAKPLPEGEEGVRIPRGLDIPLFWKVLEECVSRADEANARGDDVLPN

SEQ ID NO: 91242 - DNA, 1317 bp, Neurospora crassa
  CDS (1)..(1317)
atggctcccaagcaacgtgttattctcgacaccgaccccggtgttgacgatgtgctggctcttcttctcgcccttagtgcctcacctgaggagcttgagcttgctatgatctccgtcacttatggcaatgttccgcttcagagctgtctccgcaacgtcgtggcaacgttccacgtgctggaaaaagagatgaagtggcgcgaggagacaggcaagagcactcgcggcttcggtgccctcaacacccataaacccattgtcgccgttggtccggagcacgcgctggaggatgagatcctcgcggccgaccacttccatggtgccgacggtttacatggtgtccacgagaagcaacctcatctttcccccgccgacacctggcgctctctattcagcgacgaagagccccagggtgaaaaagtcgagcctccttcgtactccaagtacttcaccccaagcaaggctccagcgcacaaggagattctccgtgtcctgaaggaatcgcccgagaacaccgtcaccgtcgttgccgttggtcccctgacaaacgtggcgctggccgctgctgaggaccccgaaaccttcctgcgcgccaaggagctggttgtcatgggtggtgccgtaaacgtcgagggcaacgtgacccccgtcgccgagttcaactgcttcgccgataccgttgccgccgcccgcgtctacgccctgacctcgcccaacccgagctcgaccatgccccctgtcatccacggcaaatcttttttgcccccttaccccgccaagctttccaagcagcttaagctgacccttttccctcttgatatcaccaccccgctcgagctgaggaaaaagtacttctacgagaccatccagccgatcaccaagtccggcagcccgcttgcgctgtggatcgagaccttcatgacaggcatcttcaacaaagtcgaagccatgcttggcgacggcagtgagcccggtctgtccctccatgacccggcatgcatttggtacatgttgacccaggatgaccccgcatgggaacccgtggcgaagccggaagatattagaattgagacctccggccaatggaccaggggcatgcatgtcatcgacagacgacagagggcgaagccgggtgagcagtcaagcaaggtggagacgcatccgtcggatcctctggatgcgaccacctttgacgatgtccccggagacgacatgggctggctaagcgtgaacaagggaaacagaattaacaggatggtcaagacccccggcgacgagaagtttgccgccatcttgatggatagactctttggttga

SEQ ID NO: 91243 - protein, 438 aa, Neurospora crassa
MAPKQRVILDTDPGVDDVLALLLALSASPEELELAMISVTYGNVPLQSCLRNVVATFHVLEKEMKWREETGKSTRGFGALNTHKPIVAVGPEHALEDEILAADHFHGADGLHGVHEKQPHLSPADTWRSLFSDEEPQGEKVEPPSYSKYFTPSKAPAHKEILRVLKESPENTVTVVAVGPLTNVALAAAEDPETFLRAKELVVMGGAVNVEGNVTPVAEFNCFADTVAAARVYALTSPNPSSTMPPVIHGKSFLPPYPAKLSKQLKLTLFPLDITTPLELRKKYFYETIQPITKSGSPLALWIETFMTGIFNKVEAMLGDGSEPGLSLHDPACIWYMLTQDDPAWEPVAKPEDIRIETSGQWTRGMHVIDRRQRAKPGEQSSKVETHPSDPLDATTFDDVPGDDMGWLSVNKGNRINRMVKTPGDEKFAAILMDRLFG

SEQ ID NO: 91244 - DNA, 1155 bp, Magnaporthe grisea 70-15
  CDS (1)..(1155)
atgagcgctcagcctataccagtctggcttgactgtgacccaggccacgatgatgcttttgccatacttttggccgcacaccatcccatgataaatcttctgggcatttcaaccgtgttcggcaacgcatctttagagaaaacaacatacaacgccacatcacttctcgctgccattggcaagcatgatcaagtgacggtttacccaggcgccgcaaaggcccggtctcggccaccagttcactctccaaccgacatccatggagagtctggtatcgatggcactgacctgcttcccaagccgctgagggctccagataggtcaatctctgcagtcgacgccatggccaaggctgtcctggctcagcccgcaggtactccgtggatcgtggcgactggatgcctcaccaatgtcgccgaggctgtcgagaagtatccccagcttgcggagcacgttgcgggcctgtcttttatgggaggtgccgtgggtggaggcttcactacagccgtgtcgggacaggtcgacggtctcgagaggatcgggaacaggaccccctgggcagagttcaacatctttatcgacccggagtctgccgactttatcctcagcaacgaagttctggctcagaaatccaccatgatcccccttgacgtgacgcatctggttctggccacgaaggaagtccagcagcggctgcttcatggcgacggaggccccgttgaagccggggccaagggcaggacgacactgcgcgtcatgctcgttgagcttctcaacttctttgccgagacttacagaactgcctttggcatcacagagggtcctcccctgcacgatccagtggctgccgccatagtgttgcagaccttgcctgaggaataccggattccattttacgacttcgacattgcgagggatggagggaagcgccatgaacgcttctccgtcaaggtcgtcaccgagggcacctacgaagatgcctatgccggtgcgcagacgggtcgcaccatcgcgactctgcttcccgagggtgcacaaggcgttgcgataccgcgcgggctggatattcccaagttctggaccgtgatcgaggagtgtatacagcgggccgacaatctgaacgcaaagtctagcgcgggaggtccgggtgcttga

SEQ ID NO: 91245 - protein, 384 aa, Magnaporthe grisea 70-15
MSAQPIPVWLDCDPGHDDAFAILLAAHHPMINLLGISTVFGNASLEKTTYNATSLLAAIGKHDQVTVYPGAAKARSRPPVHSPTDIHGESGIDGTDLLPKPLRAPDRSISAVDAMAKAVLAQPAGTPWIVATGCLTNVAEAVEKYPQLAEHVAGLSFMGGAVGGGFTTAVSGQVDGLERIGNRTPWAEFNIFIDPESADFILSNEVLAQKSTMIPLDVTHLVLATKEVQQRLLHGDGGPVEAGAKGRTTLRVMLVELLNFFAETYRTAFGITEGPPLHDPVAAAIVLQTLPEEYRIPFYDFDIARDGGKRHERFSVKVVTEGTYEDAYAGAQTGRTIATLLPEGAQGVAIPRGLDIPKFWTVIEECIQRADNLNAKSSAGGPGA

SEQ ID NO: 91246 - DNA, 1302 bp, Magnaporthe grisea 70-15
  CDS (1)..(1302)
atggcgcccaaacatagaatcattattgataccgacccaggagtcgatgatgtattggccatcttgctggcactcagcgcctctccagaagacctggaggtggcgatgatctcggtcacgtacggcaatgtgccgcttcagggctgtctgcgcaatgcagtcgctctattccacgtcttggagaaggagagggcttggcgcaagtcggtcggtaaagagacgggctttgaatccttgtcggtattcaagcccatcgtggccattggagccaagcatccgctagaggaggaggagcttgcagcggaccacttccacggcgccgacggcctgcacggagtccacgacgcccacccggacctaacccccgcggaaacatggcgcaccctcttcgaggacgccccgggcggggccccctcggacatccccagcttttcaacatacttcaccccatccaagacgctagcgcacaaggagatcctccgaatcctcaaggaatcccccgaccagaccgtgacgatcctcaccatcgggcccatgaccaacctcgccctcgcggcagccgaggaccccgagacgctcctccgcgcccgcgaggtctgcgtcatgggaggcgccatcaacgtgcccggcaacatcacgcccgtggccgagttcaacacctttgccgacgccgtggccacggcgcgcgtctttgccctgacggcgcgggagcccgcctccaccatgccgccctgcacctcgcccagcctcaagccgtaccctgaggggctctcgcggcagctcaagctgtcgctgttcccgctcgacatcaccaccgaccaccttctcaacaagggcttcttcacggagcgcatcgcgccgctcgtcgcctccggcagcccgctcgcccgctggctggagcacgtgctgtcgcggacctttgacaagatcgacagcatcctgggcgacggcagcgagccgggcctgtcgctgcacgacccgctgacggtctggtacatgatgacgcgcgacaacccggcctggaaggcgtcggccggcgaggacatccgcgtcgagaccgccggccagtggacccgcggcatgcacatcctggaccgccgcgtgcgcagcaagccgggcgtcaagcaggaggctggccaggccgagaagaccgaggtggtcgacggcgtgcagctcgacgaggtccccggcgacaccatgggatggctgagcaggaggaggggcaacagcgtcaacaggatcgtgggctcgcccggcttcaacatctttgccgagtatctgatgaagcagctgttctggtag

SEQ ID NO: 91247 - protein, 433 aa, Magnaporthe grisea 70-15
MAPKHRIIIDTDPGVDDVLAILLALSASPEDLEVAMISVTYGNVPLQGCLRNAVALFHVLEKERAWRKSVGKETGFESLSVFKPIVAIGAKHPLEEEELAADHFHGADGLHGVHDAHPDLTPAETWRTLFEDAPGGAPSDIPSFSTYFTPSKTLAHKEILRILKESPDQTVTILTIGPMTNLALAAAEDPETLLRAREVCVMGGAINVPGNITPVAEFNTFADAVATARVFALTAREPASTMPPCTSPSLKPYPEGLSRQLKLSLFPLDITTDHLLNKGFFTERIAPLVASGSPLARWLEHVLSRTFDKIDSILGDGSEPGLSLHDPLTVWYMMTRDNPAWKASAGEDIRVETAGQWTRGMHILDRRVRSKPGVKQEAGQAEKTEVVDGVQLDEVPGDTMGWLSRRRGNSVNRIVGSPGFNIFAEYLMKQLFW

SEQ ID NO: 91248 - DNA, 1278 bp, Gibberella zeae PH-1
  CDS (1)..(1278)
atggctccgaaacagaagatcattctcgacaccgatcctgctttgcttctcgccctcagtgccaaacctgaggagctcgaagttcttctggtatctgtcacatacggcaacgttcctttgcagagctgccttcgaaatgtggtatctgccttccatgtcatcgaaaaggagctcgaatggaggaagtctacaggcaagcctgaaggctttggtgctatgaaggcaaataagcccatcgtggctgtcggccctgatcatcctctttgtgacgaggagttaatggctgactacttccatggaattgatggcttgcataacgttcatgaggcccatcctgatttgtctccagctgatacctggaagggcatctttggcgatggtgccgagggaggtgaacactcccctctattcacgccttccaaggctccttctcatcaggaaattcttcgaattctaaaggagaaccccgccgatactgtttccattctggcagttggccctctcacaaatgttgccctggcagccgcagaagaccccgagactttcctccgtgcaaaggagctcgttgtcatgggcggagctgtcaatgttgagggcaactgcactcctgttgcagagtttaactgctacgctgatgctgtagctgctgcgcgagtttatgccctgacttctcttaagccaagctccacgatgcctattattcccaaggagctctcaacactaaaggcataccccgaaaaactttcccgccaacttaagctcaccctttgccctctcgacattacaacacctcaccttattggcaagaattacttcaaggaaaacatccaggctcacattgatgccggcagccctctcgccaggtgggtatcacacttcgtcacagcctcgttcaagaagatcgaggagatggagggagacgaaaatgagcccggcctgtctctacatgatcctctaacagtctggtatatgctgactcgggacgatcctaagtggaagactcctgagaagcttgaggatatccgtgtggagaccagcggtcaatggacacacggaatgcacgtagttgatcgtaggttcaggaagaagcccgccgaggctgcagttgctctttcggccaaccctactgaggaccctcaaatcctggctttggacgaggtgcctggcgacgaccacgcttggttgagtgtgctcaagggcaaccgcctcaaccgggttattgactctcctggtcacgacatcttcaaggaagtgctcatgcagcgaatcttcggatag

SEQ ID NO: 91249 - protein, 425 aa, Gibberella zeae PH-1
MAPKQKIILDTDPALLLALSAKPEELEVLLVSVTYGNVPLQSCLRNVVSAFHVIEKELEWRKSTGKPEGFGAMKANKPIVAVGPDHPLCDEELMADYFHGIDGLHNVHEAHPDLSPADTWKGIFGDGAEGGEHSPLFTPSKAPSHQEILRILKENPADTVSILAVGPLTNVALAAAEDPETFLRAKELVVMGGAVNVEGNCTPVAEFNCYADAVAAARVYALTSLKPSSTMPIIPKELSTLKAYPEKLSRQLKLTLCPLDITTPHLIGKNYFKENIQAHIDAGSPLARWVSHFVTASFKKIEEMEGDENEPGLSLHDPLTVWYMLTRDDPKWKTPEKLEDIRVETSGQWTHGMHVVDRRFRKKPAEAAVALSANPTEDPQILALDEVPGDDHAWLSVLKGNRLNRVIDSPGHDIFKEVLMQRIFG

SEQ ID NO: 91250 - DNA, 1134 bp, Gibberella zeae PH-1
  CDS (1)..(1134)
atgtccgaagctcaggttcctatttggttggattgcgatccaggtcatgatgacgctttcgcaattctccttgcagcttatcaccctcagatgagacttcttggtgtctcaacagtttttggaaacgcatctcttgaaaacaccacacacaatgcggcttctattctcaccgccattggaatgcatgatattcccttgtatatcggcttgggaaaggcccttgagcgccctgctctccatgcaccaacagacatccatggcgtttctggactagacggcactgatcttttgcccacgccgctcgtcacaccttcaaccatgccagccgttgaggccatggccacggctctacgtgctcaacaacctggaacagcgtggattgttgcgacaggtgcgctgaccaatgttggagctctgttccgtgcgtacccagaacttatcagccacgtcaagggtgtcagtctcatgggcggctctatcggtgacaacttctcagatgcaccgctaggtgaagttgatggtcgacctcgaatcggaaactacacgccttgggccgagttcaacattctcgttgaccccgaggctgctgcaacagtcttccataacaaggagattgcggccaagaccacgattgtgccgcttgatctcagccatcaggtgctggccacacctgaggtgagagatatgcttctatatgggcctggtgccgagaagtcgggctctggaaagacaactcttcgaacaatgcttgttgagctcctttacttctttgcccaaacatacgctgacactttcggcattactgctggcccccctctccatgaccctatagctgttgccgccatactgatcggtacggagagcgaaatccccttctttgagtgggacgccaagcacagccagccccctcagcacgatgagcggttcgaggtcaccgttgtcaccgagggcacttttgaggaggccacggagggtggtaagcagacaggccgcacaatcgcaaagttgctcccacctggcgaacaaggtgtcagaattccacgcggagtcgatactgccaagttctggcaggtcattgaagagtgtatcgagcgagcagatgcaaaaaatgctgcgctcgcgcttgcactatga

SEQ ID NO: 91251 - protein, 377 aa, Gibberella zeae PH-1
MSEAQVPIWLDCDPGHDDAFAILLAAYHPQMRLLGVSTVFGNASLENTTHNAASILTAIGMHDIPLYIGLGKALERPALHAPTDIHGVSGLDGTDLLPTPLVTPSTMPAVEAMATALRAQQPGTAWIVATGALTNVGALFRAYPELISHVKGVSLMGGSIGDNFSDAPLGEVDGRPRIGNYTPWAEFNILVDPEAAATVFHNKEIAAKTTIVPLDLSHQVLATPEVRDMLLYGPGAEKSGSGKTTLRTMLVELLYFFAQTYADTFGITAGPPLHDPIAVAAILIGTESEIPFFEWDAKHSQPPQHDERFEVTVVTEGTFEEATEGGKQTGRTIAKLLPPGEQGVRIPRGVDTAKFWQVIEECIERADAKNAALALAL

SEQ ID NO: 91252 - DNA, 1647 bp, Ustilago maydis 521
  CDS (1)..(1647)
atgaaaggcaatacgccttcttctccgggaagcactccatcgctgctgcgacgcctcagccagttcgtgcagccgagtccatcatcgtcggcatttcagccaagggccaaaggctcatctgactcgccactcacgccgactgcgaatctgccgagggatgacgccacgatcaagtctgtatggctcgattgcgatcctggccatgacgacgctatggctttgcttatggcagtacatcatccgagtatagatttgctgggcatctcgactgtagctggcaacgcgggtgggcgtgacacttttctgaatgcagtccgtctcatggctctgtaccgagcagacccctcgatacccgtaatccgcgggtctgactgtccgttagtcaaagaagtcaaggtggacgtcggaatccatggtcagggaggtcttggtggggttcaaggtcttccctctttgtcatcgccgctgtgtcaaccttggctgcagcccgcttatcccaagacgagctcccccacaactgggcccgaaccttcgctcttcctatatacgctctcgaccatcctgacggagcgcctcaacaacggcaaaccgcctatccatcttgctgtcaccggtcccatgaccaacgtggcgctcttcatccgatgctatccgcacctcattcggggcattgaacagattgtgctcatgggtggtgctgctggtgttaggggtaacagagggccgctcgcggagttcaacattctcaatgatcccgaagcagctgctatcgtcttcaacaccgacatcaaggtcgtcatggctgggctcaatgtcactcatcaagccatatttacagcagagctccacgaccggctcctttctggcaagattcgatcggtctcgtcatctcgcagacaatcgaggaccgcattgagtgccatttcgccgacgcagtcgcctagtacttcgccctttgcgcccacggctgatctatcggcatcgacgcaggttgggccaagcgacctaaaaaaaatgctgagctcgacgttgaccttctttgccaagacatacgcgtccgagtttggcttcacacgaggtccgcccgtgcacgacatgttggccatcgcctacattatcgatccgacgctcttctatcgccgtgttccttcgcctggcgatgttcccaatgtgtccatggttgatgccgatccgtacaccaacaaaggcatgcctatggccgcttctttagccaagccaaataaactgggtggtttgcagggtggcaactcgttggggcttgacatgagcgttgttggaggaggaagcggagagactagcaacatcccggatgtgccggtgaacacagctgagactacgactacacccaggggcacaccaccaaaacggtaccgagtcgacgtcgagtgcagcgacggtttggcatgtggtgcaaccgtcgtcgacttttggggtgatcgtgttgaacacgagggctggggaaaaggcggcaggaacgtggaagtgctcgaaaatctcgactgtcctcgcatgtgggatattttcttcgaggtggtcgagcgtgctgaaacacatattgctagcagtggactgttcaccttcgagatcgccgaccaaggcattcgcgaccttgcgtcttggcgttga

SEQ ID NO: 91253 - protein, 548 aa, Ustilago maydis 521
MKGNTPSSPGSTPSLLRRLSQFVQPSPSSSAFQPRAKGSSDSPLTPTANLPRDDATIKSVWLDCDPGHDDAMALLMAVHHPSIDLLGISTVAGNAGGRDTFLNAVRLMALYRADPSIPVIRGSDCPLVKEVKVDVGIHGQGGLGGVQGLPSLSSPLCQPWLQPAYPKTSSPTTGPEPSLFLYTLSTILTERLNNGKPPIHLAVTGPMTNVALFIRCYPHLIRGIEQIVLMGGAAGVRGNRGPLAEFNILNDPEAAAIVFNTDIKVVMAGLNVTHQAIFTAELHDRLLSGKIRSVSSSRRQSRTALSAISPTQSPSTSPFAPTADLSASTQVGPSDLKKMLSSTLTFFAKTYASEFGFTRGPPVHDMLAIAYIIDPTLFYRRVPSPGDVPNVSMVDADPYTNKGMPMAASLAKPNKLGGLQGGNSLGLDMSVVGGGSGETSNIPDVPVNTAETTTTPRGTPPKRYRVDVECSDGLACGATVVDFWGDRVEHEGWGKGGRNVEVLENLDCPRMWDIFFEVVERAETHIASSGLFTFEIADQGIRDLASWR

SEQ ID NO: 91254 - DNA, 1281 bp, Ustilago maydis 521
  CDS (1)..(1281)
atgacatactccgaatctacagcacccgtcccactcatcatcgatacagacccaggggtcgacgatgtgctcgctatcttgcttgcactcgcttctcccgacgaggtggcagtcaaggccatcactctgacgtttggcaacacaacattggaccacgcctatgcaaatgtgctgaggttggctgctgtcctgcaacgccacctggcagatcccgctacacccgatgtggtcaagcaacgctaccgcgcctttagcgctgatgccgaacctttgatcgtcgcttcaggatctacgcagccgttggagggcaagaggttcactgcttcttactttcatggccgagatggtctgtctggagtcaactggctacccaacgatccattccccgtacctacggaaattgttgccccgctggctccaacggacaaatccgcggcagacgtgatcctcgacacgatccgacaacatcctcctcacactgtccgcattgcagcgctgggacctttgactaaccttgctgccgccttccgcaaagatcccgagacgttcgccaaggtcggtggtatttctgtcatgggaggcgcatttgatgttccgggcaacacgtcgcccgtcgccgagttcaattggtacgccgatccttactcggtgcgcgtgctgatcgacgaggctccgcgacatgcagcacttgcacggcgcaagctgccaatacaggtgctggcactcgatattacttgcggacatacggtgccttactccagcttagtcaaagctacctacgagacgcctcgggacacacctgagcgcgcaagtcatttagcaaggtttatagggactttcttgactcatccccgagcattcaccaacaacatggtcgcaccggaagagtttcacccggacagacatgaccttttcgaggcacatgatccacttgctgtcgcacatgccatttttgcgcccatgcctgcgactggatcgatcgacggcaacggatggaagcataccccgcgtcgattccagattgaaacctcgggcgatctcaccagaggcttttgtgtcgtcgaccgcaggtttacgggtaaaggcagcagtagaaagacgggcggaaacagagcagaggacgccgaaagaaaacttcacacgattgaaagtccagatgttccggtccaccgcaaggtcgaagaggtggacgagtcgcaggtcgggttagttgacgaggttacgggtacacctggggccgagtggttctccaagatgttcttagagcgcattggtttatga

SEQ ID NO: 91255 - protein, 426 aa, Ustilago maydis 521
MTYSESTAPVPLIIDTDPGVDDVLAILLALASPDEVAVKAITLTFGNTTLDHAYANVLRLAAVLQRHLADPATPDVVKQRYRAFSADAEPLIVASGSTQPLEGKRFTASYFHGRDGLSGVNWLPNDPFPVPTEIVAPLAPTDKSAADVILDTIRQHPPHTVRIAALGPLTNLAAAFRKDPETFAKVGGISVMGGAFDVPGNTSPVAEFNWYADPYSVRVLIDEAPRHAALARRKLPIQVLALDITCGHTVPYSSLVKATYETPRDTPERASHLARFIGTFLTHPRAFTNNMVAPEEFHPDRHDLFEAHDPLAVAHAIFAPMPATGSIDGNGWKHTPRRFQIETSGDLTRGFCVVDRRFTGKGSSRKTGGNRAEDAERKLHTIESPDVPVHRKVEEVDESQVGLVDEVTGTPGAEWFSKMFLERIGL

SEQ ID NO: 91256 - DNA, 1266 bp, Aspergillus nidulans FGSC A4
  CDS (1)..(1266)
atggcgcccaagaaaatcattatcgacactgacccgggaatcgacgatatcctcgctcttttgctggctttttcccagaaggcagaggacgttgaagtcctgttagtttctctgacgttcggaaatgtcgaggtgaagagctgtttacgcaatgttgtctccatgttccacatcctcgagagggagatgaagtggcgccatgagaacggtaagcctgagggctttgacgcattgcgggctcatcccccgattgtcgcactcggcgcagaggatcctctcgatgatcagaagatgctcgcagactacttccatggtattgatggcttgggtggaatccatggtagccatccgcatttgactccccaagatgcatgggagcatcttttcgacccaactcacgagcctgttgagctggaacctgtaccatctggctctggagcacaccggtcatttatcccttcgaagcgtcctgcgcacgaagagatgctccgcattttgcgcgaaaatgacccggacaccgtcaccattgtcgctgtcggaccactcaccaacctggccgtggcttctgctgctgacccagaggcatttctacgtgccaaggaagtcgtcgtcatgggcggagccgttcatgaacctggaaatgtaacgcctgttgccgagtttaacgcatatgccgacgcattcgccgccgcccgggtatatgccctcacttcgccttctcccaagagcaccctacctttctgcaagagtctaccggatctcccacccagcctcagcaagcagcttacagtcaagatcttccctctggacatcacgtcaaggcacagtatcaaccgcggtcagttccgaaaagcaacagcccctctggtagaggctggctcaccgcttgctgagtggtctaccgcattcatggcgcacacattcgccaccgttgaaagactacatgcgaaccaggtcggagatgctgcggaactcagtcttcacgatccagtgtgtgtatggtatgctctgactgccgaggacgagggctggaagccgtccgagaaatctcccgaggatatcaggatcgagaccactggtcagtggacgcggggagcgtgtataattgaccgccgtgaccggcatcccgtcgagggggaggaggaaagctcgagcgaccacggtttatggctgagttcgaaagccggaaaccggatctggaggatggacgagtctccagtggaggataactttgggacggttcttatcgagcagctattcatttga

SEQ ID NO: 91257 - protein, 421 aa, Aspergillus nidulans FGSC A4
MAPKKIIIDTDPGIDDILALLLAFSQKAEDVEVLLVSLTFGNVEVKSCLRNVVSMFHILEREMKWRHENGKPEGFDALRAHPPIVALGAEDPLDDQKMLADYFHGIDGLGGIHGSHPHLTPQDAWEHLFDPTHEPVELEPVPSGSGAHRSFIPSKRPAHEEMLRILRENDPDTVTIVAVGPLTNLAVASAADPEAFLRAKEVVVMGGAVHEPGNVTPVAEFNAYADAFAAARVYALTSPSPKSTLPFCKSLPDLPPSLSKQLTVKIFPLDITSRHSINRGQFRKATAPLVEAGSPLAEWSTAFMAHTFATVERLHANQVGDAAELSLHDPVCVWYALTAEDEGWKPSEKSPEDIRIETTGQWTRGACIIDRRDRHPVEGEEESSSDHGLWLSSKAGNRIWRMDESPVEDNFGTVLIEQLFI

SEQ ID NO: 91258 - DNA, 1014 bp, Candida glabrata CBS138
  CDS (1)..(1014)
atgacagcaaccgaaatacctatctggctagattgtgatcctggccacgatgatgcagttgcaatactcttggcatgctgcctacctgcattcaaactagtgggactaagcacctgctttggtaatgcgccaccagaaaatactgactataatgctagatccctattgacagctttggggaagactgatgtgccagtatatctaggagcacaaagaccttggattagaaaacctcattatgctcctgatattcatggagaaactgggttggacggcacttctttattgcctgttccagtagtggaggtaaacaaagaggttaactttattgatgctattgaaaaagccattttggaaagtgatggtgagctatcattcgtctcaaccggagctaccaccactattgccactgtattgcgggagaaaccctacttattagaaaaaattaaatacattagcattatgggaggtggcctgggtgtgggtaatgtgaataaaggtttatcagctgaatttaatgtatggattgatcctcatgctgctaaattcttgcttacagatccaggtatcaaacggaagtgtatattaattcctttgaatctcacacacaaagccttggctactgatgaagtaatgaagagggttcttggtgatggtaagtcgaatataaggagactgttctacgatttgttcctatttttcaaaaagacatatgaacatgctcaaggatttgaaagtgggcccccaattcatgatccacttactttattacctcttcttgagctttatggctgggaaacaaaggaggtcattaatttctcgtataggcgcttagatatcgatgttgatattgatatccatagtgaccacgcgggaaaactgataatattgaacgaatatgagcaagaagaagttcagaaaggtgttattgtaggatatgagctgaatttcgattacttctgggataaattatacttctgtttggaagaagctgagaaaacttcaacaatatag

SEQ ID NO: 91259 - protein, 337 aa, Candida glabrata CBS138
MTATEIPIWLDCDPGHDDAVAILLACCLPAFKLVGLSTCFGNAPPENTDYNARSLLTALGKTDVPVYLGAQRPWIRKPHYAPDIHGETGLDGTSLLPVPVVEVNKEVNFIDAIEKAILESDGELSFVSTGATTTIATVLREKPYLLEKIKYISIMGGGLGVGNVNKGLSAEFNVWIDPHAAKFLLTDPGIKRKCILIPLNLTHKALATDEVMKRVLGDGKSNIRRLFYDLFLFFKKTYEHAQGFESGPPIHDPLTLLPLLELYGWETKEVINFSYRRLDIDVDIDIHSDHAGKLIILNEYEQEEVQKGVIVGYELNFDYFWDKLYFCLEEAEKTSTI

SEQ ID NO: 91260 - DNA, 1017 bp, Kluyveromyces lactis NRRL Y-1140
  CDS (1)..(1017)
atgacgggcaattcagtcatacctatatgggtggactgcgatcctggtcatgatgacgcagtcgctattttattgagttgtttccatccaagcataagattattgggcatatcagcatcgtacggaaacgcttccccagaaaacacattgtacaataccctttctttacttacagcttttgggaaacaggatgaggtgcctgtgtacaaaggtgcccaacgtccttgggttagagatgttgcatacgccccagatattcatggggagactggattggacggtacgacgttattaccaaaaccaaaaaggtcatttgttgatgctgactacataaaagctatggaaaatgctatactagcaaacggagggaatattgccttggtttctacaggaactctaacatcgatagctactttgttcaaggaaaagccatatttaaaggaacaggttagatatatctccataatggggggtggcctacacgcaggaaaccgtaatgataatgattctgcggaattcaatatttgggcagaccctgatgctgcagattttatcctcaatgatgaagacattaagcataaatgcattctctctccgttggatttaacgcatacctgtattgccactgaatatatagacaagactatcttgggagatggatcatgcaaacttagaaagctcttttatgaactatttttgttctttgcgaaaacttataaaaacaaacaagggttcgaagctggtccaccggtacatgatcctgtcacactgatgccattattatatttatatggtcatatttcgaatgatattttgaggttcaagtatggaaggtttgatttgtcaatagataagaaccaagatagcataaactatggtcgcaccattgttacacaagagtacccttccgattcaaattttggcttaatggtgggtctgcagattaatgtggatttcttttggaatcaggtattgaatgcaattgatgtagcagaaaactatccaggctctctttga

SEQ ID NO: 91261 - protein, 338 aa, Kluyveromyces lactis NRRL Y-1140
MTGNSVIPIWVDCDPGHDDAVAILLSCFHPSIRLLGISASYGNASPENTLYNTLSLLTAFGKQDEVPVYKGAQRPWVRDVAYAPDIHGETGLDGTTLLPKPKRSFVDADYIKAMENAILANGGNIALVSTGTLTSIATLFKEKPYLKEQVRYISIMGGGLHAGNRNDNDSAEFNIWADPDAADFILNDEDIKHKCILSPLDLTHTCIATEYIDKTILGDGSCKLRKLFYELFLFFAKTYKNKQGFEAGPPVHDPVTLMPLLYLYGHISNDILRFKYGRFDLSIDKNQDSINYGRTIVTQEYPSDSNFGLMVGLQINVDFFWNQVLNAIDVAENYPGSL

SEQ ID NO: 91262 - DNA, 1056 bp, Debaryomyces hansenii CBS767
  CDS (1)..(1056)
atgactatcgcagattctattcctatatggctagattgtgatccaggtaatgacgatgcttttgccattttgttagccgcatttcacccaaaatttaatttgcttggtatatctacggtatatggaaatgccccaaattcaagtacaactcacaatgcattagcattattagatgttttaggggccgagcaagatcaaataaaggtttactccggggaaaataaaccattagttaagcctgttaaatttgcaccagaaatacatgggccaaccggtattggtggggccaagttacctaagacacctagaattaaagagtcgacagatcagacatacttgcaagccatgagatcagctattttggagcacgcaggaaaaatatgtgtcatttgtactgggactttgaccaatatggctattttgatagaaacctacccagaagtgaaatctaagattaggtttgtgtctattatgggtggtgcgttgaataagggtaatgctactaaatacgccgagtttaacgttcattgtgatccactcgcggctgctaatgtcttgaatgatgaagagctaagtggcaaaacgatattgactggattgaatattacacacaaggcaatcgctactatggaagtcaggaggaacatatacgacgaaacaaatccaaaaaaggactctcatgtgagaaaattgttctacgatattgcaatgttctatgcggaatcatatcgtgttcaacataatataacccttggtccaccaattcatgatccgttagcggttttccttattcttgcattagtaaataagcaagaagacttggcagatgacgttgatttcaaatatatcaaaagaaaattgaaggttatccaggagggtgaacgcgagggagagacgcaaatagctaatggggacctcgatgagctgaaggaggaggaaaatggggtttatgtcggcttgaatgttaacgtggaattattctggagttacgtcttaaaagcacttgataatgccgagcatcatgtagctaactacaaccaaaattctagcatgtaa

SEQ ID NO: 91263 - protein, 351 aa, Debaryomyces hansenii CBS767
MTIADSIPIWLDCDPGNDDAFAILLAAFHPKFNLLGISTVYGNAPNSSTTHNALALLDVLGAEQDQIKVYSGENKPLVKPVKFAPEIHGPTGIGGAKLPKTPRIKESTDQTYLQAMRSAILEHAGKICVICTGTLTNMAILIETYPEVKSKIRFVSIMGGALNKGNATKYAEFNVHCDPLAAANVLNDEELSGKTILTGLNITHKAIATMEVRRNIYDETNPKKDSHVRKLFYDIAMFYAESYRVQHNITLGPPIHDPLAVFLILALVNKQEDLADDVDFKYIKRKLKVIQEGEREGETQIANGDLDELKEEENGVYVGLNVNVELFWSYVLKALDNAEHHVANYNQNSSM

SEQ ID NO: 91264 - DNA, 969 bp, Oryza sativa (japonica cultivar-group)
  CDS (1)..(969)
atgacgacgacgaagaagaagctcgtcatcgacaccgacccgggaatcgatgacgccatggccatcttcgtggcgctgaggtcgccggaggtggagctgctgggcctcaccaccatcttcggcaacgtctacaccaccctcgccacccgcaacgccctccacctgctggaggctgttgggaggactgacatccccgtggcagagggatcccatgtaacaatcaagaaagccaccaagctacggattgcgagctttgttcatggctcggatggtctaggaaatcagaactttcctccgccaactgggaagcccttagatcaatcggccgccgcgtttcttgtcgagcaggcaaatctgtaccctggacaagttactgtggttgcccttggtccacttaccaacctagctttggctatagaacttgatccttctttcccgaagaagattgggcagattgtgatccttggtggtgcgtattcagttaatggaaatgtcaaccctgcagctgaggcaaatatatttggtgaccctgatgcagctgatatagttttcacctccggtgctgatattttggctgtgggaataaatattacacaccaagtagttctttctgatgctgaccgggaaaagcttgaacagtctgatagcaaatatgcccgatacttgagcaagatcctgggtctttattatgattaccacaaggacgcctacttcataaaaggagtgtatcttcacgatccagcaacacttattgctgcggtagatccgtcactgatgacttacacggaaggtgtagtgagggtgcagactgatggcatcacaaagggtctcacagttttcgacacaaccaagaaaaggtatggggagataactgcgtggaccggtaagccaaccgtgaaggttgctgtgaccgttgatgctcctgccgttgtggagatgatcatgcagaggcttacgacggatgattag

SEQ ID NO: 91265 - protein, 322 aa, Oryza sativa (japonica cultivar-group)
MTTTKKKLVIDTDPGIDDAMAIFVALRSPEVELLGLTTIFGNVYTTLATRNALHLLEAVGRTDIPVAEGSHVTIKKATKLRIASFVHGSDGLGNQNFPPPTGKPLDQSAAAFLVEQANLYPGQVTVVALGPLTNLALAIELDPSFPKKIGQIVILGGAYSVNGNVNPAAEANIFGDPDAADIVFTSGADILAVGINITHQVVLSDADREKLEQSDSKYARYLSKILGLYYDYHKDAYFIKGVYLHDPATLIAAVDPSLMTYTEGVVRVQTDGITKGLTVFDTTKKRYGEITAWTGKPTVKVAVTVDAPAVVEMIMQRLTTDD

SEQ ID NO: 91266 - DNA, 975 bp, Oryza sativa (japonica cultivar-group)
  CDS (1)..(975)
atggggtcgaacgagcagatccaccgggacaagctcatcatcgacacggatcccggcatcgatgatagcatgacaatccttatggcgttcagagctccaactgtggagatcatagggctcacaaccatatttggcaacaccaccacaaagaatgcgactcagaatgcgctcttgctgtgtgagagagcaggacatcctgaggttccagtagcagagggcagcgcagagcctctcaagggaggagagccacgtgttgctgactttgttcatgggtctgatggcctggggaatttgtttcttcctgcacccactagtaagaaggttgatgaaaatgctgctgagttcatggttaataaggtctctcaatttcctggagaagtttctatactcgcattgggacccctgacaaacgtggcgctggccatcaaaagggacccttcctttgcaagtaaggtgaagaaaatagttgtactgggtggtgctttctttgcggctggaaatgtcagcccagctgctgaagcaaatatatatggagatccagaagcagctgacatagtttttacctcaggagcagatgttgacgtggttggcattaacataacaactcaagtctgttttacagatgaggatctcctggagctaagaaactcaaaagggaagcatgcacagttcttatgtgacatgtgccagttctatagagactggcatgccgaatccgatggctttcatggaattttcctccatgatcctgtgagcttcactgccctagttcaccctgagtacttcacgttcaagaagggtgttgtgagagtagaaacccagggcatttgcactggtcacactttaatggaccaaggattgaaaaagtggaattcagagaatccatggtctggctacaagccaatctcagttgcatggacagttgatgtgccaaatgttctcgcattcgtgaaggaactcctcatggctccatga

SEQ ID NO: 91267 - protein, 324 aa, Oryza sativa (japonica cultivar-group)
MGSNEQIHRDKLIIDTDPGIDDSMTILMAFRAPTVEIIGLTTIFGNTTTKNATQNALLLCERAGHPEVPVAEGSAEPLKGGEPRVADFVHGSDGLGNLFLPAPTSKKVDENAAEFMVNKVSQFPGEVSILALGPLTNVALAIKRDPSFASKVKKIVVLGGAFFAAGNVSPAAEANIYGDPEAADIVFTSGADVDVVGINITTQVCFTDEDLLELRNSKGKHAQFLCDMCQFYRDWHAESDGFHGIFLHDPVSFTALVHPEYFTFKKGVVRVETQGICTGHTLMDQGLKKWNSENPWSGYKPISVAWTVDVPNVLAFVKELLMAP

SEQ ID NO: 91268 - DNA, 1017 bp, Yarrowia lipolytica CLIB99
  CDS (1)..(1017)
atgatacccatctggctcgattgcgatccaggccacgatgatgccgtcgcgattcttttagcggcgaaattacccgccttcaacttgctcggaatatcgaccgttttcggaaacgcgccgttggaaaagacaaccgtcaacgccatggccgtgctgaaagcaatcggacaagattcggaaatcaaagtgtatccgggcgccgagagaattcagtcacggggtggtggcggcgatggtgggtcacatgaccaatccaaccagtcgcacagcccttcgtcgtgttcccgtggccattacgaaactgctccctccacatttgctccttcgattcatggtgaatcaggtttggatggaacgtctctgttgccggaaatcacgtgcacaatcgaacctcatgttgattccactctcgtggccatggcaaacgccatccgaaacaaccccggcacgtgtcttgttgctactggttcacttaccaacgtttcagcgctatttgaccgctttccagatgtcaaaaatcttgtggaaacagtttccattatgggaggaggatttggaatgggcaattggacgccctatgcggaattcaacatctggtgcgacgccgagtcagctagccaggtgctcggcgacccgatcgtcgctgcgaaggttgtgctctgtccactgaacgtgactcacacggccattgcaaccgaagaggtgcttagtcagatcaagagtgtcggcggtaacgtgagccagatgtttttcgaactcatgacctttttcaaggagacatacgagtccgagtttggtttcaaggacggtcctcctgttcacgatcctctttctgtggctgttttactcaacgggattgttacgaaggagagaagagtgacagtggatgtcactgtggggggagaacagagaggaatgttgacggagcaagtggggggtcacttgacggtggttgaggaggtggatctgaacaagttttgggctttagtggtgacttgtttggaggcatgcaagtga

SEQ ID NO: 91269 - protein, 338 aa, Yarrowia lipolytica CLIB99
MIPIWLDCDPGHDDAVAILLAAKLPAFNLLGISTVFGNAPLEKTTVNAMAVLKAIGQDSEIKVYPGAERIQSRGGGGDGGSHDQSNQSHSPSSCSRGHYETAPSTFAPSIHGESGLDGTSLLPEITCTIEPHVDSTLVAMANAIRNNPGTCLVATGSLTNVSALFDRFPDVKNLVETVSIMGGGFGMGNWTPYAEFNIWCDAESASQVLGDPIVAAKVVLCPLNVTHTAIATEEVLSQIKSVGGNVSQMFFELMTFFKETYESEFGFKDGPPVHDPLSVAVLLNGIVTKERRVTVDVTVGGEQRGMLTEQVGGHLTVVEEVDLNKFWALVVTCLEACK

SEQ ID NO: 91270 - DNA, 1149 bp, Yarrowia lipolytica CLIB99
  CDS (1)..(1149)
atgccccgatcgctcatcatcgacactgatcccggcgtggacgacgcgctggccatctcgctggctctcaactcgcccgagtgcgacctcaagctcatttctctgtgtttcggcaactgcgacacgaacgccagtctgcgcaatgtggagacactcttcagcgtgtttgaacgcgagcgagtgtggcgagagcagcagggtctgcccgccaagcaccacgtgaaccagaaacccattgtggctgtcggaatggacacggcgttggacggaacccgactggacgctacctacttccatggtgacgacggactcggtaacgtgcacaccaagatgcccgagttcaccagcaccgacaagaacggacccggatacacgttttccgacaagccttcgtatcaagtcattctcgacctgctgcgtgaagagcccgacaagtccgtgacgattgcggccattggcccgctcatgaacattgcccgagcggcccagattgatcccgacaccttttcgcgggtgaaggagattgttcacatgggcggcgctctcaaggtgcctggaaatgtgactccccgtgctgagttcaactgttactctgaccccctggctgcggcggtggtgtactcgttttcggccactgagcagccctgtgtgactttgcctcctcgaaaggagttccacgtaacgcttccgcgacctgtgcccgtcacaatcttccctctggatattaccatggagtacaatctctacgagaaccagtttttcaccgcggtttccgaccgcgccgcagcaggctctcctctgacggtgtggtcgtcggtgtggctccagtccacctttgacaccttccgtcgacttaacgtggactgttctgacgtccatatcaacatgcatgatcccctggccacctggtacgccatttgtggagatgagcatggcgcctgggagtcacacgaccaggatgtccgtgtggaaaccgagggacagtggtcccgtggggtaactattgaggacgaccgcggccgacaaaagacggatgccgaggccgaggacgacggaaagtggctgggacgaggaggaaaccatgtcaaggtggtgaccaaggcgccagtcgaggtgggccagttgttggtggagcggatttacgtgtaa

SEQ ID NO: 91271 - protein, 382 aa, Yarrowia lipolytica CLIB99
MPRSLIIDTDPGVDDALAISLALNSPECDLKLISLCFGNCDTNASLRNVETLFSVFERERVWREQQGLPAKHHVNQKPIVAVGMDTALDGTRLDATYFHGDDGLGNVHTKMPEFTSTDKNGPGYTFSDKPSYQVILDLLREEPDKSVTIAAIGPLMNIARAAQIDPDTFSRVKEIVHMGGALKVPGNVTPRAEFNCYSDPLAAAVVYSFSATEQPCVTLPPRKEFHVTLPRPVPVTIFPLDITMEYNLYENQFFTAVSDRAAAGSPLTVWSSVWLQSTFDTFRRLNVDCSDVHINMHDPLATWYAICGDEHGAWESHDQDVRVETEGQWSRGVTIEDDRGRQKTDAEAEDDGKWLGRGGNHVKVVTKAPVEVGQLLVERIYV

SEQ ID NO: 91272 - DNA, 1221 bp, Cryptococcus neoformans var. neoformans JEC21
  CDS (1)..(1221)
atgccgcacaaaatcatcctcgacaccgacccaggcgtagacgacgtcctcgccatcctcctcgcgctctcttctcccgaagtcgacctggccctcatctccatcgtctttggcaacacccacgcgcccgttgcgcatagtaacttgttaaagatatatcatctcctggcgcaagaggtggcgcagactgcgggcgcggaggggaggtatgggaggttgaaggggcaggtgaagacggtgttggcgatgggggaggatgggccgattggcggggagaaggcggtggctgcgtactttcatggcccagatggattgtcaaacattagcgagacgcaccctcatttcactcctcccgagattcagccaggggacatgcatgcacatctcgacacatcgcctaaaccttcttacgaggtgatacttgatatcctcagggcggagcctgacgacagcgtgaccatcgtcgctctcggtccattgacgaacattgcacactctctgcgtgccgatccagagacattcaccaaagtctcccgcgttgtatggatgggcggtgcgatcgatcacccgggtaacacttcccccgtcgctgaattcaactgttttgccgacccttacgccgcgtcttccgtcatctctgccgccaaggagggtaagattgaactcgtcatggctcctctcgacatcaccaccccgcacgccatccctttttctgatctgatccatccttccgtcgtccccatccccgagccatccaccggtgctgtccgaaaagccccagaaacgcccacgccgctggaagcgttcatctctgcgatgctcgtcagggtccgtggtctccaagcgagttttgggctaccagatgcgatggagatgcatgatcctgtagctgtgtggtatgccattgcgcacgctggtgttccccgcggagccgggccggtggaagggtgggcgctgcagggacgggagtttacggtcgagcggacgggcgagtacacgagagggatgtgtgtggtggatcgacgcgggacgggggagacaggcgtggataggagtaaggatgagcgtattctttcacacgggctggcgcaggacacgggaaatacattgccagagaaggcgttgaagccgcggatgttgccgcttgtgatcacgcgcacgccgggggcagaagtactgaggagcacgctgcttggacgggtgtttggagagcgggagtaa

SEQ ID NO: 91273 - protein, 406 aa, Cryptococcus neoformans var. neoformans JEC21
MPHKIILDTDPGVDDVLAILLALSSPEVDLALISIVFGNTHAPVAHSNLLKIYHLLAQEVAQTAGAEGRYGRLKGQVKTVLAMGEDGPIGGEKAVAAYFHGPDGLSNISETHPHFTPPEIQPGDMHAHLDTSPKPSYEVILDILRAEPDDSVTIVALGPLTNIAHSLRADPETFTKVSRVVWMGGAIDHPGNTSPVAEFNCFADPYAASSVISAAKEGKIELVMAPLDITTPHAIPFSDLIHPSVVPIPEPSTGAVRKAPETPTPLEAFISAMLVRVRGLQASFGLPDAMEMHDPVAVWYAIAHAGVPRGAGPVEGWALQGREFTVERTGEYTRGMCVVDRRGTGETGVDRSKDERILSHGLAQDTGNTLPEKALKPRMLPLVITRTPGAEVLRSTLLGRVFGERE

SEQ ID NO: 91274 - DNA, 966 bp, Bacillus thuringiensis serovar konkukian str. 97-27
  CDS (1)..(966): transl_table=11
gtgagtatagttaataagaaaatcatcttttttggagactttggtattgatgatgctgtagcgttaatttatgcaaataaaacatgtaaattagatattttaggtattgttgctgaatatgggaatgtatcgcgagaaatcgtaacagaaaatgtgtattttttagaaagatactatgctacagaagtaaaaatcattgagggtgcagcaagaccgatgacagctgaagaacctttattctttcctgaaattcatggggagcatggtttagggccaattattccgcctgatatgaggatttgtaaacgggaaaatttttgtgaattaattaaattaattgaaccttgtccagaagatattattatcgtagcaacaggacgattaacaacattggcaacgttatttttattatatccaaatgtcatggataaagtatgttcgtattatattatgggcggtgcttttttatttcctggtaatgttactcctgtatcagaagcgaatttttatggagatccaatcgccgcaaatattgtaatgaagtacgcaaagaatgcgcatatttatccattaaatgtaacgcaagaagccctaattactcctgaaatggtggatattattaataaagaaggaacagggcaggcgaaacttataaaaccaatgattgatttttattatgagaacttttataaaaaagaataccctggtattgctggaagtccgattcatgatttacttccgtttatttcgtttataaatgatgatatttttgaatataaaaaatcagcagtttggattagtacgacaaatgacgtaacaagaggacaaagtgtggctgactttagaaaaatagctgagccgacaaggtttgatgatcggccaatacaaagaattgctgttggttttaactatcctgcatttaaagaagagtttatgcggacaatattgaagccggattgcccataa

SEQ ID NO: 91275 - protein, 321 aa, Bacillus thuringiensis serovar konkukian str. 97-27
MSIVNKKIIFFGDFGIDDAVALIYANKTCKLDILGIVAEYGNVSREIVTENVYFLERYYATEVKIIEGAARPMTAEEPLFFPEIHGEHGLGPIIPPDMRICKRENFCELIKLIEPCPEDIIIVATGRLTTLATLFLLYPNVMDKVCSYYIMGGAFLFPGNVTPVSEANFYGDPIAANIVMKYAKNAHIYPLNVTQEALITPEMVDIINKEGTGQAKLIKPMIDFYYENFYKKEYPGIAGSPIHDLLPFISFINDDIFEYKKSAVWISTTNDVTRGQSVADFRKIAEPTRFDDRPIQRIAVGFNYPAFKEEFMRTILKPDCP

SEQ ID NO: 91276 - DNA, 951 bp, Bacillus thuringiensis serovar konkukian str. 97-27
  CDS (1)..(951): transl_table=11
atgcccaaaaaagttcttattttttgtgatcctgggattgatgatacgatggctctcctcttagcattctttatcgatgaaatagaaatcatcggcatcgttgctgactacggcaatgttccaaagaagatggccgtacaaaatgctcattttcttacgaacgaaacaaggaatagaaatattaaaatatttggtggatcagaacgccctcttactggtgccccgcctgctttttttacagaagtacacgggaaacaagggcttgggccaattattccaaatgggaatgtgactaacggagaaatggagaatttctttgaagtcattcctcttattgaacagtataaagatgaattaatcattgtaagtttaggaagacttacctctctagcaattttatttattatgtgcaaacagttaatgaaacaaattaaatcttactacgtaatgggcggtgcctttttacatcctggtaacgttacccctatttccgaagctaacttttatggcgaccctactgctgctaacattgttcttcaatccgcagctaacatgtacatatacccgttaaacgttacccaatactccgtcattacaccagaaatggccgagtacattgaagcaaaaggaaaagccccactcgtcaaaccgttattcgatcattattactatggatattataaaaatgccctgccagatttaaaaggtagccccttccatgacacaatgccaatactcgctttacttgataactctatgtttacgtatcacaaatcacctatcgttgttatggcagaatcttatgcacaaggagcaagcattggagaatttcgttccttaggaaaacctaaaccatttatggattggccgagtcatcaaatcgcaattgattttgattataaccgtttctttaaacatttcatgtcacttatgacaggtgagcaattttaa

SEQ ID NO: 91277 - protein, 316 aa, Bacillus thuringiensis serovar konkukian str. 97-27
MPKKVLIFCDPGIDDTMALLLAFFIDEIEIIGIVADYGNVPKKMAVQNAHFLTNETRNRNIKIFGGSERPLTGAPPAFFTEVHGKQGLGPIIPNGNVTNGEMENFFEVIPLIEQYKDELIIVSLGRLTSLAILFIMCKQLMKQIKSYYVMGGAFLHPGNVTPISEANFYGDPTAANIVLQSAANMYIYPLNVTQYSVITPEMAEYIEAKGKAPLVKPLFDHYYYGYYKNALPDLKGSPFHDTMPILALLDNSMFTYHKSPIVVMAESYAQGASIGEFRSLGKPKPFMDWPSHQIAIDFDYNRFFKHFMSLMTGEQF

SEQ ID NO: 91278 - DNA, 936 bp, Staphylococcus aureus subsp. aureus MRSA252
  CDS (1)..(936): transl_table=11
atgaaaagaaagattattatggattgtgatccaggacacgatgatgcaatagcattaattttagcgggggcaattgacagtccactagagatattagctgtaaccacagtcgcaggtaatcaatcagttgacaagaacacgacaaacgccttgaacgtattagatattatgggacgccaagatatagtagtagcgaaaggtgcggataggccgttaattaaactagttgcctttgcttctgaaatacatggggaatctggattagatggtccgaaactaccgtcgacaccatcacgtcaagcagttgcaatgccagcatcagatgtgattattaacaaagtgatgacgagtgatacacctgtaacaattgtagcgacaggtcctcttacgaatgtagcaacggcattgattcgtgagccaagaatcgctgagcatattgaatctattactttgatgggtggtggtacatttggaaattggacgcctacagcagaattcaatatttgggtagatgctgaagcagcgaagcgtgtttttgaaagtgggattactataaatgtgtttggtttagatgtaacacatcaagttttagccgatgaacacgtgattgaacgctttgaaagtatcaataatcctgttgcacagttcgtcgtagaattattgcaattctttaagaagacatacaagactcactttaatatggacggtggtccaatacatgatgcttgtacaattttgtatttgttacaaccagaattgtttacaatggtacccgttaatatcgacattgaacatcaaagtccactaacttatggcactatggctgtagatttaaatcatgttacaggtaagcctgccaatgcctattttgctacagcagttgatgttgaagaagtgtggaacttgatagatcataagttacgtacatacgaataa

SEQ ID NO: 91279 - protein, 311 aa, Staphylococcus aureus subsp. aureus MRSA252
MKRKIIMDCDPGHDDAIALILAGAIDSPLEILAVTTVAGNQSVDKNTTNALNVLDIMGRQDIVVAKGADRPLIKLVAFASEIHGESGLDGPKLPSTPSRQAVAMPASDVIINKVMTSDTPVTIVATGPLTNVATALIREPRIAEHIESITLMGGGTFGNWTPTAEFNIWVDAEAAKRVFESGITINVFGLDVTHQVLADEHVIERFESINNPVAQFVVELLQFFKKTYKTHFNMDGGPIHDACTILYLLQPELFTMVPVNIDIEHQSPLTYGTMAVDLNHVTGKPANAYFATAVDVEEVWNLIDHKLRTYE

SEQ ID NO: 91280 - DNA, 942 bp, Staphylococcus aureus subsp. aureus MRSA252
  CDS (1)..(942): transl_table=11
gtgactaagaaagtttattttaaccatgatggtggtgtagatgatttagtatctctatttttattattacaaatggaaaacgttcaattgataggggtcagtacaattggtgctgattgttatttagaaccatctttgagcgcatcagtaaaaattattaatcgtttttcaaaggaagatattcaagttgcgccatcatatgaacgaggaaaaaatccatttcctaaagaatggcgtatgcatgccttttttatggacgcattgccaattttaaatgagccagtcaaacacgttgcttcaaatgtgagagacaaagaagcctttgaagacattattcaaactttaaagagacaatcagaaaaagtaacattattatttacaggcccgcttacagatttagcaaaagcactacaaaaagattcatcaatcgttcagtatatagaaaaattagtttggatgggtggtacctttttaccaaaaggaaatgttgaagaacctgagcatgatggttctgcagaatggaatgcatattgggatccagaagcggttaaaattgtttttgatagcgatatagagattgatatggttgctttagaaagtacgaatcaagtaccgctaacgttagatgttagacaaagatgggcgaatgaacgccaatatacgggcattgattttttaggagtaagttatgcagcggtaccaccattaacacactttataacaaattctacttactttttatgggatgttttaacgactgcttatattggtaacaaggacttagttcactcaattgagaaaaaagtggatgtaataagttatggaccaagtcaaggtaagacatttgagtgtaaagatgggcgcaaaattaatgtcataaatcatgtagataacaacgcattttttgattatataactgcacttgctaaaaaagtaaattaa

SEQ ID NO: 91281 - protein, 313 aa, Staphylococcus aureus subsp. aureus MRSA252
MTKKVYFNHDGGVDDLVSLFLLLQMENVQLIGVSTIGADCYLEPSLSASVKIINRFSKEDIQVAPSYERGKNPFPKEWRMHAFFMDALPILNEPVKHVASNVRDKEAFEDIIQTLKRQSEKVTLLFTGPLTDLAKALQKDSSIVQYIEKLVWMGGTFLPKGNVEEPEHDGSAEWNAYWDPEAVKIVFDSDIEIDMVALESTNQVPLTLDVRQRWANERQYTGIDFLGVSYAAVPPLTHFITNSTYFLWDVLTTAYIGNKDLVHSIEKKVDVISYGPSQGKTFECKDGRKINVINHVDNNAFFDYITALAKKVN

SEQ ID NO: 91282 - DNA, 948 bp, Acinetobacter sp. ADP1
  CDS (1)..(948): transl_table=11
atgacacattctcctcatcaaattattattgatacagatccaggtcaggatgatgcagttgcaattttattggcactggcgagccctgaagtaaaggtacttgcgattacaacggtcgctggaaatgtgccattggcattgaccagtgcaaatgcacgtaaagtatgtgaattggctggacgtccagatatttctgttttcgctggatgcgatcgtccgttgaaacgtccattaattaccgccgaaaatgtacatggaaaaacaggactcgatggtattgagttacctgagccgcaaatgcctttgcaggcccagcactcagttgattttattattgaaactctgcgaaatgcacctgagaaaacaattacgatctgttctttggggccgatgaccaatactgctcaggcactattaaaagctccagatattgcagcgcgagttaagcgaattgtcttgatggggggcggcttttttgaaggaggaaatattacaccttcggcagaatttaatatgtttgttgacccagacgcagcgaaaattgtatttgctgcgggtattccattaactgtgattccacttgatgtcacacatcaagtcttaacctcgaaagaatgggtcgatggtttgcgccgtatggataatcaggtcggtcctgctgtagcagcctggacagatttctttgaacgttatgatatggaaaaatacggttctgaaggcgcaccattacatgatccttgtgtcatcggctatatgatcaaacctgaactattctctggtcgttttatcaatgtcgagattgaagcggatagcccattgacagtgggcgctatggttgcagactggtggaatgtcactggtcgcactgcaaatgcagaatatttacgtgatattgatcgtgatggcttctttgatttgctatcagagcgtctggcaacgtatcagtag

SEQ ID NO: 91283 - protein, 315 aa, Acinetobacter sp. ADP1
MTHSPHQIIIDTDPGQDDAVAILLALASPEVKVLAITTVAGNVPLALTSANARKVCELAGRPDISVFAGCDRPLKRPLITAENVHGKTGLDGIELPEPQMPLQAQHSVDFIIETLRNAPEKTITICSLGPMTNTAQALLKAPDIAARVKRIVLMGGGFFEGGNITPSAEFNMFVDPDAAKIVFAAGIPLTVIPLDVTHQVLTSKEWVDGLRRMDNQVGPAVAAWTDFFERYDMEKYGSEGAPLHDPCVIGYMIKPELFSGRFINVEIEADSPLTVGAMVADWWNVTGRTANAEYLRDIDRDGFFDLLSERLATYQ

SEQ ID NO: 91284 - DNA, 972 bp, Erwinia carotovora subsp. atroseptica SCRI1043
  CDS (1)..(972)
atggttcgagagcgcattattattgataccgatcccggcgttgacgatgcaatcgccatctggctggcattggcgtcgcccgaactggacgtgctcggtattaccgttgtggcaggtaatgtgccgcttgaagcgacgttgccgaatgcttgcaacgttgttgggctgacgggcagaaccgatgtgcccatttttgctggtgcctcgcgtccgctcattcgcgatcaggttttcggtaaatacgcccatatcggcaaattttcctctgagtgggtgccgcagagcacgctatcgccggaacaggaacacgccgtcgattttctggtgcggatgacgcgtcaggccgctgccgacaataatccgatcaccatttgttcactcgggccgatgacgaatctggcgttggcgctgtgcttccatcctgatgttgcacgcggtatcaaacagattgtttccatgagcggtgcctttaccgcgatggggaatcgcgtgccgtgggctgactttaacgtctatgccgacccgcatgcagcggaaatcgtattttcctccggtgttcccgttgtcattatgccgttggatgtgacctttcaggcactgattcagacggaacaggttgatgtcatcgaacgcagcgccggtgcaccgggtaaagcgatggcggcactgctgctcatgtttgaccgcaacgaggtagaacgctttggtcgcgaaggtggaccgattcatgatgcgactgtcatcgcgtggctgttgaagccagaattgttcaagtcaaaatatgcgcgtatcggggttgaagtttccggtaagaccgcaggttacgtgtttgccgatttttatcacaaactgggtgagccagcgaatgcgctggtcatgcgggaaatcgacgaacagggatttcttgggctgattgctgaccgcctgcgccactacgatgttgatacattaaacggttcaggggggcgctga

SEQ ID NO: 91285 - protein, 323 aa, Erwinia carotovora subsp. atroseptica SCRI1043
MVRERIIIDTDPGVDDAIAIWLALASPELDVLGITVVAGNVPLEATLPNACNVVGLTGRTDVPIFAGASRPLIRDQVFGKYAHIGKFSSEWVPQSTLSPEQEHAVDFLVRMTRQAAADNNPITICSLGPMTNLALALCFHPDVARGIKQIVSMSGAFTAMGNRVPWADFNVYADPHAAEIVFSSGVPVVIMPLDVTFQALIQTEQVDVIERSAGAPGKAMAALLLMFDRNEVERFGREGGPIHDATVIAWLLKPELFKSKYARIGVEVSGKTAGYVFADFYHKLGEPANALVMREIDEQGFLGLIADRLRHYDVDTLNGSGGR

SEQ ID NO: 91286 - DNA, 954 bp, Erwinia carotovora subsp. atroseptica SCRI1043
  CDS (1)..(954)
atgagtgcgttacctattattattgattgtgatccggggatagatgacgctattgcgttattaagtgcattcgtggcaccagagttggatattcgcggcatctgtacggtgtgcggtaaccaggcgctggaaaagacggtgcgtaatgcgctgcaaattgttgagctgggtcagcgcacggatatccccgttttcgcaggctgccatcggccgctgttgcgcgaacctattcatggccagtttcacggcgaaagcgggctgggccagacggtgctgcctgaaccgcaaaaacaggccgaagcgcagcatgcggtgagttttattattgcgcagtgtcggcaggcgatagctgacggcacgccgatcacgctgtgtacgttggggccattaaccaatgtggcgatggcgctgcgtatggctcccgagattgccgacggtattgcacgcattgtcatgatgggcggtgcgtatcgggaagcgggcaaccgcagcctgacatctgaattcaatatgattgccgatccgcaggcagcgaaggtggtatttgactcgtcgattgcccttgtcgcgctgccgctggatgttacgcatcaggtaattttaacaccggaattggtggcgcgtttcgttgcgctatccgggcggatttccgtgccgctgggtgaaatgatggcgttttgggatcgtaacgatatccgccgctatggttcacgcggtggcccgctacacgatccgttggttattgcctgggttctggcgccgcactgtttcacgacagaaaaagccagcgtttacattgagcaggaaagtgagctgtgcatgggacaaaccgttgccgactggtatggaaaaaccgatcgtcagccgaatgtggatgtggtgacaggggttgatgccaaacaggttgtcgagctgtttgctgacctattgagccgctacagagagggggtctga

SEQ ID NO: 91287 - protein, 317 aa, Erwinia carotovora subsp. atroseptica SCRI1043
MSALPIIIDCDPGIDDAIALLSAFVAPELDIRGICTVCGNQALEKTVRNALQIVELGQRTDIPVFAGCHRPLLREPIHGQFHGESGLGQTVLPEPQKQAEAQHAVSFIIAQCRQAIADGTPITLCTLGPLTNVAMALRMAPEIADGIARIVMMGGAYREAGNRSLTSEFNMIADPQAAKVVFDSSIALVALPLDVTHQVILTPELVARFVALSGRISVPLGEMMAFWDRNDIRRYGSRGGPLHDPLVIAWVLAPHCFTTEKASVYIEQESELCMGQTVADWYGKTDRQPNVDVVTGVDAKQVVELFADLLSRYREGV

SEQ ID NO: 91288 - DNA, 966 bp, Propionibacterium acnes KPA171202
  CDS (1)..(966): transl_table=11
atgtcgacttctacgcgctccctgcccgtcttgttggactgcgatccgggtatcgacgacgccttcgccctggcctacgtggcctgccgtgacgacgttgagaccgtcggggtggtgacgactgccggcaacgtggggcaggacgacgtactgcgaaacgcgcttggggtgactgatctgctcggaatgggcgtgccggttgcccgaggggcggacgttccgctcgtcgagcctctcatgaccgccgaggagacccacgggccgcacgggttggggcacgctgtgctaggggagtgcgggcgtcacccggattcgcgtagcggggcacaactgtgggttgatctcgcgcgccaatacccggggaagttggtgggtatcgtcaccgggccgttgacgaacctcgcgctggcgctgcgggaagaaccggaattgccgcggttgttgcgggggctgcacgtcatgggtggggcgatcaattatcgtggcaataccgggccgacaagtgaatggaacatcgcggtggacccggaggctgcacacgaggtgttcgaggcgtggggcaaggcgtcccagcgggttgtgctcggtgcgttgcaggctaccgaagccgtccgtctcgacgagaagcatcgtcaagccgtggcacaactgaaagatcacccggttggtgccgtgcttgctgacgccctgcagttctacttcgagtttcaccaggctgacggtctggggtggtgtgcctatctgcatgacccgctcgtggtcgccaatgcggtgacgggccagttcgccaagacgagaccactggccgtcgacgtcgagctgacaggcacgttgactcgcggtcagaccgtcggtgacgagttggggcgctggggcaaagagcccaacgtcgacctgttgtgcgacgtcgatgctgaggggttcattgagcatcttttgacaacgttgcggacggggttgggctga

SEQ ID NO: 91289 - protein, 321 aa, Propionibacterium acnes KPA171202
MSTSTRSLPVLLDCDPGIDDAFALAYVACRDDVETVGVVTTAGNVGQDDVLRNALGVTDLLGMGVPVARGADVPLVEPLMTAEETHGPHGLGHAVLGECGRHPDSRSGAQLWVDLARQYPGKLVGIVTGPLTNLALALREEPELPRLLRGLHVMGGAINYRGNTGPTSEWNIAVDPEAAHEVFEAWGKASQRVVLGALQATEAVRLDEKHRQAVAQLKDHPVGAVLADALQFYFEFHQADGLGWCAYLHDPLVVANAVTGQFAKTRPLAVDVELTGTLTRGQTVGDELGRWGKEPNVDLLCDVDAEGFIEHLLTTLRTGLG

SEQ ID NO: 91290 - DNA, 1305 bp, Bacillus cereus ZK
  CDS (1)..(1305): transl_table=11
atggttaaatttattttctttcggtggattagaagcagcattcatttggccgattgtattagggttatattggaggaaaggaaatgcaacaggagcgcttgcctccattttagttggagtaagctcatatatgtgcattcatcttttctatccaaatccgttcggtatacatacagttgtcttcccgattttttttgcgtttatcgcttatatcttaggaagcatggttgctgtgaagaaaaacagtataggttagatgaaaaacgtagtccttacaggactgcgttttttcgtataaatttgttctttttattctgtaatcctgtgaatattcataaattaataacaattgaggggatggagttgagggcgatgaaaaaagtattatttttaggagacccaggaattgatgactctttagcaattatgtatggattgttgcatcctgatattgatattgttggtgtagtaactggatatggaaatgtaacgcaagaaaaggcgacaagtaatgcggcatatttattgcaactggcaggacgggaagatatacctattattaatggtgcgaaaatccctttatctggagatattacaacgtattatccagaaattcatggggcggaaggcttaggaccaattcgaccgccgaaaaatctttctccaaatataaggcctttttgtgagttttttgacattcttgaaaaatataaaggagaattaattatagttgatgctgggaggtcaacgacacttgcaacagcatttattttagaaaaaccattgatgaagtatgtgaaagaatattatataatgggcggtgcttttttaatgcctggaaatgttacaccagtcgcagaagcgaattttcatggtgaccctattgcatcacaattagtcatgcaaaatgccaagaatgtgacgttggtgccgctgaatgttacatctgaagctataatcacgccagagatggtaaagtacattacgaaacattctaaaacgagtttcaataaattaattgaaccgatttttacgtattattataaagcttatagaaagttaaatccgaaaataacaggaagtccggtacatgacgttgttacaatgatggtcgcggcgaatccttcaatactggattatgtgtatcgtcgtgtagatgtagatacagtggggattgcaaaaggagaaagtattgcagatttccgtcctcaacctgatgcaaaagccttaaaaaattgggtacgaattggttggtcattacattataaaaaattccttgaggattttgtgaaaatcatgacgtag

SEQ ID NO: 91291 - protein, 434 aa, Bacillus cereus ZK
MVKFIFFRWIRSSIHLADCIRVILEERKCNRSACLHFSWSKLIYVHSSFLSKSVRYTYSCLPDFFCVYRLYLRKHGCCEEKQYRLDEKRSPYRTAFFRINLFFLFCNPVNIHKLITIEGMELRAMKKVLFLGDPGIDDSLAIMYGLLHPDIDIVGVVTGYGNVTQEKATSNAAYLLQLAGREDIPIINGAKIPLSGDITTYYPEIHGAEGLGPIRPPKNLSPNIRPFCEFFDILEKYKGELIIVDAGRSTTLATAFILEKPLMKYVKEYYIMGGAFLMPGNVTPVAEANFHGDPIASQLVMQNAKNVTLVPLNVTSEAIITPEMVKYITKHSKTSFNKLIEPIFTYYYKAYRKLNPKITGSPVHDVVTMMVAANPSILDYVYRRVDVDTVGIAKGESIADFRPQPDAKALKNWVRIGWSLHYKKFLEDFVKIMT

SEQ ID NO: 91292 - DNA, 972 bp, Burkholderia pseudomallei K96243
  CDS (1)..(972): transl_table=11
atgagcctgcacaagatcctctacgacacggatccgggcgttgacgattcgatggcgctcgtgttccaggcgctgcatccggacatcgagctgctcggtgtgacgagcgtgttcggcaacgcgacgatcgacacgacgacccgcaacgcgctgtatctcgccggccgcttcgcgcccggcgtgcccgtcgcgcgcggcgcggccgcgccgctgcggcggccggcgcccgagccgctcggcggcattcacggcgacgacggcctcggcaacacgggcctgagcgtgtccgtcgacgtcgcggccgcgccgaacctcgacgcgcggcccgcgcatcgcttcatcatcgacacggtgcgcgcgcatccgcacgaaatcacgctgcttgcggtggggccgctcacgaatctcgcgcacgcgctcgccgaggatccgcaagtcgcgatgctcgtcaagcaggtcgtcatcatgggcggggcgttcggcaccgcgggcgtgctcggcaacgtatcgcccgccgccgaggcgaacatcgcgggcgatcccgatgcggccgacatcgtgatgtcggcgccatggccgctcgcggtcgtcgggctcgacgtcacgcaagccacgatcatgacgaccgagtatctcgccgcgctgcgcgacgacgcgggcgaggccggccgcttcgtatgggacgtgtcgcgccactacgaggcgttccatcgcgcgagcgcggggctcgccgggatctacgtgcacgattcgtcggcggtcgcgtatgtggtcgcgcctcagctgtacaggacgcgcacgggcccggtgcgcgtgctgacgagcggcatcgcggtcggcgagacgatccagaagccggcggcgatgaccgtgcccgcgcccgactgggacggacggccgccgcgcgacgtgtgcgtcggcgtcgacgcgaacgcgctgctcgcgctctaccgcaagacgctcgtcggctga

SEQ ID NO: 91293 - protein, 323 aa, Burkholderia pseudomallei K96243
MSLHKILYDTDPGVDDSMALVFQALHPDIELLGVTSVFGNATIDTTTRNALYLAGRFAPGVPVARGAAAPLRRPAPEPLGGIHGDDGLGNTGLSVSVDVAAAPNLDARPAHRFIIDTVRAHPHEITLLAVGPLTNLAHALAEDPQVAMLVKQVVIMGGAFGTAGVLGNVSPAAEANIAGDPDAADIVMSAPWPLAVVGLDVTQATIMTTEYLAALRDDAGEAGRFVWDVSRHYEAFHRASAGLAGIYVHDSSAVAYVVAPQLYRTRTGPVRVLTSGIAVGETIQKPAAMTVPAPDWDGRPPRDVCVGVDANALLALYRKTLVG

SEQ ID NO: 91294 - DNA, 1068 bp, Nocardia farcinica IFM 10152
  CDS (1)..(1068): transl_table=11
gtgcggcagaagatcatcgtggacgtcgataccggcatcgatgactcgctggcgctgctgtatctgctggcctcccccgaggccgagatcgtcggcatcgccgcgacggcgggcaatgtgagtgcggcgcaggtggccgccaacaacctggcctggctggacgtgtgcagggcgccggcgatcgaggtcgccctcggtgccgccgcaccgttggcgatcccgctgcgcaccaccgaggacacccacggcccgcagggggtcggctacgccgaactgcccacctcggcccgcccgctctcggaccgctcggccgcgcagctgtgggtcgacctggcccgcgcgcatcccgggcagatcaccggactgtgcacgggaccgctgaccaacctggcgctggccctgcgactcgagcccgccctgccgctgctgttgcgcaggctggtggtgatgggcggggcgttcaaccatcccggcaacaccacgccgaccaacgagtggaacgtccacgtcgatccggaggcggccaaggcggtcttcgacgccttctccgccgccccgcccgaacgcaggccgctgatctgtgccctggacatcaccgagaccatcgagatgcacccgcaccacctcgccgagctcgcccggcgggcgggcagcacgccggtggaacagcccgcccccaccgatccgcccggcacgcggtcgacggccgccaacccggtgatccggcacgtcaccgacgcggtgcgcttctacttcgaattccacgacgcctacgaccagggctatctcgcgcacatgcacgacccgttcgccgccgccgtcgcgctcgaccccgcgctggcccgggtgcggcccgccaccgtggacgtcgagctcaccggcaccatcacccgggcgaccacggtcgccgactgggcgggcatgtggggcaggcccttcaatgccgacatcgtgctcggcaccgacccggcgctgttcttcgagcgcatgatcgaccgcgtcggcgcgtacgcgcggtcgctgtacccgcccgtggcgaatctgcccgcgacacaggaggttccgtga

SEQ ID NO: 91295 - protein, 355 aa, Nocardia farcinica IFM 10152
MRQKIIVDVDTGIDDSLALLYLLASPEAEIVGIAATAGNVSAAQVAANNLAWLDVCRAPAIEVALGAAAPLAIPLRTTEDTHGPQGVGYAELPTSARPLSDRSAAQLWVDLARAHPGQITGLCTGPLTNLALALRLEPALPLLLRRLVVMGGAFNHPGNTTPTNEWNVHVDPEAAKAVFDAFSAAPPERRPLICALDITETIEMHPHHLAELARRAGSTPVEQPAPTDPPGTRSTAANPVIRHVTDAVRFYFEFHDAYDQGYLAHMHDPFAAAVALDPALARVRPATVDVELTGTITRATTVADWAGMWGRPFNADIVLGTDPALFFERMIDRVGAYARSLYPPVANLPATQEVP

SEQ ID NO: 91296 - DNA, 933 bp, Photobacterium profundum SS9
  CDS (1)..(933): transl_table=11
atgtctcgccctatcattatcgattgtgatcctggtcatgacgatgcaatcgcacttattcttgcttgtgctagcccagagcttgatataaaagcggttactaccagtgccggtaatcaaacccccgaaaaaaccctgcataatgcattacgcattcttacgttagtgggcagaacagacattcccgtcgcaggtggtgctctacagcccctttctcgtgaattgatcattgcagataacgtacacggtgaaacaggattagatgggcctgtactacccgaacctgcgtttgaaccacagccttgccatgctgttgaactaatggctaaaatactgacagaagcgacagaacccgtcacgcttgtaccgacaggtcctcttactaatattgccttattattggcgacccatcgtgaactgcacagtcaaattgatagcattgtattgatgggtggctcagcggaagccggtaattggaccccagcagctgaatttaatatttacgttgatcctgaagcggccgatatcgtttttaaatcgggcattcctatcactatgtgcggtttagatgttacccatagagcacaaatcatggatgaagatatcgagaaaattcgtaagataaacaatccagtcgctcaagtgactgctgaattacttgatttctttatgatttatcatcgcgatccaaaatggggctttgaaggggcgcctttgcacgatccttgtaccattgcttggttattagaaccagaactgtttgcatctatcaattgctgggtaggtatcgaaacacaaggaagccatacattaggtatgacagtcgtcgatcgctatcagctaaccgataacccaatcaatacaacggtgctgtttgatgtgaatcgccaaggttttgtcgacttattagcagaacgtcttgctaattactga

SEQ ID NO: 91297 - protein, 310 aa, Photobacterium profundum SS9
MSRPIIIDCDPGHDDAIALILACASPELDIKAVTTSAGNQTPEKTLHNALRILTLVGRTDIPVAGGALQPLSRELIIADNVHGETGLDGPVLPEPAFEPQPCHAVELMAKILTEATEPVTLVPTGPLTNIALLLATHRELHSQIDSIVLMGGSAEAGNWTPAAEFNIYVDPEAADIVFKSGIPITMCGLDVTHRAQIMDEDIEKIRKINNPVAQVTAELLDFFMIYHRDPKWGFEGAPLHDPCTIAWLLEPELFASINCWVGIETQGSHTLGMTVVDRYQLTDNPINTTVLFDVNRQGFVDLLAERLANY

SEQ ID NO: 91298 - DNA, 969 bp, Photobacterium profundum SS9
  CDS (1)..(969): transl_table=11
atgacaacaaaaattattttagataccgatcctggaattgatgatgcaatggcaatcttatttgccgaagcacaccctgcattagatttagttgcaattacaacggtttatggcaatgcaactatcgacaatgccacccgtaatgcgctttatttaaaacagaaattcaatttcactgcagatatcgcaaaaggggcaagtaagccgcttcatcgcccacccgttggcgcgaccgttgttgtacacggtgaaaccggatttggcgatctcacagcacctgatgacattacagagcaagcagaccctcgccctgcttaccaatacataatcgacacagttaaagctaaccccggcgaaattatattggtcactgtgggcccattaaccaacattgctctagcacttgaagctgcacccgagatcgcaggcttagtcaaagaagttgtcgtgatgggtggggcatttggaatgaatgatcaccgtggcaatgtgactccgtatgctgaagccaatattcatgatgacccccacgcggcagatatcgttttttgtgcctcatggccagtcgttataattggtttagatgttactgaacaaagctttttcactggccaatatctcgatgaattacgcgatgatgctggtgaagtaggtcaatttatttgggatgtaagccgttattatttgcgtttctactctcaaaaagttgggctaaatggctgccatgttcatgatccttctgccatcgtgtatgtcatcaaccccgacttatttacattacgtgaaggtgccgtgcgggttgtaacggatggccccgcagaaggtatgacgattcaaaagtttgatgaccgtaaatatatgaatgatgaatggtcatcaatgcccaatcaacgcgtgggcattgccgttgacgatcaagcgctgttaaaactgtatcgtgaaagcttaattgcatacagtcagcaataa

SEQ ID NO: 91299 - protein, 322 aa, Photobacterium profundum SS9
MTTKIILDTDPGIDDAMAILFAEAHPALDLVAITTVYGNATIDNATRNALYLKQKFNFTADIAKGASKPLHRPPVGATVVVHGETGFGDLTAPDDITEQADPRPAYQYIIDTVKANPGEIILVTVGPLTNIALALEAAPEIAGLVKEVVVMGGAFGMNDHRGNVTPYAEANIHDDPHAADIVFCASWPVVIIGLDVTEQSFFTGQYLDELRDDAGEVGQFIWDVSRYYLRFYSQKVGLNGCHVHDPSAIVYVINPDLFTLREGAVRVVTDGPAEGMTIQKFDDRKYMNDEWSSMPNQRVGIAVDDQALLKLYRESLIAYSQQ

SEQ ID NO: 91300 - DNA, 960 bp, Haloarcula marismortui ATCC 43049
  CDS (1)..(960): transl_table=11
atgcgacgcgtcatcatcgatacggacaccgcgggcgacgacacacaggcgattctccttttctgtctcagtgaccgagttaccgtcgaagctatcacggtcgttgccgggaacgtgcccttcgacagagaggtcgagaacgcgaattacacgctcgaactcgccgattcactcgacgtgcccgtctacgaaggggcgagacagccgcttctcaaggagttcgaacacgcggcgtatatccacggtgaggatggcctcggcggcgacctgtttcccgaaacggacatcgaatcagcgagcggatttggaccagatgagatcgtcgaccgctgtcgggcggcccctggcgaaatcacgctgctctgcatcggcccgctgaccaatctggcgctggcgtacgcccgcgagcctgaacttccggagcttgtcgatgaggtgtgggtgatgggcgggaacgtcaactgtgaggggaacgtcactcctgccgcggaattcaatctgtgggtcgaccccgacgctgccaaacgcgtgttcaacgccttcgaggtgacgcttgtcgactggggtgtgtgtcttcgagacgcggtgtttggctcatccgagttcggagcagtatcagcgttcgacactgagctggcgtcgttcttcgagtcggtaaccgagcaggcccgggcgttcaacagcgagggccccgacgaccccggatggacggcactcccggacagcgtcaccgccgcgctgctggcgtatccggaactccgcgaggcggtgtcgacgtaccacgtcgcggtggacgaccgcgacgggctcacccgcgggtacaccagcgtcgacgtcaacggtgtgaccgacggggacccgaacacccatgtcgtagaatccgtcgacagcgacgccttccagtccgtcatgtactcgctgctccagtcccgggaccctgacagcggcatcgccgagtga

SEQ ID NO: 91301 - protein, 319 aa, Haloarcula marismortui ATCC 43049
MRRVIIDTDTAGDDTQAILLFCLSDRVTVEAITVVAGNVPFDREVENANYTLELADSLDVPVYEGARQPLLKEFEHAAYIHGEDGLGGDLFPETDIESASGFGPDEIVDRCRAAPGEITLLCIGPLTNLALAYAREPELPELVDEVWVMGGNVNCEGNVTPAAEFNLWVDPDAAKRVFNAFEVTLVDWGVCLRDAVFGSSEFGAVSAFDTELASFFESVTEQARAFNSEGPDDPGWTALPDSVTAALLAYPELREAVSTYHVAVDDRDGLTRGYTSVDVNGVTDGDPNTHVVESVDSDAFQSVMYSLLQSRDPDSGIAE

SEQ ID NO: 91302 - DNA, 927 bp, Haloarcula marismortui ATCC 43049
  CDS (1)..(927): transl_table=11
atgtcacgcaaagtcttctttgatacggaccctggctgcgacgacgcggtcatgctggcgatggcgctcggtcacgatgcaatcgatgttgtcggtctctcgactgtctgcgggaacacgactatcgagaacacgacgcgaaacgcccacgcgatactgggcctcggtggctacgacgttccggtgtcccggggctgtggtcgcccgctcgtcgacgacctcacgaccgccgagtggattcacggcgagaacgggctccacggcgacatccccgacgccgacggcaacacacgggatatccacggggccgatgcaatcgtcgaagccgcccacgagtacggcgacgaactgacgatcgcggccgtcggtccgcttccgaacctggcgattgcactggccaaggagccgcggttacccgacctcgtcgacgacatctatctcatgggtggggcggcgatgacgaccgggaacgtgacgccgatggccgaggccaacttccacaacgaccccgcggcggccagccgcgtcctgcaggacgccaccacgcggatggtcgggctggatgtgaccaaccacgccaccgtctctcccgagttcatcgaggagttccgcacggccgatggcatccgggggactgtcgcccagtggctcgactaccggcccgactccggaacctacccactggccgacgcgccggccatccacgacgccgctgtcgtcgccgacatcattgacgaaacggtgctcacttttgaggagtactaccttgaggtagacacgaccggcggcccctgccacggggccgtcatctgtgacgagtacggcacgaccgacaacgagccaaacagccgtgtcgctgtcgacattgacgtggaccgttaccgcgaagtgctcgaagccggcgttagggcttacgcggcggaataa

SEQ ID NO: 91303 - protein, 308 aa, Haloarcula marismortui ATCC 43049
MSRKVFFDTDPGCDDAVMLAMALGHDAIDVVGLSTVCGNTTIENTTRNAHAILGLGGYDVPVSRGCGRPLVDDLTTAEWIHGENGLHGDIPDADGNTRDIHGADAIVEAAHEYGDELTIAAVGPLPNLAIALAKEPRLPDLVDDIYLMGGAAMTTGNVTPMAEANFHNDPAAASRVLQDATTRMVGLDVTNHATVSPEFIEEFRTADGIRGTVAQWLDYRPDSGTYPLADAPAIHDAAVVADIIDETVLTFEEYYLEVDTTGGPCHGAVICDEYGTTDNEPNSRVAVDIDVDRYREVLEAGVRAYAAE

SEQ ID NO: 91304 - DNA, 942 bp, Silicibacter pomeroyi DSS-3
  CDS (1)..(942): transl_table=11
atgcccccccgcaagatcatcatcgacaccgaccccggccaggacgacgcggttgccatcctgctggcgctggccagccccgacgagctcgaggtgctgggcatcaccgccgtggccggcaacgtgccgctgccgctcaccgcaaaaaacgcccgtatcgtctgcgaactggcgggccgcgctgatgtcgccgtctacgccgggtgcgacgcgcccatcgcgcgcaagctggtcaccgccgaacatgtgcatggcaagaccgggcttgacggccccgacctgcccgacccggtgatgccgctgcaagaggcgcatgccgtcgatttcatcatcgacaccctgcgcgcccatgctccgggcacggtgacgctctgcccgctgggcccgctcaccaatatcgccaccgcattcacccgcgcgcccgacattgtctcccgcgtgcaggagatcgtgctgatgggcggcgcctatttcgaggtgggcaacatcacccccgccgccgaattcaacatctatgtcgatcccgaagccgctgatatcgtgttcaaatccggtgcgccgattgtggtgatgccgctcgatgtcacccacaaggcgcttgtcaccaaggcgcgcaacgatgccttccgcgcgctcggcacccccgccggcatcgccgtcgcccagatgaccgatttcttcgagcgcttcgacaaggagaaatacggctccgaaggtgcccccctgcacgacccttgtgtcaccgcctatctgctcaaccccgatctgttctcgggccgtcacatcaatgtcgccgtcgaaaccacctcggaactgaccctcggcatgaccgtggccgactggtggcgggtgaccgagcgggcgcccaacgcgctcttcatcggcgatctcgacgccgagggcttcttcacgctgctgaccgaccgtctggcgcgcctatga

SEQ ID NO: 91305 - protein, 313 aa, Silicibacter pomeroyi DSS-3
MPPRKIIIDTDPGQDDAVAILLALASPDELEVLGITAVAGNVPLPLTAKNARIVCELAGRADVAVYAGCDAPIARKLVTAEHVHGKTGLDGPDLPDPVMPLQEAHAVDFIIDTLRAHAPGTVTLCPLGPLTNIATAFTRAPDIVSRVQEIVLMGGAYFEVGNITPAAEFNIYVDPEAADIVFKSGAPIVVMPLDVTHKALVTKARNDAFRALGTPAGIAVAQMTDFFERFDKEKYGSEGAPLHDPCVTAYLLNPDLFSGRHINVAVETTSELTLGMTVADWWRVTERAPNALFIGDLDAEGFFTLLTDRLARL

SEQ ID NO: 91306 - DNA, 933 bp, Bacillus clausii KSM-K16
  CDS (1)..(933): transl_table=11
gtggccagaaaaatcttacttgacgttgatacaggcgtagatgatgccctcgccattatccttgcctccaaaagcacggacgcacaactgcttgcaattacgacagtgaacggaaatgtttctttagaaaaagcgactgttaacacgttaaaagtgttgacacttcttcataaagagggcgacattcccgttatccaaggggctcatgcgccacttcggcgcccgtgcttttttgaacatagcgtccacggcaatgacggccttggcggtgctttgcctcattttgagccaacggcacagcctgccgacggttatgctcctgattatataatcgaacaggcaaaccgttatccaggcgaactcacgcttgtcatgacagggccgctgacgaacttggcgttagcgcttgaaaaatgccctgatttgccaaaactcgtggcgggcgtcgtctatatgggtggtgccgcctttacacatggcaatgtcacccctgtggctgagtacaacatgtatgtcgatcctgaagcagcgcgcaaggtgatccatgccggcttcgccccccttgtgcaagtcggattagatgttacccgcaaagcacttctcactagggaaaacattggatcgctcgttgactcgcctatcaagcagtttatcaaaacgtgcaccgcagactatataaaacggtatgaagcgcgcaacaccgtggcagcttgtgccctccacgatcctcttgccgttgcttatgccttaaaacccgaattgctccatttggaagagatgtttgtggaagtagaaacaaacagccaattttgcgatgggcagacggtatgcgacaggcaacagcgcttaggaaaaccggcaaacgttaacgttgccactgagatcgacagcgatgcatttttatcgtactttttgcattcaattcaaaactga

SEQ ID NO: 91307 - protein, 310 aa, Bacillus clausii KSM-K16
MARKILLDVDTGVDDALAIILASKSTDAQLLAITTVNGNVSLEKATVNTLKVLTLLHKEGDIPVIQGAHAPLRRPCFFEHSVHGNDGLGGALPHFEPTAQPADGYAPDYIIEQANRYPGELTLVMTGPLTNLALALEKCPDLPKLVAGVVYMGGAAFTHGNVTPVAEYNMYVDPEAARKVIHAGFAPLVQVGLDVTRKALLTRENIGSLVDSPIKQFIKTCTADYIKRYEARNTVAACALHDPLAVAYALKPELLHLEEMFVEVETNSQFCDGQTVCDRQQRLGKPANVNVATEIDSDAFLSYFLHSIQN

SEQ ID NO: 91308 - DNA, 933 bp, Bacillus clausii KSM-K16
  CDS (1)..(933): transl_table=11
atgacaaaaaaagtgctgatgttttgcgaccctggtatcgatgattcattggcgattatgtatgcactttctgccccttttattgaactaatcgggcttgtcgttagttacgggaatgtcagtaagaagcaagcagttacaaacgctgcgtatttgctccatttagcggggcggacagacatcccgcttatatctggggcaagcatgccaattgttgaggaaaatttagtatactatcctaatattcatggagagagcggaatgggtccgattcaattgcctgcccatgacgagattccagtccggccatttgcgactgttcctgaaatcattgcccgttttcaaggagaagtgatcattgtcgatacgggaagaatgacagcgctcgcagctgcttttgtcggatttgagaaagaaatgaaagatgtccattctttttatgtaatgggaggagccttttttattccaggaaacgccactccactagctgaagcaaatgtttacggcgacccccacgcggcacagcttgttataagccgtgctactccgttaacgcttgcccccttaaacgtcaccaaccaggcggtgctaccagcaatagtagtggacaagtgggcagaacaagcaaaaaatccattttctcacgttatacgggcgatttgctcccattacatcgaggcgcaccagcaaatgatgcctggcagccttggggcccctattcatgatttggtgccgctgatgctcatccggacaccggaaatggctggttatattgaacgtccaattgaaattattacatatggcaaagaacaaggactgacctatgttgattttcgtcctgggatgagaaatgaaggccctcgaattgccgtcacgcttgattacccgctgtttttgcgaacgttcaaggaaggagtggggttatcttcatag

SEQ ID NO: 91309 - protein, 310 aa, Bacillus clausii KSM-K16
MTKKVLMFCDPGIDDSLAIMYALSAPFIELIGLVVSYGNVSKKQAVTNAAYLLHLAGRTDIPLISGASMPIVEENLVYYPNIHGESGMGPIQLPAHDEIPVRPFATVPEIIARFQGEVIIVDTGRMTALAAAFVGFEKEMKDVHSFYVMGGAFFIPGNATPLAEANVYGDPHAAQLVISRATPLTLAPLNVTNQAVLPAIVVDKWAEQAKNPFSHVIRAICSHYIEAHQQMMPGSLGAPIHDLVPLMLIRTPEMAGYIERPIEIITYGKEQGLTYVDFRPGMRNEGPRIAVTLDYPLFLRTFKEGVGLSS

SEQ ID NO: 91310 - DNA, 1008 bp, Campylobacter jejuni RM1221
  CDS (1)..(1008): transl_table=11
atgagacttatcttagacacggacataggcaatgctattgcaggagcaaatactgatgatggtttagcacttgctttgattttgtcatctaaagaaatcaaacttgaaatgctaagcacagtttgcggtaatgttccaagccttgttgcctatagtgtggctaaggatttatttaaacgtttaaatttaaatatccccgtttatttgggagcgaatgaagccctaaaagaaccaagtaaagcttggcgtcaaagacttgatgaaagtgttaaaaattttaaacttgaatatctttgggaaaatataaaaagtcctgaaattttagaaaatataaatcctgatgcgatttttaaaatgggtgagttggtgagtaaaaatcctaaagaaatttctatttgtgcgataggacctttgacaaatatcgctatgactatgaaaatttttaaagattttgatataaatcttaaagagctttttattatgggcggcagttttgatatgccttattacactaaagatacaaattttggttttgatcctgaggcggctagtatagtgctaaattcaagagctaaaattacactcgtaccttataatgcaaccatgcagactttattaacacacgaggatttaaaagagttgcaaggtaagaatattttatgtgattttatcgttgaaactttaggtgtttggattgattatgcctctaaaacacgtggtacaaagggaacttggatacatgatgctttaacgatagcttacgcattagattctagtattgcagattttgatgagtgttatgctgatgttatttgcgatagttctttggcaagaggtatgagttggcgttgttttaaagaaccaaaaatgagtatgggggtggatttaagcactaaaaattgtgttaaaattctaaaaaatgtagacaatgcaaagcttttaaaacttataaaagagaagtttttaaaaggagtttgctatgaaaattatgaaagcataacgacttaa

SEQ ID NO: 91311 - protein, 335 aa, Campylobacter jejuni RM1221
MRLILDTDIGNAIAGANTDDGLALALILSSKEIKLEMLSTVCGNVPSLVAYSVAKDLFKRLNLNIPVYLGANEALKEPSKAWRQRLDESVKNFKLEYLWENIKSPEILENINPDAIFKMGELVSKNPKEISICAIGPLTNIAMTMKIFKDFDINLKELFIMGGSFDMPYYTKDTNFGFDPEAASIVLNSRAKITLVPYNATMQTLLTHEDLKELQGKNILCDFIVETLGVWIDYASKTRGTKGTWIHDALTIAYALDSSIADFDECYADVICDSSLARGMSWRCFKEPKMSMGVDLSTKNCVKILKNVDNAKLLKLIKEKFLKGVCYENYESITT

SEQ ID NO: 91312 - DNA, 909 bp, Staphylococcus epidermidis RP62A
  CDS (1)..(909): transl_table=11
atgtctattcccattataattgatactgatcctggtatagatgatgctacagcaattagtatcgcactttcacaccctcaatttgacgttaaaatgatatcaactgtgaatggtaatgtaggtattgagaaaacgacagcaaatgcattaaagctaaaaaggttttttaatagttctgttcctgtacatagaggggcatcccaaccattgattaatgacatctttgaagctacatcaattcatggtgagtctggtatggatggttacgagtttccacaaataaatcaagatgatttaacatcaattcatgcagttgaagcaatgagaaatctattagtaaatactcaagaacctttaaccttgattgccataggtccactaacaaatatcgctattcttttaactagttatcccgaagttcaaccatttattaaggaaattgttttaatgggtggtagtaccggtagaggtaatgtaacgcctttagctgaatttaatatatattgtgatccagaagctgctcaaattgtatttaactctggattacctttgactatgattggtcttgatttggctcgtgaagcattgtttactcaccattttgtaaaagacttcaaagatacaaatgcaacttcaaacatgttatataatttatttcagcactataagagtgaagattttgaaataggatttaaattatacgatgtattcactatattatatttgttggatccagaagcctttaatgtcaaggaggcgtatactcaaatagaattaaatggcaactttacaaggggagccacagtggtagactttaatatggagcatcccaattgtacagttgttttaagtcctgttgaaagacagtatgaggatttattcttaaacgccctttcttattgtaaataa

SEQ ID NO: 91313 - protein, 302 aa, Staphylococcus epidermidis RP62A
MSIPIIIDTDPGIDDATAISIALSHPQFDVKMISTVNGNVGIEKTTANALKLKRFFNSSVPVHRGASQPLINDIFEATSIHGESGMDGYEFPQINQDDLTSIHAVEAMRNLLVNTQEPLTLIAIGPLTNIAILLTSYPEVQPFIKEIVLMGGSTGRGNVTPLAEFNIYCDPEAAQIVFNSGLPLTMIGLDLAREALFTHHFVKDFKDTNATSNMLYNLFQHYKSEDFEIGFKLYDVFTILYLLDPEAFNVKEAYTQIELNGNFTRGATVVDFNMEHPNCTVVLSPVERQYEDLFLNALSYCK

SEQ ID NO: 91314 - DNA, 942 bp, Staphylococcus epidermidis RP62A
  CDS (1)..(942): transl_table=11
atgaccaaagtatattttaatcatgatggtggcgttgatgatctagtgtcactatttttattattacaaatggaaaatatagaacttgttggcgtaagtacgattggtgcagactgctatttagagccttcattaagtgcttcattaaagattataaatcgtttttcagacgttgaaattaatgtagcaccatcatatgaaagagggaaaaatccttttccaaaagaatggagaatgcatgctttctttatggatgccttaccagtgctaaatgagtcttgtatacccaaaagatgcaaggctagtgaggacgaggcgtatatagatattattcgtaaagtgaagagttgtgatgagaaagttacattgttatttactggaccgcttacagatttagctaaagctataaaatatgacaactcaattttaaaaaatatagagaaattagtttggatgggtggaacgtttttagacaaaggaaatgttgaagaaccagaacatgatggtacagctgaatggaatgcattttgggatcctgaggctgtaaaagttgtattagatagtgatatgaatgtcgatattgttgctttagaaagtacaaatcaagtccctctaacaatggaagttcgtcaaatgtgggcagataaaagacaatatttaggcgttgattttctgggcacaagttacgcagcagtaccaccactcacacattttgtgaccaattcaacatactttttatgggatgtattaactactgcttatgtgggttctccaaatttagttgaatcaacgaaattgaaaattgatgtagtcagtcaaggacctagtcaagggagaacattccaatctgaatatggacgtgaagttcaagtcattacggatgtaaataaacaagcattttttaactacataacggatttagcaaagaaaatcgagtcctaa

SEQ ID NO: 91315 - protein, 313 aa, Staphylococcus epidermidis RP62A
MTKVYFNHDGGVDDLVSLFLLLQMENIELVGVSTIGADCYLEPSLSASLKIINRFSDVEINVAPSYERGKNPFPKEWRMHAFFMDALPVLNESCIPKRCKASEDEAYIDIIRKVKSCDEKVTLLFTGPLTDLAKAIKYDNSILKNIEKLVWMGGTFLDKGNVEEPEHDGTAEWNAFWDPEAVKVVLDSDMNVDIVALESTNQVPLTMEVRQMWADKRQYLGVDFLGTSYAAVPPLTHFVTNSTYFLWDVLTTAYVGSPNLVESTKLKIDVVSQGPSQGRTFQSEYGREVQVITDVNKQAFFNYITDLAKKIES

SEQ ID NO: 91316 - DNA, 969 bp, Gluconobacter oxydans 621H
  CDS (1)..(969): transl_table=11
atgatgacacaggccggctccgcaccgatcgcaccccgccgcatcgtcatcgacaccgatccgggtcaggacgacgcggttgccatcctgctggcgctggcctcgccggaactgacggtcgaggccatcacgaccgttgccggcaatgtgcccgttgccctgacgacgaagaatgcctgcgccctgctcgaactggcaggccgtaccgacattcctgtttttgcaggcgcggcacgtccactgcatcgcgctcccatcagcgccgagcacgtccatggtgaaacgggcatggccggcgccgatcttccggaaccgacgctgcgcccacaggcgattgatgccgcgacttggctcgtggacctgctgcgtcgtgaacccgagggcgcgatcacgctcgtctgcctcggcccgatgaccaatctggctctggctttgacccacgcgcccgatatcgcgtcccggatcgcgggagtcgtggctatgggcggggcgcagcgcgaaggcggcaacatcacgccgaccgcagaattcaattttttcgtggacccgcacgccgcccggatcgtcatgcattccggcatccccatcacgctcctgccgctggacgtgacgcatcgcgccatcgccacaccggcccgtctggcgctgatcgccgcggtcggcacgccggtgacggacatggtggtgcggatgctgggcgcggaagaccgcttcgagaagctgaaatacggctgggagggcggtgcgctgcatgatccgctcaccatcggcttccttctgtggcccgagcttttctctgggcgcgactgcaatgtggaaatcgaggtcgacgcccccctgtgcatgggtcagagtgttgttgacctgtggaacgtaaccgatcgcgttccgaacgcgttatggatcaatgacgttgattcagacgccttctattcccttctgacggaaagacttgcccttctggactag

SEQ ID NO: 91317 - protein, 322 aa, Gluconobacter oxydans 621H
MMTQAGSAPIAPRRIVIDTDPGQDDAVAILLALASPELTVEAITTVAGNVPVALTTKNACALLELAGRTDIPVFAGAARPLHRAPISAEHVHGETGMAGADLPEPTLRPQAIDAATWLVDLLRREPEGAITLVCLGPMTNLALALTHAPDIASRIAGVVAMGGAQREGGNITPTAEFNFFVDPHAARIVMHSGIPITLLPLDVTHRAIATPARLALIAAVGTPVTDMVVRMLGAEDRFEKLKYGWEGGALHDPLTIGFLLWPELFSGRDCNVEIEVDAPLCMGQSVVDLWNVTDRVPNALWINDVDSDAFYSLLTERLALLD

SEQ ID NO: 91318 - DNA, 927 bp, Lactobacillus acidophilus NCFM
  CDS (1)..(927): transl_table=11
atgaccaaaaaacctttaattattagtactgatccaggaattgacgacatcgctgcaatgactatcagcctttttgcggacgaactcgatgttcgaatgatcgttccaacttgggggaatgtagcacttaaatatactgtgcaaaatacgcttaatttggaaaaatttttacacaccaaggttcctgtagtagttggtgccaatcaaccactggttgcaccaatgattagtgctgcatcagtacatggaaaaactggaattgccggttttgaatttgaaaaggcgaatactgatctcattaagccggggattgctgccactttaatggctgaagaaattaagaatagtccagaaaaagtgacattgatggggattgggcctttgactgattttgctttactttttaagcaatatcctgaagtaaaggataatgttgaacaaatcgtgatcatgggtggaaatattggtcgcggtaaccatagtccgcttgccgaatacaatatcgctggtgacccagaagcagctcaagtggtctttcatagcggtttaccaatcaaggtggctccacttgaaattggtaataaagctcatcttacaccagatcaaatgagtaagattgaaaaatgtggtgaagtgggtaatatgctttactcactcttttcacacattcacgaaccagatggtgatcctagaatcaagatctatgatccaacagccgtaggcattttgcttcatcctgaaatgtttacaatgaaaaaggccaacgttgaaattgaacttcgtggccaattcacttatggtgcaagtgtcatcaacttcatggatcaagagcatgcaaatgcggaaattgcgactgatgttgatttagacaagtttgcaaaatggtttatcgatagtatcaaaaaagctgatcaaggaagagaataa

SEQ ID NO: 91319 - protein, 308 aa, Lactobacillus acidophilus NCFM
MTKKPLIISTDPGIDDIAAMTISLFADELDVRMIVPTWGNVALKYTVQNTLNLEKFLHTKVPVVVGANQPLVAPMISAASVHGKTGIAGFEFEKANTDLIKPGIAATLMAEEIKNSPEKVTLMGIGPLTDFALLFKQYPEVKDNVEQIVIMGGNIGRGNHSPLAEYNIAGDPEAAQVVFHSGLPIKVAPLEIGNKAHLTPDQMSKIEKCGEVGNMLYSLFSHIHEPDGDPRIKIYDPTAVGILLHPEMFTMKKANVEIELRGQFTYGASVINFMDQEHANAEIATDVDLDKFAKWFIDSIKKADQGRE

SEQ ID NO: 91320 - DNA, 939 bp, Xanthomonas oryzae pv. oryzae KACC10331
  CDS (1)..(939): transl_table=11
atgactgacaagataccgctgctgatcgacaccgacccgggcgtagacgacgcgctggcgctgctgatggctttcaacgacgcccgccatgaggtggtcggcctgaccatcgctgccggtaacgttggcctggagcacaccgtgcgcaacgccttgaaggtctgcgagatcgccggtcgcgccgacgtgccggtctacgccggctgctcgcagccgttgctgcacccgtcggtggacgcggcccacgtgcacggtctcgacggcttcggcgatgtcggtctgccaccggccaagcgcactgccgaagccgaacacgccgcactcgccatcctgcggctgtcgcaccaacatgccggcaaattgctgttggttgcgcttggcccgctgaccaatcttgccctggcactgatcctggacccgaccctgccaacgcgcgtggcgcgcttggtggtgatgggcggggcgctgaccgggcacggcaacatcaccgccgccgccgagttcaatatcggtttcgacccggaagcggcgcatatcgtgttccgcggcttcccgcagttcgacgtcgccgactgggaagccaccatcgcgcacggcctgctgcaccgggacgtggagcagtggctggtggccgattctgctcgcgcccggttctacgaagagatctcgcgcaagacccgcttgcggtccaaggacagccgcggcgcgtactggtgtgccgccgacgcgttggcgatggcctttgccctgcacccggaaggcgcgcagcggctggaacagcgcccggtacacatcgaactatccggcacgcatacccgcggtatgaccctggtggactggaaccggcagggcggggcgtccgacaacgccaacctgctgttggcctatgacatccaacagttctacggcctggttggagcggccttggcggcgaactga

SEQ ID NO: 91321 - protein, 312 aa, Xanthomonas oryzae pv. oryzae KACC10331
MTDKIPLLIDTDPGVDDALALLMAFNDARHEVVGLTIAAGNVGLEHTVRNALKVCEIAGRADVPVYAGCSQPLLHPSVDAAHVHGLDGFGDVGLPPAKRTAEAEHAALAILRLSHQHAGKLLLVALGPLTNLALALILDPTLPTRVARLVVMGGALTGHGNITAAAEFNIGFDPEAAHIVFRGFPQFDVADWEATIAHGLLHRDVEQWLVADSARARFYEEISRKTRLRSKDSRGAYWCAADALAMAFALHPEGAQRLEQRPVHIELSGTHTRGMTLVDWNRQGGASDNANLLLAYDIQQFYGLVGAALAAN

SEQ ID NO: 91322 - DNA, 942 bp, Rhodobacter sphaeroides 2.4.1
  CDS (1)..(942)
atgaccccgccccgccggatcatcatcgacacggaccccggacaggacgacgccgtggcgatcctgctcgcgctggccagccccgaactcgaggtgctgggcatcaccgccgtggcgggcaacgtgccgctgcggctcaccgagcgcaatgcgcgcatcctctgcgagatcgcgggccggaccgacattcccgtcttcgcgggctgcgacgcgccgctggctcggcccctcgtcacggccgagcatgtccacggcaagaccggcctcgacgggccggccctgcccgaccccaccctgcccctgcaggagcgccacgcggtcgattacctgatcgagacgctgcgatccgagcccgcaggcagcatcacgctctgcccgctcggtcccctcaccaacatcgcggccatgcttcagcgcgcgccggacgtggcgccgcgcatccgcgagatcgtgctgatgggcggggcctatttcgaggtgggcaacatcacccccaccgccgagttcaacatcttcgtcgatcccgaggccgcggccatcgtcttcggcgccggcgtgccgctcgtcgtcatgccgctcgacgtgacgcacaaggccgtcaccgacagggcccgcgtggcgcggttccgcgagatgggcacccggatcggggagctggtcgaggaatggatggacttcttcgagcggttcgaccgcgagaaatacggcagcgagggcgcgccgctgcacgacccctgcgtgatcgcctatctcctcaaccccgacctcttcctcgggcggcacatcaatgtcgagatcgagaccgagggccgcttcaccaccggcatgacggtggcggactggtggcgggtgagcgaccggacaccgaacgcgctcttcatgcgcgacctcgatgcggacggcttcttcgcgctcctgaccgaacggatcgcgcggctctga

SEQ ID NO: 91323 - protein, 313 aa, Rhodobacter sphaeroides 2.4.1
MTPPRRIIIDTDPGQDDAVAILLALASPELEVLGITAVAGNVPLRLTERNARILCEIAGRTDIPVFAGCDAPLARPLVTAEHVHGKTGLDGPALPDPTLPLQERHAVDYLIETLRSEPAGSITLCPLGPLTNIAAMLQRAPDVAPRIREIVLMGGAYFEVGNITPTAEFNIFVDPEAAAIVFGAGVPLVVMPLDVTHKAVTDRARVARFREMGTRIGELVEEWMDFFERFDREKYGSEGAPLHDPCVIAYLLNPDLFLGRHINVEIETEGRFTTGMTVADWWRVSDRTPNALFMRDLDADGFFALLTERIARL

SEQ ID NO: 91324 - DNA, 927 bp, Lactobacillus gasseri
  CDS (1)..(927)
atgaaaaatatttattttaatcatgatggaaacatcgatgatttggtctcacttcttttactattgcaagcacctgatatcaaactaattggaatcagcgcaattgatggtgatggatatatcgatccagcagtagaagcttgtcgaaaaatggtcgataaatttaacttacgcggtgataagttagaagtagctcgctcaaattcacgtgcaattcatcaatttccaaaagagtggcgcatggcaacttattcctttaattacttccctattttgaatgaaagcggagaaattaaaacacctgaagctccacttcctgcccatttagatatgattgataaaattaaaaaggcagatggtccagttactctaatcatgaccggaccaattactgacctggcaagagctttagatgaagatgcttctattcagtcaaaaatcgaaaaagtttactggatgggtggttcattagatgggcacggcaatgtagtgagtgttgatgcagacgaaacgcaagaatggaatgctttctgggatccagaggctgtaagacgtgttctagattcagacctcgacattcaaatggtaggtcttgaaagtactgaagaattgccattaaccgatgaacttcgacagcactgggctagtttaagaaaatatccagctattgatttagttggcttaggatacagtctaattatctctgtacctaatgcagaactatacttgtgggacgttttaacaactatgtctgcattatatcctgaactcgttgaaactcgtcagattaaagccaatgtaattacttcaggcttagcaagcggacgaatgttcattgatcctaatggaaaagaaattactgaagtgacaaaagcagataaagattcattctttgaaaaaatagacaaaattttagaaagacaataa

SEQ ID NO: 91325 - protein, 308 aa, Lactobacillus gasseri
MKNIYFNHDGNIDDLVSLLLLLQAPDIKLIGISAIDGDGYIDPAVEACRKMVDKFNLRGDKLEVARSNSRAIHQFPKEWRMATYSFNYFPILNESGEIKTPEAPLPAHLDMIDKIKKADGPVTLIMTGPITDLARALDEDASIQSKIEKVYWMGGSLDGHGNVVSVDADETQEWNAFWDPEAVRRVLDSDLDIQMVGLESTEELPLTDELRQHWASLRKYPAIDLVGLGYSLIISVPNAELYLWDVLTTMSALYPELVETRQIKANVITSGLASGRMFIDPNGKEITEVTKADKDSFFEKIDKILERQ

SEQ ID NO: 91326 - DNA, 987 bp, Leuconostoc mesenteroides subsp. mesenteroides ATCC 8293
  CDS (1)..(987)
atgcaaaaagttataattgacacggatccaggaattgatgatagtttagcacttttggtcgcattaaaatcaccagagcttgatgttatcgccattactgttgtcgagggaaatgtccctacaaaaatcggtgttcagaatactctcaaagtgcttgaagaggtaggaaggactgatgttcctgtctttgaaggggcacatgaacccttgcaacatgagtacatcagtgcacaggatacccacggattggatgggttaggacaaagtaatattgctgtcccaatgatagaggccagcacaataagtgcccattcagcatacaatcagttactcaccaatcataatgatgtttgggtactggctttgggaccgttgacaaatattgcgctagccatgcaagaaaatcccaaggtttggcaaaatatgtcgcgcctaatcattatgggtggatcctatctttcgaatggaaatacctcaccagttgctgaatacaacttctgggtagatccgaatgcagctgattatgttttgaaaaatagtcctattgtagctgaaattgtcccattagatgttactcgaaaaatgttactgacaccaaatatcttgtcattaatgcagcgattgaatcctgagcaatcaatatttatcacaaaaatcattaagttttattttgattttcattggcaacaagaacacgtgatgggggcggttattaatgatccacttgtgattattcatgcattatatcctgagtatactcgtggcattagtaaatatgtcactgtagtaacagaaggtgtagccctcggacaaagcatagttgatatagctgatttttggaaaaaagaagcgaacgcagtgattttaacagaggtggattctttgcatgttatggcggaaatcatagctcgcctattggaaatttcgtcagcaaccatattgactgaattaaccaatattgccacagatcttgaggtattatcatga

SEQ ID NO: 91327 - protein, 328 aa, Leuconostoc mesenteroides subsp. mesenteroides ATCC 8293
MQKVIIDTDPGIDDSLALLVALKSPELDVIAITVVEGNVPTKIGVQNTLKVLEEVGRTDVPVFEGAHEPLQHEYISAQDTHGLDGLGQSNIAVPMIEASTISAHSAYNQLLTNHNDVWVLALGPLTNIALAMQENPKVWQNMSRLIIMGGSYLSNGNTSPVAEYNFWVDPNAADYVLKNSPIVAEIVPLDVTRKMLLTPNILSLMQRLNPEQSIFITKIIKFYFDFHWQQEHVMGAVINDPLVIIHALYPEYTRGISKYVTVVTEGVALGQSIVDIADFWKKEANAVILTEVDSLHVMAEIIARLLEISSATILTELTNIATDLEVLS

SEQ ID NO: 91328 - DNA, 948 bp, Leuconostoc mesenteroides subsp. mesenteroides ATCC 8293
  CDS (1)..(948)
atgacgattccacttatttttgatactgatcccggcattgatgatgcagcagcaatcgcaattttgttaactaatgatgactttgaagtacgtctgattacgtctgtttccggtaatgtttcggttgataagacaacaaacaatgttttgaaattaacacactattttaatcgaccagacgttaaggtggcccgtggtgctgagaaaccactagtcaaaccatttaaggatgcatcaaatattcatgggaagagcggaatgccaggttatgaatttggcgagctttctaccagaactataagtaaaaaagctgtagatgctattcatgaaacgctgaatagctatgatgatcaaacgacattagtagccgttggtgcattcactaatattgcaaacttaattcaaaagtatccacaagatttacaaaaaatagagcgattaatcgtaatgggtggttcgcttaccggtgggaatttaacatcggtggcagagtttaacgtatttacagatccggacgcagcgaaaattgtttttgaaagtgatttggatatcacaatgattgggcttgatgttactgaaaaagcgttgttaaccaaaaaatctatgtctgaattacttcagatgaatgagaccggaaaaatgctgatgggactgtttggacactatcaagatggttctaatgctggtggtaaaccaatgcacgatgtcaatacactttattacttactgcaccctgaaaaatacaaattagaagatttatgggttgatgtcgtgacagatggacctgcgattggtgccacggtagctgacattcttcatagtacgcatagccaaacgaatgttcatgttgctaaggatatcgatgtacctgcattcaatgcttggtatttactacaaatttctggtatttctgatggaaatattaatgctggaaggcttgaaaattaa

SEQ ID NO: 91329 - protein, 315 aa, Leuconostoc mesenteroides subsp. mesenteroides ATCC 8293
MTIPLIFDTDPGIDDAAAIAILLTNDDFEVRLITSVSGNVSVDKTTNNVLKLTHYFNRPDVKVARGAEKPLVKPFKDASNIHGKSGMPGYEFGELSTRTISKKAVDAIHETLNSYDDQTTLVAVGAFTNIANLIQKYPQDLQKIERLIVMGGSLTGGNLTSVAEFNVFTDPDAAKIVFESDLDITMIGLDVTEKALLTKKSMSELLQMNETGKMLMGLFGHYQDGSNAGGKPMHDVNTLYYLLHPEKYKLEDLWVDVVTDGPAIGATVADILHSTHSQTNVHVAKDIDVPAFNAWYLLQISGISDGNINAGRLEN

SEQ ID NO: 91330 - DNA, 957 bp, Leuconostoc mesenteroides subsp. mesenteroides ATCC 8293
  CDS (1)..(957)
atggctactaaaaaaatgattcttgatctggatactggcgtggatgatgctctggcgctcgcctacgctgtagctgatccaaatgtcgatttgattggtattatctctagttatggtaacacacttgttgaaacggccgcacaaaactcactgaatttattacatttacttggtgctgacgatgtccctgtatttattggtgctagtcattcaagtacaaccaataattttgaagttatgcctatttcacagcttattcacggtaaaaatggcgtaggtgaaatcaccttagaaacttcaccaagacaaatcgaaacccaatcagctgttgattttttaattgaatctgctcatcaatataaagaaaacctaatttttattccaactgggcctctcaccaatttggctgcagcgattgaaaaagataatgacgtggctaccttgattggtaatacaacgctaatgggcggtgctttaactgtaccaggtaacctaacgccttttaccgaagcaaacattcaccaagaccctgaagcggctgactttgctttcgttcatcagcaaaacctaacaatggttggccttgatgttaccctccgcacgctgctaacgaaaaaagaaactgcagcatggcgtacactaggaaccttagccggagaaaaatttgctgacttaatggatttctatattgatgcgtatgctaacttaaacatcaataaaaatggtgctgccctccacgatccactagcagttgctgttggaatcgatcctagctatgttacatcaattgccttagcaatgcgggtaacatacgataaagaaagtggcgattatggccgcacaatcggtgataaagagaaacttttggtcccaacaactactaaagctgctgttttagttgattcaaaaagatttgttcatgattttcaaaatctaatgctaactgtgcttcaataa

SEQ ID NO: 91331 - protein, 318 aa, Leuconostoc mesenteroides subsp. mesenteroides ATCC 8293
MATKKMILDLDTGVDDALALAYAVADPNVDLIGIISSYGNTLVETAAQNSLNLLHLLGADDVPVFIGASHSSTTNNFEVMPISQLIHGKNGVGEITLETSPRQIETQSAVDFLIESAHQYKENLIFIPTGPLTNLAAAIEKDNDVATLIGNTTLMGGALTVPGNLTPFTEANIHQDPEAADFAFVHQQNLTMVGLDVTLRTLLTKKETAAWRTLGTLAGEKFADLMDFYIDAYANLNINKNGAALHDPLAVAVGIDPSYVTSIALAMRVTYDKESGDYGRTIGDKEKLLVPTTTKAAVLVDSKRFVHDFQNLMLTVLQ

SEQ ID NO: 91332 - DNA, 960 bp, Leuconostoc mesenteroides subsp. mesenteroides ATCC 8293
  CDS (1)..(960)
atggcatcaacaaaaatgattttggacttggatactggtgttgatgatgcgctagctttggctttagctgtgtgtgatccacgagtggatttaattggtgtgattgcttcttacggtaacacactaatgaaaactgcagcacaaaatacattagatttattacatttgttacatgctgacgaagtacctgtatacttaggcgaatcacaggcttccacagttaatgattttgaggtaatgcctatatcgaaagctattcatggtgacaatggtgtaggaaatattttattagaaaaatcgccgcgatcaattgaaaaagaaagtggcattcagttcttaataaatatggctcatcaataccaagatgaattagtatatgtacccactggaccattgacgaatttagccaaagcattacaaattgatccaaagattgcacagttgattgggaatactacattaatgggtggtgctttaacggttcctggcaatgttacaccatttacagaggcaaatattaaccaggacccgcaggccgcagatcaagtatttactgctcaagaacacttgacaatggtaggtttagacgtgacccttcgtacgctactgacaaaggcacacacaaaaaagtggcgtgacttaggaactaaagctggtcaaacatatgctgatttgatggactattatattgatgcatatgataatttaggtattgatcacaggggagcggccttacatgatcctttagccgttgcggtagcgatagatccaagttatgttatgacaatttcattaaatatgcgcgtgactcatgatcaaaaaacgaaagattatggccgaacgattggcgatcgggagcggctacttgaaccgacaacgacaaaagtggccgttggtgtaaagtctgagcgcttcgtacatgacttcatggattttatgattgcagttttaaaaaattaa

SEQ ID NO: 91333 - protein, 319 aa, Leuconostoc mesenteroides subsp. mesenteroides ATCC 8293
MASTKMILDLDTGVDDALALALAVCDPRVDLIGVIASYGNTLMKTAAQNTLDLLHLLHADEVPVYLGESQASTVNDFEVMPISKAIHGDNGVGNILLEKSPRSIEKESGIQFLINMAHQYQDELVYVPTGPLTNLAKALQIDPKIAQLIGNTTLMGGALTVPGNVTPFTEANINQDPQAADQVFTAQEHLTMVGLDVTLRTLLTKAHTKKWRDLGTKAGQTYADLMDYYIDAYDNLGIDHRGAALHDPLAVAVAIDPSYVMTISLNMRVTHDQKTKDYGRTIGDRERLLEPTTTKVAVGVKSERFVHDFMDFMIAVLKN

SEQ ID NO: 91334 - DNA, 819 bp, Desulfitobacterium hafniense DCB-2
  CDS (1)..(819)
ttgggtaaagaggagctcgacatctgcgcaattaccaccacctatggcaacagcaaagtcgatatcgtttatcaaaatacagtgaatatgctcagtgagatcggccgcagggatattcctgtgtacaaagggtgtactaatcgctatgggcttgatagtgaggcaacggattatttggtaaagatggtgaacgatcaccctggtgaaatctctattttagcaacaggagccctgaccaacctctacgcggcctatattaaagatcagaattttttcaggaaattggatcggttggtggtcatgggtgggttaactcatgacgtaataccggacgggaaagcatttgatgagtggaacttatcagttgacccggcagccacccattgggttttaaaggaaggaaaagatctttttctcatcacacgggatatggacattaatgtttctgtatctactgcggatttcatccacagactgaccaggaatcggagtccaatcggccgctatatagtggaacgctccatttcctggctggaatacacgatgctgcatctaaaaagcaattgcttttatctgggggatcttgtggcggcggtctatcttgtcaatccgcagttttttgaagatcagcagcaaatcatttctttaagtaccaaaacgatcagcaaaggcttattatgccccacggataacaggcaggaagggcaaacgatccacttgccaacacttcgccatcgggatgattttgtggaggatatctatactacttggctgaaggcagactgcggttttgtaaaggaaataggaggaggttggtaa

SEQ ID NO: 91335 - protein, 272 aa, Desulfitobacterium hafniense DCB-2
MGKEELDICAITTTYGNSKVDIVYQNTVNMLSEIGRRDIPVYKGCTNRYGLDSEATDYLVKMVNDHPGEISILATGALTNLYAAYIKDQNFFRKLDRLVVMGGLTHDVIPDGKAFDEWNLSVDPAATHWVLKEGKDLFLITRDMDINVSVSTADFIHRLTRNRSPIGRYIVERSISWLEYTMLHLKSNCFYLGDLVAAVYLVNPQFFEDQQQIISLSTKTISKGLLCPTDNRQEGQTIHLPTLRHRDDFVEDIYTTWLKADCGFVKEIGGGW

SEQ ID NO: 91336 - DNA, 1056 bp, Bifidobacterium longum DJO10A
  CDS (1)..(1056)
atgcgcaaaaaactcatcctcgacctcgataccggcatcgatgacgcgctcgccatcgcatatgccctaggcagtgccgacgagatcgatctgatcggtatcacggccacctacggcaatgtcgcggtgccgctggccgcgcgcaacgcgctggcggtggtgcacttgttcggccgtgacgacgttccggtctatcccggagtcgaccatcccatcgccccggcaacattgccgaaaatgcgtggcaccacaccagacgagcggacccaggcctacgcgcgctggcagaacggcggcgcggacggctggcaaacggacgcttcgtgggcaccaactcccggctcggtggcggtccaccatcccaacggcatcggcggcgcaatcatccccgactccccgcgcgctccggaagcaccaggctcggcggtcgatttcatcatcgccgccgcgcacgaatacggcccggatctgaccatcgtacctacgggcgcgatgaccaccatggccaccgtattccgcaacgctccggatctgaaggattccggcgtgaacgtgacgttgatgggcggtgccctcacattgcccggcaatgtaagcccggccgccgaagcgaacatctcccaagacccagagtcagcagactatctgttcaagtgtggcgcacgcaccaccatgatcggcctcgacgtgacccaccagaccgcgctcgcccgtgagaaagcccatgaatgggcgtctctggggacgccggccggcgacttcctcgtcaccatgaccgactactacatcgatttctacctgaagaaccagccggaaatccacggctgcggactgcatgacccgctcgctgtggctgccgcgcttgacccatcattggtcaccacgttcggcttcaacctacaggtcgatttggagggcccgttccgtggccgcaccattggtgaccgctcgcggctgcaagatttcgacaagcacactcaggttgcgctcggcgtcgacgtgtcggaattcctcgaccgctttatggctcgcgtcaccgccgcggctcgtgggtaa

SEQ ID NO: 91337 - protein, 351 aa, Bifidobacterium longum DJO10A
MRKKLILDLDTGIDDALAIAYALGSADEIDLIGITATYGNVAVPLAARNALAVVHLFGRDDVPVYPGVDHPIAPATLPKMRGTTPDERTQAYARWQNGGADGWQTDASWAPTPGSVAVHHPNGIGGAIIPDSPRAPEAPGSAVDFIIAAAHEYGPDLTIVPTGAMTTMATVFRNAPDLKDSGVNVTLMGGALTLPGNVSPAAEANISQDPESADYLFKCGARTTMIGLDVTHQTALAREKAHEWASLGTPAGDFLVTMTDYYIDFYLKNQPEIHGCGLHDPLAVAAALDPSLVTTFGFNLQVDLEGPFRGRTIGDRSRLQDFDKHTQVALGVDVSEFLDRFMARVTAAARG

SEQ ID NO: 91338 - DNA, 1089 bp, Desulfovibrio desulfuricans G20
  CDS (1)..(1089)
atgacggcacagcataacgacacctgcggtgctgcgtgtccgccccctttgcgcagggcagaagctccggtaaaggtgctgctggacattgacaacgccatggggttgcccgtgcgcgatgccgatgacggcgtggctctggctctggcgctgtggtcgccggaattcgagctgacagcctgcaccacctgttccggaaactgccgggcatcggcttcggcgcagaacacgctgcgcatgctggaactggccggtgcagacgcggtaccggtggcagccggcaccgatacaccgctggggggtgaggacagagcgcggcatcatgcctttctggacgccaaagcttcaggagccggagcctcgctgtgggacgatgtgtcgctgccggcgccttctgcccgtcaggcctctgctcctgcctgcaggcttatcatagaaacggtgcgccgccacccgcacgaggtggtgctggtaatggaaggcgcattgactaatctggctcttgccctgcgacatgcctctgacattgctccgcttatcggcgcggttgtgcatatgggcggtgtgtttgcgccccgctgtcccgaagaaatggcaccgcagtggaaaacccccgacatacctgaatatgtgtggcggcatgcgctgcgtttcaatacatggtatgacccgcaggccaccgaggaagtggtacgggcggggctgccgctgtgctttgtgcctgtcaatgtgaccagccggacatgtctttcttcgcatcagatcgcgcagatgcgcaccgcggacgatccgctgcggtgttttgtgcgccggacgctgctgccctgggcgcgctggagcgaacaggtcagaggtctggacggcgcacacatgcatgatgcgctggcgcttgcggtggccgccatgccgcacctgtgcagctggaagccgttctgctttgatgttcaggcatttcgggatggtagggattttctactgccttttggtgacaaaccctaccatcgggtgtgggtggccactgcggtggacgcggctgcttttcatgcatggctgcttgcgaccatgggtatagatgtatcggctttgtaa

SEQ ID NO: 91339 - protein, 362 aa, Desulfovibrio desulfuricans G20
MTAQHNDTCGAACPPPLRRAEAPVKVLLDIDNAMGLPVRDADDGVALALALWSPEFELTACTTCSGNCRASASAQNTLRMLELAGADAVPVAAGTDTPLGGEDRARHHAFLDAKASGAGASLWDDVSLPAPSARQASAPACRLIIETVRRHPHEVVLVMEGALTNLALALRHASDIAPLIGAVVHMGGVFAPRCPEEMAPQWKTPDIPEYVWRHALRFNTWYDPQATEEVVRAGLPLCFVPVNVTSRTCLSSHQIAQMRTADDPLRCFVRRTLLPWARWSEQVRGLDGAHMHDALALAVAAMPHLCSWKPFCFDVQAFRDGRDFLLPFGDKPYHRVWVATAVDAAAFHAWLLATMGIDVSAL

SEQ ID NO: 91340 - DNA, 1170 bp, Anabaena variabilis ATCC 29413
  CDS (1)..(1170)
atgctcaaaattcctaatgtgcagaagttgttttctactgctgcttctttagtatcaatcacagcaattttttgtagccaacctgtacttgcagcctcttttaagccaacccccctaatcatcgacgacgatggcagccaagacggcatgactgcattggcttatatgctagccaatcccaaatttgatgtccaagcaattaccatcgcccaaggtatagcccgcccagaaagctttgtgaacaacctggaacggatgctaggcagactaaatgcttctggcatccctgttggtatcggcagatccactcccctggcaggaaataatactttcccagaatttattcgcactggtgcagacactttttggtctcccttcgtccaactacctgatacagcaccacctatagtaactcgaccagccgcagaactgattgtggagaaagtgaagcagtcattagcacctgtagcaatcttggcaactggatctttaaccaatattgctgaagcattacggcttgaccccaccattatcaacaacattgccatcatcgaaatcatgggaggcgcagttttcgtacctggaaatctcccagtcctgcctgatcccccattttctaccaacacgacagctgagttcaacatctgggttgaccctttagcagcacaagaagtatttgcagccggagggcaaggattaaaaattcagttgacccccctggatgctacaaaccagattgccttttctcgtgccgatcaacaagcatggctagctactgcaacaccagaaagtaagttagcagcagaatttttagactttgccttgaccataattcaaagtaacaatgaccccaacccagcttgggatctagttgcagccattaacttgagtgaaccagatttctcagtagaaactcctttatacttagaagttgatacgacctcagatcctgggggtactcaagggcaaactcgtgctatttctaatttgccccccaatgttctagtttccctcaaccccagttttaataatttgccctttcgaccaggccaagtcttctcttacctacaaacccagtctgttcccgaaccaacatcaattgcaggaatcttacttctagccacagtcagtgctggtatgatggcgcgacgttctcagaaaaaagtttag

SEQ ID NO: 91341 - protein, 389 aa, Anabaena variabilis ATCC 29413
MLKIPNVQKLFSTAASLVSITAIFCSQPVLAASFKPTPLIIDDDGSQDGMTALAYMLANPKFDVQAITIAQGIARPESFVNNLERMLGRLNASGIPVGIGRSTPLAGNNTFPEFIRTGADTFWSPFVQLPDTAPPIVTRPAAELIVEKVKQSLAPVAILATGSLTNIAEALRLDPTIINNIAIIEIMGGAVFVPGNLPVLPDPPFSTNTTAEFNIWVDPLAAQEVFAAGGQGLKIQLTPLDATNQIAFSRADQQAWLATATPESKLAAEFLDFALTIIQSNNDPNPAWDLVAAINLSEPDFSVETPLYLEVDTTSDPGGTQGQTRAISNLPPNVLVSLNPSFNNLPFRPGQVFSYLQTQSVPEPTSIAGILLLATVSAGMMARRSQKKV

SEQ ID NO: 91342 - DNA, 927 bp, Anabaena variabilis ATCC 29413
  CDS (1)..(927)
atgcgtaaatttatcatcgatacagataccgcctcagatgatgctgtcgcgctgattatggcgcatcactggccggatgtggaaattgtggcggtaacaattgtcaatggtaacgtccctgttgagcagggagtcaagaacgctttatacacaattgaagtatgcagcgcctccacacctgtatatgtcggctgtgccaagccgatgctacgggaatctcgttatgctgattggtttcacggcaaagatggtatgggtaatatgtactacccagaagcaaaaagcaagccagaattagcacacgctactgatgcaattattgagattatcaaacaataccctggtgaaattactttggtgacgctggggccgttgacaaatattgctaccgcattgctaaaagcgccggatattgcccaactagttcagcgttgcgtgattatgggtggtgcagcgaatacagtgggtaatgtgacacctgcggccgaatacaacatttgggtagacccggaagccgccaagattgtctttcatagtggaatgccgatggagatggtcggttgggagttgagccgtcacgatgcggcgttgacttttgcagaagtagaaaccgtgatgaatttcggcacagacagggcgcgtttagcgatggagtgtaacaagacagctttggatgttgccatgaaaaggcaaggtgctgttggtcttaccttagctgatcctgtagcgatcgcagttgcgcttgatccagatattgttacacgtcaaggaaaatactttgtagatgtggaaattacgagcgaactaactagaggtgctacagtcgttgatgagctaggagtgctaaataaaaagccaaatatgaatgtaatttgggcaataaatgtgatgcgatggaaagaaattttgtatttttgtttacactag

SEQ ID NO: 91343 - protein, 308 aa, Anabaena variabilis ATCC 29413
MRKFIIDTDTASDDAVALIMAHHWPDVEIVAVTIVNGNVPVEQGVKNALYTIEVCSASTPVYVGCAKPMLRESRYADWFHGKDGMGNMYYPEAKSKPELAHATDAIIEIIKQYPGEITLVTLGPLTNIATALLKAPDIAQLVQRCVIMGGAANTVGNVTPAAEYNIWVDPEAAKIVFHSGMPMEMVGWELSRHDAALTFAEVETVMNFGTDRARLAMECNKTALDVAMKRQGAVGLTLADPVAIAVALDPDIVTRQGKYFVDVEITSELTRGATVVDELGVLNKKPNMNVIWAINVMRWKEILYFCLH

SEQ ID NO: 91344 - DNA, 1053 bp, Burkholderia cepacia R18194
  CDS (1)..(1053)
atgacccattcgatcgcatcccgccgcaccttcctgaaactgtccgccgcgctggccggcaccgcgctgctgcccgaaacgggcgcgttcgcggccggcggcgacgccgcgcgccgcacggtgatcatcgataccgacccggggcaggacgacgccatcgcgatcctgttcgcgctgggcgcgcaggaccggctcgacgtacgcgcgctgaccgccgtcgcgggcaacgtgccgctcgacctgaccgaacgcaatgcgcggatcatccgcgactgggccgcccgcacgaagacgctgcccgtctacgcaggctgcccgcgtccgctcgtgcgcgacctcgtgacggccgcgaacgtacacggcaagaccggtctcgaaggtgtcgagctgcacgagccgcgcgcgccgcttgccggcggccatgctgtgtcgtatctcgtcgatacgctgagccgcgcagcgccggggagcgtgacgctgtgcgcgctcggcccgttgacgaacatcgcgaccgcgctggtcgaagcgccgcagattcgcggcgcactgcgcgaaatcgtgctgatgggcggcgcgttcttcgaacgcggcaacattacgccggccgccgaattcaacatctacgtcgatccgcaggcggccgaagtcgtattcggcagcggcgtgccgatcgtcgtgctgccgcgcgacgtcgcggtaaaggcgccgatcacgccggcgcgcgtcgcgccgttccgcgcgctcggcaaccgttgcggcacgatcgttgccgacatcatggatgccgagctcgcgtacaacaagaagcggcgcggcgtcgaagacgcaccgatgtacgacccgacggcggtcggctatctcgtcgatccgacgctgttcggtggccgcaaggtgaacgtgatggtcgagacgaccgggcagtggacgctcggcgagaccgtcgtcgactggaacggacgcagcggccgaacggcgaatgcgacgtggatcaacgaggtcgacgcggaccgcttctacgcagcactcgtcgagcgcattgcgaagctgccctga

SEQ ID NO: 91345 - protein, 350 aa, Burkholderia cepacia R18194
MTHSIASRRTFLKLSAALAGTALLPETGAFAAGGDAARRTVIIDTDPGQDDAIAILFALGAQDRLDVRALTAVAGNVPLDLTERNARIIRDWAARTKTLPVYAGCPRPLVRDLVTAANVHGKTGLEGVELHEPRAPLAGGHAVSYLVDTLSRAAPGSVTLCALGPLTNIATALVEAPQIRGALREIVLMGGAFFERGNITPAAEFNIYVDPQAAEVVFGSGVPIVVLPRDVAVKAPITPARVAPFRALGNRCGTIVADIMDAELAYNKKRRGVEDAPMYDPTAVGYLVDPTLFGGRKVNVMVETTGQWTLGETVVDWNGRSGRTANATWINEVDADRFYAALVERIAKLP

SEQ ID NO: 91346 - DNA, 1029 bp, Pseudomonas fluorescens PfO-1
  CDS (1)..(1029)
atgcaccgctatgctcaaaaattgcatcaattgattcgggggctgctgcttttgtccgtgataaccgcgaccggcgcccaggcggcggaaaagatcgacctgatcattgacaccgatccgggtgccgacgacgtggtcgccctgttgtttgccctggcctccccggaagagctgaacattcgcgcgttgaccaccgtggccggcaatgtgcgtctggacaagacttcgcgcaatgccaggttggcccgtgagtgggctgggcgggaagatattccggtgtacgccggggcgccaaaaccgctgatgcgcacgccgatctacgctgaaaacatccatggcaaggaaggcctgtcgggtgtcaccgtgcatgagccgaagaaaggcctggccgaaggcaatgcggtcaactatctgatcgacaccctgaaaaaagccaagccgcacagcatcaccatcgcgatgctcggcccgcagaccaacctggccctggcgctgatccaggagccggagatcgttcagggcatcaaggaagtcgtgatcatggggggcgctcacttcaatggcggcaacatcacgccagtggccgaatttaacttgtacgccgacccgcaagccgcggaagttgtgctcaaaagcggcgtgaaactgacttatctgccgctggacgtgacccacaagatcctcaccagtgacgcacgcctgaagcagattgcggcgctgaacaacaatgcgagcaagattgtcggcgacatcctcaacgagtacatcaaaggggatatggagcactacggcattccgggtggcccggtgcatgacgccaccgtcgtggcttatctgctcaagcctgaactcttcacgggtcgttcggtgaatgtggtggtcgatagccgtgaaggcccgacattcggccagaccattgtcgactggtatgacggcctgaaggcgccgaagaacgctttctgggtggagaacggcgatgcccaaggcttcttcgatctgctgaccgagcgtctgaagcgtctgaagtaa

SEQ ID NO: 91347 - protein, 342 aa, Pseudomonas fluorescens PfO-1
MHRYAQKLHQLIRGLLLLSVITATGAQAAEKIDLIIDTDPGADDVVALLFALASPEELNIRALTTVAGNVRLDKTSRNARLAREWAGREDIPVYAGAPKPLMRTPIYAENIHGKEGLSGVTVHEPKKGLAEGNAVNYLIDTLKKAKPHSITIAMLGPQTNLALALIQEPEIVQGIKEVVIMGGAHFNGGNITPVAEFNLYADPQAAEVVLKSGVKLTYLPLDVTHKILTSDARLKQIAALNNNASKIVGDILNEYIKGDMEHYGIPGGPVHDATVVAYLLKPELFTGRSVNVVVDSREGPTFGQTIVDWYDGLKAPKNAFWVENGDAQGFFDLLTERLKRLK

SEQ ID NO: 91348 - DNA, 966 bp, Burkholderia fungorum LB400
  CDS (1)..(966)
atgagcatgcacaaggtcatctacgacaccgacccgggtgtggacgatgcaatggcgctcgtgtttcaggcgctgcatccggatatcgaactgctcggtctgacgagcgtattcggcaacgcaacgatcgaaacgaccacgcgcaatgcgcgctttctcgccgggcggtttgccgcgggggtgccggtcgcacgaggcgcggcagcgccgctcaggcgcgccgcgcccgaaccgctcgcatggattcacggcgacaacgggctcggcaatatcgcgctggatacaacggagcaggccccgctcgacgcgcgccccgcgcaccgcttcatcatcgacacggtgcgcgcgcatcccggtgaagtgacgctgctggcggtagggccgctcacgaatcttgctcttgcgctcgccggcgatccgcagatcgcgccgctcgtcaaacaggtggtgatcatgggcggcgcgttcggcacggacggtgtgctcggcaacgtcacgcccgctgcggaggccaacattctgggcgacccggatgccgcggacatcgtgttcggcgcggcgtggccggtcgcgatcgtcggtctcgacgttacgcagcgcactatcatgagccacgattatctggcgtcgctgcgtgctcgcggcggcgcggcgggtcggttcgtatgggaagtgtcgcggcactacgaggcgtttcacgagcagagcgcgcagcttgcgggcatctatgtgcatgattcgtcggcggtagcctatgtattggcgccgcatctctatacgacgcgcagcggcccggtgcgcgtgctgaccgacggtatcgcggtgggtcaatccattcagaaaccgtcggccatgcccgtgcccgcgccggactgggacagccgtcccgactgcaaggtatgtatggcggtggatgtgccgggcatgctcgcgctttacgagaacaccatttgcggcacgctttga

SEQ ID NO: 91349 - protein, 321 aa, Burkholderia fungorum LB400
MSMHKVIYDTDPGVDDAMALVFQALHPDIELLGLTSVFGNATIETTTRNARFLAGRFAAGVPVARGAAAPLRRAAPEPLAWIHGDNGLGNIALDTTEQAPLDARPAHRFIIDTVRAHPGEVTLLAVGPLTNLALALAGDPQIAPLVKQVVIMGGAFGTDGVLGNVTPAAEANILGDPDAADIVFGAAWPVAIVGLDVTQRTIMSHDYLASLRARGGAAGRFVWEVSRHYEAFHEQSAQLAGIYVHDSSAVAYVLAPHLYTTRSGPVRVLTDGIAVGQSIQKPSAMPVPAPDWDSRPDCKVCMAVDVPGMLALYENTICGTL

SEQ ID NO: 91350 - DNA, 975 bp, Enterococcus faecium
  CDS (1)..(975)
atgcgaaaagtaattattgattgcgatccagggatcgacgacactttagctttatcattagctgtcaaatcccctgatatcgaagtagttgctattaccgtagtttgtgggaatgtccctgcagatataggtacgcagaatgtgctgaaatgcctggaacgctgtgatcgtttagacattcctgtttatcaaggaatggaaaaacctttgaagcaacctttcatcagtgcacaagacactcatggtatggatggtttaggggaaacaaatttcccgatgatcttgagaaaacaggcagaacctctccatgccgttgattttttggctgattatttcaaagaaaagacaaatacatcagtcattgctttgggtcctttgaccaatatcgcttctgctttgaaagtcaacccaaatattgggaaacatatggaacgttttgtctcgatgggtggaacttacaaaagccatggtaactgttcgccagttgctgaatacaattactggtgtgatcctgaagcagcttcttatgtattcgagaatctcaaacaaacgatagaaatggttgggttagatgtgacaagagaaatcgtcttgacaccgactatcctcgaatactgctgtcaaatgaatcctgaagagggagagtatctaaaagcgatcactcgtttttattttgacttccactggaaacaagaaagaattttaggatgtgtcatcaatgatccgttagctgttgcttattttatcgaggaggccatctgtgaaggtttcaaaagcttcactgctgtggaaactcaaggaataagtcgtggacaaacattggttgatcgttatgaattttggcagaaacctgctaacagtaaaattatgacaaaagtagatactcgtctttttttccgaaagtttttaaccgttcttttaaatgcacaagaagaaacgattatgaaagatttggaaaggttaaagatgggctaa

SEQ ID NO: 91351 - protein, 324 aa, Enterococcus faecium
MRKVIIDCDPGIDDTLALSLAVKSPDIEVVAITVVCGNVPADIGTQNVLKCLERCDRLDIPVYQGMEKPLKQPFISAQDTHGMDGLGETNFPMILRKQAEPLHAVDFLADYFKEKTNTSVIALGPLTNIASALKVNPNIGKHMERFVSMGGTYKSHGNCSPVAEYNYWCDPEAASYVFENLKQTIEMVGLDVTREIVLTPTILEYCCQMNPEEGEYLKAITRFYFDFHWKQERILGCVINDPLAVAYFIEEAICEGFKSFTAVETQGISRGQTLVDRYEFWQKPANSKIMTKVDTRLFFRKFLTVLLNAQEETIMKDLERLKMG

SEQ ID NO: 91352 - DNA, 930 bp, Thermobifida fusca
  CDS (1)..(930)
atgcgggttttcgtcgactgcgacccggggattgatgacgcgctggcattggcctacctcgcggcggaccacagggtcgagatcgcgggggtaggggcggtctacgggaacacgggggtggagagcaccgcggagaacgcggtgcggctgctgcagcttttcggacgtcccgagaccccggttgcggtgggggcggcgcgcccgctcatgcagcagccccggctcgcccggcatgtccacggggacaacgggctcggagggatcgaactgcccgaggcggcgaagcgtcccgtgtccgagtcggcagcggagctgcttgtgcgcctggcccggtcggctcccggggagctcaacgtgctggcgctcggtccgctcaccaacctggctgtggcgttggctctcgaaccgcggctgcctgagctggtgaaccgggtcgtggtgatgggcggtgcggtccggtcgccgggcaacgtcaccccgtgggccgaagcgaacgtcaacaacgaccctgaggcggccgaggcagtgctcggcgcggggttcgacctgactttggtggctctcgacgtcaccatgcgagccttggcgaccgagtcgtggctggaggagttggcggcgctgccgggggagcgcgcccagtacgcgcaccggttcctcgcctactacgtgggctggtacacgtcgtttctgggccagcgggcgtgtccgatgcacgacccgcttgctgcagcggtgctggtggacccgtcgctggtgaaagagtcggagaccgttcccgtgctggtggagctggccggtgcgcacacacgcggcatgaccatcgcggatctgcgtccccgccgcgaggagacctcgcggcctgcggtggtgctgcccaccgaggtggacgtgcccaagttcctctcccggatgctgcgcgcgctggcctga

SEQ ID NO: 91353 - protein, 309 aa, Thermobifida fusca
MRVFVDCDPGIDDALALAYLAADHRVEIAGVGAVYGNTGVESTAENAVRLLQLFGRPETPVAVGAARPLMQQPRLARHVHGDNGLGGIELPEAAKRPVSESAAELLVRLARSAPGELNVLALGPLTNLAVALALEPRLPELVNRVVVMGGAVRSPGNVTPWAEANVNNDPEAAEAVLGAGFDLTLVALDVTMRALATESWLEELAALPGERAQYAHRFLAYYVGWYTSFLGQRACPMHDPLAAAVLVDPSLVKESETVPVLVELAGAHTRGMTIADLRPRREETSRPAVVLPTEVDVPKFLSRMLRALA

SEQ ID NO: 91354 - DNA, 882 bp, Ferroplasma acidarmanus
  CDS (1)..(882)
atgaacagggttattcttaatgtggatactggaatcgatgacgcttttgcaatgattttgttgaaacagtacaatattactccagaattcattgttgcttcttcaggaaattcattgcttgagaatacttacaggaatacagctggtgtggcaaagttgcttgattttgattgccctgtgtaccatggatctgccaggccacttataaaaccccattattatgaaaattttcatggcgataaggggcttggaacatacgaatttaatgatccggttcaggaaaaagatcaccataatggaataattaaaatgtatgaagcattaaaacgggaaaaacataccataatctgtacatctcctttaacttccctgggaatcctcatgagactggataatagtataaaagagaacatagaacagataataatcatgggaggcgcatttggcattaccccatatggaaagggaaatatgggaaatgctgaatttaatatattttacgacccggaggcggctaaaatagtcatggaagaggatatcaacgaaactattgttccactggacgttacaatgaacagggaacttgcaataaaaagtataccgccgagtagttctggcagcccattagaagattttatccataaaaccacaaaatttatgatagaagagcatggcacttttgaaatgcatgaccccatagcagttttttccttcatagaacctgatgcttttaagtttgtgaatggggaaattacagtcaaacctgatgggagtacagaatttatagaaaagcgtgatgggaaaaagagaatagctaccgggataaatccacaggcttaccggaaagggcttgtgaacaggatatatggcaatttggcatag

SEQ ID NO: 91355 - protein, 293 aa, Ferroplasma acidarmanus
MNRVILNVDTGIDDAFAMILLKQYNITPEFIVASSGNSLLENTYRNTAGVAKLLDFDCPVYHGSARPLIKPHYYENFHGDKGLGTYEFNDPVQEKDHHNGIIKMYEALKREKHTIICTSPLTSLGILMRLDNSIKENIEQIIIMGGAFGITPYGKGNMGNAEFNIFYDPEAAKIVMEEDINETIVPLDVTMNRELAIKSIPPSSSGSPLEDFIHKTTKFMIEEHGTFEMHDPIAVFSFIEPDAFKFVNGEITVKPDGSTEFIEKRDGKKRIATGINPQAYRKGLVNRIYGNLA

SEQ ID NO: 91356 - DNA, 912 bp, Oenococcus oeni PSU-1
  CDS (1)..(912)
atgaataaactcaaagagctaattgtagataccgacccgggggttgatgatgccttggctttagcgcttgcttttaggaacagcaacttaaagatcgatttaatcacaactgtttatgggaatattggcgttaaacagtctactaataatgcgctaaaattgttaacattttggggtaaaaaagttcccgttgccgctggttccaaagcttctctattgggaaggaattttgaggcgcgatcggtccatggaaacaatggtcttggagatgcgaagtttcctgctccagacaaaggactgcttttaaatacaaatgcagtttcctccattcataaattgttaagtaactctgatcacaagatttcaattttggcgattgcaccattgacaaacctagcaattttattaaaagaatatccggaagatcgaaaaaaaatatcagagatcattatgatgggtggatcttggggcagaggaaacgctggcatattttcggaatttaatgtttttaatgacccggaagcagcaaacattatctttcaaagcacgataccattaacgattattcctttagaaattggacggatggcacagataaacaagaacacgataacatcgattaaagcttctggaataattggatattccatatccttaatgtttggcggttaccatagtggtcctgataggaatacttttaatatttacgatgctctgacggtttcttatttgcttcatccggaattctttacgcttgcgtcggcctttgttgctgtcgaaattggcggcaaatatacgcgtggcgctacagttattgatgatcgtggtaaattaaaacaaccttttaatgccaaagttgcaaagaaggtcgatgttgaagcattctccaattggtttcaaaagcaatggtag

SEQ ID NO: 91357 - protein, 303 aa, Oenococcus oeni PSU-1
MNKLKELIVDTDPGVDDALALALAFRNSNLKIDLITTVYGNIGVKQSTNNALKLLTFWGKKVPVAAGSKASLLGRNFEARSVHGNNGLGDAKFPAPDKGLLLNTNAVSSIHKLLSNSDHKISILAIAPLTNLAILLKEYPEDRKKISEIIMMGGSWGRGNAGIFSEFNVFNDPEAANIIFQSTIPLTIIPLEIGRMAQINKNTITSIKASGIIGYSISLMFGGYHSGPDRNTFNIYDALTVSYLLHPEFFTLASAFVAVEIGGKYTRGATVIDDRGKLKQPFNAKVAKKVDVEAFSNWFQKQW

SEQ ID NO: 91358 - DNA, 909 bp, Oenococcus oeni PSU-1
  CDS (1)..(909)
atgaaagtaattattgatatggatcccggcatcgatgatgcagttgctttgtcagttcttttaaacaataaaaattgtcaagttgaactgatcacgactgttgccgggaatgtaacggttgataagacaactaaaaatgcattgaaaatcgccaacttttttaattctgaagttcctcttgcagccggggccagtcaacctttggtcaaggctttcgaagatgctgccagaattcacggcgaatcaggaatggagggttacgattttccggaagggaattcccatctgcttaaacagcctgctgtcgaggcttggcatgacgttcttaataaaacagaaaagaaaattactttaattttaaccggatcatacacgaatttcgctctgtggtatcgtgaatacccggaagatgtccttaaaatcgaacgtgtaattgtaatgggtggctccttatccggcggcaatatgacaagtgctgccgagtttaatgtttttaccgatccggaagcggcaaagattttgttaagctctaatctgtcagttacgatgattggtttggatgtaactttaaaagcgctcgttgatcgagattggattcaaaaagtcgctgctctaaacgagtctggcaaaatgcttgccgctttgatctcccactataacgattggcatgccgacggctggccgattcacgatgtgaatacagttgcttacttactccatcctgaattttatagttccaagaaattatgggttgatattgcgaccgatggaccagcaattggagaaacagttgccgacattcgagctgcatatcatcaaggcaggacaaacgcaaccgttgccaccgatatcgacgccgatgcttttcgcaactggttaaagcaagaaatatcttcaatgacaagatga

SEQ ID NO: 91359 - protein, 302 aa, Oenococcus oeni PSU-1
MKVIIDMDPGIDDAVALSVLLNNKNCQVELITTVAGNVTVDKTTKNALKIANFFNSEVPLAAGASQPLVKAFEDAARIHGESGMEGYDFPEGNSHLLKQPAVEAWHDVLNKTEKKITLILTGSYTNFALWYREYPEDVLKIERVIVMGGSLSGGNMTSAAEFNVFTDPEAAKILLSSNLSVTMIGLDVTLKALVDRDWIQKVAALNESGKMLAALISHYNDWHADGWPIHDVNTVAYLLHPEFYSSKKLWVDIATDGPAIGETVADIRAAYHQGRTNATVATDIDADAFRNWLKQEISSMTR

SEQ ID NO: 91360 - DNA, 915 bp, Pediococcus pentosaceus ATCC 25745
  CDS (1)..(915)
atgacaacaaaaattattatggatacagatccaggaattgatgatgcagctgcgatttccgtggccatcaataatcctgaaatcgaattagaattaattacgacggtggctgggaatgttacggttgataaaactactaagaacgcgatgaagttagtaaaattcttcaacgctgatattccggttgctggtggggcagaacaacctttgattaaaccatttgaagatgctgctcgagttcacggcgaatccgggatgcctggttacgattttggtgcagaacccactaacattccagttaacaatgcagtggatgttttatatcacactattatggctaacgatgaaccgatcgttttggtacccacgggatcgtatactaacattgcagtactacttactgaacatcccgatgtaaaaaccaagatcgaaaaaattgtggccatgggtggcgcaattggcatgggaaatatgacaagcgctgcagaattcaacgtctttactgatccccacgctgctgaaattttatataagagtggcattccagtagtaatggttggcctagatgtaacgatgaaagctcttctaacacaatctacgttagacacagtaaaatccttaggtaaagctggagaaatgctgggagccatttttaaccactattacgagggaaatgaaggtggtatcccaatgcatgatgttaatacgttggcatacttactaaaacccgaaatgtataagaccatcccatattggattgacgtagttactgaaggaccggcgaatggtgaaaccgttgcagatatccgaggtgcttatcacgatggaaagaccaacgctgaagtgtgtgttgatattgatgccgacgccttcaatgcctggtttattgaagaagttaaaaagatgaatgcttaa

SEQ ID NO: 91361 - protein, 304 aa, Pediococcus pentosaceus ATCC 25745
MTTKIIMDTDPGIDDAAAISVAINNPEIELELITTVAGNVTVDKTTKNAMKLVKFFNADIPVAGGAEQPLIKPFEDAARVHGESGMPGYDFGAEPTNIPVNNAVDVLYHTIMANDEPIVLVPTGSYTNIAVLLTEHPDVKTKIEKIVAMGGAIGMGNMTSAAEFNVFTDPHAAEILYKSGIPVVMVGLDVTMKALLTQSTLDTVKSLGKAGEMLGAIFNHYYEGNEGGIPMHDVNTLAYLLKPEMYKTIPYWIDVVTEGPANGETVADIRGAYHDGKTNAEVCVDIDADAFNAWFIEEVKKMNA

SEQ ID NO: 91362 - DNA, 945 bp, Pediococcus pentosaceus ATCC 25745
  CDS (1)..(945)
atgatcttagatctagatactggtattgatgatgctatggccattgcatatgctttggcagcacctgacgttgatttgattggtattgtttcgacatacgggaatgtgttaacccctgacgctggtactaatagcttgaaaattcttgaattactaggccgaacggatattccggtctttcttggtgaggaacactcacaaactaccgaaagctttgaagttatgcctattagtgctcaaattcatggaaaaaatggtattggtgaagttgaactacccgctccatctcgggcaattgaaacacagcccggggttgattttattatcgaagctgctcacaaatacaactccgatttaattctagtgccaaccggtcccctaacaaatcttgcacttgccttaaagaaagatccagaagtcgccgatttaattggcaacgtaactattatgggtggtgctcttactgtccctggaaatgttagtccagttgcagaagctaacatcaaccaagaccctcacgctgctaatgacgtatttactagccacgttaacttaaccatggttggtctagatgtcactttaagaacgttactaacaaaaaaagaaacacaactttggcgcgacctagatactactgctggtagtaaatttgctgatatcgtcgattactatatcgacgtttacaaaattaccagtcctcatcttggcggttgcgccttgcatgatcctttggcggtaggaattgcccttgatgcttcattttccaaaactatggatttaaacatgttcgttgatacaactgacgaaatgtggggtcgtaccattggtgatcccggccgtttaaacgaagaaaatcccaacgtttccgtagctttgaatgtcgatgcagacttttatctcaagcgctttatggattatctcactaaattatttgctaaaaattaa

SEQ ID NO: 91363 - protein, 314 aa, Pediococcus pentosaceus ATCC 25745
MILDLDTGIDDAMAIAYALAAPDVDLIGIVSTYGNVLTPDAGTNSLKILELLGRTDIPVFLGEEHSQTTESFEVMPISAQIHGKNGIGEVELPAPSRAIETQPGVDFIIEAAHKYNSDLILVPTGPLTNLALALKKDPEVADLIGNVTIMGGALTVPGNVSPVAEANINQDPHAANDVFTSHVNLTMVGLDVTLRTLLTKKETQLWRDLDTTAGSKFADIVDYYIDVYKITSPHLGGCALHDPLAVGIALDASFSKTMDLNMFVDTTDEMWGRTIGDPGRLNEENPNVSVALNVDADFYLKRFMDYLTKLFAKN

SEQ ID NO: 91364 - DNA, 936 bp, Pediococcus pentosaceus ATCC 25745
  CDS (1)..(936)
atgttgatgaataatttaaaagcacaacctgttattatcagtactgatcctggtatcgatgatgcagttgcaatatctttggcactttttagtaacgatatagatgtcaaacttatatgtcctattgcgggtaatgtaagtttagaaaaaacaactcataatacacaaaagcttctaactttttttaacaaagaaatacctattgttccaggaagcccgtcacctctccttcgacaaaaacaaaatgctagtaacgttcatggtgaatctggcatggatggctttgattttcctatccctaaaatcacacctgatgtatcaaggaccgcggtacaagcaatgcatgaaactgtatcaaacagtactgttcctgtaactttaatgggacttggacctttaactgatattgcactttatcttcatctctatccacaggatagtaagaatatccacgaaattgtattaatgggaggagctttaggtagaggtaacttgggagtcttatctgagtttaactttggagttgaccctgaagcagcaaaaatagtatttaacagtaatatttcaatacgtattgtacccatggaaatagggagacaagctaaaataatgcccgccacttcagaaaaaataaaaaatcttggaaaaaccggtaaaatgttttattcacttttttctcattatcgtggaggtagttttgataagggattaaatatgtatgacgtcctcgctttagggttgattttaaaaccagaaatatttgagatgaaatcaacctatgttgctatagaaacccaaggagcatttacagcaggtgcttcattaattgatcttaagggataccttggggaaaattccaatgcagaggtggcaattaacgttgatactaaacaatttgaagactggttcactaaaatgatatcaaaaacaatatag

SEQ ID NO: 91365 - protein, 311 aa, Pediococcus pentosaceus ATCC 25745
MLMNNLKAQPVIISTDPGIDDAVAISLALFSNDIDVKLICPIAGNVSLEKTTHNTQKLLTFFNKEIPIVPGSPSPLLRQKQNASNVHGESGMDGFDFPIPKITPDVSRTAVQAMHETVSNSTVPVTLMGLGPLTDIALYLHLYPQDSKNIHEIVLMGGALGRGNLGVLSEFNFGVDPEAAKIVFNSNISIRIVPMEIGRQAKIMPATSEKIKNLGKTGKMFYSLFSHYRGGSFDKGLNMYDVLALGLILKPEIFEMKSTYVAIETQGAFTAGASLIDLKGYLGENSNAEVAINVDTKQFEDWFTKMISKTI

SEQ ID NO: 91366 - DNA, 924 bp, Trichodesmium erythraeum IMS101
  CDS (1)..(924)
atgtccaaaaaacttgtactaatggatcatgacggtgcagtagatgattttctctccactcttttactcatgactatggaaaatattcaacccttaggagtaattgtaacaccagctgactgttatattgaacccgcaattagtgccactcgaaaaattttagatttaataggacgttctgatattccagtagcagaaagtacagtccgtggagttaatccttttccggttttatttagaagagattcttttgcagttgaccattttcccattttaaatcagaaggaaaatatcaatactattttaatttctgaacctggtcaaaattttatggtaaaagttttaaaatctgcaccagcacccgtaacattaatggtaacaggtcctttaacaactgttgctacagcattagatattgctccagaaattgagtcaaaaattcaagaaattgtctggatgggtggtgcattaaatgtaccaggaaatgtcagtaaagacatggaaccaggtcaagatatgtctgctgaatggaatgcctattgggacccgtttgctattgaaagagtttggcaaactcaaattcctattgtactttgctcattagatattactaataatgttcccctaacttctgaattttctcacaaattaagtaagcaaagaaagtatcctatttctgattttgccggacaatgttatgcattagcaatctctcaagactattatttttgggatgttttagcaacttcttacttagcacatccagaattttatcaacttcaagaatgggaaactgtagttattacaaaaggtctcagtcaaggccggataaaagtagaaaatggtgggcggaaaattatggcaatggaaacggtcgataaagagagattttacacttatattcttcaacaatgggcgcggtag

SEQ ID NO: 91367 - protein, 307 aa, Trichodesmium erythraeum IMS101
MSKKLVLMDHDGAVDDFLSTLLLMTMENIQPLGVIVTPADCYIEPAISATRKILDLIGRSDIPVAESTVRGVNPFPVLFRRDSFAVDHFPILNQKENINTILISEPGQNFMVKVLKSAPAPVTLMVTGPLTTVATALDIAPEIESKIQEIVWMGGALNVPGNVSKDMEPGQDMSAEWNAYWDPFAIERVWQTQIPIVLCSLDITNNVPLTSEFSHKLSKQRKYPISDFAGQCYALAISQDYYFWDVLATSYLAHPEFYQLQEWETVVITKGLSQGRIKVENGGRKIMAMETVDKERFYTYILQQWAR

SEQ ID NO: 91368 - DNA, 924 bp, Silicibacter sp. TM1040
  CDS (1)..(924)
atgacaacaaaactcatcatcgacacggaccccggcatcgacgatgcgatggctattttctacgccgccgccgcgcccgatatcgagcttctggggctgaccacgatctttggcaatgtgaccaccaagatggccacccgcaatgcgctgcgtctgcttgaggccgctgaactggatctgcccgttgcccatggcgcggaaaagccgctggtcctgcccccctttgagccttcggcccatgtgcatggcgacgaaggctttggcgacattcccgccgtcaatcccaaagggcaggcgattgcagaagatgccgccgatttcctgatccgaatggcgcgcgaacacaagggcgagctggtggtctgcccggtggggccgctgacgaatatcgccatcgcgatcgagcgtgacccggagtttgtgaaaaactgcaagcgcatcgtcatcatggggggctcgcttgaggcgggcggaaatatcacgccccatgccgaggccaatatctaccacgacccccacgccgccgaggcggtctttgccgccgccgcgggcaaggtggtgatggttgggcttgatgtgacgctcaagattctctgcactcccgaggatttcgacggcatcaaggagcgctcgccggagcttggtggcatgctcaaggacatgagtgtcttttacatcaagttctatcaggaagtggccaatctcaatggatgttctctgcatgaccccgcagcggtgattgcctgcacccatcccgacctctttaagacccgggccgtgaaactggccgtttcggtcgaggaggagacctctggcaagacccagctggccgaggatggtcgtggcgatacacatgtcgcgatggacgtggacgcagaggccgtcaaggcactgttcctgaagcgcctatcgctgctgccctga

SEQ ID NO: 91369 - protein, 307 aa, Silicibacter sp. TM1040
MTTKLIIDTDPGIDDAMAIFYAAAAPDIELLGLTTIFGNVTTKMATRNALRLLEAAELDLPVAHGAEKPLVLPPFEPSAHVHGDEGFGDIPAVNPKGQAIAEDAADFLIRMAREHKGELVVCPVGPLTNIAIAIERDPEFVKNCKRIVIMGGSLEAGGNITPHAEANIYHDPHAAEAVFAAAAGKVVMVGLDVTLKILCTPEDFDGIKERSPELGGMLKDMSVFYIKFYQEVANLNGCSLHDPAAVIACTHPDLFKTRAVKLAVSVEEETSGKTQLAEDGRGDTHVAMDVDAEAVKALFLKRLSLLP

SEQ ID NO: 91370 - DNA, 942 bp, Silicibacter sp. TM1040
  CDS (1)..(942)
atgcccgcccgcaagatcatcattgataccgaccccggacaggacgatgcggttgccatccttctggcccttgcctcgcccgagaacatcgaccttctgggcatcacggccgttgccggaaacgtgccgctggagctgacccagaaaaacgcccgcatcgtctgcgaggtcgccaaacgtcaggatgtcaaagtctttgcaggccgcgcggccccactcgaacgccctctggtgaccgcagagcatgtccacgggggcactggcctcgacggcccggagctgtttgatcccgagatgccgctgcaggatcaaaacggggtcgatttcattatcgagaccctgcgccgcgaaccggctggcacggtcaccctctgcccacttggcccgcttacaaatatcgcggccgcctttcgggctgcgccggatgtggtggagcgtgtgcaggaaatcgtccttatgggcggcgcctattttgaggtgggcaacatcacccccgccgccgagttcaatatctacgtcgaccccgaagctgcgcatgaggtgctctcttccgggatcaagatcacgatgatgccgcttgatgtgacccacaaggcgttgaccactcgcgcccgcgtcgaagcctttcgcgcgctgcaaagccccgtgggcgcgttcaccgccgatatgctcgatttctttgaacgcttcgacgtggagaaatacggctccgaaggcggcccgctgcacgacccttgcgtgattgcctacctcatcgaccctgctctcttcagtggtcgccatatcaacgtcgagatcgagaccgcttccgccctcacccttggcatgactgtggccgattggtggggcgtgaccgatcgaccggccaatgctcttttcatcggcgacatagatgccgatgggttcttttcgctcctcaccaacaggctggcccgcctatga

SEQ ID NO: 91371 - protein, 313 aa, Silicibacter sp. TM1040
MPARKIIIDTDPGQDDAVAILLALASPENIDLLGITAVAGNVPLELTQKNARIVCEVAKRQDVKVFAGRAAPLERPLVTAEHVHGGTGLDGPELFDPEMPLQDQNGVDFIIETLRREPAGTVTLCPLGPLTNIAAAFRAAPDVVERVQEIVLMGGAYFEVGNITPAAEFNIYVDPEAAHEVLSSGIKITMMPLDVTHKALTTRARVEAFRALQSPVGAFTADMLDFFERFDVEKYGSEGGPLHDPCVIAYLIDPALFSGRHINVEIETASALTLGMTVADWWGVTDRPANALFIGDIDADGFFSLLTNRLARL

SEQ ID NO: 91372 - DNA, 1203 bp, Kineococcus radiotolerans SRS30216
  CDS (1)..(1203)
atgcctgctcttcggcgccgcggaggcctggggcttccgcctgcaggggatcggactcccgcagcagctcaccgacgccgccccctacctcgtgaccctcgtcgtcctcgtcctcgcgcgcgcccgccgggcgcgtcgctcaccgctgcccgcaggaggcaccccgtgaccacccctcgagaccacacccccgacagcagcggcagcggtcgcagcgtcgtcgtggacaccgacaccggcatcgacgacgccctcgccctgctgtggctggccggccgccgcgacgtcgagatcgcggcggtcaccgccgtctacggcaactgcaccgtgcaggacgccacccgcaacatcggcgcggtcttgtcggtggccggcctcaccgtcggcgagggcggcatccccgtctcggtcggggccgcaggtcccatcgatggccgcccggcccacttcgcgacctacgtccacggccacgacggactgggcgatctgggcggggagcggcccgacgtccccgtcgaggaccgcagtgccgccgagcagctcgtgcacctggcgaacaccgaccccggtcgccacgacctcctggtcctggggcccatgaccaacatcgccgccgccctcgaacgcgaccccgacctgctcacgaagttccgctccaccgtcgtcatgggcggctcgggtcccttcccggcgctgggggtcgcccagatcgtcgacgccaacatcgccaacgacgccgccgcggcccgggccgtgttcgccgctccccgcacccagctcgtgatggtcggggtcaacgtcggagccggtgccatcgtcgacgaagccgcggtgcgacgcctgcacgacagccccaccgaggtcggccgcttcagcgccgcgttgttggagtcctacatggacttctaccagcaggtctggggccggcgagtctctcccgcctgggacgggctcgccgcggcgttgctggtcgaaccacgctggatctccgacttcgaagacggacccgtcgggctcgtccccgacggggaacgctggcgcgcgcacctgctgcgcaccgcagaggggggtccggtgccgttcgaacccgccacccgccctggtcggccggcaccctcgacacgggtggccttggccgtcgacgtcgaggccttcctggacgacttcctcaccaccctcgccggtgacggcgcccgaccctga

SEQ ID NO: 91373 - protein, 400 aa, Kineococcus radiotolerans SRS30216
MPALRRRGGLGLPPAGDRTPAAAHRRRPLPRDPRRPRPRARPPGASLTAARRRHPVTTPRDHTPDSSGSGRSVVVDTDTGIDDALALLWLAGRRDVEIAAVTAVYGNCTVQDATRNIGAVLSVAGLTVGEGGIPVSVGAAGPIDGRPAHFATYVHGHDGLGDLGGERPDVPVEDRSAAEQLVHLANTDPGRHDLLVLGPMTNIAAALERDPDLLTKFRSTVVMGGSGPFPALGVAQIVDANIANDAAAARAVFAAPRTQLVMVGVNVGAGAIVDEAAVRRLHDSPTEVGRFSAALLESYMDFYQQVWGRRVSPAWDGLAAALLVEPRWISDFEDGPVGLVPDGERWRAHLLRTAEGGPVPFEPATRPGRPAPSTRVALAVDVEAFLDDFLTTLAGDGARP

SEQ ID NO: 91374 - DNA, 1008 bp, Campylobacter lari RM2100
  CDS (1)..(1008): transl_table=11
atgatacgccttattttagatactgatataggcaatggaatagcaggggctaatacggatgatggtttagcccttggacttattttagcatccaaagaaatcaaacttgaaatgattagcactttaagtggtaatgtacaagctttaaccgcttatagcgttgctaaagatttattaagtaagcttaatctggatatacctttgtatttaggcgctcatgaagctttatatgaagatagtaaattttggcgacaaagactagatgatagtgctaaaaaatttaatcttagccatctttgggatgagattgagcctattaaaattttagaaaatatcactccaaatgcttgtataaaaatgggtgagcttattatgcaaaacccaggtgaaatttcaatttgcgctatagggcctttaacaaatatagccatagcgatgaagctttttaaagactttgataaaaatgtgaaagaaatttttatcatgggtggaagttttgacatgccttatcacatcaaagatacaaattttggctttgatcctgaagctgctagtatagttttaaactcaagagccaaaatcacacttgttccttataatgcaacaatgcaaactatgctcacacatgaggatttaaatgctttagaaaatcaaaatcctctttgtgattttttagtacagactttaagagtttggattaattatgcaagcaaaacaagaggcacaaatggtacatggatacatgatgcattaactattgcttatatgcttgatcccaatttagcaagttttgatgagtatttagtagatgttatttgcgatagtacttttgctagaggaagcacgataagatgttttaaagatgcaaaaatgcctatgaaaaatcatgaattaaaaaatactataaaagttttaaaagatattgataatgctagacttttaaatcttttaaaatcaagacttttaaatggaatttgccatgaaaattacaaaaatataacggcttaa

SEQ ID NO: 91375 - protein, 335 aa, Campylobacter lari RM2100
MIRLILDTDIGNGIAGANTDDGLALGLILASKEIKLEMISTLSGNVQALTAYSVAKDLLSKLNLDIPLYLGAHEALYEDSKFWRQRLDDSAKKFNLSHLWDEIEPIKILENITPNACIKMGELIMQNPGEISICAIGPLTNIAIAMKLFKDFDKNVKEIFIMGGSFDMPYHIKDTNFGFDPEAASIVLNSRAKITLVPYNATMQTMLTHEDLNALENQNPLCDFLVQTLRVWINYASKTRGTNGTWIHDALTIAYMLDPNLASFDEYLVDVICDSTFARGSTIRCFKDAKMPMKNHELKNTIKVLKDIDNARLLNLLKSRLLNGICHENYKNITA

SEQ ID NO: 91376 - DNA, 984 bp, Trypanosoma brucei brucei
  CDS (1)..(984)
atggcgaaaacagtgatcctcgaccatgatggtaacaaggatgacttcgtggccatgattctgttgctttccaaccctaagaaggtgaacctaattggttgtatctgcactgatgctgattgcttcgttgaaaacggatttgatgtgacgggaaagatcatgtgtgccatgcacaggctcaccaaaacgcccctctttcctattggaaagtcaaccgccactgcggtgaatgcgttcccaaccgagtggcgcttcagcgcgaaaaacttggatgatatgccattcctcaacatcgtagaggacgttgcgctgtgggaaaagctgaagcctgagaatgaggcgcacaatggccagcagctgctcgccgatctcgtgatgaagtcgaaggagaaggtaaccgtctgcgttacgggaccactttccaacatggcttggtgcattgagaaatacggtgaggcattcacatcgaaggtggaggaatgcgtcatcatgggtggtgcagttgatgtgggtgggaatgttttcctccccaccactgatggcagtgccgagtggaacatctactgggacccaccggcagccaaaaaggtattgtgctgccccaacatccgctgtgttctcttctcgcttgacgccaccaacaccgttcccgtccgctccgtcgacgtgaagggttttggtgcgcaaaatcaatacctcctttcgcagatggttggtaccatgtgggccatgtctactcatgaggaaatattgcgtgatggtgacgcctattacgcctgggatgcgctgacagcggcgtatattttggagcccactattgccacactcgaaccggttgctttggatgtggacgtcagtaaagggaagagcgaaggccgaactccacgtgccagcggtgagggcaagccgtgcgcccacgtcgccagaaatccctcgaagcagatgttccacgacttagtgttcgcttccacacgcgtttactga

SEQ ID NO: 91377 - protein, 327 aa, Trypanosoma brucei brucei
MAKTVILDHDGNKDDFVAMILLLSNPKKVNLIGCICTDADCFVENGFDVTGKIMCAMHRLTKTPLFPIGKSTATAVNAFPTEWRFSAKNLDDMPFLNIVEDVALWEKLKPENEAHNGQQLLADLVMKSKEKVTVCVTGPLSNMAWCIEKYGEAFTSKVEECVIMGGAVDVGGNVFLPTTDGSAEWNIYWDPPAAKKVLCCPNIRCVLFSLDATNTVPVRSVDVKGFGAQNQYLLSQMVGTMWAMSTHEEILRDGDAYYAWDALTAAYILEPTIATLEPVALDVDVSKGKSEGRTPRASGEGKPCAHVARNPSKQMFHDLVFASTRVY

SEQ ID NO: 91378 - DNA, 1065 bp, Aedes albopictus
  CDS (1)..(1065)
atgctgcacctggtgggtcttctcctgcttgctcaagctgttgtcatcagttgctgttcatgttccgatacgaccggtgtccgcagggtcatcgtcgaccaggatggaggcggtgacgatgcctgggccctgctgatgctgctgatgaacgagaagcagtacaacgtcaaagtggaagccattacctgtgcggatggcaacactggtttggagaattctgtcaggaatgctgcaagaattttggacggtatcggaagacgggatgtaccgttgtatcgtggggctagcgagcgattgataactcctgctcccagtagggatgttaatggatacttctggggacatgatggatttggtgatgtgcgtttcgggagtgaaccggatttgcggactatttccgatgaacatgctgtggtgaagatgtacgaactgattcggaagtatccaggacaaattaccattctttgtttgggacctttgaccaacctggcgatgttgttcaaaatgttccccaaagtgaagggcgatattgccggaatctacattcttggaggcaatcggaacggtgttggtaatacggacttcgcagcggagttcaacttcttcaccgatcccgaggcggccaacatcgtggtgaacaatgcaccggtgatcttgaacatattcccgtgggaaacagttctccagctggaaacggattttccaatggattggaggaacgaagtgttcaaggtgcccagaaacaaagccattcaggtgttgaatgacgtggaagcagtggtatacgcgaatatcagcgcttggcagccttgtgatatgtacgcggcagcgatttttctggacaactgtttgataacttctgccgttgcgtatagggcagatgtggaactgagcggaagagtgactcgtggcatgttggctattctataccacgatgataatgagaatcatttcaatgtgaatatcactgacgctattgatacagacccgttcaagcagatggtgggagaattgaatcgagaacctggcgaaaagggtgtggatgttcgaccgcatcggacttga

SEQ ID NO: 91379 - protein, 354 aa, Aedes albopictus
MLHLVGLLLLAQAVVISCCSCSDTTGVRRVIVDQDGGGDDAWALLMLLMNEKQYNVKVEAITCADGNTGLENSVRNAARILDGIGRRDVPLYRGASERLITPAPSRDVNGYFWGHDGFGDVRFGSEPDLRTISDEHAVVKMYELIRKYPGQITILCLGPLTNLAMLFKMFPKVKGDIAGIYILGGNRNGVGNTDFAAEFNFFTDPEAANIVVNNAPVILNIFPWETVLQLETDFPMDWRNEVFKVPRNKAIQVLNDVEAVVYANISAWQPCDMYAAAIFLDNCLITSAVAYRADVELSGRVTRGMLAILYHDDNENHFNVNITDAIDTDPFKQMVGELNREPGEKGVDVRPHRT

SEQ ID NO: 91380 - DNA, 972 bp, Brachydanio rerio
  CDS (1)..(972)
atggcacagaagctgctgataatcgacacagactgtggtatagatgatgctctggcaatcatagttgctctggcagctccgaatgtgaaggttttgggcgtcacctgctgcttcgggaacaccaatgtagacaatgtgtgtatgaatgtaatgcgggtcctgacagtctgtcaacaaacccagattccagtattcaaaggttctgcggctcctttacttgggccagagctgccactgaaagatcactttggcacagatgggcttggaggcgttctgaagaactctgaggattggaagcagctgatacagaaagagcatgcggttcatgccatattaaggctggtcaatgaaaacccaggacaggtatctctcatagctcttggtccactcaccaacttggctttggctgttagattagatcccggtctccctcagaaactcaaggatctgtatgtaatgggcggtaacatggaaggcaaggggaatatgacgccatcgtcagagtttaatttcaggatggatgctgaatcagcttatgtagtcttggaggaatacacctgcccgacacacatcgcaacctgggagtttacttgcagaaacaaactatcttgggagtattttgaggaactggttaatcagaaaacatcagttgctcaattcataaagaagatcacatccaagtgctgggcctactctagagattttaactccagcaacaacaaagacgtgctctttgggaaagggtttgtcccctatgatgcctttgctgtggcagcctgtctggacagcagtgtgatcacagagagtttgcggtgtgctgtacgtgtggaggtacgaggtgaactgggacgaggcatgatgattgtggacgcagccaatacactgaaaaaaggccatcttgcttttgtgatgaggacatgtgaccttaaaaagttcagctcaatgctcaatgcttcttttcaaatagcatag

SEQ ID NO: 91381 - protein, 323 aa, Brachydanio rerio
MAQKLLIIDTDCGIDDALAIIVALAAPNVKVLGVTCCFGNTNVDNVCMNVMRVLTVCQQTQIPVFKGSAAPLLGPELPLKDHFGTDGLGGVLKNSEDWKQLIQKEHAVHAILRLVNENPGQVSLIALGPLTNLALAVRLDPGLPQKLKDLYVMGGNMEGKGNMTPSSEFNFRMDAESAYVVLEEYTCPTHIATWEFTCRNKLSWEYFEELVNQKTSVAQFIKKITSKCWAYSRDFNSSNNKDVLFGKGFVPYDAFAVAACLDSSVITESLRCAVRVEVRGELGRGMMIVDAANTLKKGHLAFVMRTCDLKKFSSMLNASFQIA

SEQ ID NO: 91382 - DNA, 1014 bp, Oryza sativa
  CDS (1)..(1014)
atggatctgcaggaggcggcgatggaagccaggaacggccatcggatcccgccgacggaggagaaggtcatcatcgacacggatccagggatcgatgacagcgtggcgatcatgatggcgttcgaagctcccggcgtgaaggtcgtcggactcaccaccatcttcggcaactgcactacctcccacgccacccgcaatgccctcatcctgtgcgacagagcaggccgtcctgaggtgccggtagcagagggcagcgctgagcctctcaagggagggaaacctcacgttgctgattttgttcatggatcggatggacttggtaacacgtcctttcctgatcctaccaccaccaacaaagttgagcagtcagctgcagagtttctggttgataaggtatcagaatctccaggagagatctctgtactcgccttgggccctctcactaatatcgcattggccatgaagaaagactcctcctttgcaagcaaggttaagaggatagttgtgctgggtggagctttctttgcagctgggaatgccaccccttcagctgaagcaaatatccatagcgacccagaagcagctgacatagttttcacttctggggcagatatctacgtagttggccttaacataacaacccaagtctacttcacagacaaggatatgttggagctaaggaactcgaaagggaagcacgcacaattcctttgtgacatctgcaagttctacagagactggcatgtccactcctacggcgtcgatgctctttttctccatgatcctgtgagtttcaccgcgctagttcaccccgagtacttcacgttcaagaagggcgtggtgagggttgagacccagggcatctgcaaggggcatacttccatggacatgggactgaagaagtggaattcagacaacccgtggactggttactctccgatctcggttgcttggactgttgatgttcctaaggttctggcatatgccaaggagctactcttcaacgcacaatga

SEQ ID NO: 91383 - protein, 337 aa, Oryza sativa
MDLQEAAMEARNGHRIPPTEEKVIIDTDPGIDDSVAIMMAFEAPGVKVVGLTTIFGNCTTSHATRNALILCDRAGRPEVPVAEGSAEPLKGGKPHVADFVHGSDGLGNTSFPDPTTTNKVEQSAAEFLVDKVSESPGEISVLALGPLTNIALAMKKDSSFASKVKRIVVLGGAFFAAGNATPSAEANIHSDPEAADIVFTSGADIYVVGLNITTQVYFTDKDMLELRNSKGKHAQFLCDICKFYRDWHVHSYGVDALFLHDPVSFTALVHPEYFTFKKGVVRVETQGICKGHTSMDMGLKKWNSDNPWTGYSPISVAWTVDVPKVLAYAKELLFNAQ

SEQ ID NO: 91384 - DNA, 978 bp, Zea mays
  CDS (1)..(978)
atggggcaggacggccagcagatccgccgcgacaagctcatcatcgacacggatcccggcatcgatgatagcatgacgatcctaatggcgttcagagcacctagtgtggaaatcattgggctcacgaccatattcggcaacgtcgacacaaagggcgcaacacgtaacgcgctattgctgtgtgagagagcaggatgccccgaagttccagtagcagagggcagccatgagcccctaaagggaggaaagcggcgtgttgctgatttcgttcatgggtcagatggcattgggaatctgtttcttcctgcaccctctgctaagaaggttgaggaaagtgctgctgatttcctgattaataaggtctctgagtttccaggagaggtctctgtgcttgcgttgggacccctgacaaatgtagcattggccatcaaaagagacccttcctttgcaagcaaggttaagaaaatagttgtactgggtggagctttctttgcggctggaaatgtcaaccctgctgctgaagcaaatatccatggagacccagaagcagctgacatagtttttacttcaggagcagatatcgttgtggttggcattaacataacaacacaagtctgcctgacagatgaggatctcttggagctaagaaactcgaaagggaagcatgcagcgttcttatatgagatgtgcaagttctacagagattggcatgccaagtctgatggttttcatggaattttccttcatgatcctgtgagcttcactgccgtacttcatccagagtacttcacattcaagaagggtgtggtgagagtagagacccagggcatttgcactggccacactttgatggatcagggattgaaaaagtggaattcagagaacccatggtcagggtataaaccgatttcagttgcatggacggttgatgtgccaaaggtcatcagctttataaagaagctgctcatggcaccatga

SEQ ID NO: 91385 - protein, 325 aa, Zea mays
MGQDGQQIRRDKLIIDTDPGIDDSMTILMAFRAPSVEIIGLTTIFGNVDTKGATRNALLLCERAGCPEVPVAEGSHEPLKGGKRRVADFVHGSDGIGNLFLPAPSAKKVEESAADFLINKVSEFPGEVSVLALGPLTNVALAIKRDPSFASKVKKIVVLGGAFFAAGNVNPAAEANIHGDPEAADIVFTSGADIVVVGINITTQVCLTDEDLLELRNSKGKHAAFLYEMCKFYRDWHAKSDGFHGIFLHDPVSFTAVLHPEYFTFKKGVVRVETQGICTGHTLMDQGLKKWNSENPWSGYKPISVAWTVDVPKVISFIKKLLMAP

SEQ ID NO: 91386 - DNA, 1053 bp, Culex quinquefasciatus
  CDS (1)..(1053)
atgggcaaaatttctgccattgttggcgtagctctggcggcctttatgattttcatcattgtagcagactctgctgaggccaatcaatcaattcgacgcgttattgtcgatgtcgatgctggccccgatgacgcgtgggcactttatcacctgcttagcagcccgcaggtcaaagttgaggccatcagctgtgtgcgaggtaacacgaacgtgaccatggtgggtcggaacgtgctgcggattctgaccgcaatgggaaaggagaatgagattccagtttttttggggtctgatgaacgcctgattacgcctgggccggttgtggaccccaaggatatgtactttggagcggacggattctcagacgtagattactcccatttgcctccgctgaatatggcgctacttcgaacgggtgccattggtgaacatgcaagactcattgaaaagtatccttcagaaatcacgtttatcaccttgggaccgctaacaaacctcgctctgctgctgaaagtccacccgagcacccgccaactgatcaaggaagttttcgtgatgggcggaaaccgacacggtgttggcaacactgaaagtgccgccgagtttaacttctacaacgaccccgagagcgccaatatcgtggtcaacaactatcccgggctgatcacggtatttccgtgggagacagtttcgctcgatcatctcgtgatgaatcaaacgtggcggttcgagacgattgtaagctccacgaatcctgtggtacaaattttgagccctgctgagcggaaatcgttaggggaaggtgacaactggatgccctgcgatctgttggtggcaatgggcttcactaatccggaactgatcacaaaaacgaaacaatatccgggaagtgtggaacttgccggatcgctgacacgtggtcagctcgtgctgaaccatcaaaaggagggaactggaaacattgtgattgtggatgacatggaccacgcggcggtggagcgaatgatcatgggattggccgcggaatgcaaggcatgtgctggttcaggatga

SEQ ID NO: 91387 - protein, 350 aa, Culex quinquefasciatus
MGKISAIVGVALAAFMIFIIVADSAEANQSIRRVIVDVDAGPDDAWALYHLLSSPQVKVEAISCVRGNTNVTMVGRNVLRILTAMGKENEIPVFLGSDERLITPGPVVDPKDMYFGADGFSDVDYSHLPPLNMALLRTGAIGEHARLIEKYPSEITFITLGPLTNLALLLKVHPSTRQLIKEVFVMGGNRHGVGNTESAAEFNFYNDPESANIVVNNYPGLITVFPWETVSLDHLVMNQTWRFETIVSSTNPVVQILSPAERKSLGEGDNWMPCDLLVAMGFTNPELITKTKQYPGSVELAGSLTRGQLVLNHQKEGTGNIVIVDDMDHAAVERMIMGLAAECKACAGSG

SEQ ID NO: 91388 - DNA, 777 bp, Oryza sativa
  CDS (1)..(777)
atgacgacgacgaagaagaagctcgtcatcgacaccgacccgggaatcgatgacgccatggccatcttcgtggcgctgaggtcgccggaggtggagctgctgggcctcaccaccatcttcggcaacgtctacaccaccctcgccacccgcaacgccctccacctgctggaggctgttgggaggactgacatccccgtggcagagggatcccatgtaacaatcaagaaagccaccaagctacggattgcgagctttgttcatggctcggatggtctaggaaatcagaactttcctccgccaactgggaagcccttagatcaatcggccgccgcgtttcttgtcgagcaggcaaatctgtaccctggacaagttactgtggttgcccttggtccacttaccaacctagctttggctatagaacttgatccttctttcccgaagaagattgggcagattgtgatccttggtggtgcgtattcagttaatggaaatgtcaaccctgcagctgaggcaaatatatttggtgaccctgatgcagctgatatagttttcacctccggtgctgatattttggctgtgggaataaatattacacaccaagtagttctttctgatgctgaccgggaaaagcttgaacagtctgatagcaaatatgcccgatacttgagcaagatcctgggtctttattatgattaccacaaggacgcctacttcataaaaggtcagtgcctagcatcatgcaagttcatcgggaaaaaaaggttgcacagtctgtaa

SEQ ID NO: 91389 - protein, 258 aa, Oryza sativa
MTTTKKKLVIDTDPGIDDAMAIFVALRSPEVELLGLTTIFGNVYTTLATRNALHLLEAVGRTDIPVAEGSHVTIKKATKLRIASFVHGSDGLGNQNFPPPTGKPLDQSAAAFLVEQANLYPGQVTVVALGPLTNLALAIELDPSFPKKIGQIVILGGAYSVNGNVNPAAEANIFGDPDAADIVFTSGADILAVGINITHQVVLSDADREKLEQSDSKYARYLSKILGLYYDYHKDAYFIKGQCLASCKFIGKKRLHSL

SEQ ID NO: 91390 - DNA, 942 bp, Oryza sativa
  CDS (1)..(942)
atgacgacgacgaagaagaagctcgtcatcgacaccgacccgggaatcgatgacgccatggccatcttcgtggcgctgaggtcgccggaggtggagctgctgggcctcaccaccatcttcggcaacgtctacaccaccctcgccacccgcaacgccctccacctgctggaggctgttgggaggactgacatccccgtggcagagggatcccatgtaacaatcaagaaagccaccaagctacggattgcgagctttgttcatggctcggatggtctaggaaatcagaactttcctccgccaactgggaagcccttagatcaatcggccgccgcgtttcttgtcgagcaggcaaatctgtaccctggacaagttactgtggttgcccttggtccacttaccaacctagctttggctatagaacttgatccttctttcccgaagaagattgggcagattgtgatccttggtggtgcgtattcagttaatggaaatgtcaaccctgcagctgaggcaaatatatttggtgaccctgatgcagctgatatagttttcacctccggtgctgatattttggctgtgggaataaatattacacaccaagtagttctttctgatgctgaccgggaaaagcttgaacagtctgatagcaaatatgcccgatacttgagcaagatcctgggtctttattatgattaccacaaggacgcctacttcataaaaggagtgtatcttcacgatccagcaacacttattgctgcggtagatccgtcactgatgacttacacggaaggtgtagtgagggtgcagactgatggcatcacaaagggtctcacagttttcgacacaaccaagaaaaggtatggggagataactgcgtggaccggtaagccaaccgtgaaggttgctgtgaccgttgatgctcctgccgttgtggagatgtag

SEQ ID NO: 91391 - protein, 313 aa, Oryza sativa
MTTTKKKLVIDTDPGIDDAMAIFVALRSPEVELLGLTTIFGNVYTTLATRNALHLLEAVGRTDIPVAEGSHVTIKKATKLRIASFVHGSDGLGNQNFPPPTGKPLDQSAAAFLVEQANLYPGQVTVVALGPLTNLALAIELDPSFPKKIGQIVILGGAYSVNGNVNPAAEANIFGDPDAADIVFTSGADILAVGINITHQVVLSDADREKLEQSDSKYARYLSKILGLYYDYHKDAYFIKGVYLHDPATLIAAVDPSLMTYTEGVVRVQTDGITKGLTVFDTTKKRYGEITAWTGKPTVKVAVTVDAPAVVEM

SEQ ID NO: 91392 - DNA, 1023 bp, Dictyostelium discoideum
  CDS (1)..(1023)
atgttgaatgaagaattattaccaatttggttagatcacgactgcggacatgatgatgcgtttgccatgttattagcatttcattcaaaaatatttaatattttaggtatttcaagtgttcatggtaatcaaacagttgataagactaccattaatgcattgataacattggaaatcattggtaaatcaaattgtggttatgaagttgtcaaaggtgttagatcaccaatgtgtagacctgaacaagtatgttctgaaattcatggtgaaacaggattagattgtccaactgctgaattaccaaaaccaacccaactaccaattacagatagacctgcaattcaagttatgtttgaaaagatatcaaaattctatactgataatcaacaaaaacaaaaagttataatcgttgcaacaggttcattaacaaatgttgccttgctattcgcagtttacccacaaataaaaccaatggtagaagtctcattattgggtggctcaattaattttggtaatatctcaccagctgcagagtataacattttagtggatcctgaagctgcaaaagtggttttcgaaagtggtgtcaaggtcattatggtgccgttggaatgctcccataaggcattagttaatgaaaagattttagaaagaatttcagatattgaaaaagcagatggtaaacaaactcaattcataaagattatcaaaggtttattattgtttttcgcagataattataagagtacattcgattttgatcatccaccattacacgatccattggctgtagcttatttaattgatccaaccattttcaaatgtaaattaatgagagttgatattgaaacttcctctcatctttgtttgggtagaactgttgtagatttattcagtatgtcaaaattacaaaaaaatgttcacgtttgtactgacataaatgtcgataagttttgggatttaatgattaatgcaattgataattgttataatcatttatataaatcaaatattttaaaataa

SEQ ID NO: 91393 - protein, 340 aa, Dictyostelium discoideum
MLNEELLPIWLDHDCGHDDAFAMLLAFHSKIFNILGISSVHGNQTVDKTTINALITLEIIGKSNCGYEVVKGVRSPMCRPEQVCSEIHGETGLDCPTAELPKPTQLPITDRPAIQVMFEKISKFYTDNQQKQKVIIVATGSLTNVALLFAVYPQIKPMVEVSLLGGSINFGNISPAAEYNILVDPEAAKVVFESGVKVIMVPLECSHKALVNEKILERISDIEKADGKQTQFIKIIKGLLLFFADNYKSTFDFDHPPLHDPLAVAYLIDPTIFKCKLMRVDIETSSHLCLGRTVVDLFSMSKLQKNVHVCTDINVDKFWDLMINAIDNCYNHLYKSNILK

SEQ ID NO: 91394 - DNA, 969 bp, Xenopus laevis
  CDS (1)..(969)
atgtcatgcgagaagaagctgcttcttattgatgtggactgtggtacagatgatgctcaggctatcatgatggcaattgctgctccccatgtagaaattttagggatcacatgtgtgggtggcaacactccattggacaacgtctgcaaaaatgtccttcgtgttcttcgagtgtgcaatcgttctgatatccctgtttttagaggagcatccaaaccagtccttggagaagcaattcatgcttcctattttcatggagtagatggtctaggggatgttcctgatccagatgctccagatctagaacaaattcagaaggaacatgctgctgatgctctaaacagaattgtatcggagcaccctggccagatctccttggtggctacaggcccactgaccaatttggctttggctgtaaggatggatccaaatttccctcagaaacttaaaagcttgtacataatgggagggaatatggagtccagaggaaatactacggcttgtggagagttcaacttcttagcagatcccgaaggtgcctacattgttctaaatgagttcacttgtttaatgtacattgctacctgggaacacacatgtcgtcacaaactctcatgggaatggtatgatcagtgggtcaataggaacacaaagaaagcagactttataaagaagatctatgcccacagtttgcagtactcgagatataatgaaaaggagattaaagctttggtgggtggacctggatttgtttcctgcgactcttatgctatggcggctgccattgatgagaccacagtgaccgactttgttgagtgtgcagtgacagttgagctttctggaaaatttgctcgtggaatgatggtgctggatttgattgatgaccttaagaaaaaaagtaaggctcgtgtcatgacaggatgtgatatgggaaagtttgtcatccttatggagtcttctgtgcaataa

SEQ ID NO: 91395 - protein, 322 aa, Xenopus laevis
MSCEKKLLLIDVDCGTDDAQAIMMAIAAPHVEILGITCVGGNTPLDNVCKNVLRVLRVCNRSDIPVFRGASKPVLGEAIHASYFHGVDGLGDVPDPDAPDLEQIQKEHAADALNRIVSEHPGQISLVATGPLTNLALAVRMDPNFPQKLKSLYIMGGNMESRGNTTACGEFNFLADPEGAYIVLNEFTCLMYIATWEHTCRHKLSWEWYDQWVNRNTKKADFIKKIYAHSLQYSRYNEKEIKALVGGPGFVSCDSYAMAAAIDETTVTDFVECAVTVELSGKFARGMMVLDLIDDLKKKSKARVMTGCDMGKFVILMESSVQ

SEQ ID NO: 91396 - DNA, 945 bp, Leishmania donovani
  CDS (1)..(945)
atgccgcgcaagattattctcgattgtgatcccgggatcgatgatgccgtggccatctttctcgcccacggcaacccggaggtcgagctgctggccattacgacggtggtgggcaaccagaccctggagaaggtgacccggaacgcgcggctggtagctgacgtagccggcatcgttggtgtgcccgtcgcggctggttgcaccaagcccctcgtgcgcggtgtgcggaatgcctctcagattcatggcgaaaccggcatgggtaacgtctcctacccaccagagttcaagacaaagttggacggccgtcatgcagtgcagctgatcatcgaccttatcatgtcgcacgagccgaagacgatcacgcttgtgcctacgggtggcctgacgaacattgcgatggctgtccgtcttgagccgcgcatcgtggaccgtgtgaaggaggtggttctgatgggtggcggctaccatactggtaatgcgtcccctgtagcggagttcaacgtcttcgtcgacccggaggcggcgcacattgtgttcaacgagagctggaacgtaacgatggtggggctggacctaacgcaccaggcactcgccacgccggcggtccagaagcgagtgaaggaggtgggcacgaagccggctgccttcatgctgcagattttggacttttacacgaaggtgtacgaaaaggagcgcaacacgtacgcgacggtgcacgatccctgcgctgtggcgtacgtgattgaccccaccgtgatgacgacggagcaagtgccagtggacatcgagctcaatggggcactgacgactgggatgacggtcgcggacttccgctacccacggccaaagcactgccacacgcaggtggctgtgaagctggacttcgacaagttttggtgcctcgtgattgacgcactcaagcgcatcggcgatcctcaatga

SEQ ID NO: 91397 - protein, 314 aa, Leishmania donovani
MPRKIILDCDPGIDDAVAIFLAHGNPEVELLAITTVVGNQTLEKVTRNARLVADVAGIVGVPVAAGCTKPLVRGVRNASQIHGETGMGNVSYPPEFKTKLDGRHAVQLIIDLIMSHEPKTITLVPTGGLTNIAMAVRLEPRIVDRVKEVVLMGGGYHTGNASPVAEFNVFVDPEAAHIVFNESWNVTMVGLDLTHQALATPAVQKRVKEVGTKPAAFMLQILDFYTKVYEKERNTYATVHDPCAVAYVIDPTVMTTEQVPVDIELNGALTTGMTVADFRYPRPKHCHTQVAVKLDFDKFWCLVIDALKRIGDPQ

SEQ ID NO: 91398 - DNA, 1077 bp, Arabidopsis thaliana
  CDS (1)..(1077)
atggcgataggagaccgcaagaagattatcatcgatactgatcctggaatcgagagctatcatgagtttattctcactggatttgatgatgttgtagatgatgcaatggcgatattcgtagctttaaattcacctgaagttgatgtcattggcctcactactatctttggaaacgtgtataccactctcgccactcgaaacgccttgcatttgttggaggttgcgggtaggaccgatattccggtggctgaaggaacacataaaaccttcttgaacgatacgaagcttcgaatagctgactttgttcatggaaaagatgggcttggcaaccaaaacttccctccacctaaaggaaaaccaattgaaaagtctggacctgagtttttagttgaacaagcaaagctttgccctggtgaaatcacggttgttgctttgggaccactaacaaatctcgcgttggctgttcagcttgatccagagttttcgaaaaatgtcggacaaattgttcttcttggtggagcatttgcagtaaacggaaatgtaaatccagcttcggaagctaatatttttggcgatcccgaagctgcagatattgtgttcacatgtggggccgatataattgctgtgggaatcaatgtgacccatcaagttattatgacagaacataatttagttaaacagagctttctaatggcttttttcccggtgtttctgctggatttagctgatgacaaggacaaactagcatcatcgaaggggaaattagctcaatatctctgtaaaatccttgatgtgtactatgattatcatctcacggcttacgaaatcaaaggtgtgtaccttcatgatcctgcgacgatccttgcggctttccttccttctctattcacttatacagaaggagttgctagagtgcagacaagtggtatcactaggggactcactttactgtacaacaatcttaagaggtttgaggaagcgaacgagtggtcagacaaaccaacggtaaaagtggcagtgacggttgatgctcctgcagtcgtgaagctcataatggataggcttatggagtcttaa

SEQ ID NO: 91399 - protein, 358 aa, Arabidopsis thaliana
MAIGDRKKIIIDTDPGIESYHEFILTGFDDVVDDAMAIFVALNSPEVDVIGLTTIFGNVYTTLATRNALHLLEVAGRTDIPVAEGTHKTFLNDTKLRIADFVHGKDGLGNQNFPPPKGKPIEKSGPEFLVEQAKLCPGEITVVALGPLTNLALAVQLDPEFSKNVGQIVLLGGAFAVNGNVNPASEANIFGDPEAADIVFTCGADIIAVGINVTHQVIMTEHNLVKQSFLMAFFPVFLLDLADDKDKLASSKGKLAQYLCKILDVYYDYHLTAYEIKGVYLHDPATILAAFLPSLFTYTEGVARVQTSGITRGLTLLYNNLKRFEEANEWSDKPTVKVAVTVDAPAVVKLIMDRLMES

SEQ ID NO: 91400 - DNA, 1060 bp, Crithidia fasciculata
  CDS (61)..(1008)
ttctcctcttctatttgcaggcaatccactgtcgctctatatcttaaaaaaaaaaaaaagatgccgaagaagatcatcctcgactgcgacccgggtctcgatgacgccgtggcgatcctgctggcgcacggcaaccccgagatcgagctgctggccatcacgacggtggtaggcaaccagacgctggcgaaggtcacccgcaacgcgcagcttgtggccgacatcgccggcattacgggtgtccctattgctgccggctgcgacaagccgctggtgcgcaagatcatgacggcgggccacattcacggcgagtcgggcatgggcacagttgcctacccggccgagttcaagaacaaggtggacgagcgccacgcggtgaacctgatcatcgaccttgtgatgagccacgagcccaagacgatcacgctggtgccgacgggtggactgacgaacattgcgatggctgcgcgtctggagccgcggatcgtggaccgcgtgaaggaggtcgtgctgatgggcggcggctaccacgagggcaatgcgacgtctgttgccgaatttaacatcattatcgatcccgaagcagcgcacatcgtctttaacgagagctggcaggtgacgatggtgggcctcgacctcacgcaccaggcgctggccacaccgccgattctgcagcgtgtgaaggaggtggacacgaacccggcgcgcttcatgttggagatcatggactactacacgaagatttaccaaagtaaccgctatatggcggctgcggcggtgcacgacccttgcgcggtggcttacgtgattgacccgtcggtgatgacgacggagcgagtgccggtggacatcgagctgaccggtaagctgacgctggggatgacggtggctgatttccgtaacccacgcccggagcactgccacacgcaggtggcggtgaagctggacttcgagaagttctggggcttggtgttggacgctctggagcgtatcggcgacccccagtaacaggatctcgaagattcaatcggaaagaagagatggcgtcagtaaagcagac

SEQ ID NO: 91401 - protein, 315 aa, Crithidia fasciculata
MPKKIILDCDPGLDDAVAILLAHGNPEIELLAITTVVGNQTLAKVTRNAQLVADIAGITGVPIAAGCDKPLVRKIMTAGHIHGESGMGTVAYPAEFKNKVDERHAVNLIIDLVMSHEPKTITLVPTGGLTNIAMAARLEPRIVDRVKEVVLMGGGYHEGNATSVAEFNIIIDPEAAHIVFNESWQVTMVGLDLTHQALATPPILQRVKEVDTNPARFMLEIMDYYTKIYQSNRYMAAAAVHDPCAVAYVIDPSVMTTERVPVDIELTGKLTLGMTVADFRNPRPEHCHTQVAVKLDFEKFWGLVLDALERIGDPQ

SEQ ID NO: 91402 - DNA, 1137 bp, Saccharomyces cerevisiae
  CDS (1)..(1137)
atggaatctgctgatttttttacctcacgaaacttattaaaacagataatttccctcatctgcaaggttggggaagggttggacagcaataaccagcgactgtttgaagaaaagatgactgttagtaaaatacccatatggctagattgtgatcctggtcatgatgatgccatagccattttattaggctgtttccatccagctttcaatcttctaggaatcagcacgtgttttggtaacgcaccgccagagaatactgactacaacgcccgttctcttttgactgcgatgggcaaagcacaagcgattccagtttataaaggcgcacagagaccttggaaaagggaacctcattatgctcctgacattcatggtatatcaggtttagacggcacttctttgctacctaagccaacatttgaggcaagaactgataaaacgtatattgaggccattgaagaggcgattctagctaacaatggagagatatcctttgtgtctactggtgcacttaccacattagcaacagtttttaggtgtaaaccatacctaaaaaaatctgtcaaatatattagcattatggggggtggactccatggtctaggaaactgtaacccaaatctttctgctgaattcaacgtttggattgatcctgacgcagcgaattacatattccgtgatcccgatgtaaaggacaaatgtatagtagttcctctaaatttaactcacaaggccatagctacttacaaggttaacgaaatgatatacaacgaaaagaataacagcaagttacgagaattgtttttggagctttttcaattttttgctcatacctacaaggatatgcaaggatttgaatcgggcccacctatacatgatccggtagctttgatgccgcttttggaattttatgggtgggatccatcgtctgcggttggatttcgctacaagagaatggacatatcctgcattgatgatgttttcaacgaaaactcagggaaaattatcattgaaaaagaatatccaaatgacagtgatgttggtacaataattggtctcgatttgaatatccagtacttttgggatcagatttttgaagcattaaatagagcagacaaaatgtcaacgattggataa

SEQ ID NO: 91403 - protein, 378 aa, Saccharomyces cerevisiae
MESADFFTSRNLLKQIISLICKVGEGLDSNNQRLFEEKMTVSKIPIWLDCDPGHDDAIAILLGCFHPAFNLLGISTCFGNAPPENTDYNARSLLTAMGKAQAIPVYKGAQRPWKREPHYAPDIHGISGLDGTSLLPKPTFEARTDKTYIEAIEEAILANNGEISFVSTGALTTLATVFRCKPYLKKSVKYISIMGGGLHGLGNCNPNLSAEFNVWIDPDAANYIFRDPDVKDKCIVVPLNLTHKAIATYKVNEMIYNEKNNSKLRELFLELFQFFAHTYKDMQGFESGPPIHDPVALMPLLEFYGWDPSSAVGFRYKRMDISCIDDVFNENSGKIIIEKEYPNDSDVGTIIGLDLNIQYFWDQIFEALNRADKMSTIG

SEQ ID NO: 91404 - DNA, 915 bp, Escherichia coli
  CDS (1)..(915): transl_table=11
atgcgtttacctatcttcctcgatactgaccccggcattgacgatgccgtcgccattgccgccgcgatttttgcacccgaactcgacctgcaactgatgaccaccgtcgcgggtaatgtctcggttgagaaaactacccgcaatgccctgcaactgctgcatttctggaatgcggagattccgctcgcccaaggggccgctgtgccactggtacgcgcaccgcgtgatgcggcatctgtgcacggcgaatcgggaatggctggctacgactttgttgagcacaaccgaaagccgctcgggataccggcgtttctggcgattcgggatgccctgatgcgtgcaccagagcctgttaccctggtggccatcggcccgttaaccaatattgcgctgttactttcacaatgcccggaatgcaagccgtatattcgccgtctggtgatcatgggtggttctgccggacgcggcaactgtacgccaaacgccgagtttaatattgctgccgatccagaagctgctgcctgtgtcttccgcagtggtattgaaatcgtcatgtgcggtttggatgtcaccaatcaggcaatattaactcctgactatctctctacactgccgcagttaaaccgtaccgggaaaatgcttcacgccctgtttagccactaccgtagcggcagtatgcaaagcggcttgcgaatgcacgatctctgcgccatcgcctggctggtgcgcccggacctgttcactctcaaaccctgttttgtggcagtggaaactcagggcgaatttacctcaggcacgacggtggttgatatcgacggttgcctgggcaagccagccaatgtacaggtggcattggatctggatgtgaaaggcttccagcagtgggtggctgaggtgctggctctggcgtcgtaa

SEQ ID NO: 91405 - protein, 304 aa, Escherichia coli
MRLPIFLDTDPGIDDAVAIAAAIFAPELDLQLMTTVAGNVSVEKTTRNALQLLHFWNAEIPLAQGAAVPLVRAPRDAASVHGESGMAGYDFVEHNRKPLGIPAFLAIRDALMRAPEPVTLVAIGPLTNIALLLSQCPECKPYIRRLVIMGGSAGRGNCTPNAEFNIAADPEAAACVFRSGIEIVMCGLDVTNQAILTPDYLSTLPQLNRTGKMLHALFSHYRSGSMQSGLRMHDLCAIAWLVRPDLFTLKPCFVAVETQGEFTSGTTVVDIDGCLGKPANVQVALDLDVKGFQQWVAEVLALAS

SEQ ID NO: 91406 - DNA, 993 bp, Schizosaccharomyces pombe
  CDS (1)..(993)
atgactaacacaattgattcattccaaaaaggctccgcattagaaaactataacatatggatcgattgcgatcctggacatgacgatgttgtcgccttaacattggctgcttgcgctggacattgtaaaattttgggtgttagtaccgtacatggtaatacaacgctagaatttactaccaaaaatgctttagcggtaatggagcttttaaatcaagatgttgatgttcatgctggcgcagcgaagcccttgatgcgcgagtccgcgttcgctactcacatacatggtacgaatgggcttgcagggatttcattgcttcctgattatcccaaaaagaaggctactcctgatgcggtgttcgctatgtataccactatttctaattatccagagcctgtcactctcgtagctaccggtcctttgacaaacattgcattgttattggcaacgtacccaagcgttaccgacaacatagaaaggtttatatttatgggtggtagcacaggcattggaaatattacttctcaagcagaattcaacgtgtatgctgatcctgaggcagctaggctcgttttagagactaaatcacttatcggcaaactatttatggtgccgctagatgtcactcataaagtacttttagatgcaaacattattcagttactgcgtcaacatagcaacccatttagttccacactggtagaattgatgactgtctttcaacaaacttatgaaaatgtctacggaattcgaaacggtgttcccgttcatgacgtttgtgctgttgctttggcgctgtggccatctctgtggacctcgcgttctatgtatgtgactgtaagcttagattctctcactcttggtcgcactgtctgtgatgtatggtcgcaacaaaatcagtatccggctaatgttcatgttgttttggaagctgatgtttcattattttgggagacgtttattggagttatagacaggctcaattatttgtag

SEQ ID NO: 91407 - protein, 330 aa, Schizosaccharomyces pombe
MTNTIDSFQKGSALENYNIWIDCDPGHDDVVALTLAACAGHCKILGVSTVHGNTTLEFTTKNALAVMELLNQDVDVHAGAAKPLMRESAFATHIHGTNGLAGISLLPDYPKKKATPDAVFAMYTTISNYPEPVTLVATGPLTNIALLLATYPSVTDNIERFIFMGGSTGIGNITSQAEFNVYADPEAARLVLETKSLIGKLFMVPLDVTHKVLLDANIIQLLRQHSNPFSSTLVELMTVFQQTYENVYGIRNGVPVHDVCAVALALWPSLWTSRSMYVTVSLDSLTLGRTVCDVWSQQNQYPANVHVVLEADVSLFWETFIGVIDRLNYL

SEQ ID NO: 91408 - DNA, 942 bp, Escherichia coli
  CDS (1)..(942): transl_table=11
atggaaaagagaaaaattattctggattgtgatccgggtcatgatgatgctattgctataatgatggcggcgaaacatccggcaatagatttattaggcatcactattgtagcgggtaatcagacgcttgataaaacattaattaatggcctgaatgtttgccagaaactggagattaatgttccggtttatgcggggatgccgcagcccattatgcgtcaacaaatcgttgccgataatattcacggtgaaaccggactggatggcccggtattcgagccgctgacccgccaggcagaaagcactcatgcggtgaaatatatcattgataccctgatggcaagcgatggcgatatcactctggtgccggttggtccgctttcaaatatcgcggtggcaatgcgtatgcaacccgcgatcctgcccaaaatccgtgaaattgtgctaatgggcggcgcttacggtacaggcaacttcacgccatctgccgagttcaacatctttgccgacccggaagccgcacgcgtagtgttcacctccggcgttccattagtgatgatgggcctcgatctcaccaaccagaccgtttgcaccccggacgtgattgctcggatggaaagggcaggcggccccgccggagagctgttcagcgacatcatgaacttcactctcaaaacgcagttcgaaaactacggccttgctggcggcccggtgcacgacgccacctgcatcggttatctgattaaccctgatggcattaaaacccaggagatgtacgtcgaagtggacgtcaacagtggcccttgctatgggcgtaccgtctgcgacgagctgggcgttcttggcaagcccgccaataccaaagtcggcatcactattgatacagactggttctggggattagtcgaagagtgcgtgcgcggctacatcaaaacccattaa

SEQ ID NO: 91409 - protein, 313 aa, Escherichia coli
MEKRKIILDCDPGHDDAIAIMMAAKHPAIDLLGITIVAGNQTLDKTLINGLNVCQKLEINVPVYAGMPQPIMRQQIVADNIHGETGLDGPVFEPLTRQAESTHAVKYIIDTLMASDGDITLVPVGPLSNIAVAMRMQPAILPKIREIVLMGGAYGTGNFTPSAEFNIFADPEAARVVFTSGVPLVMMGLDLTNQTVCTPDVIARMERAGGPAGELFSDIMNFTLKTQFENYGLAGGPVHDATCIGYLINPDGIKTQEMYVEVDVNSGPCYGRTVCDELGVLGKPANTKVGITIDTDWFWGLVEECVRGYIKTH

SEQ ID NO: 91410 - DNA, 24 bp, Primer
atggcactgccaattctgttagat

SEQ ID NO: 91411 - DNA, 24 bp, Primer
ttaagcgtaaaatttcagacgatc

SEQ ID NO: 91412 - protein, 567 aa, consensus
  MISC_FEATURE (1)..(567): consensus for the disclosure of xaa see table XV
DXDXGXDXXXXXXXXXXXXXXXDXXAXXXXXXXXXXXXXXXXXXXXXXXXXXXXXXXXXGNXXXXXXXXNXXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXHGXXGXXXXXXXXXXXXXXXXXXXXXXXXXXXXXXXXXXXXXXXXXXXXXXXXXXXXXXXXXXXXXXXXXXXXXXXXXXXXGXXTNXAXXXXXXXPXXXXXXXXXXXMGGXXXXXXXXXXXXXXXXXXXXXXNXXXXAEXNXXXDPXAAXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXG

SEQ ID NO: 91413 - protein, 73 aa, consensus
  MISC_FEATURE (1)..(73): consensus for the disclosure of xaa see table XV
XXXXXXXXXXXXXXXXXXXXXXXXXXXXXXXXXXXXXXXXXXXXXXXXXXXXXXXXXXXXXXXXXXXXXXXXX

SEQ ID NO: 91414 - protein, 71 aa, consensus
  MISC_FEATURE (1)..(71): consensus for the disclosure of xaa see table XV
XXXXXXXXXXXXXXXXXXXXXXXXXXXXGXXXXXXXXXXXXXXXXXXXXXXXXXXXXXXNXXXDXXXXXXX

SEQ ID NO: 91415 - DNA, 1686 bp, Escherichia coli
  CDS (1)..(1686)
atgaatataaacgtcgccgaattgttaaatgggaattacattctgttattatttgtggtcctcgcgcttgggctatgtctcgggaaattacgacttggttcgatccaactgggtaattccattggcgttttagtcgtatcgctgttattaggccaacaacatttcagcattaacaccgacgcgcttaatcttggctttatgctgtttattttctgcgtcggggtcgaagccggaccgaactttttttccattttttttcgcgatgggaaaaattacctaatgttagcactggtgatggttggcagtgcgctggtgatcgccttagggttaggtaagctgtttggctgggatattggcctgacggccggtatgttagctggctctatgacgtcgacaccggttctggtcggtgctggcgatacactgcgtcattccggcatggaaagcaggcagctctcactggcactggataatctgagcctcgggtatgccttaacctatttaatcggtctggtgagtttgattgttggtgcgcgttacttgccgaaattgcagcatcaggacttacagaccagcgcccagcaaatcgcccgcgaacgtggcctggacactgatgccaaccgtaaggtttatttaccggtgatccgcgcctaccgcgtcggcccggagctggtggcctggaccgacggcaaaaatctgcgtgaactgggtatttatcgacaaactggctgctacattgaacgtattcgacgtaacgggattctggcgaatccagacggtgatgctgtgctacaaatgggagatgaaatagcgttggtaggctatcccgacgcccacgcacgactcgatcccagcttccgtaacggcaaagaagttttcgatcgtgaccttctcgacatgcgtatcgtcactgaagaagtggtcgttaaaaaccataacgccgtgggcaaacgtctcgcacaactgaagttgaccgatcacggttgcttccttaaccgcgtcattcgtagccagattgagatgccgatagatgacaacgtcgtgcttaacaaaggtgacgttttacaagtcagcggcgatgcccgtcgcgtaaaaaccatcgccgatcgcatcggctttatctcgattcacagccaggtcactgacttgctggcattctgcgccttctttgttattgggctgatgatcgggatgatcaccttccagttcagcacattcagtttcggcatggggaacgctgccgggttgttattcgccggaattatgctgggatttatgcgcgctaaccacccgaccttcggttacattccgcagggtgcattaagcatggtgaaagagttcggcttaatggtgtttatggcaggcgttggtctgagcgccggtagcggtattaataacggcctgggcgcgattggcggtcagatgttgattgccggattgattgtcagtcttgtgccagtggttatctgtttcttgttcggtgcttatgtattgcgaatgaaccgcgcactgttgttcggcgcaatgatgggcgcacgcacctgcgcgccggcaatggagatcatcagtgatacagctcgcagcaacatcccggcgctgggctatgcgggcacctatgcaatcgccaacgtcctgctgacgctggcagggacaatcatcgtcatggtatggccaggattaggataa

SEQ ID NO: 91416 - protein, 561 aa, Escherichia coli
MNINVAELLNGNYILLLFVVLALGLCLGKLRLGSIQLGNSIGVLVVSLLLGQQHFSINTDALNLGFMLFIFCVGVEAGPNFFSIFFRDGKNYLMLALVMVGSALVIALGLGKLFGWDIGLTAGMLAGSMTSTPVLVGAGDTLRHSGMESRQLSLALDNLSLGYALTYLIGLVSLIVGARYLPKLQHQDLQTSAQQIARERGLDTDANRKVYLPVIRAYRVGPELVAWTDGKNLRELGIYRQTGCYIERIRRNGILANPDGDAVLQMGDEIALVGYPDAHARLDPSFRNGKEVFDRDLLDMRIVTEEVVVKNHNAVGKRLAQLKLTDHGCFLNRVIRSQIEMPIDDNVVLNKGDVLQVSGDARRVKTIADRIGFISIHSQVTDLLAFCAFFVIGLMIGMITFQFSTFSFGMGNAAGLLFAGIMLGFMRANHPTFGYIPQGALSMVKEFGLMVFMAGVGLSAGSGINNGLGAIGGQMLIAGLIVSLVPVVICFLFGAYVLRMNRALLFGAMMGARTCAPAMEIISDTARSNIPALGYAGTYAIANVLLTLAGTIIVMVWPGLG

SEQ ID NO: 91417 - DNA, 1686 bp, Escherichia coli K12
  CDS (1)..(1686): transl_table=11
atgttatctcaagagaaatggacgatgagtgatatagcattaacggtcagtattctggctttggtggcagtcgtcggtttgtttatcggcaacgtcaaatttcgcggcataggattaggtattggcggcgtgctgtttggtgggatcatcgtcggccattttgtttctcaggcggggatgacattaagtagcgatatgctgcatgttattcaggaatttggcctgatcctgttcgtttatactatcgggattcaggtagggccgggcttctttgcctcattgcgcgtctccggattacgcctcaacctgtttgctgttctgatcgtcatcatcggtggtctggttaccgccatcctgcataaactgtttgatattccactgccggtagtgctggggattttctccggtgcggttaccaatacgccagcgctgggggcagggcagcagattttgcgcgacctgggtacaccaatggaaatggtcgatcagatggggatgagttacgcgatggcgtatccattcggcatttgcgggattttgttcaccatgtggatgttgcgggttattttccgcgtcaatgtcgagacagaagctcagcagcacgagtcttcacgcaccaatggcggcgcgctgatcaagactatcaatattcgcgttgagaaccctaacctgcatgatttagccattaaagatgtaccgattctcaacggcgacaaaattatctgctcgcgtctgaaacgcgaagaaaccctaaaagttccttcgccagataccattatccaactgggcgatttgctgcatctggtgggtcagccagcggatttacataatgcgcaactggtgattggtcaggaggtcgatacttcgctgtccacgaaaggcactgatttgcgcgtcgagcgtgtggtggtcaccaatgaaaacgtgctcggaaaacgtattcgcgacctgcactttaaagaacgctatgacgttgttatctcgcgcctgaaccgtgccggggtcgaactggtcgccagtggcgatatcagcctgcagttcggcgatatcctcaatctggtggggcgtccgtccgcaattgatgccgttgccaatgtgctggggaatgcgcagcaaaaactgcaacaggttcagatgctgccagtgtttattggcatcgggctaggcgtattgttaggttctattcccgtctttgtgccaggattcccggccgcgttgaaactggggctggcgggcggaccgctgattatggcgttgatcctcgggcgtatcggcagtatcggcaagctgtactggtttatgccgccaagcgccaacctcgcgctgcgggagctggggatcgtgctgttcctctcggtcgttggtctgaaatctggtggggattttgtgaataccctggtcaatggcgaagggctaagctggattggttatggtgccctgatcaccgccgttccgctgattactgttggcattctggcgcggatgttagccaaaatgaattacctgaccatgtgcgggatgctggcaggttccatgaccgatcctccggcgctggcgtttgctaataatcttcatccaaccagcggtgcggcggcgctctcttacgccactgtctatccgttggtaatgttcctgcgcattatcaccccccaattactggcggtgctcttctggagtatcggttaa

SEQ ID NO: 91418 - protein, 561 aa, Escherichia coli K12
MLSQEKWTMSDIALTVSILALVAVVGLFIGNVKFRGIGLGIGGVLFGGIIVGHFVSQAGMTLSSDMLHVIQEFGLILFVYTIGIQVGPGFFASLRVSGLRLNLFAVLIVIIGGLVTAILHKLFDIPLPVVLGIFSGAVTNTPALGAGQQILRDLGTPMEMVDQMGMSYAMAYPFGICGILFTMWMLRVIFRVNVETEAQQHESSRTNGGALIKTINIRVENPNLHDLAIKDVPILNGDKIICSRLKREETLKVPSPDTIIQLGDLLHLVGQPADLHNAQLVIGQEVDTSLSTKGTDLRVERVVVTNENVLGKRIRDLHFKERYDVVISRLNRAGVELVASGDISLQFGDILNLVGRPSAIDAVANVLGNAQQKLQQVQMLPVFIGIGLGVLLGSIPVFVPGFPAALKLGLAGGPLIMALILGRIGSIGKLYWFMPPSANLALRELGIVLFLSVVGLKSGGDFVNTLVNGEGLSWIGYGALITAVPLITVGILARMLAKMNYLTMCGMLAGSMTDPPALAFANNLHPTSGAAALSYATVYPLVMFLRIITPQLLAVLFWSIG

SEQ ID NO: 91419 - DNA, 1662 bp, Salmonella enterica subsp. enterica serovar Typhi Ty2
  CDS (1)..(1662): transl_table=11
atgagtgatatcgcattgacggtcagcgttctggcgttggtggcggttgtcggtttatggatcggcaacattaaagtgcgcggtgtcggctttggtattggcggtgtgttgttcggcggtattatcgtcggccacttcgtcgatcaggctggggtgacgctgagcggcgatatgctgcactttatccaggagttcggcctgatcctttttgtttataccatcggcatacaggtggggccggggtttttcgcctcgctgcgcgtttccgggctacgtctgaatctgtttgccgttctgattgtgattatgggcgggttggtcaccgcgattctgcataaaattttcgctattccgctgccggtagtgctggggattttctccggcgcagtcaccaatacgcctgcgttaggggcgggtcagcaaatcctgcgcgatctgggaacgccagtggatctggtagatcagatggggatgagctatgcgatggcgtatccgtttggcatctgcggtattttgctcaccatgtggctgatgcggctgatttttcgcgttaacgtcgaggcggaggcgcagaagcacgaatcctctctcgctaacggccattcattaattcagacaatgaatatccgtgtcgagaatccgaacctcaataatatggctatccaggatgtgccgatcctgaacagcgataaaatcatttgctcacgcctgaaacgcgatgacacgctgatggtgccgtcgccggggacgattatccaggcaggcgacctgctgcacctcgtcggccaacctaccgacctgcataacgcgcaactggtgatcggtaaggaagtggacacctcgttgtcgacgcgcggcacggatttacgtgtcgagcgtgtggtcatcaccaacgaaaaagtgctcggcaaacgtatccgcgatttgcactttaaagagcgttatgacgtggttatctcccgccttaaccgcgcgggcgttgagctggtcgccagcagcgacgctagcctgcagtttggcgacattctcaatctggtggggcgtcctgcctcgattgatgcggtagccaatgtggtcggcaacgcgcagcaaaaactccagcaggtgcagatgctgccggtgtttatcggcatcggattaggggttctgcttgggtcaatcccgttgtttgtgccgggattcccggtcgcgttaaaactggggctggccggcgggccgttgatcatggcgctaattttggggcgtatcggcagcatcggtaagctgtactggtttatgccgccgagcgccaacctcgcgctgcgtgaattaggcatcgttttgtttctggcggtcgttggactgaaatccggcggcgattttgtcgatacgctgacacagggcgaaggattaagctggattggctacggtattttcatcaccgctattccgctgattaccgtcggtttgctggcgcgaatttttgccaaaatgaactacctgacgctgtgcgggatgctggccggttcgatgaccgatccgccagcgctggcatttgccaacaatcttcatgccaccagcggcgcggcggcgctctcttacgcgaccgtctatccgttagtgatgttcctgcgtattatcacgccacaactgctggcggtgattttttggggaatgggttag

SEQ ID NO: 91420 - protein, 553 aa, Salmonella enterica subsp. enterica serovar Typhi Ty2
MSDIALTVSVLALVAVVGLWIGNIKVRGVGFGIGGVLFGGIIVGHFVDQAGVTLSGDMLHFIQEFGLILFVYTIGIQVGPGFFASLRVSGLRLNLFAVLIVIMGGLVTAILHKIFAIPLPVVLGIFSGAVTNTPALGAGQQILRDLGTPVDLVDQMGMSYAMAYPFGICGILLTMWLMRLIFRVNVEAEAQKHESSLANGHSLIQTMNIRVENPNLNNMAIQDVPILNSDKIICSRLKRDDTLMVPSPGTIIQAGDLLHLVGQPTDLHNAQLVIGKEVDTSLSTRGTDLRVERVVITNEKVLGKRIRDLHFKERYDVVISRLNRAGVELVASSDASLQFGDILNLVGRPASIDAVANVVGNAQQKLQQVQMLPVFIGIGLGVLLGSIPLFVPGFPVALKLGLAGGPLIMALILGRIGSIGKLYWFMPPSANLALRELGIVLFLAVVGLKSGGDFVDTLTQGEGLSWIGYGIFITAIPLITVGLLARIFAKMNYLTLCGMLAGSMTDPPALAFANNLHATSGAAALSYATVYPLVMFLRIITPQLLAVIFWGMG

SEQ ID NO: 91421 - DNA, 1638 bp, Photobacterium profundum SS9
  CDS (1)..(1638): transl_table=11
ttgctttttgttgttctcgctgttggtctaagttttggtaaaattcgttttgctaagatgcaagtaggcaattctattggtgttttactgactgccatactgttcggtaatgccgggtttacctttaatactgaagcattaaatattggctttatgctgtttattttttgtgtgggtatagaggctggccccaacttttttggtattttcttccgagatggtaaacattaccttttactcgcccttgttgtgctgctttccgccatagctatcactttagccatgactcattatcttgggcttgatataggtttagcgacaggcttaatggctggttcattgacagcaacacctgttcttgtaggtgcaaaagacgcattgaattccggattatctggcattagcgatcctgatatcattaaacaaaccattgatagcctaagcgttggctatgctatgtcttatttaatgggcttaatcagtcttatttttctcgctaaactaatgcctaaattacagaaacaagacctggctgaatcgtcgcaacaaattgcccgtgaacgcggtattggtgaagtggggcaacgtaaagtatatttgccaatcattcgcgcttaccgtgttggccctgagcttattaactggattgatagtcgtaacttacgtgagttgggcatctaccgccaaacaggctgctacatcgaacgtatacggcgaaacggtatattagctaacccagatggtgatgctattttacaagaaggtgatgagattgccttagtgggttacccagacagccatgcacgtttggatcccagctttcgaaacggcaaagaagttttcgaccgtgatcttctcgaccttcgtattgttgaagaagagattgtagttaagaatgacaacatctctggcaaacgcctatctgagctaaatttatcagaatacggttgtttcttgaaccgtgttgttcgcgcacaaatagaaatgccgatggaccataatattcttttgaataaaggggatattttgcaagtcagtggagaaaaaagtcgagtacttggtcttgctgaacgtattggttttatctcgattcacagtcaaattgccgatctattagcattctgctgtttttttatcatcgggttacttatcggttcgattacattagcatttggtcacgttgcatttggtttaggtagtgctgcagggcttctgattgccggtattacattaggattcctacgtgctaaccaccctacttttggctatgtaccccaaggtgcgcttaatatggcgaaagatcttggcttaatggtcttcatggtaggaattggtttgagtgcgggttctaatttattcgattcatttgcacatattggccctatggtcttagtcaccagcttaatggtgagtgtgatccctgttgtattggcatacctgtttggtgcttacgtactgaagatgaaccgtgcacttttatttggtgccatcattggtgctcgaacttgtgcacctgcgatggatatgatcaatgaacatgctcgaagcacaattccagctttaggctatgctggtacttatgccattgccaacgtactgttaacgattgccggtacgttaatcatcatcatgaattaa

SEQ ID NO: 91422 - protein, 545 aa, Photobacterium profundum SS9
MLFVVLAVGLSFGKIRFAKMQVGNSIGVLLTAILFGNAGFTFNTEALNIGFMLFIFCVGIEAGPNFFGIFFRDGKHYLLLALVVLLSAIAITLAMTHYLGLDIGLATGLMAGSLTATPVLVGAKDALNSGLSGISDPDIIKQTIDSLSVGYAMSYLMGLISLIFLAKLMPKLQKQDLAESSQQIARERGIGEVGQRKVYLPIIRAYRVGPELINWIDSRNLRELGIYRQTGCYIERIRRNGILANPDGDAILQEGDEIALVGYPDSHARLDPSFRNGKEVFDRDLLDLRIVEEEIVVKNDNISGKRLSELNLSEYGCFLNRVVRAQIEMPMDHNILLNKGDILQVSGEKSRVLGLAERIGFISIHSQIADLLAFCCFFIIGLLIGSITLAFGHVAFGLGSAAGLLIAGITLGFLRANHPTFGYVPQGALNMAKDLGLMVFMVGIGLSAGSNLFDSFAHIGPMVLVTSLMVSVIPVVLAYLFGAYVLKMNRALLFGAIIGARTCAPAMDMINEHARSTIPALGYAGTYAIANVLLTIAGTLIIIMN

SEQ ID NO: 91423 - DNA, 1659 bp, Lactobacillus acidophilus NCFM
  CDS (1)..(1659): transl_table=11
atgtggcattcagtatgtaatttctttctaactaatccctctgtagccatcttcttaacactaggcttaggttatttagttggtagatttcatatcaaaagcttcaaacttggtgcaacagttggtgtactactagttggattaattattggacaaatgggaaaatttcaaatagctccagttgttaaaaatcttttctttgacttatttatttttacaattggctatgaagttggtcctgtgtttattgccagttttaagaaaaaaggtattaaattcatcattcaaagtgtggtattttcagtaattgcatttgtcgtatcttttgcattatttaaaatatttcacgttaactttggtgaagccggtggtatcattgcaggttcattaacacaatcagcatgtattggtaccgctaattcagcaattgaagcattacatatttcgcaagctgctaaaactgctgcaatgtctcaagttgcaattgcttatgccctaacttatgtctttggtactattggcgttttgattttcttaaagaatattgctcctgcaattttccatgttaacttaagagaagcaacgaaggaatatattgaaacaaatcatattaaaactgatacaaaaagcgtaaaaatttctgcaaacattcgtgttagagcatttagaattaatgcagaaaataagtatattggtaaaactattctagactttaataatgacaatgcaggattgaacattgaagaaatagttagagatggtaaaacattgactagtccttcaacggtcctagctaacaatgacattattttagtaataggtagtattaaaaacttcgctgactttacagataaaaaatataatttatcagaagttgatgccaataattatccattacatttgaaaaagacaacaattttattaactaaagtatacaattacaatacccttgaaaatatgcttgctaatggtgtaattattgaatctgcatatcacgatgataagaaaatcactgattatactttattatccgttggcgatcatatcactgtaattggaccacaaagctacttaactaatattatgaaaaatattggttacgaaaaagctgctggtaccaaaacagatgttagcttcctatcaatcggtattttcttaggtatcttgttaggtgcaattgtaatcacaattcataaaattccacttaccctaggtggcggtggcggtgctctatttgccggattatacttcggctggctccaagaaaagcatccaaatattggtgtaattcctccttccaccagatggttactaaagagcttgggtttgaacctatttattggtgtagtaggtcttcaagccgggagtggctttgtcactgctttaaaagaaatgggctggctagtatttgttatcggtattttagtttcaatactccctcatttatttaccctattatttagcaaatttatattaaagatgaacattgttgataatatcggatcactttgtggatctggtactatcactgcagctttaaacgcagttaatgctgaaactgattcaactgtatttgcattaagctacactcctacatatgcattaggcaacatattcttaactgttatggctcctctaattgttgcattactcgcataa

SEQ ID NO: 91424 - protein, 552 aa, Lactobacillus acidophilus NCFM
MWHSVCNFFLTNPSVAIFLTLGLGYLVGRFHIKSFKLGATVGVLLVGLIIGQMGKFQIAPVVKNLFFDLFIFTIGYEVGPVFIASFKKKGIKFIIQSVVFSVIAFVVSFALFKIFHVNFGEAGGIIAGSLTQSACIGTANSAIEALHISQAAKTAAMSQVAIAYALTYVFGTIGVLIFLKNIAPAIFHVNLREATKEYIETNHIKTDTKSVKISANIRVRAFRINAENKYIGKTILDFNNDNAGLNIEEIVRDGKTLTSPSTVLANNDIILVIGSIKNFADFTDKKYNLSEVDANNYPLHLKKTTILLTKVYNYNTLENMLANGVIIESAYHDDKKITDYTLLSVGDHITVIGPQSYLTNIMKNIGYEKAAGTKTDVSFLSIGIFLGILLGAIVITIHKIPLTLGGGGGALFAGLYFGWLQEKHPNIGVIPPSTRWLLKSLGLNLFIGVVGLQAGSGFVTALKEMGWLVFVIGILVSILPHLFTLLFSKFILKMNIVDNIGSLCGSGTITAALNAVNAETDSTVFALSYTPTYALGNIFLTVMAPLIVALLA

SEQ ID NO: 91425 - DNA, 1659 bp, Haemophilus somnus 2336
  CDS (1)..(1659)
atgagtgatattgctatcacaatttgtatcctagcccttgttgccgttattggtttatggatagggcattggaaaatacgcggagtcggtttaggcatcgggggagtattattcggtgggattattgtcgctcattttatgaaccaaaatggattgaaattagatgcacacactctacactttatccaagaatttgggttaattctatttgtttataccattggcattcaagtcggtccgggatttttcgcctctctactttctgctggtttaaaacttaacggcttagcaacattaattgttgttctcggtgcagtaagtgtttttgtcctatataaagttgttaatgttgatcttgatattattctcggtatctactccggtgcggtcactaatacgccatccttgggtgcgggtcaacaaattctcactgaactaggcatagaaaatgctaacagcacaatgggtatggcgtacgctatggcttatcctttcgggatttgcggcattttacttagcatgtggttaattcgtttattttttaaaattaaggttgaagaagaagagaaacaattccaaaaagccagcggacaggataaagaaagcttaacaacagtaaatgttaaagtgaccaatccaaatttaagtggtttacgattaattgatattcccggctttgacaataaagatgtggtttgttctcgtttaaaacgacaagaaaatattagtgtaccaagtgcagataccataatagcaattgatgacgtattacatttagttggtgaaatcaatgccttgaaaaaaatgaaattggtgataggtgaggaaattgatatgcctatgactcatttagcaggagatcttcgctctgaacgtattgttgttaccaatgaaaaagtgcttggtaaacgcataaaacacctaggaattcataaaaaatatggcgttgtgatttcacgtttaaatcgtgccggcgtagagttagttccaacagccaacaccgcattacaatttggcgatgtgctacatattgtagggcgatccgatacaattggtaatgcaacctcaattattggcaatgcacaacaaaaactacaacaagtgcaaatgttaccggtatttatcggaattggattaggcgtgctattaggctcaattccattctacattccaggattccctgtagcattaaaattaggtttagccggaggtccattagttgtcgcactaatccttgctcgtattggtagtgtcggtaaactctattggtttatgccacccagtgcaaacttagcactacgtgaaattggtatcgttttattcctagctgttgttggactaaaatccggaggcggatttgttgacacactggttaatggtcaaggacttgaatggatgggatatggtatgttcattacctttattccattaatgatcaccggcattattgctcgcttatacatgaaattaaactatctcagcttatgcggtttgcttgcaggttcaatgactgatcctcccgcactggcttttgccaatgcaattaaagaagatagcggtatagctgcattatcttacgctactgtttatccgctttctatgttcctgcgtattatgtcgcctcagttgcttgccattttactttggacagcaatgtaa

SEQ ID NO: 91426 - protein, 552 aa, Haemophilus somnus 2336
MSDIAITICILALVAVIGLWIGHWKIRGVGLGIGGVLFGGIIVAHFMNQNGLKLDAHTLHFIQEFGLILFVYTIGIQVGPGFFASLLSAGLKLNGLATLIVVLGAVSVFVLYKVVNVDLDIILGIYSGAVTNTPSLGAGQQILTELGIENANSTMGMAYAMAYPFGICGILLSMWLIRLFFKIKVEEEEKQFQKASGQDKESLTTVNVKVTNPNLSGLRLIDIPGFDNKDVVCSRLKRQENISVPSADTIIAIDDVLHLVGEINALKKMKLVIGEEIDMPMTHLAGDLRSERIVVTNEKVLGKRIKHLGIHKKYGVVISRLNRAGVELVPTANTALQFGDVLHIVGRSDTIGNATSIIGNAQQKLQQVQMLPVFIGIGLGVLLGSIPFYIPGFPVALKLGLAGGPLVVALILARIGSVGKLYWFMPPSANLALREIGIVLFLAVVGLKSGGGFVDTLVNGQGLEWMGYGMFITFIPLMITGIIARLYMKLNYLSLCGLLAGSMTDPPALAFANAIKEDSGIAALSYATVYPLSMFLRIMSPQLLAILLWTAM

SEQ ID NO: 91427 - DNA, 1659 bp, Actinobacillus pleuropneumoniae serovar 1 str. 4074
  CDS (1)..(1659)
atgagcgatatagccattattgtaagcctattatcattagttgcggtattaggtttatggattggtcatataaaaatcaaaggggtcggtctcggtatcggcggagtattattcggtgggatcattatttctcattgtactcatttgtacggtatcgaattggatgcgcacacgttacattttattcaagagttcggattaattctgtttgtttactcaatcggtattcaggttggtccgggcttttttgcgtcattgcgtcaatcgggtttaaaactgaacggctttgcggtgatgattgtcgggctaagcggaatacttgttgcgctcattcataagttattcgatgttcctttaccggtgattttaggtattttctccggtgcggtaaccaatacgccgtctttaggggcggggcaacaagtattaaccgagcttggcggagacaatattacggcggtaatggggatgagttatgcgattgcttatccgttcgggattatcggtattttactttctatgtggttgattcgtatcatttttaaggtgaatatcgataaagaagcgcaagagttcgataacaatcaaaatcagcagaaagaaggattggatacgcttaacgtacgtttaaccaaccctaatttaggcggtttaaaattaaaggaaatccctgattttgaatcgcatacggttatttattcccgtttgaaacggaatgaccaattgattgtgccgaatgtcgatacagtcttaaatgtcggagatgtgcttcacttagtcggagaaaaagcgacgttacgtaaaatgcagcttattttaggagaagaagcggacgtatccgtttcgaccagaggtacgattttccgttccgagcgggcggtagttaccaatgaaaacgtatttggtaaaaaaatccgtcatttaatgctgaaagggaaatatgaagttgtgatttctcgtttaaaccgtgcgggggtcgaattaattccgaacggtgaaatggcattacaattcggggacgtactgaacttagtcggacgtcaggaagatattgaaacggtgcgtgcgattattggcgatgcgcatcaaaaactacagcaagttcaaatgttgccgatttttgtcgggattggattaggtgttttgctcggttcattaccgctttatattccgggatttccggtggcgttaaaattaggtttagccggcggtccgttggtggtagctttaattcttgcgagaatcggcagtatcggtaaactttattggtttatgccgccgagtgccaacttggcattgcgagaaatcggtatcgtattattcctttccgtagtcggtttaaaagccggggcgaatttcctcgatactttactcagtccggaagggcttgcatggatgggatacggtgcgatcatcacctttattccattgattgtgaccggatttgttgctcgtatttacggaaaaatgaattatttatcgctatgcggtttgttatccggtgcgatgaccgatccgccggcattggcttttgccaatgaaattaaagacggacacggtgcggcggcactttcctatgcaacggtctatccgcttgtgatgttcttacgtatcatcttaccgcaattacttgccattttgctttggacggcaagctaa

SEQ ID NO: 91428 - protein, 552 aa, Actinobacillus pleuropneumoniae serovar 1 str. 4074
MSDIAIIVSLLSLVAVLGLWIGHIKIKGVGLGIGGVLFGGIIISHCTHLYGIELDAHTLHFIQEFGLILFVYSIGIQVGPGFFASLRQSGLKLNGFAVMIVGLSGILVALIHKLFDVPLPVILGIFSGAVTNTPSLGAGQQVLTELGGDNITAVMGMSYAIAYPFGIIGILLSMWLIRIIFKVNIDKEAQEFDNNQNQQKEGLDTLNVRLTNPNLGGLKLKEIPDFESHTVIYSRLKRNDQLIVPNVDTVLNVGDVLHLVGEKATLRKMQLILGEEADVSVSTRGTIFRSERAVVTNENVFGKKIRHLMLKGKYEVVISRLNRAGVELIPNGEMALQFGDVLNLVGRQEDIETVRAIIGDAHQKLQQVQMLPIFVGIGLGVLLGSLPLYIPGFPVALKLGLAGGPLVVALILARIGSIGKLYWFMPPSANLALREIGIVLFLSVVGLKAGANFLDTLLSPEGLAWMGYGAIITFIPLIVTGFVARIYGKMNYLSLCGLLSGAMTDPPALAFANEIKDGHGAAALSYATVYPLVMFLRIILPQLLAILLWTAS

SEQ ID NO: 91429 - DNA, 1656 bp, Haemophilus influenzae R2846
  CDS (1)..(1656)
atgagtgatattgcgatcacgattagtcttcttgccctcgtcgccgtaatcggcttatggatcgggcattggaagatccgcggggttgggcttggcattggtggcgtgctgtttggcggcattattgttgcccatttcactgatcaatatggcttgaaactggatgcgcatacgctgcattttgtgcaagaatttggtttgattttatttgtttatactattggtattcaggttgggcctggctttttttcttctttacgaaaatctggtttaaagctaaatgcctttgccattttgattattgtgctggggtcaattgccgtggttcttgtacataaaattgcggatgttccactggatattgccttaggtatttattctggtgctgttactaatacgcctgcgttgggggcagggcagcaaattttagcagaattaggggtgcctcaaaccactgtaactatgggggtgtcttatgcaatggcttatccattcgggatttgcggtattttgcttgcaatgtggttaatccgcttgttttttaacgtcaaagtggacgatgaagctgctcgttttaatgcggagagcagccaagataaagaaagtttacataatatttctttaaaagtgacgaaccaaaatctagatggtctgacgttaattcaaattccgggatttagcgatgaagaagtcgtatgttcacgtttaaaacacgatgatatggaaattgttccaaaggcaagtactgagattcgtaccaacgatattttacaattagtgggtgatgataattcgcttgctaaaatgcgtttaattatcggacacgaagttgatgcaccaaccgttgcctatagtggcgaaattcgttccgagcgtgtggtggtaacgaatgaaaaagtattaggcaaaaagatccgtgcgttaggcattcatcaaaaatatggggttgtaatttcacgtttaaatcgtgcagggattgagttagttccaacgggaaataccacactgcaatttggcgatgtgctacatatggttggacgcagtgatgtactaaatcaggccatttcagttattggtaacgcacaacagaaattacttcaagtgcaaatgttaccagtgtttatcggtattggtttaggggtactcgttggttcgattccattctatattccaggtttccctgttgcgttaaaattagggcttgctggcgggccattggtggttgcgttgattttagcgagaattggcacgattggtaaactttactggtttatgccaccaagtgctaacttggcattgcgcgaaattgggattgttcttttcttggcggttgttggtttaaaatcaggtggaagtttctttgatactttagtgaatggttcgggacttgaatggatgggatacggtatttttatcacttttgtgccgttgattattgttgggactatagcacgcttatatggaaaacttaattacctcacaatatgcggtttacttgcaggttcaatgacggatcctcccgctttagcatttgcgaatgaaattaaagaagataacggtgctgcagcactttcttatgcaactgtgtatccattggtgatgttcttgcgaataatgtcgccacagttattggcagtgttattatgggcagcatag

SEQ ID NO: 91430 - protein, 551 aa, Haemophilus influenzae R2846
MSDIAITISLLALVAVIGLWIGHWKIRGVGLGIGGVLFGGIIVAHFTDQYGLKLDAHTLHFVQEFGLILFVYTIGIQVGPGFFSSLRKSGLKLNAFAILIIVLGSIAVVLVHKIADVPLDIALGIYSGAVTNTPALGAGQQILAELGVPQTTVTMGVSYAMAYPFGICGILLAMWLIRLFFNVKVDDEAARFNAESSQDKESLHNISLKVTNQNLDGLTLIQIPGFSDEEVVCSRLKHDDMEIVPKASTEIRTNDILQLVGDDNSLAKMRLIIGHEVDAPTVAYSGEIRSERVVVTNEKVLGKKIRALGIHQKYGVVISRLNRAGIELVPTGNTTLQFGDVLHMVGRSDVLNQAISVIGNAQQKLLQVQMLPVFIGIGLGVLVGSIPFYIPGFPVALKLGLAGGPLVVALILARIGTIGKLYWFMPPSANLALREIGIVLFLAVVGLKSGGSFFDTLVNGSGLEWMGYGIFITFVPLIIVGTIARLYGKLNYLTICGLLAGSMTDPPALAFANEIKEDNGAAALSYATVYPLVMFLRIMSPQLLAVLLWAA

SEQ ID NO: 91431 - DNA, 1695 bp, Ralstonia eutropha JMP134
  CDS (1)..(1695)
atggaattgctttcagacttgcttgcctcccaaccggagatcgcgctcttcctcgcgctcgcggtcggccatgcgattggcgcgatccgtttcgggccattccagctcggcggcatctgcggcacgctgatcgccgcgctcgtgatcgggcaaagcggggcgcgtctcgacaacgacgtcaagaacgttgccttcgcggtgttcatctttgcgctcggcttcaccggtggcccgcagttcttcgccaatgtcgggcgcgaatggcgcatcggattgctctcgctcgtggaagcctttgtactcctggcactgcttgcgatcgccgtaccgttgctgagcctggaccagggtacggccgccggcctgctcgccggcgccgcgaccgaatcggccgtgatcggcaccgcttccgaagcgatttcccggctcggcatctcttccgagcaggtgcgcgtgctgcagaccaatatcgtcaccgcatacagcgtgacgtacctgttcggcctgatctcgatcgtgctgttcacgagccagctcgcgccgtggctgttgcgcgtgaacctgcgcgaatcggcggaaaggctgtggcagaagctcggcggcgagaacgacttgggcgaaggccagagcagcgcactgccgttgctggtcggtcgcgtgctgcgcgtggaacgcgtcgcgggcaagacggtgctggaagcggagcaactggtcgcgctcggcgcaacgatacggcgcgtgcggcgcgatggcgagaccttccggccatcgcccgccgagttgctgcgcaccggtgacgttgtgctcgcagtcggccggcgcgatgcaatggtggccttcgccggctacgtcggcaccgagttgcctgaagagcccggcatggaagccgtgcagaacgagcaggacgtgctgctcacgcggcgcgagatccgcggactgacgctggcccggctgcgccagatggccgacgtcggcatgggccgcggtgtctatatccagcgtatctcgcgcatgcagcaccgggtgcccacgctgccggaaacggtgctcgagcgtggagacgtactgacgctgagcggaccgcaggaagccgtgcagcgagtggtgccggaactcggctacgcggtcacgccgacgatcaagacggatttcgtgttcctgggcatcggcgtgctgctaggcatgctgatcggtgcgttcagcgtcaagttcggtcaggccgatctcacgctggggaccggcggcggctgcctcgtgtcgggcctgatcttcggctggctgcgcgcgcgcatgccgctgttcggctcgctgccctcctccgcggccgagatcctgaaggacttcggcctcgctacgttcattgccgcagtcggcctgtccgccggacccgatgcgatcacgctcatccgcgagtacggcctgatcctgcccgttgcgggcatcctggtttccgtggtgccggccgcgatttcgctgttcatcggccaccgctggctgaagctggacacgccgatcctgctcggcgccgtcgcaggccagcactgcagcacgccgacgatcatggcgctgaccagcgcggccggcaatggcaccccggtgatcggctacacgatcacgtatgcgatttccaatgttctgcttccgctgctggggccgatttccgtggccatggcgggcgccctggcgaggcactga

SEQ ID NO: 91432 - protein, 564 aa, Ralstonia eutropha JMP134
MELLSDLLASQPEIALFLALAVGHAIGAIRFGPFQLGGICGTLIAALVIGQSGARLDNDVKNVAFAVFIFALGFTGGPQFFANVGREWRIGLLSLVEAFVLLALLAIAVPLLSLDQGTAAGLLAGAATESAVIGTASEAISRLGISSEQVRVLQTNIVTAYSVTYLFGLISIVLFTSQLAPWLLRVNLRESAERLWQKLGGENDLGEGQSSALPLLVGRVLRVERVAGKTVLEAEQLVALGATIRRVRRDGETFRPSPAELLRTGDVVLAVGRRDAMVAFAGYVGTELPEEPGMEAVQNEQDVLLTRREIRGLTLARLRQMADVGMGRGVYIQRISRMQHRVPTLPETVLERGDVLTLSGPQEAVQRVVPELGYAVTPTIKTDFVFLGIGVLLGMLIGAFSVKFGQADLTLGTGGGCLVSGLIFGWLRARMPLFGSLPSSAAEILKDFGLATFIAAVGLSAGPDAITLIREYGLILPVAGILVSVVPAAISLFIGHRWLKLDTPILLGAVAGQHCSTPTIMALTSAAGNGTPVIGYTITYAISNVLLPLLGPISVAMAGALARH

SEQ ID NO: 91433 - DNA, 1686 bp, Ralstonia eutropha JMP134
  CDS (1)..(1686)
atggaatggttgcatgacattttccagaaatcgccggaatcagcgctattcctgtcgctggccgtcggctatgccatcggcaagattacgttcgggcgcttccagcttggtggcgtggcgggctcgctgctggccgcggtgctgatcagccaggtcggcgtccagatcgacaatggcgtcaaggcggtgatgttcgccgtcttcatctatgcggtcggctacgaaagcggcccgcagttcttcaactcgctgaaccgcagctcgctgcgcgagatcgccatggcggtgttcatggcggtatgcggcctggtcacggtggtggtgctggccaagatctttgatctcgacaagggcatcgccgcaggcctggccgcaggtggcatgacgcagtcggccatcatcggtacggccggtgatgcgatcaccaagcttgggctgccaccggaccaggtgaagcaactacaggcaaacgttgcaatagggtatgcggtgacatatgtgtttgggtctctcggcgcgatcatcgtttgcgtgaacatcctgccgcgcttcatgaaagccgacctgaaggaagacgcgaagaagatggaagcgcagctgcacggcgggctgccgcagttcggcccgaaccagcgcggtgcgctgccgcggctagtgggccggcttttccgcgtgggcggcgctgcgggcaagaccgtttcgcatatcgagatcggcggcgaggatctcgtcacggtggagaagatccagcgcggcggcaaggcgctcgaggtcaagcaggacatcgtgctcaaggacggtgacctggtgctgctggtgggccgccgcgacgccatggtgcccacggccgcgctgatcggcgaggaagtcgccgatgtggaaggcatgggcgtcgtcatgcagacgcgcaaggtggtgttcaccgccaagggcatgaacaacaagacggtcgcggagatcgtcgagatggtggggcgcgacatgcgccacggtgtgtacatcgagcatatcgagcgctacgacaacccgctgccgttgctgccagaactgaagctgcagcatggcgacatcctcacgctgtacggcacgccggccgataccaggcgtgccgcgcagatggccgggtacgaactggcgcccaccgagaagacggacttcgtctacttcggtgccggtgtgctggtgggtctgctgatcggcctgctggtatggcgcatcggctcgatcccgctgacgctcggcgccggcggtggtgcgctgctctccggcctggtgttcggctgggcccggtccaagcacaagatgttcggcgcgatgccgactgccgcgtgccagttgctgaaggacttcgggctcgctgcgttcgtggccatcgtcggcatcaactcgggtctgcaggctgctaccacgttgaagcagcaaggcctgaccatcttcatccttggtgccgtggtcacgctgctgccgctgttcctgaccatgttcttcggccgctacgtgctcaagtacgacaacgccgcgctgctcgcgggcgcgctgtccgggtcgcgcagtgcgaaccccgccttcggcggcattctcgacaaggccgagagcccggtgccgaccgtgcccttcgccatcacctacgccattgccaacgtgctgctgacgctgctcggaccgctggtggtgggcctcgtctag

SEQ ID NO: 91434 - protein, 561 aa, Ralstonia eutropha JMP134
MEWLHDIFQKSPESALFLSLAVGYAIGKITFGRFQLGGVAGSLLAAVLISQVGVQIDNGVKAVMFAVFIYAVGYESGPQFFNSLNRSSLREIAMAVFMAVCGLVTVVVLAKIFDLDKGIAAGLAAGGMTQSAIIGTAGDAITKLGLPPDQVKQLQANVAIGYAVTYVFGSLGAIIVCVNILPRFMKADLKEDAKKMEAQLHGGLPQFGPNQRGALPRLVGRLFRVGGAAGKTVSHIEIGGEDLVTVEKIQRGGKALEVKQDIVLKDGDLVLLVGRRDAMVPTAALIGEEVADVEGMGVVMQTRKVVFTAKGMNNKTVAEIVEMVGRDMRHGVYIEHIERYDNPLPLLPELKLQHGDILTLYGTPADTRRAAQMAGYELAPTEKTDFVYFGAGVLVGLLIGLLVWRIGSIPLTLGAGGGALLSGLVFGWARSKHKMFGAMPTAACQLLKDFGLAAFVAIVGINSGLQAATTLKQQGLTIFILGAVVTLLPLFLTMFFGRYVLKYDNAALLAGALSGSRSANPAFGGILDKAESPVPTVPFAITYAIANVLLTLLGPLVVGLV

SEQ ID NO: 91435 - DNA, 1599 bp, Ralstonia eutropha JMP134
  CDS (1)..(1599)
atggcgatggatgcagtccgggtattgttcgaaacccagcccttgttcacgttgctccttacgattgcactgggctacgttgtcggcgaaatcaatatcaaaggcgtcgcgctgggatccggagccgtcctgtttgtcggattggcgatcgggggcttcgcgcccaaagcggcaccgcctgcgctggtcgggaccctgggcctgctgctgttcctctatggcattggcatccagtacggcgcccaattcttcgaggggctgaccagcgtccgcggtctgaaggccaatgccgccgcggctgtgggtgttatcggtgccggcatggcgtcgctggcgctggtaccgctgttcggcctgcggctcgatgagtcgctgggtatctttgcgggtaccgggaccagcaccgcgacattgcaggccgtcattgcggccatgaagggcgatggcgcggcggttggctacagcgtggcatacccgttcggggtcgcgggcccgatcctgttgctctatgccctcagcgtattgctgaaagcgaaaatcgaggcgccagcggccaagatcctcgagacgggcgagatttccctgcgcaaccccgagatcgtcggcctcacgcttgcccagctgaaggcgcgcctgccggttggactcgccattgccgcggtgcgtcgcgagcaccataaccagctgccgaccgaagaccttgtcctgcgccaggacgacgttctgctcgcgacatccacggagccggccttgcttcgggaagctgctggcctgctgggggaactgcagcccggccggattagcagtcaccgcgaggacctggactatgtccgcttgtttgcctcaagccgcgccgtggtcgggcttgcgctacgcgatatccgctttcccgatggcattacaggttcgatcgtccaggtacgaaggggcgacgccgacatgctgccaacccccgaactcatcctcgaagtgggcgaccgggtaggagtgctggtcaatcgcgctcataccaaggccatgcgcaagcttttcggcgactccatcaaggggaccgccgaactgagctttatttccatcggcatcggtgcggcgctcggcctgttggcgggcatgatccccttgccgatccccggcgccggcaagctgaccctcggcttggcggctctgctgctggttgcgctgtatctgggcaagatccgccggtccggcccgctggtctggaccatgccgctttccgccaatctggtgttgcgcaatctcgggctcactatcttcctggcacaggtgggcatatcgtcaggaccgaaattcttctcgaccattgccatcaccggcgcttcactgctcctttacagcgtgctgattgtgctggtgctcgtgctggtcacggcactggcttgcctgtggatcttcaggatgcccttcgatgtcaccgccggcgtcatctgcggcgcgaccggtaatccggcaatcctggcgttcgccaaccgcgtagcgcccacggagcagcccgatatcggctacgccatgatctttccttcgatgacggtcacaaaaatcctgtttgtggagattgtcatggtcctggctggcgggtag

SEQ ID NO: 91436 - protein, 532 aa, Ralstonia eutropha JMP134
MAMDAVRVLFETQPLFTLLLTIALGYVVGEINIKGVALGSGAVLFVGLAIGGFAPKAAPPALVGTLGLLLFLYGIGIQYGAQFFEGLTSVRGLKANAAAAVGVIGAGMASLALVPLFGLRLDESLGIFAGTGTSTATLQAVIAAMKGDGAAVGYSVAYPFGVAGPILLLYALSVLLKAKIEAPAAKILETGEISLRNPEIVGLTLAQLKARLPVGLAIAAVRREHHNQLPTEDLVLRQDDVLLATSTEPALLREAAGLLGELQPGRISSHREDLDYVRLFASSRAVVGLALRDIRFPDGITGSIVQVRRGDADMLPTPELILEVGDRVGVLVNRAHTKAMRKLFGDSIKGTAELSFISIGIGAALGLLAGMIPLPIPGAGKLTLGLAALLLVALYLGKIRRSGPLVWTMPLSANLVLRNLGLTIFLAQVGISSGPKFFSTIAITGASLLLYSVLIVLVLVLVTALACLWIFRMPFDVTAGVICGATGNPAILAFANRVAPTEQPDIGYAMIFPSMTVTKILFVEIVMVLAGG

SEQ ID NO: 91437 - DNA, 1674 bp, Ralstonia metallidurans CH34
  CDS (1)..(1674)
atgcccacggcggtgctgttcatcaccgtcggccttggctacgccattggcaagcttcgcgtcggcccgatcgtgctcggcggtgtctgcggcacgctgatcgtggcgctgcttgtcgggcagaccgggtgccagatgcacggcgagttgaaggacgttgccttcgcgctcttcatcttcgcgatgggatattcgggcggcccgcagttcttcgcgaacttgaaccgctccagcctgcggttcatggtcctgccgctcatcgaagcgttcgtggtactggcaatcgtgctggtggccgtgcgaatgctggatctggaccctggcacggcggcgggtctcgcagccggcgcggcgacggaatccgcagtggtcggcacggctgcggaggcgctcaaacatctgaacctggtcccgacagaactggcccggatgcaatcgaacatcgccacggcctatacgctgacctacctcgtcggcctgatcagcatcgtgttcttcaccagccaggtggctcccttcctgcttcgcttcaacctgcgcgaggcatcgagcgaactggccaaggaactgcaggccgcgtccgacgatgacgtcgccacgcagccggtgctgccccgcctggtgggacgtgctcaccgcgtggaacatgcggccggcctgaccgtgcgccaactggaagccgcgcttggcgggcggacactggtgatggggctggtgcgcgacggcaagctcatggagtcggtgccggatctgaccataaaacgggacgacatcgtggcgctgatcggcgtgcgcgacaaactcgtctcggctcgcgaggtgattggccaggaggtgtcgttgccgctgagccagtccgacgtgctgcggctcgaagagcatcaggtgatcgtcaacaatcccgctgtcaatggccgctcgctggccgaactcggccgggaagccgcccagcaacatcttcgctacgtctgggtccagcagatcgttcgatccggcatgagcctgccgatcacgcccgccacacgcctgcagcatggcgaccgggtaagcctggtgggcgtggaaccgacactgacctcagcggcccgcaacctgggcagggatctacgcaccaccgataccaccgaactcgtcttcctgtgcgcgggcatcctgattggcctcttgatcggcagcgtcaccctgaaggcagccggcatcccgatctcgctcggcagcggcggcggcgcgctgctcagcggtcttgtcttcggctggatcaatttcaaacggcccggcgtgggcgacatgccaagcgccgcggtccagttgctgaaagacctgggactggcgatgttcgtggcctgcgtcggcttgtctgccggacctgatgccgtcacgctgattcgcgagcatggcgccgtgttgccgctcgtcggcctggccgtgtcgctgacgccggcatgcatgtcactctggatcggccacaaattcctgaaaatccaggggccactgctggtcggcgccatcgcggggcagcacgtcagcacgccggcgatcagcgccgtgctggccgccagccagagttcggtgccgctgctcggctacacggtgacgtatgccatcgccaacgtgatgctgccggtgcttgggccaatcatcgtggccctcgcatatcgcgttggcggcatgtga

SEQ ID NO: 91438 - protein, 557 aa, Ralstonia metallidurans CH34
MPTAVLFITVGLGYAIGKLRVGPIVLGGVCGTLIVALLVGQTGCQMHGELKDVAFALFIFAMGYSGGPQFFANLNRSSLRFMVLPLIEAFVVLAIVLVAVRMLDLDPGTAAGLAAGAATESAVVGTAAEALKHLNLVPTELARMQSNIATAYTLTYLVGLISIVFFTSQVAPFLLRFNLREASSELAKELQAASDDDVATQPVLPRLVGRAHRVEHAAGLTVRQLEAALGGRTLVMGLVRDGKLMESVPDLTIKRDDIVALIGVRDKLVSAREVIGQEVSLPLSQSDVLRLEEHQVIVNNPAVNGRSLAELGREAAQQHLRYVWVQQIVRSGMSLPITPATRLQHGDRVSLVGVEPTLTSAARNLGRDLRTTDTTELVFLCAGILIGLLIGSVTLKAAGIPISLGSGGGALLSGLVFGWINFKRPGVGDMPSAAVQLLKDLGLAMFVACVGLSAGPDAVTLIREHGAVLPLVGLAVSLTPACMSLWIGHKFLKIQGPLLVGAIAGQHVSTPAISAVLAASQSSVPLLGYTVTYAIANVMLPVLGPIIVALAYRVGGM

SEQ ID NO: 91439 - DNA, 1686 bp, Ralstonia metallidurans CH34
  CDS (1)..(1686)
atgacctggtttgtctccaccctcaaggcgtaccccgagatcgcgatttttctcgcactgggaatcggctactgggtaggcgggaagagctacaaggggttcagcctgggcgccgtaacgtcgacactgctggtggcgatcgtcatcggcatcctcggcgtgaagatctccgcgaacgtgaaatccgtctttttcctgatgtttctgtttgcggtgggctatggcgtcggcccgcagttcgttcgcggcattgcgaaggatggcatccctcaagccatatttgctgcgatagtctcggtgctgtgtctcgccgcacccatcgttgcggcgatggtcgccggctacgatctcgggtcggctgccggattatttgcgggttcgcagacaatctcggcgtccatgggcctcgccactgatgccatcaatcgcctgggccgatctccggaagaaaccaaacagcttctggacggcatgccgatcgcctatgcggtcacgtatatcttcggtacggtcggctcggcaattatcctggcgcaaattggccccaaactgcttggcatcgaccttgtagctgcctgcaaggattatgagcagcaacttggagccggagcagacggagaaggcaccgaatggcatgagtttgaactgcgagcctacgcgctggccccccacagcccatacatcggcaagtccgtagccgaactggaggccagcacggccgaaggcgtacgtgcctttatcgaacgcattcgccgaggtggcaagattatcgaggcacaactcgataccgttctggagcctggcgatatcgtcgcaataggcggaaagcgcgatcaactgattgccagactgggaccaagcggccgtgaagtggaagactcagagctgctcaatgtgcagacggagggtgtggacatctatatcaccaacaaggaggttgatggccacacactgcaggagatggctcggtggcccggtgcgcgtgggattttcctgaagaagatcaagcgcggaccgacggaaacggtcatccccgtactgccgaaaaccaagctctaccgcggtgacgtcatcacggtggtcggccgcacgcaggacatcaatgcgacagcgaaacatgtcgggtatatcgaccgcccgacaacggtgaccgacgtggcattcgtgtcgctggcgattaccgtcggcgcattgatcggtgccgtcgtgatcaacgtcagcggcattcccctgacgatttccacggcaggcggcgcgctaatcgcaggtattatcttcggttggtaccgggccattcacccgactttcggacgcatacctgagccaactctttggttcatgaattcggttggcctcaatgtgttcattgcggtcgtcggtatttccgcgggccctggctttattgccggcctgcagaaactcggcgtcagcctcttcctctggggtattttcgccacatcgataccgctaatcatcggcatgtacctggccaagtacgtatttcgctttcatccggcgctcgtacttggagtctgtgccggcgcgcgcacaaccactgctgcgctcggcatgatctgcgagaccgcgaaaagccaagtgccaggccttggctataccgtgacctacgctgtgggtaacaccctgctgacaatctgggggatggtcgtcatcatgattctttcatga

SEQ ID NO: 91440 - protein, 561 aa, Ralstonia metallidurans CH34
MTWFVSTLKAYPEIAIFLALGIGYWVGGKSYKGFSLGAVTSTLLVAIVIGILGVKISANVKSVFFLMFLFAVGYGVGPQFVRGIAKDGIPQAIFAAIVSVLCLAAPIVAAMVAGYDLGSAAGLFAGSQTISASMGLATDAINRLGRSPEETKQLLDGMPIAYAVTYIFGTVGSAIILAQIGPKLLGIDLVAACKDYEQQLGAGADGEGTEWHEFELRAYALAPHSPYIGKSVAELEASTAEGVRAFIERIRRGGKIIEAQLDTVLEPGDIVAIGGKRDQLIARLGPSGREVEDSELLNVQTEGVDIYITNKEVDGHTLQEMARWPGARGIFLKKIKRGPTETVIPVLPKTKLYRGDVITVVGRTQDINATAKHVGYIDRPTTVTDVAFVSLAITVGALIGAVVINVSGIPLTISTAGGALIAGIIFGWYRAIHPTFGRIPEPTLWFMNSVGLNVFIAVVGISAGPGFIAGLQKLGVSLFLWGIFATSIPLIIGMYLAKYVFRFHPALVLGVCAGARTTTAALGMICETAKSQVPGLGYTVTYAVGNTLLTIWGMVVIMILS

SEQ ID NO: 91441 - DNA, 1683 bp, Burkholderia fungorum LB400
  CDS (1)..(1683)
atggactggctacatcatatctttcagaaatcacccgagattgcgctgtttctgtcgctcgcggccggctacttcatcggccagatcaacttcggcaaattccagctgggcggtgtgggcgggtcgttgctggccgcggtcgtgatcagtcaggcgggcgtgacgatcgacaacggtgtgaagtcggtcatgttcgccgtcttcatctacgcggtcggctacgactccggtccgggcttcttcaactcactgaaccgcaagacgctgcgtgagatcgcgatggccgtctttctggccgtcaccgcgctgatcaccgtggtcgtatgcgcgaagctgttccacctgaacaaggggcttgccgccggactcgcgggcggcgcgctcacgcagtcggcgatcatcggcacggcgggcgacgcgatcgcgcgtctcggcctgcccgccgatcaggtcaagtcgctgcaatcggacgtggcgattgcctacgcggtgacttacgtattcggctcgttgggcgcgatcatcgtgtgcgtgaatattctgcccaagttcatggggcagggtttgcgcgaagcctcggtcgaagtggagcgcgaactgacggcgggcgcggcggccgctggcccggggcaactctccgcgttgcccgagatggtgggccgcgcgtacaagatcgatgtcagcgccggaaaaacggtgaaggctgtggagacgctgcatcaagacctgttgacgatcgagcggatcaagcgggacggccagccgctcgacccggcgcccggtctgatcctgaaacccggcgacgtggtcctcgtggtcggccgccgcgaggcagtggtcgaattcggcgcggccggaggcgaggttgccaccgtggaggacgtcggcgccgtcatgcagacccgcgaagccgtgttcacgcgcaagggcatgaaccacaccacgatcgccgccgcgcgggccgtggtggatcgcgatatgcggcacggcgtctatatccagagtatctcgcgcgcaggccagccgctgccggtcctgccggaaaccaaactggagcacggcgacgtcatcaccttttacggctcgccgaaagacaccaagcgagccgccgaggcagccggctacgaactgccgtacagcaacaagaccgacttcatttacatgggcgtcggcattgtgctcggcttgttgatcgggctgatcgtcgtcaacgtggccggcattccgctcacccttggttcgggtggcggctgcctgctggccgggttgctgttcggctggatgcgcggcaagcatccaatgtacggcgcgatgccgtccgcggcctcgcagttgctgaaggacttcggccttgcggccttcgtcgcggtggtcggtttgaactccggcttgcaggccgtggtcaccgtcaaacagagcggcatgacgatcttcctgctcggtgtgttcgtcacgctgtttccgctattgctcaccatgctgttcggccgctacgtgctgaagtacaacaactcggccattctggccggcgcgctgtccggctcgcgcagtgcgaatccggcattcggcggcgtgctcgacaaggccgaaagcgctgtgccgaccgtgccgttcgcgatcacgtatgccatcgcgaacgttgcgttgacgctgctcggtccgctcgtggtcgggctggtctag

SEQ ID NO: 91442 - protein, 560 aa, Burkholderia fungorum LB400
MDWLHHIFQKSPEIALFLSLAAGYFIGQINFGKFQLGGVGGSLLAAVVISQAGVTIDNGVKSVMFAVFIYAVGYDSGPGFFNSLNRKTLREIAMAVFLAVTALITVVVCAKLFHLNKGLAAGLAGGALTQSAIIGTAGDAIARLGLPADQVKSLQSDVAIAYAVTYVFGSLGAIIVCVNILPKFMGQGLREASVEVERELTAGAAAAGPGQLSALPEMVGRAYKIDVSAGKTVKAVETLHQDLLTIERIKRDGQPLDPAPGLILKPGDVVLVVGRREAVVEFGAAGGEVATVEDVGAVMQTREAVFTRKGMNHTTIAAARAVVDRDMRHGVYIQSISRAGQPLPVLPETKLEHGDVITFYGSPKDTKRAAEAAGYELPYSNKTDFIYMGVGIVLGLLIGLIVVNVAGIPLTLGSGGGCLLAGLLFGWMRGKHPMYGAMPSAASQLLKDFGLAAFVAVVGLNSGLQAVVTVKQSGMTIFLLGVFVTLFPLLLTMLFGRYVLKYNNSAILAGALSGSRSANPAFGGVLDKAESAVPTVPFAITYAIANVALTLLGPLVVGLV

SEQ ID NO: 91443 - DNA, 1641 bp, Geobacter metallireducens GS-15
  CDS (1)..(1641)
atgatcaaaatattcatcgacaatccgcttcttcttctcttcgtcgtcgccgccatcgggtatcccctcggccggatccggatcagggggtcgagcctcggcgtggcggcggtcctctttgtcggccttggcatcggcgcgctccatccggagctgaaactccctgaaattgtctatgtcctggggcttgccctctttgtctataccatcgggctcgccagcgggccggcctttgtggcgtcgctcaaggaggacggggttcggaacaacctcctcattctcggcgttcttgtgctcgcggcggccctcaccgtagctgcccagcggtttcttgcccttccggccacaatcaccgccggccttttcgccggcagtctcaccaataccccggcccttgccggcgcccttgaaaccatcaagcacgtggcgccgcaaaatctcatggaacagctcctggccgagccggtcgtgggctactccatcgcctatcccatgggggttatgggggtggtgctcgccatcagcctcgtccagaagctctggcggatcgactacgcggaagaggcggcacggaccaggatcgccggcgccgccaccgaaagcctgaggtccagaacaatccgggtcacttggccccaggccggacgacagaccgttgcggcactctctcatcagcaaaagtgggacgtggttttcggcagaatcaagcgcggggatgaatgtctgctgaccgggccggaggtccgcttccgcccgggggatctggtgctggcggtcggtaccgatgtggaactgcagcatgtggcggaggttctcggcgaggtgagcgaagaggagattaccgtcgaccggagcgagttcgactaccggcggatcttcgtctccaatccgcgggtggccggccggcggctggggagcctgaatctcttcgaacggttcggcgccacggtaaccagggtccggaggggtgacgacgatttcctcccccacgacgacatggtgctggagttgggggaccgggtccgggtggtcacccaccgggatcggatgggggaggtgacggccctgttcggcgactcctaccgggcggtttccgaagtggacatccttaccttcagcctgggacttgctctggggctgttgctcggcatcgtgccgtttcccctgccggggggggtgacgctcaagctcggctttgcgggcggccccctcatcgtggcgctcgtcctcggaactctcggccgctcgggaggaatgatctggagcctcccctacagcgccaacatgacactgcgccagatcggtctcgtcctcttcctggccggcatcggcacccgggccggctacggcttcgtctccacccttgccaagggtggcgggttcgccatcttcgccgcaggagcggtggtcacctgctttgcagcccttaccaccctatgggtcggtcaccggatcctcaagattcccatggggatcctcatcggcatggtggccggcctccagacccaacccgcggttctcggttatgccctggagcagaccggcaacgatctccccaacatcggctacgcctcggtctacccggtcgcaaccatcgggaagatactcattgtccaggtgcttttgtccttactgatgtga

SEQ ID NO: 91444 - protein, 546 aa, Geobacter metallireducens GS-15
MIKIFIDNPLLLLFVVAAIGYPLGRIRIRGSSLGVAAVLFVGLGIGALHPELKLPEIVYVLGLALFVYTIGLASGPAFVASLKEDGVRNNLLILGVLVLAAALTVAAQRFLALPATITAGLFAGSLTNTPALAGALETIKHVAPQNLMEQLLAEPVVGYSIAYPMGVMGVVLAISLVQKLWRIDYAEEAARTRIAGAATESLRSRTIRVTWPQAGRQTVAALSHQQKWDVVFGRIKRGDECLLTGPEVRFRPGDLVLAVGTDVELQHVAEVLGEVSEEEITVDRSEFDYRRIFVSNPRVAGRRLGSLNLFERFGATVTRVRRGDDDFLPHDDMVLELGDRVRVVTHRDRMGEVTALFGDSYRAVSEVDILTFSLGLALGLLLGIVPFPLPGGVTLKLGFAGGPLIVALVLGTLGRSGGMIWSLPYSANMTLRQIGLVLFLAGIGTRAGYGFVSTLAKGGGFAIFAAGAVVTCFAALTTLWVGHRILKIPMGILIGMVAGLQTQPAVLGYALEQTGNDLPNIGYASVYPVATIGKILIVQVLLSLLM

SEQ ID NO: 91445 - DNA, 1635 bp, Chloroflexus aurantiacus
  CDS (1)..(1635)
atgaacaccatcatgatcgatatattagccaacaaccccctcctgctactctttacagtatcggcaatcggctacctgatcggcaggatcaacatcggtggaatcagtcttggagtagcagccgtactcttcgttgggctggcctttggcgcactcgatcaacgactgcggctgcccgacatcatctacctgctcggtctggtcatcttcgtctacacgattggcctgagcagcggccccggttttatcgcatcctttcgccgacgcgggctacgtaacaacctgtttgtgggtggagtcatcgtcgttgccgccggtattgctgtcgtgctgcgcatgatcctgggtctcaacagcgcgcaaaccgccggtctcttcgccggcagtctgaccaacaccccagccctggcggcggtcatcgagcagttgagtcaacgaggcgcagatgaagtgctccgtaccgaaccggtggtcggctactcggtggcttacccggttggtgtactcggcatgatccttgccatctacctgacgcgccggctctggcggatcgatctggcgcaggaaagccagcagcttcgcgaattcggggcagttggcgagcacctgatcaactgcactattcgcgtgaccaacgccaatgtggacgggcaaagcattgccgaactggtcagagctaatggctggaacgtcatcttcagccgacgccaacatgatggccggatcgagctggctaccggagcagcccggctcaataccggtgacctgatcagtgtcgttggctcgccggaagccgtggcccaggtcacggctgtacttggtgagccaaccgacgagcaactcatgctcgaccgtcataccctcgacttccggcgtatcttcgtctccaatccggcggttattggagtgccactgcgcatgctcaacctgccctccaccctcggagcggtcatcacccgcattcgccgtggtgatgttgaactcttaccgcacggcgatacagtgcttgaacccggtgatcgggtgcgtgttgtcacccaacgcgacaatatggatcgggtcagcgccttcttcggcgactcctaccgttcgctggccgaaattgacgtagtttcgctgggtttgggtactgcactcggcatgctggtgggactgatccctattccgctacccggtgggggaagtttctcgcttggcctggccggtggcccgctgattgtcgccctcatcctcggctggcgtggccgcaccgggccgattatctggagcctgccgtacagcgccaatctcacattacgccaggttggcatgaccctcttcctggccggcattggcacccgtgccggctacagcttcttcaccaccatcacccagggcaatggcctgttcctcttcatcggaggtgcgctgatcacgataccggttgccatactaaccctctttatcggttataaactgctcaagataccgttcagcctgctgatcgggatgctggccggtctccagacccaaccggcagtgctggcgttcgccaatgagcaggccggcaacgaagcacctaatatcggctacgcgatggtcttcccgacagccatggttgtgaagatcattctggcccagattctgcttggatga

SEQ ID NO: 91446 - protein, 544 aa, Chloroflexus aurantiacus
MNTIMIDILANNPLLLLFTVSAIGYLIGRINIGGISLGVAAVLFVGLAFGALDQRLRLPDIIYLLGLVIFVYTIGLSSGPGFIASFRRRGLRNNLFVGGVIVVAAGIAVVLRMILGLNSAQTAGLFAGSLTNTPALAAVIEQLSQRGADEVLRTEPVVGYSVAYPVGVLGMILAIYLTRRLWRIDLAQESQQLREFGAVGEHLINCTIRVTNANVDGQSIAELVRANGWNVIFSRRQHDGRIELATGAARLNTGDLISVVGSPEAVAQVTAVLGEPTDEQLMLDRHTLDFRRIFVSNPAVIGVPLRMLNLPSTLGAVITRIRRGDVELLPHGDTVLEPGDRVRVVTQRDNMDRVSAFFGDSYRSLAEIDVVSLGLGTALGMLVGLIPIPLPGGGSFSLGLAGGPLIVALILGWRGRTGPIIWSLPYSANLTLRQVGMTLFLAGIGTRAGYSFFTTITQGNGLFLFIGGALITIPVAILTLFIGYKLLKIPFSLLIGMLAGLQTQPAVLAFANEQAGNEAPNIGYAMVFPTAMVVKIILAQILLG

SEQ ID NO: 91447 - DNA, 1686 bp, Pseudomonas dacunhae ATCC 21192
  CDS (1)..(1686): transl_table=11
atggatttacttaaaagcatttttcaccaatcaccggaggcggcacttttcgcatctctggccctgggatactgggtcggcaagttccgcttcggatcattccagttaggtggtgtggctggttcgctattggcagcggttttgatcagccagatcggcattcagatcgattcaggcatcaaggctgtgcttttcgccttgttcatatacgccgtaggctttgaaagcggcccgcagttcttcaattctttggggcgtcattcggtcaaggaaatcatgatggccgtcgtggtggccttgtccggcttgatcacggtggtggtgattgcccgggtattcggactggacaaaggcctggctgcaggccttgcagccggcggactgacgcagtcggcaatcattggaacggctggctctgctattgagaaactcgggctctcgggcgaagaggtgcagcgcatgcaggccaatgtcgccatcggctatgcagtcacctatatattcggctctttcggcgccatcatcatgtgcgtcaatgtcctgccatggattacccgacgcaatatccgggatgacgcggttcaagctgagcaggagcagctcaagggcgttcgggtctatggcgtgggtgaatcgccagcggcacccgatctggttgggcgtattttccgcgtcgctcaatcaggcaaaaccgtggccgatctcgaagcggaggggactcagggcagggtgacagtggagcgtattcagcgaaagaatgccctggtcggcgtggaccccagcctagtactggaggctggtgacattattttgctggtcggacgccgctccgccgtggtgtctctgggcaagttggtaggcgatgagctgcccggtgcccagggcatggatgtggtgatggtgcgccgtgatgtggccatttccaattcccagtatctcaaccgctgcgtcaaggacattctggacagcctgtctcaggatctcaagcacggcgtctatgccgagggattgatacgcgcgggatcgccggttcccatcactgcgcagaccatggtgatgcccggcgatgtggtcaccttgttcggcacccctcaggacgttcagaaggctgcccaggccgccggtcccatcattgttcccagcgacaagaccgactgggtgttccacggcttcggcattgtcgtcggcctgctgatcggcctgctggtgctgcgcataggcgctattcccatcactctgggcagcggtggcggtgccttgctctcgggcctgctgtttggctggtggcgcagccgcaagcacaccatgggcaatatgccgacaagcgcctcgacattgctacgcgatctggggctggccggctttgtggccatggtgggcctgcagtccggccagcaggcggtcagcacggtcatggagcagggcttgacgctattcatgctgggcgttctggtcaccatcattccgctgctgattgccattttgtttggcaagtatgtgttgcgttacgacaacgtggccgtgttcgcgggctcgctgtcgggcgcacgcagtgccaaccccgcgtttggcgaggttctggacaaggccggcaattcaatccccaccaccccgtttgcaatcacttatgcgttggccaatgtgttcctgactttgttgggtccgctggtcattgcctttgcgtga

SEQ ID NO: 91448 - protein, 561 aa, Pseudomonas dacunhae ATCC 21192
MDLLKSIFHQSPEAALFASLALGYWVGKFRFGSFQLGGVAGSLLAAVLISQIGIQIDSGIKAVLFALFIYAVGFESGPQFFNSLGRHSVKEIMMAVVVALSGLITVVVIARVFGLDKGLAAGLAAGGLTQSAIIGTAGSAIEKLGLSGEEVQRMQANVAIGYAVTYIFGSFGAIIMCVNVLPWITRRNIRDDAVQAEQEQLKGVRVYGVGESPAAPDLVGRIFRVAQSGKTVADLEAEGTQGRVTVERIQRKNALVGVDPSLVLEAGDIILLVGRRSAVVSLGKLVGDELPGAQGMDVVMVRRDVAISNSQYLNRCVKDILDSLSQDLKHGVYAEGLIRAGSPVPITAQTMVMPGDVVTLFGTPQDVQKAAQAAGPIIVPSDKTDWVFHGFGIVVGLLIGLLVLRIGAIPITLGSGGGALLSGLLFGWWRSRKHTMGNMPTSASTLLRDLGLAGFVAMVGLQSGQQAVSTVMEQGLTLFMLGVLVTIIPLLIAILFGKYVLRYDNVAVFAGSLSGARSANPAFGEVLDKAGNSIPTTPFAITYALANVFLTLLGPLVIAFA

SEQ ID NO: 91449 - DNA, 1632 bp, Tetragenococcus halophilus
  CDS (1)..(1632): transl_table=11
atgaatgcaattggtaatttccttgtgggaactcctgtctttactattttcatttgtttggcattaggttatttgttaggtaagttgaaaattggttcatttacacttggcgcaaccgtcggtgttttgattgttgctttattaattggccaattaggtgtcttcccccgtgatacacttttaggtgatatctttttcgacttctttatgtttgcaattggttaccgtgttgggcctagcttcatctcaagtatgaagaaatttggggccaagattgtttatgcgacattaattttcttagtatcagcgtttatcgttgcatacgcatgtttcaaaatgttccacatcggacccggaattgcagctgggattattgctggtggattaacacaatctgctgttattggtagttctttagaaacaatttctaaattgccaatttcagatcatttgaagactttatactcaaaccaaattccaatcgtatatactttaacatatgtttttgggactatcggggttttaatcttcttacgtgatattatgccaaaattaatgcacatcgatttaaagaaacaagctgttaaaacagccaaggaattggatatgattcctgtgcctgttatcgttgctagcacgcatttctacacaattaacgatggttcatcattaattggtcaaaccttaggtactgttaacactaaatttgctaaaggtttagtagcagctggcttgaatgattctgctgatatggcatcagttattaatgccggcgatgttcttgcaattagtggtgggattgatgaaatcggtcgtgctgtgcaagaatttaacttgcttgaagtaactggtaagacaaaagcttatgtttcaaaacaagttgtcttgaagaagaacttttctgctgacgttctaaaaaacgctcaagacaaaggggttttagtggcgacattggccggtgacgtaatggatccagcacagttcagtactttaaaacctgctgaaagtgtaacattagttggtcaaaaagacgccgttagtgaagtccaaagccaattaggtcgtctccgtgctgctgagaatattattaactattcatggtttgcacttgggattgctttgagtgctgcccttgggatagttggaactaaagttagtggtgtgccaatcgccttaggtggtgggactgctagtttaatcgtcggtttagtacaaagtatttaccgtgataaacatgctcatatggacacgattcctgatagtttattggaattcttccaaagtattggtttgaacttatttatcgctacggttggtttatcagctgctaagacatttattagcgctatccaatcaatgggaatctctgtattattaattggtgcagtaatttctatcttgccacatatcattactttcgtaatttgttactatttaatgaaaatggaacccatctcaattattggggcacaaactggtgctgatacattgtcagctgctttgaatgatgtctcagaacgtgttggttctgatgctagcccattctttgccgctgcagttgcacctgcatatgctattggtaatattttcttaaccttaatgggaccaatctttatcgtgttacttagctaa

SEQ ID NO: 91450 - protein, 543 aa, Tetragenococcus halophilus
MNAIGNFLVGTPVFTIFICLALGYLLGKLKIGSFTLGATVGVLIVALLIGQLGVFPRDTLLGDIFFDFFMFAIGYRVGPSFISSMKKFGAKIVYATLIFLVSAFIVAYACFKMFHIGPGIAAGIIAGGLTQSAVIGSSLETISKLPISDHLKTLYSNQIPIVYTLTYVFGTIGVLIFLRDIMPKLMHIDLKKQAVKTAKELDMIPVPVIVASTHFYTINDGSSLIGQTLGTVNTKFAKGLVAAGLNDSADMASVINAGDVLAISGGIDEIGRAVQEFNLLEVTGKTKAYVSKQVVLKKNFSADVLKNAQDKGVLVATLAGDVMDPAQFSTLKPAESVTLVGQKDAVSEVQSQLGRLRAAENIINYSWFALGIALSAALGIVGTKVSGVPIALGGGTASLIVGLVQSIYRDKHAHMDTIPDSLLEFFQSIGLNLFIATVGLSAAKTFISAIQSMGISVLLIGAVISILPHIITFVICYYLMKMEPISIIGAQTGADTLSAALNDVSERVGSDASPFFAAAVAPAYAIGNIFLTLMGPIFIVLLS

SEQ ID NO: 91451 - DNA, 1656 bp, Haemophilus influenzae
  CDS (1)..(1656): transl_table=11
atgagtgatattgcgatcacgattagtcttcttgccctcgtcgccgtaatcggcttatggatcgggcattggaagatccgcggggttgggcttggcattggtggcgtgctgtttggcggcattattgttgcccatttcactaatcaatatggcttgaaactggatgcgcatacgctgcattttgtgcaagaatttggtttgattttatttgtttatactattggtattcaggttggacctggctttttttcttctttacgaaaatctggtttaaagctaaatgcctttgccattttgattattctgctggggtcaattgccgtggttcttgtacataaaattgcggatgttccactggatattgccttaggtatttattctggtgctgttactaatacgcctgcgttgggggcagggcagcaaattttagcagaattaggggtgcctcaaaccactgtaactatgggggtgtcttatgcaatggcttatccattcgggatttgcggtattttgcttgcaatgtggttaatccgcttgttttttaacgtcaaagtggacgatgaagctgctcgttttaatgcggagagcagccaagataaagaaagtttacataatatttctttaaaagtgacgaaccaaaatctagatggtctgacgttaattcaaattccgggatttagcgatgaagaagtcgtatgttcacgtttaaaacgcgatgatatggaaattgttccaaaggcaagtactgagattcgtaccaacgatattttacaattagtgggtgatgataattcgcttgctaaaatgcgtttaattatcggacacgaagttgatgcaccaaccgttgcctatagtggcgaaattcgttccgagcgtgtggtggtaacgaatgaaaaagtattaggcaaaaagatccgtgcgttaggcattcatcaaaaatatggggttgtaatttcacgtttaaatcgtgcagggattgagttagttccaacgggaaataccacactgcaatttggcgatgtgctacatatggttggacgcagtgatgtactaaatcaggccatttcagttattggtaacgcacaacagaaattacttcaagtgcaaatgttaccagtgtttatcggtattggtttaggggtactcgttggttcgattccattctatattccaggtttccctgttgcgttaaaattagggcttgctggcgggccattggtggttgcgttgattttagcgagaattggcacgattggtaaactttactggtttatgccaccaagtgctaacttggcattgcgcgaaattgggattgtccttttcttggcggttgttggtttaaaatcaggtggaagtttctttgatactttagtgaatggttcgggacttgaatggatgggatacggtatttttatcacttttgtgccgttgattattgttgggactatagcacgcttatatggaaaacttaattacctcacaatatgcggtttacttgcaggttcaatgacggatcctcccgctttagcatttgcgaatgaaattaaagaagataacggtgctgcagcactttcttatgcaactgtgtatccattggtgatgttcttgcgaataatgtcgccacagttattggcagtgttattatgggcagcatag

SEQ ID NO: 91452 - protein, 551 aa, Haemophilus influenzae
MSDIAITISLLALVAVIGLWIGHWKIRGVGLGIGGVLFGGIIVAHFTNQYGLKLDAHTLHFVQEFGLILFVYTIGIQVGPGFFSSLRKSGLKLNAFAILIILLGSIAVVLVHKIADVPLDIALGIYSGAVTNTPALGAGQQILAELGVPQTTVTMGVSYAMAYPFGICGILLAMWLIRLFFNVKVDDEAARFNAESSQDKESLHNISLKVTNQNLDGLTLIQIPGFSDEEVVCSRLKRDDMEIVPKASTEIRTNDILQLVGDDNSLAKMRLIIGHEVDAPTVAYSGEIRSERVVVTNEKVLGKKIRALGIHQKYGVVISRLNRAGIELVPTGNTTLQFGDVLHMVGRSDVLNQAISVIGNAQQKLLQVQMLPVFIGIGLGVLVGSIPFYIPGFPVALKLGLAGGPLVVALILARIGTIGKLYWFMPPSANLALREIGIVLFLAVVGLKSGGSFFDTLVNGSGLEWMGYGIFITFVPLIIVGTIARLYGKLNYLTICGLLAGSMTDPPALAFANEIKEDNGAAALSYATVYPLVMFLRIMSPQLLAVLLWAA

SEQ ID NO: 91453 - DNA, 1641 bp, Geobacter sulfurreducens
  CDS (1)..(1641): transl_table=11
atgctttcaatcctccttgaaaaccctcttcttgtgttgttcctcgtggcggcaatcggctatcccctcggcaggatcaaaatccggggatcgagtctcggagttgcggccgtgctcttcgtggggctggccatgggatcgctccatcccgagttgaagctccccgaaatcgtctatgtcctgggcctcgccctgtttgtctacaccatcggcctctccagcggccccgcctttgtggcatccctgaaacgcgagggaatccgcaacaacgccctgatcatcggaatgctcctggtcgctgccgggctggtcgtgggagcccaacgactcctggggttcaaggggaccgtcaccgcgggcctctttgccggaagcctcaccaatacccccgccttggccggggcactggaaaccatcaaacacatcgcctcgccggaactgcgtgaactgctgctggccgaaccggtggtgggttactcggtggcctaccctatgggggtcatgggggtggtgctcgccatcagtctggtgcagaagctctggaacgtcgattacggcgaggaagggaaacggctcaggcttgctggaaccgcgtcggaggcgctgcggagcatgacggtacgcatcgcctggcccggggcagggcgccacaccgtggccgagctggcccgccatgagaagtgggacgtgatttttggccggatccggcgcggggattcatatcttctcaccggcccgcaggttcgcttccagccgggcgatcttgttaccgcagtgggaaccgagacggagctgcggcgggtagccgcctttctgggggaagtgagcgaagaagagatcaccgttgaccggagcgagtacgactaccggcggatctttgtctcgaatccccgggtagccgggcggcagctgggagagcttaacctgttcgagaactacggtgccaccgttacgcgggtgcggcgtggcgacgacgacttcctgccccatgacgacatggtcctcgagcttggcgaccgggtacgtgtcgtcacgcaccgcgatcacatggcagaagtgacggcctttttcggcgattcctaccgggccgtaagcgaggtggatatcctcactttcagcttgggactggccttgggactcctgctcggcatcatccccattcccctgcccggaggcatcaccctcaagctcggtttcgccggcgggcccctcatagtggcgctgattctcggcaccatcggccggtcgggctctatggtctggagcctgccctacagcgccaacatgaccctgcgccagatcggcctggtattgttcctggccggagtcggcacacgggcgggctacggtttcgtcaccaccctcgccaaggggggcggattggccatcttcgccgccggtgcggtcgtcacctgtcttacggccctcgccaccctctggatcggtcacaaactcatgaaaattcccatgagcatcctcatcggtatggtcgccggcctccagacccaacccgccgttctcggctacgccctggagcagaccggcaacgatctccccaatatcggctacgcctcggtctatcccgtggcgaccatcagcaagattctcattgtgcagatactgcttacgatgctcatgtga

SEQ ID NO: 91454 - protein, 546 aa, Geobacter sulfurreducens
MLSILLENPLLVLFLVAAIGYPLGRIKIRGSSLGVAAVLFVGLAMGSLHPELKLPEIVYVLGLALFVYTIGLSSGPAFVASLKREGIRNNALIIGMLLVAAGLVVGAQRLLGFKGTVTAGLFAGSLTNTPALAGALETIKHIASPELRELLLAEPVVGYSVAYPMGVMGVVLAISLVQKLWNVDYGEEGKRLRLAGTASEALRSMTVRIAWPGAGRHTVAELARHEKWDVIFGRIRRGDSYLLTGPQVRFQPGDLVTAVGTETELRRVAAFLGEVSEEEITVDRSEYDYRRIFVSNPRVAGRQLGELNLFENYGATVTRVRRGDDDFLPHDDMVLELGDRVRVVTHRDHMAEVTAFFGDSYRAVSEVDILTFSLGLALGLLLGIIPIPLPGGITLKLGFAGGPLIVALILGTIGRSGSMVWSLPYSANMTLRQIGLVLFLAGVGTRAGYGFVTTLAKGGGLAIFAAGAVVTCLTALATLWIGHKLMKIPMSILIGMVAGLQTQPAVLGYALEQTGNDLPNIGYASVYPVATISKILIVQILLTMLM

SEQ ID NO: 91455 - DNA, 1662 bp, Pasteurella multocida
  CDS (1)..(1662): transl_table=11
atgagtgatatcgccatcacgataagcctccttgcactggttgctgtcattgggttgtggataggacattggaagattcgaggcgtggggttaggtattggcggagtattatttggcgggattattgtcgcccattttactaaccaatatggtttaaagctagatgcacatacgatgcattttattcaagagtttggtttaattttattcgtttatacgattgggattcaagtgggacccggctttttcgcctcattacgtcaatctggtcttaagttaaatggctttgcagcattaattgttttattgggttcactggcggtgattgtgatccataagcttgctgatgtgccattggatattattctcgggatttattcaggtgcggtgacgaatacaccgtcgttaggggcagggcaacaaattctttctgaattagggcttacgcaaaccacgtcaaccatggggatggcgtatgcgatggcttatccatttggtatctgcgggattttactgagtatgtggttaatccgcttatttttccgcattaaaattgatgatgaagcgaaaaatttcctgaaagaaagtgggcaagataaagaaacccttggttcgataaatgtcagagtcaccaatccgaatttagatgggctacgtttagtggatattcccgggtttgatgaaaaaagagatgtggtgtgtacgcgtttaaaacgggacgagcatattagtgtgccgcaagccaatacgattatccagaaaggtgacttgttacatttggtgggtgaaattcctttattgcgtaaaatcaaattggtgttaggtgaagaagtcgatgtgcctttatccagttttactggggatttacgctccgatcgtattgtggtcaccaatgaaaaagttttaggcaagaaaattcgcgcgttaggtattcatcagaaatatggcgtcgtgatttcacgattaaaccgagcaggggttgagttggtgccgacagcgaataccgcattacagtttggtgatgtgttacatgttgttgggcgcagtgaagtattaaaccaagcggtttcaattctcggcaatgcgcaacaaaaattacaacaagtccaaatgttgcctgtgtttattgggattggcttaggggtattactgggttccattcctttccatattcccggttttccagtgccgcttaagctcggtttagccggtggaccattagtggttgcgttgattttggcgcgtattgggagcattggtaaactgtattggtttatgccacctagcgctaacttagcattgcgtgaaattgggatcgtgttattccttgcagtagtgggcttaaaatccggaggaaattttgtcgatactttagttaatgggagtgggctagaatggatggtgtatgggatttttatcacctttgtaccattgatgattgttggtatcgtggcacgcttatacgcgaaaatgaactatttaagtttgtgtggcttattggcgggttcgatgaccgatccgccagcactagcctttgcaaatgcgattaaagaggaaagtggcgcatctgcgttatcctacgcaacggtttatccgcttgtgatgttcttacggattatttcgcctcaactgttagctatattgctgtggacgttactgtaa

SEQ ID NO: 91456 - protein, 553 aa, Pasteurella multocida
MSDIAITISLLALVAVIGLWIGHWKIRGVGLGIGGVLFGGIIVAHFTNQYGLKLDAHTMHFIQEFGLILFVYTIGIQVGPGFFASLRQSGLKLNGFAALIVLLGSLAVIVIHKLADVPLDIILGIYSGAVTNTPSLGAGQQILSELGLTQTTSTMGMAYAMAYPFGICGILLSMWLIRLFFRIKIDDEAKNFLKESGQDKETLGSINVRVTNPNLDGLRLVDIPGFDEKRDVVCTRLKRDEHISVPQANTIIQKGDLLHLVGEIPLLRKIKLVLGEEVDVPLSSFTGDLRSDRIVVTNEKVLGKKIRALGIHQKYGVVISRLNRAGVELVPTANTALQFGDVLHVVGRSEVLNQAVSILGNAQQKLQQVQMLPVFIGIGLGVLLGSIPFHIPGFPVPLKLGLAGGPLVVALILARIGSIGKLYWFMPPSANLALREIGIVLFLAVVGLKSGGNFVDTLVNGSGLEWMVYGIFITFVPLMIVGIVARLYAKMNYLSLCGLLAGSMTDPPALAFANAIKEESGASALSYATVYPLVMFLRIISPQLLAILLWTLL

SEQ ID NO: 91457 - DNA, 1677 bp, Vibrio cholerae
  CDS (1)..(1677): transl_table=11
gtgaacatcgacgtcgttttgttgctagagcaaaatccaattttgctgatatttgttgtcctcgccatcggtctctctttcgggaaaattcgctttggcagcttccaattgggtaattcgattggagtgctcatcacctctctgatcatggggcatcttggtttttcctttacaccggaagcattaaccatcggctttatgctctttatttattgtgtcggcattgaagcgggtcctaacttctttggtattttcttccgcgatggtaaacactacttaattctaagcttagtggtcttgatcactgcgacttggattgcctactttggtggttactatcttaatctggattatggcttagccgccgggatgatggcgggcgcattaacctcaacacccgtactggttggtgctcaggatgcgctcaattctgggcttgccgcggtaccaagacatatggatttatcactgattttagataatgtctcggtcggttatgcgatggcctacttgatcggccttatcagcatgatcatgtttgctaaattactccctaagttgcaaaagcaaaacctgtccgattcggctcaacaaatcgcgcaagaacgagggttaggcagtcagcgtaaagtctatctgccgatcatccgtgcctatcgagtcggacctgaactgattaactggatcgacggtcgtaatctgcgcgagctgggtatctaccgtcaaacaggctgttatattgagcgtatccgccgacatggcattttggcccatcctgatggtgatgccattttgcaagaaggggatgaaattgctctcgtaggtttcccagatagtcacgctcgtcttgacccgagctttcgcaatggcaaagaagtgtttgaccgtaacttactcgacctacgaatttcagaagaagagatcgtggtaaaaagtgacagcattgcgggaaaacgtctctccgatcttaatctttcggaatacggctgcttccttaaccgagtcgttcgtgcgcaaatcgaaatgccgatggatctggatatcgtgctcgccaaaggcgatgtcctgcaagtcagcggcgagaaaagcaaagtaaaggggctggcagataaaatcggttttatctctgtacacagccaaatggctgatctgcttgctttctgtagcttttttattcttggcattctgtttggtttggtcaccatgacctttggccaagtgtcgtttagcttaggtaatgcggtggggttactgctctctggtatcactttgggctttttgcgagccaaccacccgactttcggttatgttccgcaaggcgcactcaatatggtcaaagaccttggtctagccatcttcatggtcggtattgggctcaatgcaggtagcaaaatgttccagcatctctccgaagtaggtgtgcaagtgatcggtttagcctttttagtgagcgttgtacctgtcgtgttcgcttacttggttggcgcctacattctaaagatgaaccgcgctctattgtttggtgcgattattggcgcgcgcacctgtgctccggcgatggatgtggttaatgaatacgctaagtctaccattccagcactgggttatgcgggcacctacgcgattgccaatatcttaatgaccttaacgggtaccatctttatcttgctcagttaa

SEQ ID NO: 91458 - protein, 558 aa, Vibrio cholerae
MNIDVVLLLEQNPILLIFVVLAIGLSFGKIRFGSFQLGNSIGVLITSLIMGHLGFSFTPEALTIGFMLFIYCVGIEAGPNFFGIFFRDGKHYLILSLVVLITATWIAYFGGYYLNLDYGLAAGMMAGALTSTPVLVGAQDALNSGLAAVPRHMDLSLILDNVSVGYAMAYLIGLISMIMFAKLLPKLQKQNLSDSAQQIAQERGLGSQRKVYLPIIRAYRVGPELINWIDGRNLRELGIYRQTGCYIERIRRHGILAHPDGDAILQEGDEIALVGFPDSHARLDPSFRNGKEVFDRNLLDLRISEEEIVVKSDSIAGKRLSDLNLSEYGCFLNRVVRAQIEMPMDLDIVLAKGDVLQVSGEKSKVKGLADKIGFISVHSQMADLLAFCSFFILGILFGLVTMTFGQVSFSLGNAVGLLLSGITLGFLRANHPTFGYVPQGALNMVKDLGLAIFMVGIGLNAGSKMFQHLSEVGVQVIGLAFLVSVVPVVFAYLVGAYILKMNRALLFGAIIGARTCAPAMDVVNEYAKSTIPALGYAGTYAIANILMTLTGTIFILLS

SEQ ID NO: 91459 - DNA, 1668 bp, Bacteroides thetaiotaomicron
  CDS (1)..(1668): transl_table=11
atggagtggttatataatctgtttctcgaacattctgccttacaggcagttgtggtgctttcactgatttctgcgattgggctggggctgggaagagtgcatttctggggagtatctctgggagtcacttttgttttttttgcaggtatccttgccggacacttcgggctttcggttgatccacagatgctgaattatgcagaaagtttcggactggttattttcgtatattcactggggcttcaggtagggcccggtttcttcagttctttccggaaaggaggggtgacgctgaatatgttggcgttggccgtagttctgttgggtactttgctgactgttgttgccagttatgcgacaggtgtgtctcttcctgatatggtgggtatcctttgcggagccacgactaatactcctgccttgggagctgcgcagcagacacttaaacagatgggcatagagagcagtactccggctttggggtgtgcggtagcctatccgatgggagtgatcggtgtgattcttgccgtactgctgattcgtaaattcttggttcataaagaagacttggagattaaagaaaaggatgatgccaacaaaacctttatcgcagcgtttcaagtacataaccccgctatttttaataaaagtatcaaggatatagctcagatgagttatccgaaatttgtgatttcccgtttgtggcgtgacggtcatgtcagtattcctacctccgacaaggtattgaaggaaggcgaccgcctgttggtgatcacagcggaaaagaatgtcctggctctgacagtacttttcggtgaacaggaagaaaatacggactggaacaaggaagatatagactggaatgcaattgacagcgaattgatctcgcagcgtatcgtcgtaacccgccccgaactgaatggaaagaaacttggctcattgagactaagaaaccattatggaatcaatatcagccgtgtgtaccgttcgggtgtgcaactacttgccactccggaactgattctccagctgggcgaccgcctgacagtagtaggtgaagcagcagccattcagaatgtagaaaaagtattgggaaatgcagtgaaaagtctgaaagaacctaatcttgttgtcatatttataggcatcgtattgggattggcattgggagcgatcccgttctccataccgggaatcagtactcccgtgaagctggggctggcaggcggaccgattatcgtgggtatcctgctgggaactttcggcccacggatacacatgatcacttacactacccgcagcgccaatctgatgctgcgcgcgttggggctttccatgtatctagcctgtcttggtctggatgccggtgctcatttcttcgatactgtcttccgtccggaaggattgctttggatagctttgggagccggtctgacaattatcccgacggtcctggtcggctttgtcgctttcaagattatgaagatagacttcggcagtgtatccggtatgttgtgcggcagtatggcgaatccgatggcgctgaattatgccaacgatacgataccgggtgacaatccttccgtcgcttatgctacagtatatccgttgtgtatgtttctgcgtgtgatcattgcgcaggtgctgttgatgtttttattgggctga

SEQ ID NO: 91460 - protein, 555 aa, Bacteroides thetaiotaomicron
MEWLYNLFLEHSALQAVVVLSLISAIGLGLGRVHFWGVSLGVTFVFFAGILAGHFGLSVDPQMLNYAESFGLVIFVYSLGLQVGPGFFSSFRKGGVTLNMLALAVVLLGTLLTVVASYATGVSLPDMVGILCGATTNTPALGAAQQTLKQMGIESSTPALGCAVAYPMGVIGVILAVLLIRKFLVHKEDLEIKEKDDANKTFIAAFQVHNPAIFNKSIKDIAQMSYPKFVISRLWRDGHVSIPTSDKVLKEGDRLLVITAEKNVLALTVLFGEQEENTDWNKEDIDWNAIDSELISQRIVVTRPELNGKKLGSLRLRNHYGINISRVYRSGVQLLATPELILQLGDRLTVVGEAAAIQNVEKVLGNAVKSLKEPNLVVIFIGIVLGLALGAIPFSIPGISTPVKLGLAGGPIIVGILLGTFGPRIHMITYTTRSANLMLRALGLSMYLACLGLDAGAHFFDTVFRPEGLLWIALGAGLTIIPTVLVGFVAFKIMKIDFGSVSGMLCGSMANPMALNYANDTIPGDNPSVAYATVYPLCMFLRVIIAQVLLMFLLG

SEQ ID NO: 91461 - DNA, 1683 bp, Vibrio parahaemolyticus
  CDS (1)..(1683): transl_table=11
gtgaacatagacgtcgtacaacttctcgatcaaaaccccattcttctaatcttcgtcgtattagccattggccttgccatcggaaaaattcgctttggaaacctacagttaggcaactctataggtgttctaattacctcgctgatcatgggtcatttaggcttttccttcaacgctgaagcgctaaccatcggctttatgctctttatctattgcgttggcatagaagctggacctaacttttttggcatcttctttagggatggtaaacactacttcatcctcagtatgaccgtgcttgtcgctgcagtgagcttaacttacggtttaagccactactttggcctcgatttcggtctttctgccggcatgatggcaggagcattgacggcgacacctgttctagttggtgctcaagatgctttgaactcaggtcttgcaacaataccgcgcaatatggatttttctttggtattagaaaatctatccgtaggttacgcgatggcttatctgattggtttgatcagcatgatcatgttcgctaagttgctaccaaagttacaaaagcagaacctttcagactctgctcaacaaatcgctcaagagcgtggccttggtaactcaagccagcgcaaagtttatctacctattattcgcgcatatcgagttggcccggagcttatcgattggacagacggcaaaaacttacgagaacttggtatttaccgccaaacgggttgttatattgagcgtattcgccgtaatggtatcctcgcccaccctgatggtgatgcgattttgcaagaaggcgatgaaatagcactggtaggcttccctgacagccacgctcgtttggacccaagcttccgaaacggtaaagaagtgttcgaccgtaaccttctcgatctgcgtattgtggaagaagagattgtcgttaagagcgacgcgattgccggcaaacgtctatctgatttgaacctgtctgagttcggttgtttccttaaccgtgtagttcgtgcgcaaatcgaaatgccaatggatttagacattgttcttgccaaaggtgatgtgcttcaggtgagtggtgagaagagtcgtgtacatggccttgctgagaaaatcggttttatctcgattcacagccaaatggccgacttattggcgttctgtagcttctttattcttggcattatgtttggcctagtgaccatgacatttggccaagtgtcgtttagcttaggtaacgcggtaggccttttgctgtcaggtattacactaggcttccttagagccaaccaccctactttcggctacgtaccacaaggcgcgttaaacatggtcaaagatcttggtttaatgttctttatggtcggtatcggtttgagtgctggtggcaagatgttcgagcatttgactcaagttggcccacaggtgattggtcttgcgtttattgtcagtgtcgtgcctgttgtgattgcttaccttgttggtgcatacattttgaagatgaaccgcgcattgctattcggggcaatcattggcgcacgtacttgtgcaccagcgatggatgtcgtaaacgaatacgcgaagtcgacgattcctgctcttggttatgcgggtacttatgcgatagccaacatcctaatgacgctagctggtacgattttgataattctgagttaa

SEQ ID NO: 91462 - protein, 560 aa, Vibrio parahaemolyticus
MNIDVVQLLDQNPILLIFVVLAIGLAIGKIRFGNLQLGNSIGVLITSLIMGHLGFSFNAEALTIGFMLFIYCVGIEAGPNFFGIFFRDGKHYFILSMTVLVAAVSLTYGLSHYFGLDFGLSAGMMAGALTATPVLVGAQDALNSGLATIPRNMDFSLVLENLSVGYAMAYLIGLISMIMFAKLLPKLQKQNLSDSAQQIAQERGLGNSSQRKVYLPIIRAYRVGPELIDWTDGKNLRELGIYRQTGCYIERIRRNGILAHPDGDAILQEGDEIALVGFPDSHARLDPSFRNGKEVFDRNLLDLRIVEEEIVVKSDAIAGKRLSDLNLSEFGCFLNRVVRAQIEMPMDLDIVLAKGDVLQVSGEKSRVHGLAEKIGFISIHSQMADLLAFCSFFILGIMFGLVTMTFGQVSFSLGNAVGLLLSGITLGFLRANHPTFGYVPQGALNMVKDLGLMFFMVGIGLSAGGKMFEHLTQVGPQVIGLAFIVSVVPVVIAYLVGAYILKMNRALLFGAIIGARTCAPAMDVVNEYAKSTIPALGYAGTYAIANILMTLAGTILIILS

SEQ ID NO: 91463 - DNA, 1689 bp, Yersinia pestis
  CDS (1)..(1689): transl_table=11
gtgaatataaacgtcgcaaatttgttaaacggcaactatatcttgctgttattcgtcgtcttagcgttggggttatgcttaggtaaattgcgccttggctctatccaattaggtaacgctattggtgtactggtggtatcactgttgctagggcaacagcatttcgccatcaatactgaagcgctaaatctgggctttatgttgtttattttttgtgtcggtgttgaagccggtccaaacttcttttctattttcttccgtgatggcaaaaattacctgatgctcgccttggttatggtgggcagcgcgatgattttagcgttggggcttggcaaattatttggttgggatatcggtctgaccgccgggatgctggcagggtcaatgacatcgacccccgttttggttggggccggtgatacgctacgccataccatggctaatggttcgtcactgcaacaagcacaggataatttgagcctcggctatgccctgacttatcttatcgggctggttagcctgattttaggtgcgcgctatttacctaagcttcagcatcaggatttaccgaccagcgcccaacaaattgcccgcgaacgagggctggacaccgatagccagcgtaaagtgtatttgcctgtcatccgtgcttatcgtgtaggcccggagctggttgcctgggcagatggtaaaaacttgcgtgaattagggatttaccgccaaaccggttgctatatcgagcgtatccgccgcaacggtattctcgcgaatccggatggtgacgccgtgctacaagtcggtgatgaaatctcgttggtgggttacccagatgcccattcccgccttgaccccagcttccgtaatggcaaagaagttttcgaccgtgatctgttggatatgcgtatcgtcaccgaagagatcgtggtcaaaaatagcaatgctgtcggtaaacgcctcagccatttaaaactcaccgatcacggttgcttccttaatcgggtcattcgtagccaaattgaaatgcccattgatgataacgtggtgttgaataaaggtgatgtgctgcaagtcagcggtgatgcccggcgagtcaaaagcgtggcagaaaaaattggctttatctctattcacagtcaggtcactgacctgctggccttctgctcattctttattcttgggttaatgattggcctgattactttccagttcagcaatttcagcttcggtattggcaatgccgcagggctgttattagcagggatcatgctgggatttttacgtgccaaccaccctacttttggctatatcccgcaaggcgccttgaatatggtgaaagagttcgggttaatggtctttatggcaggtgtcgggttaagtgccgggggcggcattaatagcagcctgggcgccgtcggtggacaaatgttgatttccggtttgatagtcagtttggttccggtggtgatctgctttgtttttggtgcttatgttctgcgtatgaaccgtgcactgctttttggtgccattatgggggccagaacctgtgcacccgccatggacatcatcagtgataccgcgcgtagcaatattcccgcattaggctacgcggggacttacgctatcgccaacgtcttactgaccttggctggctcgttgattgtcatcctctggccagggatattaggttag

SEQ ID NO: 91464 - protein, 562 aa, Yersinia pestis
MNINVANLLNGNYILLLFVVLALGLCLGKLRLGSIQLGNAIGVLVVSLLLGQQHFAINTEALNLGFMLFIFCVGVEAGPNFFSIFFRDGKNYLMLALVMVGSAMILALGLGKLFGWDIGLTAGMLAGSMTSTPVLVGAGDTLRHTMANGSSLQQAQDNLSLGYALTYLIGLVSLILGARYLPKLQHQDLPTSAQQIARERGLDTDSQRKVYLPVIRAYRVGPELVAWADGKNLRELGIYRQTGCYIERIRRNGILANPDGDAVLQVGDEISLVGYPDAHSRLDPSFRNGKEVFDRDLLDMRIVTEEIVVKNSNAVGKRLSHLKLTDHGCFLNRVIRSQIEMPIDDNVVLNKGDVLQVSGDARRVKSVAEKIGFISIHSQVTDLLAFCSFFILGLMIGLITFQFSNFSFGIGNAAGLLLAGIMLGFLRANHPTFGYIPQGALNMVKEFGLMVFMAGVGLSAGGGINSSLGAVGGQMLISGLIVSLVPVVICFVFGAYVLRMNRALLFGAIMGARTCAPAMDIISDTARSNIPALGYAGTYAIANVLLTLAGSLIVILWPGILG

SEQ ID NO: 91465 - DNA, 1698 bp, Bacteroides fragilis
  CDS (1)..(1698): transl_table=11
atggattggattgtacatcaacttagggtacaccccgagctggctatcttcctgaccctttttgtgggcttttggattggaaaaatcaaaatcggaaagttcagcctaggagttgtaacaagcgtattgctggtaggagtccttgtcggacaactcgacatcaccgtcgacggacctatcaaatctgttttctttctgctttttcttttcgccatcggctataaggtcggtcctcagtttttccgcggactgaaaaaggacggactccctcaaatggggtttgccgccatcatgtgtgtattctgcctgatcatcccttggatactggctaagattatggggtataatgtaggtgaggctgccggattactggccggatcgcaaaccatctctgccgtaatcggcgtggccggagacacgattaacgaactgaacatctctccggaaaccaaagaagcatataataacattatcccggtgtcgtatgccgtaacttacatcttcggcacggccggctctgcatgggtattgggttcactcggcccgcgactgctggggggactcgataaagtgaaagctgcctgcaaagaactggaagccaaaatgggaaataacgaagcggatcaacccggattcatggcagccgcccgccccgttactttccgtgcttataaaatagccaacgagtggtttggtgacggcaaacgggtgtcagatcttgaaagttattttcaggaaaacgataaacgcctgtttgtggaacgggtgcgccaggcaggagtcatcgtaaaagaggttagtccgacttttgtactgaagaaaggcgacgaagtggtactgagcggccggcgcgagtatgtgatcggtgaagaggactggatcggtcctgaagtattggacccgcagttgctggacttccctgctgaggtattacccgttatggtcacccgcaaaacggttgccggagaaaaagtcagcaccatccgggccctgaaatttatgcacggtgtcagcattcgccgcatcaaacgggcaggtattgacataccggtattggcccagaccgtggtcgacgccggtgacatggtggaactggtgggtaccaaacatgaagtggatgcggcagccaagcagctgggatatgccgaccggccgaccaaccagacagacatgatctttgtcggattgggtattttgataggaggactgatcggcgcactcagcattcacatgggaggagtccccatcagcctcagcactagcggaggagccttgatcggcggattattcttcggatggctacgcagcaaacaccctactttcggacgtattcccgaacccgctctctggatactggacaacgtgggactgaacatgtttattgccgttgtgggcattgctgcaggtcccagcttcgtgcaagggttcaaggaagtgggtttaagcctgttcatcgtaggcgcactggccacttccattcctctgatagcaggcatactgatggcaaaatatatctttaaattccatccggcactggtattgggatgcacagccggcgcacgtaccactacggctgcattaggagccatccaggaagccgttgaaagcgaaactcctgctttgggatatactgtgacgtatgctgtcgggaatactcttctgattatctggggagtagtgatcgtattacttatgtag

SEQ ID NO: 91466 - protein, 565 aa, Bacteroides fragilis
MDWIVHQLRVHPELAIFLTLFVGFWIGKIKIGKFSLGVVTSVLLVGVLVGQLDITVDGPIKSVFFLLFLFAIGYKVGPQFFRGLKKDGLPQMGFAAIMCVFCLIIPWILAKIMGYNVGEAAGLLAGSQTISAVIGVAGDTINELNISPETKEAYNNIIPVSYAVTYIFGTAGSAWVLGSLGPRLLGGLDKVKAACKELEAKMGNNEADQPGFMAAARPVTFRAYKIANEWFGDGKRVSDLESYFQENDKRLFVERVRQAGVIVKEVSPTFVLKKGDEVVLSGRREYVIGEEDWIGPEVLDPQLLDFPAEVLPVMVTRKTVAGEKVSTIRALKFMHGVSIRRIKRAGIDIPVLAQTVVDAGDMVELVGTKHEVDAAAKQLGYADRPTNQTDMIFVGLGILIGGLIGALSIHMGGVPISLSTSGGALIGGLFFGWLRSKHPTFGRIPEPALWILDNVGLNMFIAVVGIAAGPSFVQGFKEVGLSLFIVGALATSIPLIAGILMAKYIFKFHPALVLGCTAGARTTTAALGAIQEAVESETPALGYTVTYAVGNTLLIIWGVVIVLLM

SEQ ID NO: 91467 - DNA, 1698 bp, Bordetella parapertussis
  CDS (1)..(1698): transl_table=11
atgcaggctttcgtgcaattcctgggcagcaacccctacatactgctgtttctcaccatcggcctggcggtctgggtcggcaagttttccatcaagggctacgggctgggcgcggtcgccgccgccatcgtggtcggctgcctggtcgccaccgtgggcgcggcctacggcgtcaagttccacctggacgagttcgccaagtcgctgctctattacctgttcatgtacggcgtggggctgcgcgtgggtccgtccttcgtcaacgcgctgaacaaggagtccatcaactacgccatcctggccatcatcgcgccgatcctgggcctggccatcgtggtgctgggcacgcagttcttcggcctgccgctgggcgcggccggcggcatgctggccggctcgcagaccatgtcggcggccatcggctcggccgaacaggcggtcagcgccggcgtgctgtcgctgggttcggagagtcccgagcagatcagcgccatgatcgcgctgtcctacggcatcacctacatctggggcacggtcggcatcatcctgctgtgcaagtacctgccgcgcatctggggcgtggacgccaaggccgccgcgctcgagttcgagaaggcgcatggcgtgcccaacgtggacgacgccgggctgacggcctttcatccgttcgacctgcgcgcctaccgggtcgagaacccggaatcgatcggcaagacggtccagcagttccgcacgcgctttccccagtaccaggtggtcaatgtcgagcgcggcgaccagctgctcggcccctcggccgagaccgtgctgcagcagggcgacgtggtggcgctgggcggccgcctggaggaaatgaccgccaacatggggatgctcggccccgaggtgcccgacgcccgcgcgctgaacataccgctggaccaggccgagatcctggtgaccaacaaggaggtgaccggccggccgctgaagaccttccgcggttcggagctggccgggcagatccagctgcagcgcgtcgagcgcagcggcgtgccgctgcccatcggcctggaaaccacgctgcaaaagcgcgacgtactgttcgtgaccggcctgcagccggccgtcagcaaggccggcgagatcttcggcgtgattgcgcgccatagctcggccaccgacctgctgaccctgtcgttcggcatgatcctgggctttctgatcgggctgatcgaagtgccggcgttcggcgccaaggtggggctgggcaacgcgggcggcctgctgctgtcgggcatcatcgtgtcgtcgatttcctcgcggctgcgctttttcggcaacacccccaacgccgcgcgcaacatcctcgaggacctgggcctgatcggcttcgtggccatcgtcggcatcaacgccggcgccgacctgctcacccagctaaccggcgcgatcgcgctgaagatcttcatcgtgggctttctcgcctcgaccatcccgcccatcatcgtgtgggccatcggctttcacatcatgaagatcaaccccgcgctgctgatgggcgccaccgccggcgcgcgcagccactcggggccggcgcgcgaagccgccaaggaagtcggctccagcgtgccctggctgggattcccggtcggctacgccgtctccggcgtgctgctgaccgtgttcggctacttcgccatggtcctggcgcactga

SEQ ID NO: 91468 - protein, 565 aa, Bordetella parapertussis
MQAFVQFLGSNPYILLFLTIGLAVWVGKFSIKGYGLGAVAAAIVVGCLVATVGAAYGVKFHLDEFAKSLLYYLFMYGVGLRVGPSFVNALNKESINYAILAIIAPILGLAIVVLGTQFFGLPLGAAGGMLAGSQTMSAAIGSAEQAVSAGVLSLGSESPEQISAMIALSYGITYIWGTVGIILLCKYLPRIWGVDAKAAALEFEKAHGVPNVDDAGLTAFHPFDLRAYRVENPESIGKTVQQFRTRFPQYQVVNVERGDQLLGPSAETVLQQGDVVALGGRLEEMTANMGMLGPEVPDARALNIPLDQAEILVTNKEVTGRPLKTFRGSELAGQIQLQRVERSGVPLPIGLETTLQKRDVLFVTGLQPAVSKAGEIFGVIARHSSATDLLTLSFGMILGFLIGLIEVPAFGAKVGLGNAGGLLLSGIIVSSISSRLRFFGNTPNAARNILEDLGLIGFVAIVGINAGADLLTQLTGAIALKIFIVGFLASTIPPIIVWAIGFHIMKINPALLMGATAGARSHSGPAREAAKEVGSSVPWLGFPVGYAVSGVLLTVFGYFAMVLAH

SEQ ID NO: 91469 - DNA, 1695 bp, Zymomonas mobilis
  CDS (1)..(1695): transl_table=11
ttgtctgtgatggtaatattagaatttttgcagacattgttaagaaacaaccctgaaattgccctctttttggcaattgccatcggctattggataggaaaattccgttttggatccttacaaatcggaggagtcgccggttctttattggcggctgtcctgataagccagattggtatccatattgattcagggctgaaaacagttctgtttgccctttttatctatgctgtcggttttcaaagtggcccccagtttttcaaatctctgggacggcaatctttacgtgaagtgctgatggcctttgtcttggctatatccggtctttttaccgttttagccgtagccagaatgtttcatctcgataaaggtttggccgcgggtgtcgccgccggtggattgacccaatccgctattatcggaacggccagttctgctttggaaaagctaggcttgccgctggctcaaacccagatgttacaaggccatgtcgccgtcggctatgctgtgacctatatattcgggtcgcttgccccgattattatctgcgtcaatattctaccttggttgatgaaaagagggctgcgtgaagacgccctcaccgctgaagccgaacaaatgcaaggcatggctgtttatggcgacggtgaacgccccgctttgtctgaatttgtcagccgcgtctatcaggtaaaaaaagcaggccaatctgtccaacagattgaaagcgatcacgtcaccgttgaacagattcggagacagaaaaatcttgtcgctgtgacgcaagacagcaccgtcgaagccggagacctccttttgctgttcggacatcgtgccgatgttatttcgacgggagaattgctgggcgaagaaataaaacagccgccgcatgatatggatgtggtgattgttcgccatgatgttcttttgacgaataaggcctttgtcggcaaatcagtagccgaatgtagccaaattttatcccaagtagcacgccacggtgtttattttctgggactgaaacgcggcgataaaaccttaccgcttacctctgatctgcatattttgtcgggcgatattgtgacgctttatggcacccgccaagatgtcgatcgggtagccaaggaattgggcagcctactgaccagaagccttaaaacagaccttgtctttcatggcgtggggcttgttgtcgggttactcattggtctgatcgttgtcagattagggtctattcctttgaccttagggagcggcggcggcgcgcttctctctggcctgttattcggctggtatcaaaatcgccatagcaaaagcggcaatatgccaatggcagcctcaaccttgttggttgatttcggcttatccggttttgtggcggtcacgggtctccagactggacagcaagccgtcaccaccatcatgcaacagggtatcaccctctttatgctgggtgtcgtggtgtcgattgtgcctttgattatcaccatgctgtttgggcgttatgtcctgcaatataaaaacacagctgtttttgctggtgcgctggcgggctcccgcagtgccaatcctgctttgggcgaaatccttaataaagccggtaacgctgttccgacgacgtctttcgctatcacctatgccattgccaacgttcttttgaccttattgggcccgctggtggtcgctttttcctag

SEQ ID NO: 91470 - protein, 564 aa, Zymomonas mobilis
MSVMVILEFLQTLLRNNPEIALFLAIAIGYWIGKFRFGSLQIGGVAGSLLAAVLISQIGIHIDSGLKTVLFALFIYAVGFQSGPQFFKSLGRQSLREVLMAFVLAISGLFTVLAVARMFHLDKGLAAGVAAGGLTQSAIIGTASSALEKLGLPLAQTQMLQGHVAVGYAVTYIFGSLAPIIICVNILPWLMKRGLREDALTAEAEQMQGMAVYGDGERPALSEFVSRVYQVKKAGQSVQQIESDHVTVEQIRRQKNLVAVTQDSTVEAGDLLLLFGHRADVISTGELLGEEIKQPPHDMDVVIVRHDVLLTNKAFVGKSVAECSQILSQVARHGVYFLGLKRGDKTLPLTSDLHILSGDIVTLYGTRQDVDRVAKELGSLLTRSLKTDLVFHGVGLVVGLLIGLIVVRLGSIPLTLGSGGGALLSGLLFGWYQNRHSKSGNMPMAASTLLVDFGLSGFVAVTGLQTGQQAVTTIMQQGITLFMLGVVVSIVPLIITMLFGRYVLQYKNTAVFAGALAGSRSANPALGEILNKAGNAVPTTSFAITYAIANVLLTLLGPLVVAFS

SEQ ID NO: 91471 - DNA, 1662 bp, Bacteroides fragilis
  CDS (1)..(1662): transl_table=11
atggagtggttatatagtctctttatcgaacattctgctttgcaggcagttgtcgttctttccctgatttccgccattgggctcggattgggcaaaattcatgtttgtggcatttcgcttggcgttacctttgtcttttttgccggcattctggccgggcacttcggattgtccattgatccgcagatgctgaattacgccgagagtttcgggctcattatctttgtatatgccttggggttgcaggttggtcccggctttttcagctcatttcgcaagggaggggttacgttgaatatgcttgccatcgcagtagtgattctgggtacgtttcttgcggttgtttgcagctataccaccggggtttcgttacccaatatggtaggcattctgtgtggtgccaccactaacactccggctttgggagcagcccagcagacgctgaagcagatggggcttgaaagcagtacaccagctttgggatgtgccgtggcctatcctctcggagtgattggggtgattctggcggttctgttgatccgtaaattgctggtacgccgggaagatcttgaagtacaggaaaaagacgatgccaacaaaacctatattgccgcttttcaggtacacaaccctgctatttttaataaaagcattaaggatatcgctcatatgagttatccaaaattcgtcatttcccgtttgtggagagacggcaatgtcagtattcccacttccgaaaagattataaaagaaggcgaccgcttattggttgttacatccgaaaaagacgcattggcccttaccgtactgttcggtgaacaggagaatacggattggaacaaggaagatatcgattggaatgctatcgacagccaattgatttcgcaacgcatcgtcgtcacccgtcccgaattgaacgggaagaagttgggagctcttcgtctgcgcaatcattacggaatcaatatcagccgtgtctatcgttccggggtgcaattgttggctactcccgaacttaccttgcagttgggtgaccgtctgacagtggtcggcgaagcggctgccatccagaatgtggagaaggtacttggaaatgccatcaaaagcttgaaagaacccaatcttgtggctgtatttgtcggtatcatcctgggattggccctgggagccgtacctttctcaattcccggtatcagtactcctgtccggctcggacttgcaggcggtcccattattgtaggcatcctgatcgggacctttggaccccgtttgcacatgatcacctataccactcgcagtgccaatctgatgctccgtgccttggggctgtccctttatcttgcctgccttgggttggatgcaggtgcccatttcttcgatacggtattccgtcccgaaggacttttatggatcggcctgggctttgggctgaccctcgtgcctacggtgcttgtggggttctttgcttttaagattatgaagatcgattttggcagcgtttccggtatgttgtgtggcagtatggccaatccgatggcattgaattacgccaatgataccatccccggagataatccgtcggtagcttatgctacggtctatccgttgagtatgttccttcgcgtcattatagcccaggtgctgctcatgtttcttctatag

SEQ ID NO: 91472 - protein, 553 aa, Bacteroides fragilis
MEWLYSLFIEHSALQAVVVLSLISAIGLGLGKIHVCGISLGVTFVFFAGILAGHFGLSIDPQMLNYAESFGLIIFVYALGLQVGPGFFSSFRKGGVTLNMLAIAVVILGTFLAVVCSYTTGVSLPNMVGILCGATTNTPALGAAQQTLKQMGLESSTPALGCAVAYPLGVIGVILAVLLIRKLLVRREDLEVQEKDDANKTYIAAFQVHNPAIFNKSIKDIAHMSYPKFVISRLWRDGNVSIPTSEKIIKEGDRLLVVTSEKDALALTVLFGEQENTDWNKEDIDWNAIDSQLISQRIVVTRPELNGKKLGALRLRNHYGINISRVYRSGVQLLATPELTLQLGDRLTVVGEAAAIQNVEKVLGNAIKSLKEPNLVAVFVGIILGLALGAVPFSIPGISTPVRLGLAGGPIIVGILIGTFGPRLHMITYTTRSANLMLRALGLSLYLACLGLDAGAHFFDTVFRPEGLLWIGLGFGLTLVPTVLVGFFAFKIMKIDFGSVSGMLCGSMANPMALNYANDTIPGDNPSVAYATVYPLSMFLRVIIAQVLLMFLL

SEQ ID NO: 91473 - DNA, 1578 bp, Propionibacterium acnes
  CDS (1)..(1578): transl_table=11
atgacagtactgaccgactttcttgccacgcatcaactgctgacgatcctgatcgtcctggcctccggcgccttgctaggccaaatcaagtttggcccgttgagatttggtgccgctggagccctgtttatggggctggtcgtcggggcccttgatcctcgcttcggtcaaaacctggggatgatcaaaggcctaggcgtcgtgctgttctgctacaccgtgggcctggctgctggatcgaccttcttatctgacctcaaacgtcagtggggcctcatgctcgccggtgtcgtcgggttggcagtgatggccgcagctggactcggcctggggcgactcttcggtttaaccccggctcacgttgcgggtctgtacgccggtgtcctcacctcaccagccattgacgccgcatcgatggctacccatggagccgcagatactcttgtggggtatgcgctgtcctatcccgtgggcgtcgtcgtcgggctcattatggtcgcaatcattgctaagagatgctggccggccagcaaagacaacacctcaatggctgaggctgggcttaccgcggtgtcgacagtcgtcgaccgggagacatcgatccggcagacccctggctttaatgacgaccaggttcggatgtcctatctgctgcgcgatggcgagatgcgattggccacccccgacgacgatctccacgtcggtgatcaggtgctggtggtcggaaaccctgacgacgtcaatcgtgctgtcgagcacctcgggcacgtctccgagcgcaccctcaccaacgagcgcaacgagctcgatttccggcgctttgtggtgtccaacccggccttggtgggccgcaccttaggcagcatcgatgtgcgcggacgtaccagtggcaaggtgacgcgagtacgtcgcggtgacctcgatatgttggctcgcagcgacatcgtcctgcagccaggagatcgggtgctgtgtgttgtgccagctcatcgcctttccgacgctgcggacctctttggcgactctgaggctcgcgtctcccaagtggatgctctgtctttgggattgggtgccgctcttggcttattgctcggtgccctcatggtggccctgcccagggggttgcagttcgagctgggaaccgctgctgggccgctggtcatgggcatgatcttaggatcgattcaccgcacggggccgctgcggtggcaattgccgcacgcgacgaacgcgattctgcgtcagctcgggctcatgatcttcctggcctgcgtcgggctggcgtccgggccagcattcttgtcccaggcggtgagcgggacgggtctggcggttattgccgtctcggctgtgaccctggtccttggtggtgcgatcgtcatcgcagcagcctggtgtatgaagctttcggcccagcgcgctacgggtgcttttgcaggcttcgttggtcagcccgccatccttagctacgccaactctctcgttaatgacgaacggatcgagtcggcctacggtgcccttttcgcgttaggaaccgtcgtcaaaatcctgctagtacaggtgattgtgctggtctaa

SEQ ID NO: 91474 - protein, 525 aa, Propionibacterium acnes
MTVLTDFLATHQLLTILIVLASGALLGQIKFGPLRFGAAGALFMGLVVGALDPRFGQNLGMIKGLGVVLFCYTVGLAAGSTFLSDLKRQWGLMLAGVVGLAVMAAAGLGLGRLFGLTPAHVAGLYAGVLTSPAIDAASMATHGAADTLVGYALSYPVGVVVGLIMVAIIAKRCWPASKDNTSMAEAGLTAVSTVVDRETSIRQTPGFNDDQVRMSYLLRDGEMRLATPDDDLHVGDQVLVVGNPDDVNRAVEHLGHVSERTLTNERNELDFRRFVVSNPALVGRTLGSIDVRGRTSGKVTRVRRGDLDMLARSDIVLQPGDRVLCVVPAHRLSDAADLFGDSEARVSQVDALSLGLGAALGLLLGALMVALPRGLQFELGTAAGPLVMGMILGSIHRTGPLRWQLPHATNAILRQLGLMIFLACVGLASGPAFLSQAVSGTGLAVIAVSAVTLVLGGAIVIAAAWCMKLSAQRATGAFAGFVGQPAILSYANSLVNDERIESAYGALFALGTVVKILLVQVIVLV

SEQ ID NO: 91475 - DNA, 1665 bp, Bacteroides thetaiotaomicron
  CDS (1)..(1665): transl_table=11
atggattggttacaaagtttattgtgggaccctagctccgtagcgcacattgtattcctctacgcttttgtagtggcagccggtgtgtatctcggtaaaataaagatattcggagtatctttgggagtcacttttgttttgtttgccggcatcctaatgggacatttcggcttcacagccgatacacacatcctacatttcatccgagaattcggattgatcttgttcgtattctgtatcggtcttcaggtggggccatcattcttctcttctttcaaaaaggggggaatgacattgaacctgttggctgtaggcatcgtagtgttaaatattgctgttgcattggggctttattacctctggaacggtcgtgtggaactgccgatgatggtaggtatcctctacggagctgtgacgaacactccgggacttggtgccgccaatgaggccctgaaccagttgagctacaacggaccgcagattgcactgggttatgcctgtgcgtatccgctgggtgtggtaggtatcatcggttctatcatagctatccgttacatcttccgcgtcaatatgaccaaagaggaagagagcctgaaaactcagagcggagacgcgcaccacaagccgcacatgatgagccttgaggtacgcaatgagtctatcagcggaaaaacactgattgaaatcaaagaatttctgggacgcaactttgtttgctcccgtatccgtcacgaaggacacgtaagtattccgaaccacgaaacgatattcaatatgggcgaccagttgtttattgtctgttcggaagaagatgctcccgccatcaccgtatttatcggaaaagaagtcgaactggactgggagaagcaggatcttccgatggtttcccgccgtattctggttactaaaccggaaattaacggaaaaacgctcggttccatgcacttccgtagtatgtatggtgtcaacgtgacccgtgtcaaccgttccggtatggacctgttcgctgatccgaacctgatattgcaggtaggtgaccgcgtaatggtagtaggtcagcaagatgcggtagagcgtgtagctggtgttttgggtaaccaactgaaacgtctggacacaccgaatatcgttactatcttcgtaggtatcttcttaggtattcttttaggaagtcttccgattgcattccccggtatgccgactcctttgaaattaggtttggccggtggtccgttggtggtagctatcctgatcggacgtttcggacacaaacttcatttggtgacttacaccacaatgagtgccaacctgatgctgcgcgaaatcggtattgtgctattccttgccagtgtaggtatagatgcgggtgccaactttgtgcaaacagttgtagaaggcgacggcttactgtatgtaggctgtggtttcctgatcactgtcatcccgttgcttatcatcggtgcaattgcaagactatattataaggtaaactacttcactctgatgggattgatagccggtagtaatacggaccctcccgcattggcttatgccaatcaggtgacatccagtgatgcaccggcagtaggatattctactgtttatccattatctatgttccttcgtatcctgacgggacagatgatattactggcgatgatgtaa

SEQ ID NO: 91476 - protein, 554 aa, Bacteroides thetaiotaomicron
MDWLQSLLWDPSSVAHIVFLYAFVVAAGVYLGKIKIFGVSLGVTFVLFAGILMGHFGFTADTHILHFIREFGLILFVFCIGLQVGPSFFSSFKKGGMTLNLLAVGIVVLNIAVALGLYYLWNGRVELPMMVGILYGAVTNTPGLGAANEALNQLSYNGPQIALGYACAYPLGVVGIIGSIIAIRYIFRVNMTKEEESLKTQSGDAHHKPHMMSLEVRNESISGKTLIEIKEFLGRNFVCSRIRHEGHVSIPNHETIFNMGDQLFIVCSEEDAPAITVFIGKEVELDWEKQDLPMVSRRILVTKPEINGKTLGSMHFRSMYGVNVTRVNRSGMDLFADPNLILQVGDRVMVVGQQDAVERVAGVLGNQLKRLDTPNIVTIFVGIFLGILLGSLPIAFPGMPTPLKLGLAGGPLVVAILIGRFGHKLHLVTYTTMSANLMLREIGIVLFLASVGIDAGANFVQTVVEGDGLLYVGCGFLITVIPLLIIGAIARLYYKVNYFTLMGLIAGSNTDPPALAYANQVTSSDAPAVGYSTVYPLSMFLRILTGQMILLAMM

SEQ ID NO: 91477 - DNA, 1629 bp, Corynebacterium efficiens
  CDS (1)..(1629): transl_table=11
gtgagcattttcgtggaaaatcagttgttggccctggtggccatcatgggtatcggtctgttgctcggccggatcaggttcttcgggttccggctcggggtggcggcggtgttgttcgtgggtctggccttctccaccatcgaaccggacatcacggtgcctcccctgatctacgtggtgggcctggccctgtttgtgtacaccatcgggctggaggccggccgtgacttcttcaggtcgctgcggtccaccggcctgcgtaacaacgggctggccctcggtgccatcatcgccaccaccgcgatcgcctgggtggtcatcaaggcgctgggcctggcacccgcgacgggtgccggcatgttgaccggtgcgctgaccaacaccccggcgatggcggcggtggtcgacgccctaccggcgcttatcgacgacaaccccaccgacgcagcacgcatcctggagctgcctgtggtggcctattccctcacctacccgctcggtgtcctggtggtgatcctcacgatcgcggtctgcgggggcctgttcaaggtcaaccatgagaaggaggcgaagaatgccggcgtggccgttcaggagctgacgggacgccgtgtccgggtcacccgggatgatctgcccgccatcagcaatatcccggaactgctggacctggaggtcatcgtctcccgtgtggagcgccgggggcagcatgaccagttcatccccgaggagggtgatcgcacccggttgggtgacattctcaccgtggtgggctccgatgatgagctcgagcgcgcggtgggtctgctcggcgaattcgtcgacggccatccatacagcgatatcgatctggattaccgcaggatcttcgtctctgatgaatccatggtcggtgtgcccttggcgaaactgcgcaaccgtattcccggcatgttgatcacccggatcaggcggggtgacaccgacctgattgcgcatccggatatgaccctccagctgggtgatctggtccgcgtggttgcccccgccgagcggatcaaggaggccacccacatcttcggtgactcctacaaacgcctcgctgatttcaatctggttcccctggtggtcggtctctccctcggggtgctggtgggcatgatggaattccccctgcccggtggaagcgccctgtccctgggcaatgccggtgggcccctgttgatcgcgctgctgctgggggcgatgggccgcaccggcaaggtggtctggcagatcccctacagtgccaacctcgccctccgacagctgggcatcaccatgtttctggcggccatcgggacgaccgcgggtgccgggttccggtccgcgctgagcgatccggcctccctgctgatcatcggggtgggtgccctgctgaccctggtgatctccgtgctggttcttgtcatcgggcacaaggtcatgcgtatccccttcggcgagaccgccggcatcctcgccggcacccagacccatcctgcggtgttgagctacatatcggaggcctcgcgcaatgaactgccggcgatgggttacacctccgtctatcccctcgccatggtggcgaagatcatcgccgcacaggtgctgttgttcctgctgatatag

SEQ ID NO: 91478 - protein, 542 aa, Corynebacterium efficiens
MSIFVENQLLALVAIMGIGLLLGRIRFFGFRLGVAAVLFVGLAFSTIEPDITVPPLIYVVGLALFVYTIGLEAGRDFFRSLRSTGLRNNGLALGAIIATTAIAWVVIKALGLAPATGAGMLTGALTNTPAMAAVVDALPALIDDNPTDAARILELPVVAYSLTYPLGVLVVILTIAVCGGLFKVNHEKEAKNAGVAVQELTGRRVRVTRDDLPAISNIPELLDLEVIVSRVERRGQHDQFIPEEGDRTRLGDILTVVGSDDELERAVGLLGEFVDGHPYSDIDLDYRRIFVSDESMVGVPLAKLRNRIPGMLITRIRRGDTDLIAHPDMTLQLGDLVRVVAPAERIKEATHIFGDSYKRLADFNLVPLVVGLSLGVLVGMMEFPLPGGSALSLGNAGGPLLIALLLGAMGRTGKVVWQIPYSANLALRQLGITMFLAAIGTTAGAGFRSALSDPASLLIIGVGALLTLVISVLVLVIGHKVMRIPFGETAGILAGTQTHPAVLSYISEASRNELPAMGYTSVYPLAMVAKIIAAQVLLFLLI

SEQ ID NO: 91479 - DNA, 1689 bp, Shewanella oneidensis
  CDS (1)..(1689): transl_table=11
atgaactggttaaaaacaacgttgcaaatttaccctgaaattgccgtctttctttctttggcaatcggatattgggttggcaacaaaacttttaaaggattttccttgggggcggtgacagcaacgcttttagctgctgtcgtcattggccagtttgatataacactttcatccaatgtaaaaagtatcttttttctgatgtttctttttgccgttggttatggaattggtccgcaatttgttcaaggcattgctaaagatggcttgccgcaagccttatttgcggtggttgcgtgtcttttttcgttattatttcctattctttgcgcaaaaatagcgggttatgatcttggggcgacggctggattttttgcgggcacacaaactatttctgcctcaatgggattggcgacagacgccattgtgcatctcgatttacccgccgaagagagtaagaaaatgttttctgtaatacctgttgcctatgccgttacctatatttttggcacggttggatccgcaattgttctcgcgcaaataatcccaaagcttctgcgtattgatttggaggctgcgtgtaaagattatatggcgaaaaatggtggaacaaccgaaaacgcacgcggagaatggcacacttacgcactgcgttcttataagcttactgagaaaaatcgggctgtcggtatgactatccatgaatttgaagcgcaatttcctcatcgcaaagtgtttgttgaaggacttaggcatgaaggcaaagtgattgataccgatccaaactcgaaactttcaacgggcgatattattgctgtcggtggcgagtatgatgcttttgttgagttctttgatcaccctgattcctttgatgaaacccaagatagtgagttgttgaatcaacctgtgctgggtgtcgacgtgtatgtcacatcgcgaggaattaacggaaagacattggcagaattaggaaaaacgacaagctcccatggcatttttttacgcaaaatcaagcgtggaccgaaagccattgaaattcccatcctgccacaaacccgtttattccgaggtgatatattaaccttgagtggattaaccaaagatgttgaacgagtcaccaaacagcttggcgttattgatcagcgtggaaactcgatggacgtggctttttgggcctttgctattgtcattggtgcgttactcggttccttggtgtttaaaattggaaacctgccattaaccttatcaactgcaggcggtgttttaattgcaggtttgatttttagctgggtgcgttcctttcatccgactttcggctgggtaccagaaccgacagtttggtttatgaactccgtcggtctcaatgtttttatcgctgcgataggtataagtgctgggccaaacttcgtggccggacttaaagagttaggttttagccttttcctctggggggtagtggcaaccaccttacctctgttttttgctgcgttagttggtaaatatgtttttaagtttcatcccgctattctgttagggtgctgtgccggggctagaacgactacagcatctttgggcatgattaacgaaaaggccaaaagcaatatcccaagtttaggttatacaatcacttatgctgtgggtaatactttactcacgatgtggggcctagtgttgatcctgatccttacctaa

SEQ ID NO: 91480 - protein, 562 aa, Shewanella oneidensis
MNWLKTTLQIYPEIAVFLSLAIGYWVGNKTFKGFSLGAVTATLLAAVVIGQFDITLSSNVKSIFFLMFLFAVGYGIGPQFVQGIAKDGLPQALFAVVACLFSLLFPILCAKIAGYDLGATAGFFAGTQTISASMGLATDAIVHLDLPAEESKKMFSVIPVAYAVTYIFGTVGSAIVLAQIIPKLLRIDLEAACKDYMAKNGGTTENARGEWHTYALRSYKLTEKNRAVGMTIHEFEAQFPHRKVFVEGLRHEGKVIDTDPNSKLSTGDIIAVGGEYDAFVEFFDHPDSFDETQDSELLNQPVLGVDVYVTSRGINGKTLAELGKTTSSHGIFLRKIKRGPKAIEIPILPQTRLFRGDILTLSGLTKDVERVTKQLGVIDQRGNSMDVAFWAFAIVIGALLGSLVFKIGNLPLTLSTAGGVLIAGLIFSWVRSFHPTFGWVPEPTVWFMNSVGLNVFIAAIGISAGPNFVAGLKELGFSLFLWGVVATTLPLFFAALVGKYVFKFHPAILLGCCAGARTTTASLGMINEKAKSNIPSLGYTITYAVGNTLLTMWGLVLILILT

SEQ ID NO: 91481 - DNA, 1659 bp, Photobacterium profundum
  CDS (1)..(1659): transl_table=11
atgagtgatattgcactatctatcagcatattagcgctggttgcggtgctgggcttatggattgggaattggcgtatttgtggtgttggattagggattggcggggtgctgtttggcggcatttttgttggtcactttactgactcatggggcgttgctctcgattcacataccctgcactttatacaagaattcgggttaatactgtttgtgtatacaattggtattcaagtaggacccggattctttgcttcactacgaagttccggtcttaaactcaacgcctttgctgcattggtcgttttactaggctgcattgttgctatcggtttgtataaaatatttgatgttccattacctgttattctcggtattttctcgggtgctgtcactaataccccgtcacttggtgctggtcagcagatactcactgaacttggtgcacaagaaggtatgcttgacctaacaggcatgggctatgctgttgcgtacccttttggtatttgtggaattttattaaccatgtggattttacgtctggcttttcgtgtcaatgttgacaaagaagcggaagagtttgaagttcagaacggtcataaaaaacaaaacttacacacccttaacgttgctattcgtaatcccaacttaaacggtttgcagcttaaagatgtaccagcattagctgagggtgacattgtttgttcacgcttaaaacgaggcgagaaattgcatgttccccgccctgatacgcgaattgaaacaaatgacttgctccacttagtcggcgctaaacacgccctcgaaaaagcacgattagtgattggtgaagttgtagatgcatcactatcaacccgaggtacagatctaagggttcagcgattagtggtaaccaatgaaatcgttttgggcaaaaaaattagccaccttgatctcaaagaaaaatatgacgttgtggtatcacgcttaaaccgagcaggtgttgaattagtaccgacaagccaaacgacattacaatttggtgatattttaaaccttgttgggcgccaagaagccatcgaatctgttagtggtattgtgggtaatgcccatcaaaaattacaacaggtacaaatgctgccagtatttgtgggtattggtttaggggttttattggggtcgattcctttctatttaccggggtttccagccgcaattaaacttggcttagcaggtggaccgttacttgtcgcactcatacttgctcgtataggcagtattggtaagttatattggtttatgccacccagtgctaacttggcattacgagaaatagggatagtgctatttcttgccgttgttgggttaaaatctggtggtggctttgttgatacactggtaaacggtgacggtttaagttggatgggctacggtattgttatcaccttagtgcctcttcttactgtcggctttttagcacgtattgtggggcagcttaattaccttactatctgtggcatgctggcgggttcgatgaccgatccaccagctcttgcttttgccaatggcttacatccaacaagtggggcttcagcgctatcgtacgcaacagtctatccattagtgatgtgtttacgaatattatcaccacaaatactcgccttattattatgggctgtttaa

SEQ ID NO: 91482 - protein, 552 aa, Photobacterium profundum
MSDIALSISILALVAVLGLWIGNWRICGVGLGIGGVLFGGIFVGHFTDSWGVALDSHTLHFIQEFGLILFVYTIGIQVGPGFFASLRSSGLKLNAFAALVVLLGCIVAIGLYKIFDVPLPVILGIFSGAVTNTPSLGAGQQILTELGAQEGMLDLTGMGYAVAYPFGICGILLTMWILRLAFRVNVDKEAEEFEVQNGHKKQNLHTLNVAIRNPNLNGLQLKDVPALAEGDIVCSRLKRGEKLHVPRPDTRIETNDLLHLVGAKHALEKARLVIGEVVDASLSTRGTDLRVQRLVVTNEIVLGKKISHLDLKEKYDVVVSRLNRAGVELVPTSQTTLQFGDILNLVGRQEAIESVSGIVGNAHQKLQQVQMLPVFVGIGLGVLLGSIPFYLPGFPAAIKLGLAGGPLLVALILARIGSIGKLYWFMPPSANLALREIGIVLFLAVVGLKSGGGFVDTLVNGDGLSWMGYGIVITLVPLLTVGFLARIVGQLNYLTICGMLAGSMTDPPALAFANGLHPTSGASALSYATVYPLVMCLRILSPQILALLLWAV

SEQ ID NO: 91483 - DNA, 1620 bp, Corynebacterium glutamicum
  CDS (1)..(1620): transl_table=11
gtgagcttccttgtagaaaatcaattactcgcgttggttgtcatcatgacggtcggactattgctcggccgcatcaaaattttcgggttccgtctcggcgtcgccgctgtactgtttgtaggtctagcgctatccaccattgagccggatatttccgtcccatccctcatttacgtggttggactgtcgctttttgtctacacgatcggtctggaagccggccctggattcttcacctccatgaaaaccactggtctgcgcaacaacgcactgaccttgggcgccatcatcgccaccacggcactcgcatgggcactcatcacagttttgaacatcgatgccgcctccggcgccggcatgctcaccggcgcgctcaccaacaccccagccatggccgcagttgttgacgcacttccttcgcttatcgacgacaccggccagcttcacctcatcgccgagctgcccgtcgtcgcatattccttggcataccccctcggtgtgctcatcgttattctctccatcgccatcttcagctctgtgttcaaagtcgaccacaacaaagaagccgaagaagcgggcgttgcggtccaggaactcaaaggccgtcgcatccgcgtcaccgtcgctgatcttccagccctggagaacatcccagagctgctcaacctccacgtcattgtgtcccgagtggaacgagacggtgagcaattcatcccgctttatggcgaacacgcacgcatcggcgatgtcttaacagtggtgggtgccgatgaagaactcaaccgcgcggaaaaagccatcggtgaactcattgacggcgacccctacagcaatgtggaacttgattaccgacgcatcttcgtctcaaacacagcagtcgtgggcactcccctatccaagctccagccactgtttaaagacatgctgatcacccgcatcaggcgcggcgacacagatttggtggcctcctccgacatgactttgcagctcggtgaccgtgtccgcgttgtcgcaccagcagaaaaactccgcgaagcaacccaattgctcggcgattcctacaagaaactctccgatttcaacctgctcccactcgctgccggcctcatgatcggtgtgcttgtcggcatggtggagttcccactaccaggtggaagctccctgaaactgggtaacgcaggtggaccgctagttgttgcgctgctgctcggcatgatcaatcgcacaggcaagttcgtctggcaaatcccctacggagcaaaccttgcccttcgccaactgggcatcacactatttttggctgccatcggtacctcagcgggcgcaggatttcgatcagcgatcagcgacccccaatcactcaccatcatcggcttcggtgcgctgctcactttgttcatctccatcacggtgctgttcgttggccacaaactgatgaaaatccccttcggtgaaaccgctggcatcctcgccggtacgcaaacccaccctgctgtgctgagttatgtgtcagatgcctcccgcaacgagctccctgccatgggttatacctctgtgtatccgctggcgatgatcgcaaagatcctggccgcccaaacgttgttgttcctacttatctag

SEQ ID NO: 91484 - protein, 539 aa, Corynebacterium glutamicum
MSFLVENQLLALVVIMTVGLLLGRIKIFGFRLGVAAVLFVGLALSTIEPDISVPSLIYVVGLSLFVYTIGLEAGPGFFTSMKTTGLRNNALTLGAIIATTALAWALITVLNIDAASGAGMLTGALTNTPAMAAVVDALPSLIDDTGQLHLIAELPVVAYSLAYPLGVLIVILSIAIFSSVFKVDHNKEAEEAGVAVQELKGRRIRVTVADLPALENIPELLNLHVIVSRVERDGEQFIPLYGEHARIGDVLTVVGADEELNRAEKAIGELIDGDPYSNVELDYRRIFVSNTAVVGTPLSKLQPLFKDMLITRIRRGDTDLVASSDMTLQLGDRVRVVAPAEKLREATQLLGDSYKKLSDFNLLPLAAGLMIGVLVGMVEFPLPGGSSLKLGNAGGPLVVALLLGMINRTGKFVWQIPYGANLALRQLGITLFLAAIGTSAGAGFRSAISDPQSLTIIGFGALLTLFISITVLFVGHKLMKIPFGETAGILAGTQTHPAVLSYVSDASRNELPAMGYTSVYPLAMIAKILAAQTLLFLLI

SEQ ID NO: 91485 - DNA, 1683 bp, Photobacterium profundum
  CDS (1)..(1683)
atgaatatcgatgtagcatcccttctccatcagaatgatatcctgttgctttttgttgttctcgctgttggtctaagttttggtaaaattcgttttgctaagatgcaagtaggcaattctattggtgttttactgactgccatactgttcggtaatgccgggtttacctttaatactgaagcattaaatattggctttatgctgtttattttttgtgtgggtatagaggctggccccaacttttttggtattttcttccgagatggtaaacattaccttttactcgcccttgttgtgctgctttccgccatagctatcactttagccatgactcattatcttgggcttgatataggtttagcgacaggcttaatggctggttcattgacagcaacacctgttcttgtaggtgcaaaagacgcattgaattccggattatctggcattagcgatcctgatatcattaaacaaaccattgatagcctaagcgttggctatgctatgtcttatttaatgggcttaatcagtcttatttttctcgctaaactaatgcctaaattacagaaacaagacctggctgaatcgtcgcaacaaattgcccgtgaacgcggtattggtgaagtggggcaacgtaaagtatatttgccaatcattcgcgcttaccgtgttggccctgagcttattaactggattgatagtcgtaacttacgtgagttgggcatctaccgccaaacaggctgctacatcgaacgtatacggcgaaacggtatattagctaacccagatggtgatgctattttacaagaaggtgatgagattgccttagtgggttacccagacagccatgcacgtttggatcccagctttcgaaacggcaaagaagttttcgaccgtgatcttctcgaccttcgtattgttgaagaagagattgtagttaagaatgacaacatctctggcaaacgcctatctgagctaaatttatcagaatacggttgtttcttgaaccgtgttgttcgcgcacaaatagaaatgccgatggaccataatattcttttgaataaaggggatattttgcaagtcagtggagaaaaaagtcgagtacttggtcttgctgaacgtattggttttatctcgattcacagtcaaattgccgatctattagcattctgctgtttttttatcatcgggttacttatcggttcgattacattagcatttggtcacgttgcatttggtttaggtagtgctgcagggcttctgattgccggtattacattaggattcctacgtgctaaccaccctacttttggctatgtaccccaaggtgcgcttaatatggcgaaagatcttggcttaatggtcttcatggtaggaattggtttgagtgcgggttctaatttattcgattcatttgcacatattggccctatggtcttagtcaccagcttaatggtgagtgtgatccctgttgtattggcatacctgtttggtgcttacgtactgaagatgaaccgtgcacttttatttggtgccatcattggtgctcgaacttgtgcacctgcgatggatatgatcaatgaacatgctcgaagcacaattccagctttaggctatgctggtacttatgccattgccaacgtactgttaacgattgccggtacgttaatcatcatcatgaattaa

SEQ ID NO: 91486 - protein, 560 aa, Photobacterium profundum
MNIDVASLLHQNDILLLFVVLAVGLSFGKIRFAKMQVGNSIGVLLTAILFGNAGFTFNTEALNIGFMLFIFCVGIEAGPNFFGIFFRDGKHYLLLALVVLLSAIAITLAMTHYLGLDIGLATGLMAGSLTATPVLVGAKDALNSGLSGISDPDIIKQTIDSLSVGYAMSYLMGLISLIFLAKLMPKLQKQDLAESSQQIARERGIGEVGQRKVYLPIIRAYRVGPELINWIDSRNLRELGIYRQTGCYIERIRRNGILANPDGDAILQEGDEIALVGYPDSHARLDPSFRNGKEVFDRDLLDLRIVEEEIVVKNDNISGKRLSELNLSEYGCFLNRVVRAQIEMPMDHNILLNKGDILQVSGEKSRVLGLAERIGFISIHSQIADLLAFCCFFIIGLLIGSITLAFGHVAFGLGSAAGLLIAGITLGFLRANHPTFGYVPQGALNMAKDLGLMVFMVGIGLSAGSNLFDSFAHIGPMVLVTSLMVSVIPVVLAYLFGAYVLKMNRALLFGAIIGARTCAPAMDMINEHARSTIPALGYAGTYAIANVLLTIAGTLIIIMN

SEQ ID NO: 91487 - DNA, 1689 bp, Bacteroides fragilis
  CDS (1)..(1689): transl_table=11
atggaacttttaagaaacctgtttgagggataccccaacctttggggtggaggagtggcacattccgtgcttatcctgtcgctggtcattgcgtttggcattatgctgggtaaaataaaagtagcaggcatctctctgggagttacctggattttgtttgtcggcattgtcttcggacattttaatctgaatctgaacgagcatttattgcactttctgaaggagttcggacttatcttatttgtatattccatcggattgcaggtggggcccggattcttctccgcttttaagaaaggaggattcaccctcaatatgttggctatgatcgttgtctttgcaggagtcatcattacccttgcattgcattttataaccggaataccgattaccaccatggtaggtattttatcgggagcggtgaccaacacacccggattgggtgctgcgcaacaggccaacagtgacctgaccgggatagatgcaccggagattgctttgggatatgctgtagcctatccgttgggcgtagtgggatgcatcatgtcgctgttaggccttaaataccttttccgtattaataccaagcaggaggaagccgaagccgaacagggactgggacatttacaagagttgacagtacgtcctgtttcattggaggtccgtaatgaagctcttcacggtaaacgtattaaggatatacgtccattggtaaaccgtaattttgtggtatcgcgtatccggcatttgaatggaaagaaagagtcggaattggtaaattccgatactgagcttcatctgggtgatgaaatattggttattgcgactccgatagatatagaggcgatcactgcgtttttcggcaaaccgatcgaagtggaatgggaacagctgaacaaagaactgatttcacgccgaattctgataaccaagcccgaactgaacggtaagacattggcgcaattgaagattcgtaataattttggtgccagtgtcacccgcgtcaaccgttcgggagtggatctggtggcaagtccccagttgcaattacaaatgggagaccgtgtgacgattgtcggcagtgagttggcggtgagtcatgcagaaaaggtattgggtaattcgatgaaacgcctgaatcatccgaatctgattcctatttttctgggtattgccttgggatgtatcctgggtagcatcccgtttatgtttcccggaattccccaaccggttaaactcgggttggcaggaggcccgttgattgtttcgattcttatcagccgtttcggcccgcagtataagctgattacttataccactatgagtgccaatctgatgataagggaaatcggcatctcgctgtttcttgcttgtgtcggtctcggagctggcgacggatttgtggaaaccattatccatgaaggcggatatgtgtggatcgcttacggtatgattataacaatcgttcccctgctgctggccggttttatcggacgttatgctttcaagctgaactattatacgttgataggggtgttggccggttccacaacgaatccgccggcgttggcctactccaatgatctgacatcgtgtgatgcgccggcagtaggttatgctacagtctatccgctgacgatgttcctgcgtgtgcttacggcacaattattaattctttcgttaggttga

SEQ ID NO: 91488 - protein, 562 aa, Bacteroides fragilis
MELLRNLFEGYPNLWGGGVAHSVLILSLVIAFGIMLGKIKVAGISLGVTWILFVGIVFGHFNLNLNEHLLHFLKEFGLILFVYSIGLQVGPGFFSAFKKGGFTLNMLAMIVVFAGVIITLALHFITGIPITTMVGILSGAVTNTPGLGAAQQANSDLTGIDAPEIALGYAVAYPLGVVGCIMSLLGLKYLFRINTKQEEAEAEQGLGHLQELTVRPVSLEVRNEALHGKRIKDIRPLVNRNFVVSRIRHLNGKKESELVNSDTELHLGDEILVIATPIDIEAITAFFGKPIEVEWEQLNKELISRRILITKPELNGKTLAQLKIRNNFGASVTRVNRSGVDLVASPQLQLQMGDRVTIVGSELAVSHAEKVLGNSMKRLNHPNLIPIFLGIALGCILGSIPFMFPGIPQPVKLGLAGGPLIVSILISRFGPQYKLITYTTMSANLMIREIGISLFLACVGLGAGDGFVETIIHEGGYVWIAYGMIITIVPLLLAGFIGRYAFKLNYYTLIGVLAGSTTNPPALAYSNDLTSCDAPAVGYATVYPLTMFLRVLTAQLLILSLG

SEQ ID NO: 91489 - DNA, 1689 bp, Erwinia carotovora
  CDS (1)..(1689): transl_table=11
atgaatataaacgtcgctgatttgttaaacgggaattacattctgcttttattcgtggttctttcattaggactctgtctggggaaattgcgcctcgggccagtacaactcggtaattctattggcgttttagtggtttctttattactcggccaacaacatttttcgattaataccgaagcactgagcctcggttttatgttatttattttttgcgtgggagtagaagccgggccgaatttcttttctattttcttccgcgacgggaaaaattatttcatgctggcgctggtgatggtcggcagcgccatgttactggcgttagggttaggcaaacttttcggctggggaatcggcctgaccgcggggatgctggcaggatccatgacatcgacaccggtgctggtcggtgcaggcgacacactacgcaataccgccagtttgggtggtcaactcggtgttgaacaagatcatttgagcctgggctatgcgctgacgtatctggtcgggctggtcagtctcatttttggtgcacgctatctgcccaaacttcagcatcaggatcttcccaccagtgcgcagcaaattgcacgcgagcgcgggctggatgtagacagccaaagaaaagtgtatctgccagtgattcgtgcctatcgcgtcgggccagagttggttgactgggcggctggcaaaaacttgcgcgaactgggaatctatcgccagaccggttgctacatcgagcgcattcgacgcaacggaattctggcaaatcccgacggggatgccgtcttgcaaatcggcgacgagatcgcgctggtcggttatcccgatgcacactctcgtctgaactccaatttccgcgatggcaaagaagttttcgaccgtaatttgttggacatgcgcatcgtgacggaagagattgtcgtcaagaatcacaacgccgtcggtaagcgcctcagccaattgaagctgactgaccacggctgtttccttaaccgtattgttcgcagccagatagaaatgccgctcgacgataacgtcgtgctgaataaaggcgatgtcttacaggtcagcggtgacgcccgtcgggtaaaaagcattgctgagcgaatcgggttcatttctattcacagtcaggtcaccgatttactggccttctgcgccttttttgttatcggcgtgatggtcgggctgatcaccatccagttcagcaacttcacctttggcatcggtaacgcggctgggttgctcttcgccggtatcatgctgggcttcctgcgcgccaaccacccgaccttcggctatattccgcaaggcgcgcttaacatggtcaaagagtttggcctgatggtctttatggcgggcgtaggactgagtgccggtagcaccatcaacagtagcctaggagaagtcggtatccagatgctggcttcagggctgattgtcagtctcgtgccagtggtgatttgttttctgttcggcgcgtatgtgctgaaaatgaatcgagcgctgctgtttggtgccatgatgggcgctcggacctgcgcgccagccatggagatcatcagcgataccgctcgcagtaatattcctgctctcggctatgcgggtacctacgccatcgctaacgttctgctcacattagcaggttcacttatcgtggttatctggcctgaattgcccggctga

SEQ ID NO: 91490 - protein, 562 aa, Erwinia carotovora
MNINVADLLNGNYILLLFVVLSLGLCLGKLRLGPVQLGNSIGVLVVSLLLGQQHFSINTEALSLGFMLFIFCVGVEAGPNFFSIFFRDGKNYFMLALVMVGSAMLLALGLGKLFGWGIGLTAGMLAGSMTSTPVLVGAGDTLRNTASLGGQLGVEQDHLSLGYALTYLVGLVSLIFGARYLPKLQHQDLPTSAQQIARERGLDVDSQRKVYLPVIRAYRVGPELVDWAAGKNLRELGIYRQTGCYIERIRRNGILANPDGDAVLQIGDEIALVGYPDAHSRLNSNFRDGKEVFDRNLLDMRIVTEEIVVKNHNAVGKRLSQLKLTDHGCFLNRIVRSQIEMPLDDNVVLNKGDVLQVSGDARRVKSIAERIGFISIHSQVTDLLAFCAFFVIGVMVGLITIQFSNFTFGIGNAAGLLFAGIMLGFLRANHPTFGYIPQGALNMVKEFGLMVFMAGVGLSAGSTINSSLGEVGIQMLASGLIVSLVPVVICFLFGAYVLKMNRALLFGAMMGARTCAPAMEIISDTARSNIPALGYAGTYAIANVLLTLAGSLIVVIWPELPG

SEQ ID NO: 91491 - DNA, 1551 bp, Bradyrhizobium japonicum
  CDS (1)..(1551): transl_table=11
atgctgacttggctggaacagtttctcatccgctatccggagctcgcgctgttcctggtgatcgccgcgggctactggatcggaagcttcaagatcggcgccttcagtctgggcccggtcacaggcgcgttgttcgctggcctcgtggtcggcgacttcgcgcatgtgcctgtttccagcatgaccaaatccttcctgtttctgctgtttctgttcggcgtcggctattccgtcggtccgcaattcgtgcaggcgatgaagcgcgacgggctgaagccggtgctgctcgccgtcgtcgtgtgcctcaccggccttgcggccgcaatcgccgtgggcaggatactcgggctcgatcccggctttgcggcagggctgatgtcggggtcgctcagccaaagcgcggcgatggggacggcgaccgacgcggtcaacggcctcgccgtgcccgaggcgcagcgcgccctctatatctcgcacatcgcggtagccgatgcggtctgctacatctttggctatgcaggcgtgatcatgtggtgcacggtggtcgcaccggcactcctgaagatcgacctgcgggacgaggcgctcaagctcgagcggtcgctggggatgagccgcgccaagcccggtctggcatccgcgtggcgaaagttcgagctgcgcgcctatcgcctcgacgagcactctcccctcatcggatcgacagttgcggccgccgaggctcgcccggagcatcgcctgttcatccatcggatccgccgtggagaacgcgtactccaagcggagcccggcaccatcctcgcgcccggcgacgtcatcacgatatcggcgccgcgccagatcatcgtggagctgatcggctcccgcgccgaggaggtcgaagacagggaactgctcgacattcccttgatctccgctgacgtgttcctgatcaacgccaagctcgcgggcatgaacctgcaagaggcctcgcagcaggactggacacacggcctctatctgcgctcgttgagccggggcggccaggaacttccgattgctcccggcgtcgtcctccagcgtggcgacctgctgcgcatcgtcggccccgaaccggttgtcgagaacgcggcgaagaatatcggcgtcatcgttgcgcccagcaacagcatcgatttcgtggtgctggggcttgcgatcttcttcggcggcgttgttggcgttctcgtgagctttcccgtcggcagcatcaagatcgcactgagcacgagcgtcgggacgctgcttgccgggcttctggtcggtcacctccgcacgctcgatccgcgcttcggacgaatcccggacggcgccatcagcctgatgacgtcgctcggactggccgcgttcgtcgggctcaccgggatccatgccgggccgatcttcctctccgccctgcgagactccggcatcagcctgctgctcggcggcatggtggtgaccctgctgccacagatcgtcggattctgcttcggtcattttgtcttgcgcatgaatccaatccttctgctcggcggtttgaccggggcgtag

SEQ ID NO: 91492 - protein, 516 aa, Bradyrhizobium japonicum
MLTWLEQFLIRYPELALFLVIAAGYWIGSFKIGAFSLGPVTGALFAGLVVGDFAHVPVSSMTKSFLFLLFLFGVGYSVGPQFVQAMKRDGLKPVLLAVVVCLTGLAAAIAVGRILGLDPGFAAGLMSGSLSQSAAMGTATDAVNGLAVPEAQRALYISHIAVADAVCYIFGYAGVIMWCTVVAPALLKIDLRDEALKLERSLGMSRAKPGLASAWRKFELRAYRLDEHSPLIGSTVAAAEARPEHRLFIHRIRRGERVLQAEPGTILAPGDVITISAPRQIIVELIGSRAEEVEDRELLDIPLISADVFLINAKLAGMNLQEASQQDWTHGLYLRSLSRGGQELPIAPGVVLQRGDLLRIVGPEPVVENAAKNIGVIVAPSNSIDFVVLGLAIFFGGVVGVLVSFPVGSIKIALSTSVGTLLAGLLVGHLRTLDPRFGRIPDGAISLMTSLGLAAFVGLTGIHAGPIFLSALRDSGISLLLGGMVVTLLPQIVGFCFGHFVLRMNPILLLGGLTGA

SEQ ID NO: 91493 - DNA, 1704 bp, Bradyrhizobium japonicum
  CDS (1)..(1704): transl_table=11
atgggtgacatcatgattgactggttctttcatacgctcaaaagctatccggaaatcgcgatcttcctgtccttggccttgggctactatttcggctccttcacctacaagggcctgggactgggggccgtcaccgcgacgctgattgccgctgttatcatcggccagatcgggatcacgattacaggcccgctcaagccgttcttcttcctgatgttcctgtttgccatcggctacggagtcgggccgcaattcgtgcgcggcatcgcgcaggacggcgttcctcaggcgatcttcgccgccgtcgtgtgcgtgttctgccttctcgccccgtatgtcgcggcgaagattgccggttacgatgtcggttcggccgcgggactttatgccggctcccagacgatttcggcgtccatgggtctcgccaccgacgccatcaaccggctcgggctgtcgccggaagagacgaagaaaatcctcgacgggatgcccgtcgcctacgccgtcacctatatcttcggcaccgtcggatccgcgatcgttctcgctctgcttggcccggccctgctcggcatcgatctcgaggcggcgtgcaaaagatatgaggaggagtacggcggcaagaagcagttgggcggcccaggcaccgcgtggcaccagttcgacgtccgtgcatttcgcgttcgcgagcgcgggccggcggtggggaagacggtgcaggaggccgaagcgctgatcccggatcaacgggtgttcatcctgcggctgcgacaggaggggaagatcgtcgatgccacctccgatgccgtgattcacgccggcgacgtcgtggcggtggcaggccggcgcgacgtgctggtccagctcatcggcgaacaggcggaggaagtcgacgatcgcgagctgctcgcgatgccgatcgaaggcgtcgatgtctacgtgaccagcaaggacgtcgacagcaagacgctcgagcagctggcgaaggccccggcggcgcgcggcgtgttcctgcgcaagatcacgaggggcgcgatcgcggtcgagatccccatccttcccaacaccaagctgaatcggggcgacatcgtcaccattgttggacgcacgcccgatgtcgcagccgcgacaaagatgcttggccggccggatcgggcaaccgatatggccgacgttgccttcatcggcgctgctattgccatcggcgcgttggtcggcgcgatcgtttacaagatcggtagcgtgccgctgacgctatccacctccggcggagcgctgatctcgggcctgttcttcggctggctgcggtcggtgcggccgaccttcggccggattccctcgccgactgtctggttcatgaactccgtcggcctgaacgttttcattgccatagttggtatctcatcgggaccgggcttcgttgccggcctgaaggcgctcggcttcggcctgttcctgtggggcgtcgtggcgacgaccgcgccgctgatcctcgcaatgtatgtcggcaaatacgtgttccgcttccatgacgccatcgtgcttggatgctgttccggtgcgcggaccacgactgcctcgctcggtatggtcaacgatcgcgccaagagccagattccgggtcttggctataccgtcacctacgcggtcggaaacacgctgctgacgatctggggcatggtgctcgtcatgctgatgacgtag

SEQ ID NO: 91494 - protein, 567 aa, Bradyrhizobium japonicum
MGDIMIDWFFHTLKSYPEIAIFLSLALGYYFGSFTYKGLGLGAVTATLIAAVIIGQIGITITGPLKPFFFLMFLFAIGYGVGPQFVRGIAQDGVPQAIFAAVVCVFCLLAPYVAAKIAGYDVGSAAGLYAGSQTISASMGLATDAINRLGLSPEETKKILDGMPVAYAVTYIFGTVGSAIVLALLGPALLGIDLEAACKRYEEEYGGKKQLGGPGTAWHQFDVRAFRVRERGPAVGKTVQEAEALIPDQRVFILRLRQEGKIVDATSDAVIHAGDVVAVAGRRDVLVQLIGEQAEEVDDRELLAMPIEGVDVYVTSKDVDSKTLEQLAKAPAARGVFLRKITRGAIAVEIPILPNTKLNRGDIVTIVGRTPDVAAATKMLGRPDRATDMADVAFIGAAIAIGALVGAIVYKIGSVPLTLSTSGGALISGLFFGWLRSVRPTFGRIPSPTVWFMNSVGLNVFIAIVGISSGPGFVAGLKALGFGLFLWGVVATTAPLILAMYVGKYVFRFHDAIVLGCCSGARTTTASLGMVNDRAKSQIPGLGYTVTYAVGNTLLTIWGMVLVMLMT

SEQ ID NO: 91495 - DNA, 1665 bp, Bacteroides fragilis
  CDS (1)..(1665): transl_table=11
atggattggttacaagatttattatggaaccccaactccgtagcccacatcgtcttcctctacgctttcgtagtggcggcaggtgtctatttgggaaagatcaagatcttcggagtctctttaggggttacctttgttttgtttgccggcatcctaatgggacattttggcttcacaggcgatacccatatcctacatttcatccgcgaattcggattgatattgttcgtattctgtatcggtcttcaggtggggccttctttcttctcttcatttaagaaaggcggaatgaccctaaacatgctggccgtaggaattgtggtattgaacattgccgtagcaatggcgctctatttcattctgggaggcagaatcgagctccccatgatggtaggtatcctgtacggcgcagtcacaaacaccccgggactcggtgccgcacaagaagcactgaatcaattgagttattccggcccgcagatcgcattaggttatgcctgtgcttatccgttaggagtagtaggtatcataggctctatcatcgcagtgcgttacatcttccgcatcaacttcgccaaagaagaagagaactggaatcaagagactgacggcactcaccacaagccacaccttatgagtctggaagtacacaacgaagccatctacggaaaaaccctgggcacaatcagcagcttcctcggacgtccgtttgtttgttcgcgcatccgtaaaaacgggcacgtcagcattccaaaccacggcactatcctagaacagaatgaccagttatttgtggtatgttcagaagaagattcagatgccattgtagcctttatcggacgcgaagtgcaagtagactgggagaaacaggatatgccgatggtatcacgtcgtatcttggtaaccaaaccggaaataaacggaaagaagctcggtatgctgaacttccgcagcatgtataatgtcaacattacccgtgtcaaccgttcgggtgtcgacctgtttgctaaccccaacctgatactgcaagtgggtgaccgtgtcatggtagtaggctccgaagacgctgtagaacgggtagccagcgtacttggtaactctttgaaacgcctcaacgaaccgaacattatcacattgtttgtgggcatcttcctgggtatcctgtgcggtagtcttcccattgcatttccgggtatgccgactcctgtcaagctcggccttgccggcggaccgctggtggtagccattctgataggacgtttcggacacaaactacatctggtaacttatacaactcaaagcgccaacctgatgatacgtgaaatcggtatcgttctcttccttgccagtgtaggtatcgaagccggagcaaatttcgtggatacggtaatccatggagatggtctgctttatgtaggttgcggtttcctgatcacgattattcctttgctgataatcggggtcatagcacgttcgtattataaaatcaattacttcatgctgatgggattgatcgcgggtagcaataccgaccctcccgcattggcctattccaatcaggcaaccggtagcgacgcaccggcagtaggttattctaccgtatatccgctatcgatgtttctccgtatccttgcgggacaaatgatattgttgctaatgatgtga

SEQ ID NO: 91496 - protein, 554 aa, Bacteroides fragilis
MDWLQDLLWNPNSVAHIVFLYAFVVAAGVYLGKIKIFGVSLGVTFVLFAGILMGHFGFTGDTHILHFIREFGLILFVFCIGLQVGPSFFSSFKKGGMTLNMLAVGIVVLNIAVAMALYFILGGRIELPMMVGILYGAVTNTPGLGAAQEALNQLSYSGPQIALGYACAYPLGVVGIIGSIIAVRYIFRINFAKEEENWNQETDGTHHKPHLMSLEVHNEAIYGKTLGTISSFLGRPFVCSRIRKNGHVSIPNHGTILEQNDQLFVVCSEEDSDAIVAFIGREVQVDWEKQDMPMVSRRILVTKPEINGKKLGMLNFRSMYNVNITRVNRSGVDLFANPNLILQVGDRVMVVGSEDAVERVASVLGNSLKRLNEPNIITLFVGIFLGILCGSLPIAFPGMPTPVKLGLAGGPLVVAILIGRFGHKLHLVTYTTQSANLMIREIGIVLFLASVGIEAGANFVDTVIHGDGLLYVGCGFLITIIPLLIIGVIARSYYKINYFMLMGLIAGSNTDPPALAYSNQATGSDAPAVGYSTVYPLSMFLRILAGQMILLLMM

SEQ ID NO: 91497 - DNA, 2010 bp, Desulfotalea psychrophila
  CDS (1)..(2010): transl_table=11
gtgaagagttctctggcagttttaagcacagctaggagcgacacaaccacaacctacatagggagaaaccaaatgattgcccccatggcatttcaagcaaaaaggtccacttttctctgcccgctattagtagccttggccatactcttcagcctgacagcggtctcctccggcacatcctgggccaaggaccatgctggcagctctcaggctactgtctcggctgttgctggcgataatcaggcggtgaccgccaagggcgaagtaaaaaactcctttgctccaattaaaacctgctttaactttcttaaagaacagccatttgtctttatcctcctcgccctggccatcggctaccccctgggcaagatatcgctctggggcatatccctcgggccaacagcggggacattactggtgggagtgctcatctccatcatcggccaaaatatcttcgggattatctatggcatccccagcattgtctccaccatctttctcctcatgtttatgtacgcccttggccttaaggttggtcctcaatttttttcaggcctcaagacaggtggtctggccttcattgtcatagggctgattgtctggtcactgaactggctcatctgttttttcggggttaaactagcaggtctggaagccggctttgcccccggcattatctccggcagctacaccattaccgccatcattggcgtggcccaaacagcacttaccaacggtgcctacaccccgccaccgggagtaagcacagaacagattggggcaaacattgcggctggctatgccataagctacgtcctctccaatatcggtatcatcctccttatccgctacctgccccaaatatttggccatgaccccatagccgatgcccaactagctgaaaaagagctgagtggcggagcaacagaccccgttcccggagccgcaggctctctctctttaggtttttcccactttgatcttcgcgcctacgaggtcgaccaccaagagatcatcggcaaaactgtccaggaattttttcacctctatcctgaggcacccatcctccgggttgtccgtcagggcaagctactcaacttgtccgaaaacaatcccataaagaggggagatattgtctccgttcgagccgatgtgcacgagctcatagccgatggtaaaaaactgataggaaaggagagcgacagtattctggcaagagatgtccccatagaggttgccgatatccatattggtagccgcgatgttgccggagataccctggcagagcttggccgatccattggttttggcctacagctcaaggccctctttcgatttggccaagagcttcccctcctcgcaggcacagctgttcaggtaggtgatgtgttgagatttgtcggtccggatttctgtatccaacaggcagcaaaaagactcggtggcagaccaatccttaacagttcaattaccgaggtcatgtatatggccatcgccatgggcataggctatatttttggtagcctcagcttcaacttcgcaggtatcccctttgcccttggcacctctgccggttgcctgcttgccggtatctttatgagttactggcgaagccgtaaccctgaatttggtggccccatgagtgaaggtgcccgcagtttcttgcaggacatcggcctcaacctctttgttgcagtactcgcagccgctgttggccctaagataatcgaatccttccacgggaccacggcaatatgggtcgcaatcatcggtatcctgggagcgctagtgccccctctggttgcctttgtcgtgggaatcaaggtcttcaagctcaacagcgttgtggcagccggggccagtaccggggcccgcaactcaaccccggggctcaatgccatctgcgaacagtcccaaagtgctgtggcggcggttccctatcccctcacctatgccctgacaacagttctcgctctggttggtggctatttcgccatgctcctctcctaa

SEQ ID NO: 91498 - protein, 669 aa, Desulfotalea psychrophila
MKSSLAVLSTARSDTTTTYIGRNQMIAPMAFQAKRSTFLCPLLVALAILFSLTAVSSGTSWAKDHAGSSQATVSAVAGDNQAVTAKGEVKNSFAPIKTCFNFLKEQPFVFILLALAIGYPLGKISLWGISLGPTAGTLLVGVLISIIGQNIFGIIYGIPSIVSTIFLLMFMYALGLKVGPQFFSGLKTGGLAFIVIGLIVWSLNWLICFFGVKLAGLEAGFAPGIISGSYTITAIIGVAQTALTNGAYTPPPGVSTEQIGANIAAGYAISYVLSNIGIILLIRYLPQIFGHDPIADAQLAEKELSGGATDPVPGAAGSLSLGFSHFDLRAYEVDHQEIIGKTVQEFFHLYPEAPILRVVRQGKLLNLSENNPIKRGDIVSVRADVHELIADGKKLIGKESDSILARDVPIEVADIHIGSRDVAGDTLAELGRSIGFGLQLKALFRFGQELPLLAGTAVQVGDVLRFVGPDFCIQQAAKRLGGRPILNSSITEVMYMAIAMGIGYIFGSLSFNFAGIPFALGTSAGCLLAGIFMSYWRSRNPEFGGPMSEGARSFLQDIGLNLFVAVLAAAVGPKIIESFHGTTAIWVAIIGILGALVPPLVAFVVGIKVFKLNSVVAAGASTGARNSTPGLNAICEQSQSAVAAVPYPLTYALTTVLALVGGYFAMLLS

SEQ ID NO: 91499 - DNA, 1659 bp, Yersinia pseudotuberculosis
  CDS (1)..(1659): transl_table=11
atgagtgctatcgcccttaccgtcagtatgttggcgctggtcgccgtattggggttatggatcggtaattggaaaatctatggtgtggggttaggtatcggtggggtgctatttggcggcattattgtgggccattttgcacaaacttatcagatcgttcttaacggagatatgctgcattttattcaagagttcggcctgattctgtttgtgtataccatcggtattcaagttgggccggggttcttctcttcactacgggtatcggggttgcggcttaactgcttcgccatcttgatggtggttgtgggcgggttagtaaccgcgattattcataagctgtttgctgtgccgctgccgattattctgggggtgttttcaggtgcggtaaccaatacaccggcacttggtgcggctcagcaaattctcaccgatttaggttcgccgccacaactggtcagtcaaatggggatgggttacgccatggcgtatccatttggtatttgtggcattttactggtgatgtggctgattcgtttattctttaaaatcaatatcgatcgtgaagcgaaagcgtttgatagcagctatgggcaaaaccgcgagttgctgcaaaccatgaacgttgcggtgcgtaaccccaatctacatggtttatcggtacaggatgtgccattgctgaacagcgatgaggtggtctgttcacgattgaagcgtggcgatttactgatggtgcccatgcccgccacggtgattgaaattggggattatctgcatttggtcgggcaacgggatgcgctggagaaagtgcggctggttgtgggtgaagaggtcgatgtgacattatccacggcaggaacggcgttgcaaacggctcgagtggtagtgaccaacgaggcggtattgggtaaaaaaatccgcgatcttaatctaaaacagaagtatgacgtggtgattactcgtcttaatcgcgcgggtatcgagctggtcgccagcaacagtgccaacttgcaattcggcgatatcctgaatttagtgggccgtcctgaagctatcgaagcggtgtccgcgattgtggggaacgcgcagcaaaaattgcaacaggtgcagatgttaccggtatttatcggtgtcggtctcggggttttactggggtcgataccgctgtttgttccagggtttccggcggcattacgtttagggctagcgggtggtccgctagtggtggcgttgatcctcggacggattggtagcattggtaagctgtattggtttatgccaccgagtgctaacctggccttgcgtgaattggggatagtgctgtttttgtcagtggtcgggttgaaatccggcggtgattttatcaatacgctggtcaatggtgatgggctggcatggattggttatggtgcgatgatcaccgggataccgttgctaacggtaggtattttggcacgtatgctggtcaaaatgaactacctgacgctatgtggcatgttagcgggttcgatgacggatccacctgcgctggcctttgccaatggcctgcacccgaccagcggtgcggcggcgttgtcttatgcgacagtgtacccgctggcgatgtttctacgaatcatgtcaccacagatattggcggtattgttctggacgttgtag

SEQ ID NO: 91500 - protein, 552 aa, Yersinia pseudotuberculosis
MSAIALTVSMLALVAVLGLWIGNWKIYGVGLGIGGVLFGGIIVGHFAQTYQIVLNGDMLHFIQEFGLILFVYTIGIQVGPGFFSSLRVSGLRLNCFAILMVVVGGLVTAIIHKLFAVPLPIILGVFSGAVTNTPALGAAQQILTDLGSPPQLVSQMGMGYAMAYPFGICGILLVMWLIRLFFKINIDREAKAFDSSYGQNRELLQTMNVAVRNPNLHGLSVQDVPLLNSDEVVCSRLKRGDLLMVPMPATVIEIGDYLHLVGQRDALEKVRLVVGEEVDVTLSTAGTALQTARVVVTNEAVLGKKIRDLNLKQKYDVVITRLNRAGIELVASNSANLQFGDILNLVGRPEAIEAVSAIVGNAQQKLQQVQMLPVFIGVGLGVLLGSIPLFVPGFPAALRLGLAGGPLVVALILGRIGSIGKLYWFMPPSANLALRELGIVLFLSVVGLKSGGDFINTLVNGDGLAWIGYGAMITGIPLLTVGILARMLVKMNYLTLCGMLAGSMTDPPALAFANGLHPTSGAAALSYATVYPLAMFLRIMSPQILAVLFWTL

SEQ ID NO: 91501 - DNA, 1659 bp, Erwinia carotovora
  CDS (1)..(1659): transl_table=11
atgagtgatatcgcacttaccgtgagtatgctggcgctggttgccgttctggggttatggatcggcaattggcggatttatggcgtcggtttagggattggcggggtcctgttcggtgggatcatcgtcgggcatgttgcccatcagtaccagatccaactgaatgatgacatgttgcacgtcattcaggagttcgggttgatcctgtttgtctacaccattggcattcaggttgggccgggcttcttttcctctctgcgcgtatctggcctgcgcctcaatgcgttcgccctgttgacggtatttctcggtagtgtggtgaccgtcatgctgcacaaactgctcaatattcctctgcctattattctcggtattttttccggtgcggtgactaacacgccttcgcttggcgcgggtcagcagattctgaccgatctgggttcgagtacagccttagtgaaccaaatggggacgggatacgcgatggcgtatccactggggatctgcggcattttgctggtgatgtggctgatgcgcgtcctgtttcgtgtcgcggtggataacgaggcaaagcagtttgagaccagcaacggtcagcaccatgaacagctactcacgattaatgtgtcggtaacgaataccaatctgcaagggttggcgattcaggacgtgccgattctgaaccgtgacacgatcgtttgctcccgtctgaaacgcggcgatgaactgatggtgccatcgccgcatacgctgatccaactgggtgattatctgcatttggttggtgcgaaaaacgatctggagcaggcgcgtctggtcatcggtaatgaagttgagacgtcgctctcgacgcggggcaccgatctgcatgttgaacgtgtggtggtgacgaatgagaaagtgctgggtcgcaagattcgcgagcttaacctgaagcaaaattatgatgtggtgatctcgcgcctgaaccgtgcgggtgtcgagttggtcgccagcaatcaggccagcctgcaatttggcgatattctgaatctggtcggacggaaaacggcgatcgatgccgtcgcggatatcgtggggaatgcgcagcagaagctccagcaggtacagatgctgcccgtctttattggtattgggctgggcgtactgctgggctctgtgccgctgatggttcctgggtttccggtggcgctgcggctcgggcttgcaggtgggccgctggtggtggcgttggtgctggggcgcatcggcagtatcgggaaacttcattggtttatgccgcccagtgcgaatctggcgttgcgtgagctcggcatcgtgctgttcttatcggtggtgggattgaaatccggcggtgatttcgtcgatacgttattgaacggcgacggggtgtggtggattggctatggtgcgctgattaccattgtgccgctgctggctgtcggcatactggcgcgcacgttaggcaagatgaattacctgacgctctgcggcatgctggcgggttccatgaccgatccacccgcgttggcgtttgccaatgggctacacccgaccagcggtgcggcggcattgtcttatgcgacggtttatccgctggcgatgtttttgcgaattatgtcgccgcagcttttagccgtgttgttcctgaccctctaa

SEQ ID NO: 91502 - protein, 552 aa, Erwinia carotovora
MSDIALTVSMLALVAVLGLWIGNWRIYGVGLGIGGVLFGGIIVGHVAHQYQIQLNDDMLHVIQEFGLILFVYTIGIQVGPGFFSSLRVSGLRLNAFALLTVFLGSVVTVMLHKLLNIPLPIILGIFSGAVTNTPSLGAGQQILTDLGSSTALVNQMGTGYAMAYPLGICGILLVMWLMRVLFRVAVDNEAKQFETSNGQHHEQLLTINVSVTNTNLQGLAIQDVPILNRDTIVCSRLKRGDELMVPSPHTLIQLGDYLHLVGAKNDLEQARLVIGNEVETSLSTRGTDLHVERVVVTNEKVLGRKIRELNLKQNYDVVISRLNRAGVELVASNQASLQFGDILNLVGRKTAIDAVADIVGNAQQKLQQVQMLPVFIGIGLGVLLGSVPLMVPGFPVALRLGLAGGPLVVALVLGRIGSIGKLHWFMPPSANLALRELGIVLFLSVVGLKSGGDFVDTLLNGDGVWWIGYGALITIVPLLAVGILARTLGKMNYLTLCGMLAGSMTDPPALAFANGLHPTSGAAALSYATVYPLAMFLRIMSPQLLAVLFLTL

SEQ ID NO: 91503 - DNA, 1605 bp, Rhodopirellula baltica
  CDS (1)..(1605): transl_table=11
atgaacccaattctcgttctcctgtgtgtgattgccttgggcctgctggttggccgcgtttcttttcgcggcatctcgctgggcacatcagcgatcctgtttgtcgctttgcttgccgggcattacggatggaccattccaaccggcttcggaacgcttggtttggcgttgtttgtctactgcgtcggaatctcggccgggcccactttctttcgcggtcttgcgtcacacggccgagccatggcgatcaccggatccgtcattgttttgaccggtgtcgcggtgacgtggacgagcgcacgtctgttgggattgcccgccgaattggctggtgggttgatggccggtgcgatgaccagcacgcctgctcttggtgcgatcacccaatcatcgagcgatcccgctgccgttgcggttggttttggtgtcgcctacccgatcggaatcatcgcggtggtgttgttcgtgcaaatcgcgatcaagctgtttgctaaaccaggcgacagcgatggcaccgattccgcatcggaaacatcgggccaatcgagtgccgaaatcgccgagtccaacagcattggaaggcgagtcgttcgcattgccaatccagttgtctcgggcaagcgtcccagcgatatcgtcgccttcgcggattcgccatgccagatgtcgcgagttcaacgagaaggtcgttggcgtcccacgccgccggactaccaattcgagattggtgatgacgtcatgttggttggcggagcgtctgagattcgccgagtgtcagaaacactgggtgaattgcaagacacggcggaaccagtcgtcgatgcggatcgcgaacgtcggtacgtcgtcgtgacatcaccggaaatttacggtcggacgctcaaagaattgcgtttgcgatcgaaatatggtgtgacgattgttcgagtccagcgtcacgatgtggaattcgttccgtcggcccgcactcgcattgagtttggtgatggcttggtcgctgttggtgaaccggatgcactggcaaagattgcaaacgccgtcgggcatcgccctcgcacggtgaacgaaaccgatctgttgtctcttgtcgctggcattgtgctcggaatcttcgtcggcaacctgtcgcttcagatcggcgaattttcgatgtcactgggaattgccggtggcccattgatggtggggctcatccttgggcactttcgacggctcggacccattcggggatcgtatcctcccgcagcgatgcttttgatgacagaaggtggcttggcgttgtttcttgcggatgcaggattgaacgcgggtgccaacgttgtcgaggtgttgatggaacgcggagcaatgctatgcgtggcagccgcagcgatcgcgatcattccattattggttggcttcgccggatcaaggtatttcggaggccgaacgttgtggcaatcgctcggtgcgacctgtggcggaatgacgtccacgccgggattggctgtgttgacgggagcgaccgattccagccaaccggcaaccagttacgtcgcggcttatccggttgcactggtcttgatcacggttgccgcaccatggttggtcgaactgatcggctga

SEQ ID NO: 91504 - protein, 534 aa, Rhodopirellula baltica
MNPILVLLCVIALGLLVGRVSFRGISLGTSAILFVALLAGHYGWTIPTGFGTLGLALFVYCVGISAGPTFFRGLASHGRAMAITGSVIVLTGVAVTWTSARLLGLPAELAGGLMAGAMTSTPALGAITQSSSDPAAVAVGFGVAYPIGIIAVVLFVQIAIKLFAKPGDSDGTDSASETSGQSSAEIAESNSIGRRVVRIANPVVSGKRPSDIVAFADSPCQMSRVQREGRWRPTPPDYQFEIGDDVMLVGGASEIRRVSETLGELQDTAEPVVDADRERRYVVVTSPEIYGRTLKELRLRSKYGVTIVRVQRHDVEFVPSARTRIEFGDGLVAVGEPDALAKIANAVGHRPRTVNETDLLSLVAGIVLGIFVGNLSLQIGEFSMSLGIAGGPLMVGLILGHFRRLGPIRGSYPPAAMLLMTEGGLALFLADAGLNAGANVVEVLMERGAMLCVAAAAIAIIPLLVGFAGSRYFGGRTLWQSLGATCGGMTSTPGLAVLTGATDSSQPATSYVAAYPVALVLITVAAPWLVELIG

SEQ ID NO: 91505 - DNA, 1599 bp, Bacteroides thetaiotaomicron
  CDS (1)..(1599): transl_table=11
atgtttactgacttattgcattcctcttatttctcgctctttctgatagtagcgttgggatttatgttaggaagaattaagattaaggggctatcgcttgatgtgtcagcggtgatctttattgctcttctttttggacactttggtgttattattcctaaagaattaggaaacttcggtttggtactttttatttttaccatcggtattcaggccggtcccggattcttcgactcttttcgtagtaaaggaaagacgctgattctcattactatgcttattatctgttctgcctgcctcacggcagtaggtttgaagtatgcgttcgatattgatacgccgagtgtagtcggattgattgcaggagctttgaccagtactccgggattggcggtagcaattgatagtacccactctccgttagcatccattgcttacggtatcgcttatccgtttggtgtaatcggagtgattttgtttgtgaagctgcttcccaaaatcatgcgtgtaaatttggatcaggaagcccgtcgccttgaaatagagcgccgcggacaatttccggagttgggcacttgtatctaccgtgtcactaatgcaagcgtattcaaccgtagcttgatgcagatcaatgcacgggcaatgacaggtgctgttatttcccgtctgaaacataaagatgaaatatccatccccaccgcgcatacagtattgcacgaaggagactatattcaggcagtaggcagtgaggaatcactgaatcagctgtctgtattaattggcgaacgtgaagaaggtgaacttcctttggataaaacacaggaaatcgagtccttactattgaccaagaaagatatgatcaataagcaactgggtgatctgaatttacagaaaaacttcggttgtacggtgacccgtgttcgtcgaagcggtattgacttatctccgtcaccggatttggctttgaagtttggtgataaactgatggtggtaggagagaaggaaggcatcaaaggagtagcccgcctactgggaaacaatgcgaagaaactttccgatactgatttcttccccatcgcgatgggtattgtgctgggggtcttatttggtaagttgaatatttctttctccgatacactgtcgttttcacctggattgaccggaggagtattgatggtggcgttggttttgagtgccgttggtaagacagggcctatcatttggtctatgtccggccccgccaatcaactgttgcggcagttaggtctgttgcttttccttgctgaagtcggaacctctgccggaaagaaccttgtggctacttttcaggaaagcggattactgatgttcggagtgggtgcagctatcacagtagtaccgatgctggttgcggtaattgtaggacgcttggtattcaagatcaacatacttgatctactgggaaccattacgggaggtatgaccagtactccgggactggctgctgccgattcgatggtagacagtaatattccaagcgtggcatacgcgaccgtttatccgattgctatggtattccttattttatttatacaggtgatatcttcagctgtgtattaa

SEQ ID NO: 91506 - protein, 532 aa, Bacteroides thetaiotaomicron
MFTDLLHSSYFSLFLIVALGFMLGRIKIKGLSLDVSAVIFIALLFGHFGVIIPKELGNFGLVLFIFTIGIQAGPGFFDSFRSKGKTLILITMLIICSACLTAVGLKYAFDIDTPSVVGLIAGALTSTPGLAVAIDSTHSPLASIAYGIAYPFGVIGVILFVKLLPKIMRVNLDQEARRLEIERRGQFPELGTCIYRVTNASVFNRSLMQINARAMTGAVISRLKHKDEISIPTAHTVLHEGDYIQAVGSEESLNQLSVLIGEREEGELPLDKTQEIESLLLTKKDMINKQLGDLNLQKNFGCTVTRVRRSGIDLSPSPDLALKFGDKLMVVGEKEGIKGVARLLGNNAKKLSDTDFFPIAMGIVLGVLFGKLNISFSDTLSFSPGLTGGVLMVALVLSAVGKTGPIIWSMSGPANQLLRQLGLLLFLAEVGTSAGKNLVATFQESGLLMFGVGAAITVVPMLVAVIVGRLVFKINILDLLGTITGGMTSTPGLAAADSMVDSNIPSVAYATVYPIAMVFLILFIQVISSAVY

SEQ ID NO: 91507 - DNA, 1677 bp, Porphyromonas gingivalis
  CDS (1)..(1677): transl_table=11
atggacgcaatagttctttggctccgcgaagttttcctcgagccgtcggttacgcagacgatcattatcctcagtctcgtatgcgctttgggcttgcagttgggcaagcttcgtatcggcactatctcgcttggcatcactttcgtcttttttgtcgggattttggcttctcatttcggagttacgaccgatcccgtgatgctcacttttgcgcagaacttcggccttgtaatctttgtctatgcgctgggtttacaggtaggcccgtcttttttcccttcgctcaagaaggggggcattgcccagaatcttatctccttgggattagtcctactcacatttctcctgtgcatcctcctttattatatccttggcatttccatgcccaatctgatgggtatcgtggccggtgccactaccaatacccctgctttgggtgcagcccaaacgaccctccatcagatcaatcccgatgccacggccgaaatggccgaaatggctctggcctgtgccgttacctatcctttgggcgttgtgggtgttattattgctttggccctgctgaaagttatgatgcccaaggtcgaggaacgagacgattccgaggctcccaaagctttcttctccgagtatgaaatctgcaatcctgctttggatggcaaaagcgttcgcgaagtagcactcctgctcaagcgccctttcgtcattacacgggtctggcacaacggtaaagtcgagatccctacctctgatatgatcctctatttcggcgatcacatcctcgctgtctccggtgaagaggatacctcacagctcgaaatactcttcggcaagagagaaatgaaggattggaaccgtcccgatatagactggaacagtgtggacaaacagctcgtatcacgcaggctggtaataactcgccctaagctcaacggcgtacgcctcggcatgctgaaaatccgcaacctgtatggggtcaatatcagtcgtgtggacagggccggagtagaattgctgccggatagagatcttcgcctgcagttgggcgaccgcctgaccgtcgttggcgaaggcaaggctgtagagcgtgtggccgagattttgggtgatgaggtcaaacagttggacaatcctcatttgaccactttgttcggaggccttgtcttgggatgtgttttcggcatgatccccttctatctgcccggtgtcagtatgcctatcaagctgggattagccggcggccctatcatcatcggtattctgatgggagcattcgggccacgcttccacctgaccacctatgtaaccaacagtgccaatctacttctgcgccaattcggtatcatcctctatctcggtggacttggattggccagtggagccaatttctttgataccattatccatggggacggtctgctttgggtcggagcgggctttttgattacgatgcttcctacgctattggtcggttgggcttctatcaagttgctccgcaacaggtacgatggcacagccggtatgatatgcggaagtacggccaatccgatggctctcgactatgtgaatagccagctcaaaggtgacggagcctctgtggtgtacgccaccgtgtatccgctttcgatgttcgtccgtatcatcttcgcacaaatcatgatcctcatctttgcatag

SEQ ID NO: 91508 - protein, 558 aa, Porphyromonas gingivalis
MDAIVLWLREVFLEPSVTQTIIILSLVCALGLQLGKLRIGTISLGITFVFFVGILASHFGVTTDPVMLTFAQNFGLVIFVYALGLQVGPSFFPSLKKGGIAQNLISLGLVLLTFLLCILLYYILGISMPNLMGIVAGATTNTPALGAAQTTLHQINPDATAEMAEMALACAVTYPLGVVGVIIALALLKVMMPKVEERDDSEAPKAFFSEYEICNPALDGKSVREVALLLKRPFVITRVWHNGKVEIPTSDMILYFGDHILAVSGEEDTSQLEILFGKREMKDWNRPDIDWNSVDKQLVSRRLVITRPKLNGVRLGMLKIRNLYGVNISRVDRAGVELLPDRDLRLQLGDRLTVVGEGKAVERVAEILGDEVKQLDNPHLTTLFGGLVLGCVFGMIPFYLPGVSMPIKLGLAGGPIIIGILMGAFGPRFHLTTYVTNSANLLLRQFGIILYLGGLGLASGANFFDTIIHGDGLLWVGAGFLITMLPTLLVGWASIKLLRNRYDGTAGMICGSTANPMALDYVNSQLKGDGASVVYATVYPLSMFVRIIFAQIMILIFA

SEQ ID NO: 91509 - DNA, 1593 bp, Corynebacterium efficiens
  CDS (1)..(1593): transl_table=11
gtgcttgatttccttgcggcaaacccactgatcgccctggcggtgatcctcgcggtgggtctggccatcggtcggatctcactattcggggtgtccctcggtgccgcggccgtgttgatcgtggcgctggtggtctccaccctcaacccggacatccagatcccggccttcgtgttccagctgggtctggccatgttcgtctatgtcatcggcatctcggcgggcccggccttcttccgggagttccgctcgcggggatggaaactcacgcttttcatgatcacgctgctggtatccctgacagccctggcctgggttctcatccgggccttcggactgggggccggggcgggcgccggcatgttcgccggctcgctgacctccacgccgggtatggccgcggtggtcgcactcatggacccagcccaggccggtgaccccgtcatcgggtactccctggcctaccccggtgccgtgctgggttccatcctggtcgcggcggtgggcgcgaaactgctcaaggtcaaccacaccgaggatgcccgcgaggagggactggtcaccgaacccctggtgtggaagggcgtgcgtatcggggaggggatcagcggcaccatcggagacctgccccggttgtcgggtcagcagatcatcgccacccgcatcgtggaggatccccatgaacaccgcctggcggatccgacgctgcccatcaaacccggcatggaactggtcatcaacggcaccgtcaacgcggtcgaccgggcgatcgccgcgctggggggtgaatgcgacaccaagatcgaggacaccgaactggtgtactcccggttcactgtctccaacccggacatcgtcggacgcaccgtcgcggaactggatccggtggccaacggattcatgatcgcgcgtatccggcagggggacaccgagatcgtcccgcaccgggacaccgtgctcaactactccgaccgcgtccgcgtggtcgccgcaccgggacgcatgggcgaggtacgacgcttcctcggcgactccgagaaggccctgggggatgtcaacctgctgccgttcgccatcggactgtccctcggcctgctgctgggggcgatccccgtcccgctgcccggggacaccacgatgtacctgggtttcggtggtggacccatcgtcgccggtctcatcctcggtgccctcaaccgcaccgggcccatcacctggcagctgcccttccacgccaacaggaccatctccacgctggggctcgcgctgttcctggccggtgtgggtacctccgccggtgcgggtttccgtcaggcactgaccgatccgcagtccttcgtctacatgggggtgggctttgccatcaccgtcacctcggcgctggtgtgcgccgtggtgggcatgtggctgctgaaattgaaatgggatgaatccatgggcgtggccgccggcgccaccaccaacccggcgatcatctcctacctcaatgaccagaccggcacggacctggccaaccgtgggtatgccacggtgtaccccactgccatgatcggcaagatcctggcctgtcaggtgctgttcctgctgttgtag

SEQ ID NO: 91510 - protein, 530 aa, Corynebacterium efficiens
MLDFLAANPLIALAVILAVGLAIGRISLFGVSLGAAAVLIVALVVSTLNPDIQIPAFVFQLGLAMFVYVIGISAGPAFFREFRSRGWKLTLFMITLLVSLTALAWVLIRAFGLGAGAGAGMFAGSLTSTPGMAAVVALMDPAQAGDPVIGYSLAYPGAVLGSILVAAVGAKLLKVNHTEDAREEGLVTEPLVWKGVRIGEGISGTIGDLPRLSGQQIIATRIVEDPHEHRLADPTLPIKPGMELVINGTVNAVDRAIAALGGECDTKIEDTELVYSRFTVSNPDIVGRTVAELDPVANGFMIARIRQGDTEIVPHRDTVLNYSDRVRVVAAPGRMGEVRRFLGDSEKALGDVNLLPFAIGLSLGLLLGAIPVPLPGDTTMYLGFGGGPIVAGLILGALNRTGPITWQLPFHANRTISTLGLALFLAGVGTSAGAGFRQALTDPQSFVYMGVGFAITVTSALVCAVVGMWLLKLKWDESMGVAAGATTNPAIISYLNDQTGTDLANRGYATVYPTAMIGKILACQVLFLLL

SEQ ID NO: 91511 - DNA, 1695 bp, Bacteroides thetaiotaomicron
  CDS (1)..(1695): transl_table=11
atggaatggattattaatcaactcagggatcatcccgaacttgccattttcctcactttattcgccggcttctggctgggcagattcaaaataggaaaattttcgttgggaacagtaaccagcgtgctactggtcggagtactggtaggacaattaaacattagtgtagacggcccgatgaaagctgtctttttcctcctgtttttattcgctgtgggctataaggtaggtccgcaattctttcgcggattgaagaaagacggattgccgcaagtaggatttgccgtcctgatgtgcattgtcagcctcatcgccccatggatacttgccaaaatcatgggctaccatgtaggcgaggctgccggattgctggcaggctcacagaccatttccgcagtaatcggtgtggcaagcgacacgatcaatcaattaagcatcagcgatgcgcagaaagcgacatttatcaatgccatccccgtagcatacgctgtgacttatattttcggtacggcaggttccgcatggattctggcttcactcggtcccaaaatgctgggcggactggagaaggtgaaagcggactgcaaagagctggaagccaaaatgggaacttccgaagcagatgaacccggattttacaccgccctccgccccgtcgtattccgtgcttataaaatagataacgaatggttcggcaaaggaaaaacggtcagcgaactggagaactatctggtggaaaacgataaacggctgtttgtagaacgcgtacggcaaaagggcgtcatagaagaagtcaccccggatatgcttctacaaccgggcgatgaagtcgtattaagcggccgccgtgaatatgcaatcggcgaagaagactggatcggtccggaagtgatcgacgcccaactgctcgactttccggcagagacgcttccggtaatggtcacccaccgcacattcgcaggcgaaaaggtctccacgatccgtgcgctgaaattcatgcacggagtcagtatccgcagtatcaagcgagcaggcatcaatgttccggtactcgctcagacagtgatcgactccggcgatattctcgaactgaccggaacaaaactcgaagtagaaactgccgccaaacagatgggctatatcgatcgccccaccaaccagacagatatgatcttcgtgggactgggtatcctgctcggtggtctggtcggcgcacttgccattcacctgggaggtatcccgatcagcctgtccaccagtggaggtgccttgatcgcaggactcgtattcggctggctgcgcagcaaacatccgacctttggcggtatccccgaaccttcgttgtgggtattgaataatgtgggattgaatatgtttatcgctgttgtcggcatcgctgcaggacctagtttcgtgaccggtttcaaagaagtaggattcagcctgtttatcgtcggtgcactggcaaccgccatccctcttctcagcggactgctgatgggaagatatctgttcaagttccaccctgccctcacactgggatgtacagccggagcacgtaccacaaccgccgcactgggagctattcaggatgcattgggaagcgacactcccgcgttaggatacaccgtgacgtatgcagtcggtaatacactactgattatctggggagtagccatcgtattgctcatgtaa

SEQ ID NO: 91512 - protein, 564 aa, Bacteroides thetaiotaomicron
MEWIINQLRDHPELAIFLTLFAGFWLGRFKIGKFSLGTVTSVLLVGVLVGQLNISVDGPMKAVFFLLFLFAVGYKVGPQFFRGLKKDGLPQVGFAVLMCIVSLIAPWILAKIMGYHVGEAAGLLAGSQTISAVIGVASDTINQLSISDAQKATFINAIPVAYAVTYIFGTAGSAWILASLGPKMLGGLEKVKADCKELEAKMGTSEADEPGFYTALRPVVFRAYKIDNEWFGKGKTVSELENYLVENDKRLFVERVRQKGVIEEVTPDMLLQPGDEVVLSGRREYAIGEEDWIGPEVIDAQLLDFPAETLPVMVTHRTFAGEKVSTIRALKFMHGVSIRSIKRAGINVPVLAQTVIDSGDILELTGTKLEVETAAKQMGYIDRPTNQTDMIFVGLGILLGGLVGALAIHLGGIPISLSTSGGALIAGLVFGWLRSKHPTFGGIPEPSLWVLNNVGLNMFIAVVGIAAGPSFVTGFKEVGFSLFIVGALATAIPLLSGLLMGRYLFKFHPALTLGCTAGARTTTAALGAIQDALGSDTPALGYTVTYAVGNTLLIIWGVAIVLLM

SEQ ID NO: 91513 - DNA, 1716 bp, Francisella tularensis
  CDS (1)..(1716): transl_table=11
atgtttcatgaagtaattcttaatgttttaaaaaatccttttatagcactatttttaacattaagtttaggctacttagttggcaaaataaaatataagacttttgtgttaggaggaatatcaggatctcttataattggtgtaattatagggcaacttaacattaccatctcaccagatattggctctttattttttgcattattcatatatgcaggtggttatcaaggaggagctcaattttttagatcattaaacaaagatacacttttactactggcttcttcaactataacctgcgtactaggcttactatgcgtactagtttttgcttggatattccagttagacaaaggcactgcagcaggattaggtgcaggaggattaacacaatctgcaatgattggctcagccaataatgcaatagccatgataaactcagtatccgaatcgaccattcacactatgcagaccaatgttacggtaggatatgccgtatgctatatctttggatcttttggtcctataattctgcttgcaacaatttttccattagtgatgaaatgggatcttagaaaagaagcaattaaattagcaacagaacagtctgatgggaatttagacctagaagttggtcaattctctgcttttagcgagtatactacgagagcatataaaattaatcgcgactctcagttgctcggtaagtctttagtagaagtatataagacatacaagtataaagtagtaataaaaaatatcattcgcgataataaactgctaactataactcctgaaaccactataaatacaaatgatatagtagcgataacattctatgcagatttagatatccaatcaattatttcaaaagatattgaggttactaaacccgagcagttcaattttattgaagagaaaagatccctaatattgactaataaaaatctattcaataaaacaattaaagaggtcaaagatataattcaagacagaaattattatggagtatttttacaaaaaattattcgctctggtcagaaacttcctatctctgatgatctcaaacttagaagaggtgatgagattagacttataggtaaaccagaagatctcgataaaataagcaataagataggaacttttatttctgaagctcctatcactgatttcattttctttggtttaggtatggttttaggttatatctttggtttaataagctttaatatctttggaatttcaataactttaggagctggagtggactgtttattatctggcttaatttttggctggatcagatcaataaaacctcagtttagcaacttacctgtgggagcatctaattttattcgagatctcggtttagcaatatttgtagctagtgttggaattactgccggacctcaagctataactactatcaaggaacatggacttacactatttttcttaggtattggtgtaacaatcatacctcaagtaatttctttttatatatcgtactatttacttaaaatcaaaaatcctattgtattattagcaactattgctggaggtagaagtgtaaatcctggttttgctgctttattagaacgcgctggcaatgctactccagtaatcccctttacatcatcatacgctttagcaaatatatggttgacactgtggggacctgtaatagttgcattagtaacaatcatacctaaataa

SEQ ID NO: 91514 - protein, 571 aa, Francisella tularensis
MFHEVILNVLKNPFIALFLTLSLGYLVGKIKYKTFVLGGISGSLIIGVIIGQLNITISPDIGSLFFALFIYAGGYQGGAQFFRSLNKDTLLLLASSTITCVLGLLCVLVFAWIFQLDKGTAAGLGAGGLTQSAMIGSANNAIAMINSVSESTIHTMQTNVTVGYAVCYIFGSFGPIILLATIFPLVMKWDLRKEAIKLATEQSDGNLDLEVGQFSAFSEYTTRAYKINRDSQLLGKSLVEVYKTYKYKVVIKNIIRDNKLLTITPETTINTNDIVAITFYADLDIQSIISKDIEVTKPEQFNFIEEKRSLILTNKNLFNKTIKEVKDIIQDRNYYGVFLQKIIRSGQKLPISDDLKLRRGDEIRLIGKPEDLDKISNKIGTFISEAPITDFIFFGLGMVLGYIFGLISFNIFGISITLGAGVDCLLSGLIFGWIRSIKPQFSNLPVGASNFIRDLGLAIFVASVGITAGPQAITTIKEHGLTLFFLGIGVTIIPQVISFYISYYLLKIKNPIVLLATIAGGRSVNPGFAALLERAGNATPVIPFTSSYALANIWLTLWGPVIVALVTIIPK

SEQ ID NO: 91515 - DNA, 1626 bp, Corynebacterium diphtheriae
  CDS (1)..(1626): transl_table=11
gtggatatcttcgtggcaaacccgctgttggcgctttttgtcatcatggcggttggattagcgatcggtcaggttaaaatccgaggttttagtctcggagtggcagcagtgctttttgcaggcgttggatttgcggctgtagagcctgatattcacatcccacacttggtgtacatcttgggattgtctatttttgtgtactccatcggtttggaatcaggccatgcgtttttcgccctgtttaagtcgcaaggagtcaaacaaaacgcgctcgctattaccgcgttggcgctgataacaggcatttctatcgctttgttttcgctgatacatctcaacggggtcaccgctgctgggttgtttacaggcgcggtaacaaatacaccggccatggctgccgtggtggattcgttacccagcatctttggggatgcgaacaaggtacacgaggtggaatcgttgcccttagttgcatattcgctggcctaccccatcggcgtattgggagttatcgcggcaattgggttgtgtgcaaagtggttccgtatcgatcacgtgcaagaagctcacgacgcaggtgttgctgttgaggatttgttcacccgtcagatcaaggtcaatcatgtggttacgggctctgatcttgtgattgatatccaccacacgctgggcctagagattattgtctcgcgaattgagcgtgatggtcagcagactctccctactgcgtcgtctcgtatccatatgggagatgtgttgtctgtggtgggcacggccgaggaactcgacaaggccgcgcatgtgctaggtgatttgctcccaggcgatcctttccatggtcacgatttagattatcggcgcatttttgtttccaatcaggatttagtgggcatacctctggctaaacttcggcctcgattgtcaggaattttgattactcgggtccgtcgtggcgaccatgaccatgtggctactccggaaacagttttgcagcttggcgaccgtgttcgggtggtggcagctcatgatcgtatgaaatccgtgacggcactgttcggcgattcctatcgtcgcctttctgatttcaatcttttccctctcgttgccgggcttgcgcttggattgctcgttggcatgattgaggtaccacttcctggcggtgctgcgttgtctttaggaagcgccggcggcccattagtagtagctctcgttctaggcgcagtgggacgctcaggtcgttttgtgtggcaggttccttacggagcaaacttggcactgcgacaactaggcatcaccttgtttctcgccgctattggtaccactgcaggagctagtttccgtgcatcgctatcagatcccgcatcgttgaccatcattgccgttggtgccatcatcaccttgacattggctatctttgttctggttgtgggctataaggtgatgaagatcccgtacggccaaacagcgggcatgcttgcgggtattcaaacgcacccagctgtactgtcctatgtttctgcgatgacgaaaaatgatctgccggcattgggctacacctcggtatatccactggccatgatcgctaagatcattgcagcacaggttgtgctattcgctttgacatag

SEQ ID NO: 91516 - protein, 541 aa, Corynebacterium diphtheriae
MDIFVANPLLALFVIMAVGLAIGQVKIRGFSLGVAAVLFAGVGFAAVEPDIHIPHLVYILGLSIFVYSIGLESGHAFFALFKSQGVKQNALAITALALITGISIALFSLIHLNGVTAAGLFTGAVTNTPAMAAVVDSLPSIFGDANKVHEVESLPLVAYSLAYPIGVLGVIAAIGLCAKWFRIDHVQEAHDAGVAVEDLFTRQIKVNHVVTGSDLVIDIHHTLGLEIIVSRIERDGQQTLPTASSRIHMGDVLSVVGTAEELDKAAHVLGDLLPGDPFHGHDLDYRRIFVSNQDLVGIPLAKLRPRLSGILITRVRRGDHDHVATPETVLQLGDRVRVVAAHDRMKSVTALFGDSYRRLSDFNLFPLVAGLALGLLVGMIEVPLPGGAALSLGSAGGPLVVALVLGAVGRSGRFVWQVPYGANLALRQLGITLFLAAIGTTAGASFRASLSDPASLTIIAVGAIITLTLAIFVLVVGYKVMKIPYGQTAGMLAGIQTHPAVLSYVSAMTKNDLPALGYTSVYPLAMIAKIIAAQVVLFALT

SEQ ID NO: 91517 - DNA, 1626 bp, Desulfotalea psychrophila
  CDS (1)..(1626): transl_table=11
ttggacaaggaaaacaaaatggacatactaaacaatcagatttttctgctcctactcattaccctgattggcatgaccataggcaagatcaatattaaaaatttttccctcgactcctctgccatcatctttgtcggcctcttcttcggccattttggctataccctgcccaagacattccagaccctgggccttgtcctcttcatctactccatcggcctccaggcggggcccggatttttcttcagccttcggcaacgaggattaaagctgagcctgggaacagtggccatcattggcattggctttttaaccactctggcaactacctaccttttccattttagtgccggcaccagtgccggcatctttacaggtgccctaaccagcacaccgggacttgccgtggccgttgagattgccggcggtcagaacgccccagctgcatatggagtgacctatttctttggtatagtgggggtcattgtcttcattcagataattcccaagatactgaatattacagtcaaagatgaagaacaggcccttaacaaggaacgagataagacacataagccgctgcattttatgcatcttgagctcaccaatctcaacctcgttgacaggcaggtcaagcacctcaatctcaaaagcatatctcccgtcatcatcacccgactgctgagaaaaaacggcacagagcctattttagtcggcgggcaaaccatcctccaggcaggtgatcacctacgcataaccggcaccaaagatgatcttgaaatgatgcaaatgtacctgggaactcccgttgatcaggatattgaatttgagcgcgtcctctccggggagtatatcaccgtctccaataaggatatttgcggaatgagcctcaaacaactcaactgccacgaggtctttaatgtacagctgagcagaataagccgcaacggcatcgagctgcccgcaggccctaacctgcgtctccatatgggcgacaccatccatgcggtcggtagcaaacaatccctggaaaatattaaaaaaatatttggcaacagcataaaagactcctataatttcaatatcctgcccatatttactggtctttttttaggatttattctgggcaagataccgctctatattcccttttcgggcattttttatctgggcaccacgggtggggtactgatagcaggactgtttctcagcaatatctataagacaggtcccttaatctgggccatccccagcaatgccaatagttttatccgagagatgggcctggtgctctttatggcaaccattggcacccaaaccgggacaagcatccttgcaactctgcgtcacgaagggctacaactctccctggccggaatactggtcacgacagtccccctgatcagttcagtctttatctgcaaacatctactcaaactcccctttctctctatgctgggagtaataacgggcgccatgacaagtacaccgggtcttgccacaatggcaaagatatccaaaaccccctatgccacatcgagctatgccactgtctaccccgtagccctgatcagcatgattatctacacgaaactactgatctttatcgtcgagagatttttctaa

SEQ ID NO: 91518 - protein, 541 aa, Desulfotalea psychrophila
MDKENKMDILNNQIFLLLLITLIGMTIGKINIKNFSLDSSAIIFVGLFFGHFGYTLPKTFQTLGLVLFIYSIGLQAGPGFFFSLRQRGLKLSLGTVAIIGIGFLTTLATTYLFHFSAGTSAGIFTGALTSTPGLAVAVEIAGGQNAPAAYGVTYFFGIVGVIVFIQIIPKILNITVKDEEQALNKERDKTHKPLHFMHLELTNLNLVDRQVKHLNLKSISPVIITRLLRKNGTEPILVGGQTILQAGDHLRITGTKDDLEMMQMYLGTPVDQDIEFERVLSGEYITVSNKDICGMSLKQLNCHEVFNVQLSRISRNGIELPAGPNLRLHMGDTIHAVGSKQSLENIKKIFGNSIKDSYNFNILPIFTGLFLGFILGKIPLYIPFSGIFYLGTTGGVLIAGLFLSNIYKTGPLIWAIPSNANSFIREMGLVLFMATIGTQTGTSILATLRHEGLQLSLAGILVTTVPLISSVFICKHLLKLPFLSMLGVITGAMTSTPGLATMAKISKTPYATSSYATVYPVALISMIIYTKLLIFIVERFF

SEQ ID NO: 91519 - DNA, 1686 bp, Salmonella paratyphi
  CDS (1)..(1686): transl_table=11
gtgaatataaacgtcgcagatttgttaaatgggaattacatcctgttattatttgtggtcctggctcttggcctgtgtcttggcaagttacgtctgggttcagtccaacttggtaattccattggcgttttagtggtctctctattattagggcagcaacacttcagtattaacaccgacgcgctaaatctgggatttatgctgtttattttttgtgtcggcgtcgaggctggccccaactttttttcgattttttttcgcgacggtaaaaactatctgatgcttgccctggtcatggtcggtagcgctctgctaatcgccttaggccttggtaagctattcggctgggatatcggcctgacggccggtatgctggccggctcaatgacatccacgcccgtgctggttggcgcaggcgataccctgcgacattccggcatcgccagcacccaactctcctccgctcttgataatctgagcctgggctatgccctgacctatctgattggcttggtcagtctgatcgtgggcgcgcgctacttgcctaaactacagcatcaggatttgcaaaccagcgcccagcaaattgctcgcgagcgcggtctggataccgatgctaatcgcaaagtttatttgccggttatccgcgcctatcgggttggtccggagctggtggcctggactgacggtaaaaacctgcgcgagctgggtatttaccgccagacaggctgctatatcgaacgtattcgccgtaacggtattctggcgaacccggatggcgatgcggtgctgcaaatgggcgatgagattgcgctggtcggctatccggacgcgcacgccaggctcgatcccagcttccgtaatggtaaggaagtgtttgatcgcgatctgcttgatatgcgcatcgtgacggaagaaattgtggtgaaaaaccacaatgcggtcggtcgccgcctcgctcagctcaagctgaccgatcatggctgcttccttaaccgcgtcatccgcagccagatcgaaatgcctatcgacgataacgttgtgctgaataaaggcgacgtgttacaggtgagcggcgacgccagacgcgtaaaaaccattgccgatcgcattggttttatttcgattcatagtcaggtgacggacctgctcgccttctgcgctttttttatcatcgggttaatgatcgggatgattaccttccagttcagcaattttagtttcggcatcggcaacgcggccggattgctgttcgccgggatcatgctcggtttcctgcgcgctaaccatcctacctttggttatattccgcagggcgcgcttaatatggtgaaagaattcggcttgatggtgtttatggcaggcgttggtttaagcgccggcagcggtatcagcaacggtctgggcgcggtcggcggacaaatgctgatcgccgggcttgtcgtcagcctggtaccggtggtgatctgcttcttgtttggcgcttatgtgctgcgcatgaaccgggcgctgctgttcggcgccatgatgggcgcgcgtacctgcgccccggcgatggaaatcattagcgatacggcgcgcagtaatattccagcgctgggttatgcggggacttacgccatcgccaacgttctactaacgctggcggggacgcttattgtcatcatctggccggggttaggataa

SEQ ID NO: 91520 - protein, 561 aa, Salmonella paratyphi
MNINVADLLNGNYILLLFVVLALGLCLGKLRLGSVQLGNSIGVLVVSLLLGQQHFSINTDALNLGFMLFIFCVGVEAGPNFFSIFFRDGKNYLMLALVMVGSALLIALGLGKLFGWDIGLTAGMLAGSMTSTPVLVGAGDTLRHSGIASTQLSSALDNLSLGYALTYLIGLVSLIVGARYLPKLQHQDLQTSAQQIARERGLDTDANRKVYLPVIRAYRVGPELVAWTDGKNLRELGIYRQTGCYIERIRRNGILANPDGDAVLQMGDEIALVGYPDAHARLDPSFRNGKEVFDRDLLDMRIVTEEIVVKNHNAVGRRLAQLKLTDHGCFLNRVIRSQIEMPIDDNVVLNKGDVLQVSGDARRVKTIADRIGFISIHSQVTDLLAFCAFFIIGLMIGMITFQFSNFSFGIGNAAGLLFAGIMLGFLRANHPTFGYIPQGALNMVKEFGLMVFMAGVGLSAGSGISNGLGAVGGQMLIAGLVVSLVPVVICFLFGAYVLRMNRALLFGAMMGARTCAPAMEIISDTARSNIPALGYAGTYAIANVLLTLAGTLIVIIWPGLG

SEQ ID NO: 91521 - DNA, 1662 bp, Salmonella paratyphi
  CDS (1)..(1662): transl_table=11
atgagtgatatcgcattgacggtcagcgttctggcgttggtggcggttgtcggtttatggatcggcaacattaaagtgcgcggtgtcggctttggtattggcggcgttctgttcggcggtattatcgtcggccacttcgtcgatcaggctggggtgacgctgagcggcgatatgctgcactttatccaggaattcggcctgatcctttttgtttataccatcggcatacaggtggggccggggtttttcgcctcgctgcgcgtttccgggctgcgtctcaatctgtttgctgttctgattgtgattatgggcgggttagtcaccgcgattctgcataaaattttcgctattccgctgccagtggtgctggggattttctccggcgcagtcaccaatacgcctgcgttaggggcgggtcagcaaatcctgcgcgatctgggaacgccagtggatctggtagatcagatggggatgagctatgcgatggcgtatccgtttggcatctgcggtattttgctcaccatgtggctgatgcggctgatttttcgcgttaacgtcgaggcggaggcgcagaagcacgaatcctctctcgctaacggccattcattaattcagacaatgaatatccgtgtcgagaatccgaacctcaataatatggctatccaggatgtgccgatcctgaacagcgataaaatcatttgctcacgcctgaaacgcgacgacacgctgatggtgccgtcgccggggacgattatccaggcaggcgacctgctgcacctcgtcggccaatctaccgacctgcataacgcgcaactggtgatcggcaaggaagtggacacctcgttgtcgacgcgcggcacggatttacgcgtcgagcgtgtggtcgtcaccaacgaaaaagtgctcggcaaacgtatccgtgatttgcactttaaagagcgttatgacgtggttatctcccgtcttaaccgcgcgggtgttgagctggtcgccagtagcgacgccagcctgcagtttggcgacattctcaatctggtggggcgtccagcctcgattgatgcggtagccaatgtggtcggcaacgcgcagcaaaaactccagcaggtgcagatgctgccggtgtttatcggcatcggattaggggttctgcttgggtcaatcccgttgtttgtgccgggattcccggtcgcgttaaaactggggctggccggcgggccgctgatcatggcgctaattttggggcgtatcggcagcatcggtaagctgtactggtttatgccgccgagcgccaacctcgcgctgcgtgagttaggcatcgttttgtttctggcggtcgttgggctgaaatccggcggcgattttgtcgatacgctgacgcagggcgaaggattaagctggattggctacggtattttcatcaccgctattccgctgattaccgtcggtttgctggcgcggatttttgccaaaatgaactatctgacgctgtgcgggatgctggccggttcgatgaccgatccgccagcgctggcatttgccaacaatcttcatgccaccagcggcgcggcggcgctctcttacgcgaccgtctatccgttagtgatgttcctgcgtattatcacgccacaactgctggcggtgattttttggggaatgggttag

SEQ ID NO: 91522 - protein, 553 aa, Salmonella paratyphi
MSDIALTVSVLALVAVVGLWIGNIKVRGVGFGIGGVLFGGIIVGHFVDQAGVTLSGDMLHFIQEFGLILFVYTIGIQVGPGFFASLRVSGLRLNLFAVLIVIMGGLVTAILHKIFAIPLPVVLGIFSGAVTNTPALGAGQQILRDLGTPVDLVDQMGMSYAMAYPFGICGILLTMWLMRLIFRVNVEAEAQKHESSLANGHSLIQTMNIRVENPNLNNMAIQDVPILNSDKIICSRLKRDDTLMVPSPGTIIQAGDLLHLVGQSTDLHNAQLVIGKEVDTSLSTRGTDLRVERVVVTNEKVLGKRIRDLHFKERYDVVISRLNRAGVELVASSDASLQFGDILNLVGRPASIDAVANVVGNAQQKLQQVQMLPVFIGIGLGVLLGSIPLFVPGFPVALKLGLAGGPLIMALILGRIGSIGKLYWFMPPSANLALRELGIVLFLAVVGLKSGGDFVDTLTQGEGLSWIGYGIFITAIPLITVGLLARIFAKMNYLTLCGMLAGSMTDPPALAFANNLHATSGAAALSYATVYPLVMFLRIITPQLLAVIFWGMG

SEQ ID NO: 91523 - DNA, 26 bp, Primer
atgaatataaacgtcgccgaattgtt

SEQ ID NO: 91524 - DNA, 24 bp, Primer
ttatcctaatcctggccataccat

SEQ ID NO: 91525 - protein, 567 aa, consensus
  MISC_FEATURE (1)..(567): consensus for the disclosure of xaa see table XV
GXXXGXXXXXXXXLGXXXXXLXXXXXXXXXXXXXXXXXXXXXXXXXXXXXXXXFXXXXGXXXGPXFXXXXXXXXGXXXXXXXXXXXXXXXXXXXXXXXXXXXXXXXXXXXGXXXGXXTXXXXXXXXXXXXXXXXXXXXXXXXXXXXXXXXXXXYXXXYXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGDXXXXXGXXXXXXXXXXXXXXXXXXXXXXXXXXXXXXXXXXXXXXXXXXXXXXXXGXXXXXXXXXXXXXXXXXXXXXXXXRXXXXXXXXXXXXXXLXXGDXXXXXGXXXXXXXXXXXXGXXXXXXXXXXXXXXXXXXXXXGXXXGXXXXXXXXXXXXXXLGXXXGXLXXXXXXXXXXXXXXXXXXXXPXXAXXXXXXXGXXXFXXXXGXXXGXXXXXXXXXXXGXXXXXXGXXXXXXPXXXXXXXXXXXXXXXXXXXXXGXXXGXXXXXXXXXXXXXXXXXXXXXXXXXXYXXXY

SEQ ID NO: 91526 - protein, 73 aa, consensus
  MISC_FEATURE (1)..(73): consensus for the disclosure of xaa see table XV
XXXXXXXXXXXGXXXXXXXXXXXXXXXXXXXXXXXXXXXXXXXXXXXXXXXXXXXXXXXXFXXXXGXXXGXXF

SEQ ID NO: 91527 - protein, 57 aa, consensus
  MISC_FEATURE (1)..(57): consensus for the disclosure of xaa see table XV
GXXXGXXXXXXXXXXXXXXXXXXXXXXXXXXXXXXXXXXXXXXXXXXYXXXXXXXXX

SEQ ID NO: 91528 - protein, 76 aa, consensus
  MISC_FEATURE (1)..(76): consensus for the disclosure of xaa see table XV
XXXXXXXXXXXXXXXXXXXXXXXGXXXXXXXXXXXXXXXXXXXXXXXXXGXXXXXXXXXXXXXXXXXXXXXXXXXX

SEQ ID NO: 91529 - protein, 70 aa, consensus
  MISC_FEATURE (1)..(70): consensus for the disclosure of xaa see table XV
XXXXGXXXXXXXXXXXXXXXXXXXXXXXXXXXXXXXXXXXXXXXXXXXXXXXXXXXXXXXXXXXXXXXXG

SEQ ID NO: 91530 - DNA, 759 bp, Escherichia coli (strain K-12); identical to SEQ ID NO: 29326
  CDS (1)..(759)

SEQ ID NO: 91531 - protein, 252 aa, Escherichia coli (strain K-12); identical to SEQ ID NO: 29327

SEQ ID NO: 91532 - DNA, 678 bp, Streptococcus thermophilus LMG 18311; identical to SEQ ID NO: 29328
  CDS (1)..(678)

SEQ ID NO: 91533 - protein, 225 aa, Streptococcus thermophilus LMG 18311; identical to SEQ ID NO: 29329

SEQ ID NO: 91534 - DNA, 1812 bp, Arabidopsis thaliana; identical to SEQ ID NO: 29330
  CDS (1)..(1812)

SEQ ID NO: 91535 - protein, 603 aa, Arabidopsis thaliana; identical to SEQ ID NO: 29331

SEQ ID NO: 91536 - DNA, 798 bp, Neisseria meningitidis Z2491; identical to SEQ ID NO: 29332
  CDS (1)..(798): transl_table=11

SEQ ID NO: 91537 - protein, 265 aa, Neisseria meningitidis Z2491; identical to SEQ ID NO: 29333

SEQ ID NO: 91538 - DNA, 678 bp, Streptococcus agalactiae 2603V/R; identical to SEQ ID NO: 29334
  CDS (1)..(678): transl_table=11

SEQ ID NO: 91539 - protein, 225 aa, Streptococcus agalactiae 2603V/R; identical to SEQ ID NO: 29335

SEQ ID NO: 91540 - DNA, 774 bp, Oceanobacillus iheyensis HTE831; identical to SEQ ID NO: 29336
  CDS (1)..(774): transl_table=11

SEQ ID NO: 91541 - protein, 257 aa, Oceanobacillus iheyensis HTE831; identical to SEQ ID NO: 29337

SEQ ID NO: 91542 - DNA, 759 bp, Oceanobacillus iheyensis HTE831; identical to SEQ ID NO: 29338
  CDS (1)..(759): transl_table=11

SEQ ID NO: 91543 - protein, 252 aa, Oceanobacillus iheyensis HTE831; identical to SEQ ID NO: 29339

SEQ ID NO: 91544 - DNA, 759 bp, Shigella flexneri 2a str. 301; identical to SEQ ID NO: 29340
  CDS (1)..(759): transl_table=11

SEQ ID NO: 91545 - protein, 252 aa, Shigella flexneri 2a str. 301; identical to SEQ ID NO: 29341

SEQ ID NO: 91546 - DNA, 678 bp, Streptococcus mutans UA159; identical to SEQ ID NO: 29342
  CDS (1)..(678): transl_table=11

SEQ ID NO: 91547 - protein, 225 aa, Streptococcus mutans UA159; identical to SEQ ID NO: 29343

SEQ ID NO: 91548 - DNA, 750 bp, Lactobacillus plantarum WCFS1; identical to SEQ ID NO: 29344
  CDS (1)..(750): transl_table=11

SEQ ID NO: 91549 - protein, 249 aa, Lactobacillus plantarum WCFS1; identical to SEQ ID NO: 29345

SEQ ID NO: 91550 - DNA, 702 bp, Coxiella burnetii RSA 493; identical to SEQ ID NO: 29346
  CDS (1)..(702): transl_table=11

SEQ ID NO: 91551 - protein, 233 aa, Coxiella burnetii RSA 493; identical to SEQ ID NO: 29347

SEQ ID NO: 91552 - DNA, 1491 bp, Rhodopirellula baltica SH 1; identical to SEQ ID NO: 29348
  CDS (1)..(1491): transl_table=11

SEQ ID NO: 91553 - protein, 496 aa, Rhodopirellula baltica SH 1; identical to SEQ ID NO: 29349

SEQ ID NO: 91554 - DNA, 1596 bp, Oryza sativa (japonica cultivar-group); identical to SEQ ID NO: 29350
  CDS (1)..(1596)

SEQ ID NO: 91555 - protein, 531 aa, Oryza sativa (japonica cultivar-group); identical to SEQ ID NO: 29351

SEQ ID NO: 91556 - DNA, 1503 bp, Oryza sativa (japonica cultivar-group); identical to SEQ ID NO: 29352
  CDS (1)..(1503)

SEQ ID NO: 91557 - protein, 500 aa, Oryza sativa (japonica cultivar-group); identical to SEQ ID NO: 29353

SEQ ID NO: 91558 - DNA, 657 bp, Methanococcus maripaludis S2; identical to SEQ ID NO: 29354
  CDS (1)..(657): transl_table=11

SEQ ID NO: 91559 - protein, 218 aa, Methanococcus maripaludis S2; identical to SEQ ID NO: 29355

SEQ ID NO: 91560 - DNA, 681 bp, Desulfotalea psychrophila LSv54; identical to SEQ ID NO: 29356
  CDS (1)..(681): transl_table=11

SEQ ID NO: 91561 - protein, 226 aa, Desulfotalea psychrophila LSv54; identical to SEQ ID NO: 29357

SEQ ID NO: 91562 - DNA, 765 bp, Bacillus licheniformis DSM 13; identical to SEQ ID NO: 29358
  CDS (1)..(765): transl_table=11

SEQ ID NO: 91563 - protein, 254 aa, Bacillus licheniformis DSM 13; identical to SEQ ID NO: 29359

SEQ ID NO: 91564 - DNA, 882 bp, Leuconostoc mesenteroides subsp. mesenteroides ATCC 8293; identical to SEQ ID NO: 29360
  CDS (1)..(882)

SEQ ID NO: 91565 - protein, 293 aa, Leuconostoc mesenteroides subsp. mesenteroides ATCC 8293; identical to SEQ ID NO: 29361

SEQ ID NO: 91566 - DNA, 702 bp, Methanococcoides burtonii DSM 6242; identical to SEQ ID NO: 29362
  CDS (1)..(702)

SEQ ID NO: 91567 - protein, 233 aa, Methanococcoides burtonii DSM 6242; identical to SEQ ID NO: 29363

SEQ ID NO: 91568 - DNA, 759 bp, Enterococcus faecium; identical to SEQ ID NO: 29364
  CDS (1)..(759)

SEQ ID NO: 91569 - protein, 252 aa, Enterococcus faecium; identical to SEQ ID NO: 29365

SEQ ID NO: 91570 - DNA, 801 bp, Methanosarcina barkeri str. fusaro; identical to SEQ ID NO: 29366
  CDS (1)..(801)

SEQ ID NO: 91571 - protein, 266 aa, Methanosarcina barkeri str. fusaro; identical to SEQ ID NO: 29367

SEQ ID NO: 91572 - DNA, 2195 bp, Lycopersicon esculentum; identical to SEQ ID NO: 29368
  CDS (80)..(1717)

SEQ ID NO: 91573 - protein, 545 aa, Lycopersicon esculentum; identical to SEQ ID NO: 29369

SEQ ID NO: 91574 - DNA, 690 bp, Haloarcula marismortui ATCC 43049; identical to SEQ ID NO: 29370
  CDS (1)..(690)

SEQ ID NO: 91575 - protein, 229 aa, Haloarcula marismortui ATCC 43049; identical to SEQ ID NO: 29371

SEQ ID NO: 91576 - DNA, 1710 bp, Nicotiana tabacum; identical to SEQ ID NO: 29372
  CDS (1)..(1710)

SEQ ID NO: 91577 - protein, 569 aa, Nicotiana tabacum; identical to SEQ ID NO: 29373

SEQ ID NO: 91578 - DNA, 819 bp, Acinetobacter sp; identical to SEQ ID NO: 29374
  CDS (1)..(819)

SEQ ID NO: 91579 - protein, 272 aa, Acinetobacter sp; identical to SEQ ID NO: 29375

SEQ ID NO: 91580 - DNA, 660 bp, Aquifex aeolicus; identical to SEQ ID NO: 29376
  CDS (1)..(660): transl_table=11

SEQ ID NO: 91581 - protein, 219 aa, Aquifex aeolicus; identical to SEQ ID NO: 29377

SEQ ID NO: 91582 - DNA, 768 bp, Bacillus subtilis; identical to SEQ ID NO: 29378
  CDS (1)..(768): transl_table=11

SEQ ID NO: 91583 - protein, 255 aa, Bacillus subtilis; identical to SEQ ID NO: 29379

SEQ ID NO: 91584 - DNA, 681 bp, Halobacterium sp; identical to SEQ ID NO: 29380
  CDS (1)..(681)

SEQ ID NO: 91585 - protein, 226 aa, Halobacterium sp; identical to SEQ ID NO: 29381

SEQ ID NO: 91586 - DNA, 681 bp, Lactococcus lactis; identical to SEQ ID NO: 29382
  CDS (1)..(681): transl_table=11

SEQ ID NO: 91587 - protein, 226 aa, Lactococcus lactis; identical to SEQ ID NO: 29383

SEQ ID NO: 91588 - DNA, 759 bp, Lactobacillus plantarum; identical to SEQ ID NO: 29384
  CDS (1)..(759): transl_table=11

SEQ ID NO: 91589 - protein, 252 aa, Lactobacillus plantarum; identical to SEQ ID NO: 29385

SEQ ID NO: 91590 - DNA, 759 bp, Listeria innocua; identical to SEQ ID NO: 29386
  CDS (1)..(759): transl_table=11

SEQ ID NO: 91591 - protein, 252 aa, Listeria innocua; identical to SEQ ID NO: 29387

SEQ ID NO: 91592 - DNA, 759 bp, Listeria monocytogenes; identical to SEQ ID NO: 29388
  CDS (1)..(759): transl_table=11

SEQ ID NO: 91593 - protein, 252 aa, Listeria monocytogenes; identical to SEQ ID NO: 29389

SEQ ID NO: 91594 - DNA, 729 bp, Methanosarcina acetivorans; identical to SEQ ID NO: 29390
  CDS (1)..(729): transl_table=11

SEQ ID NO: 91595 - protein, 242 aa, Methanosarcina acetivorans; identical to SEQ ID NO: 29391

SEQ ID NO: 91596 - DNA, 663 bp, Methanococcus jannaschii; identical to SEQ ID NO: 29392
  CDS (1)..(663): transl_table=11

SEQ ID NO: 91597 - protein, 220 aa, Methanococcus jannaschii; identical to SEQ ID NO: 29393

SEQ ID NO: 91598 - DNA, 648 bp, Methanopyrus kandleri; identical to SEQ ID NO: 29394
  CDS (1)..(648): transl_table=11

SEQ ID NO: 91599 - protein, 215 aa, Methanopyrus kandleri; identical to SEQ ID NO: 29395

SEQ ID NO: 91600 - DNA, 729 bp, Methanosarcina mazei; identical to SEQ ID NO: 29396
  CDS (1)..(729): transl_table=11

SEQ ID NO: 91601 - protein, 242 aa, Methanosarcina mazei; identical to SEQ ID NO: 29397

SEQ ID NO: 91602 - DNA, 666 bp, Methanobacterium thermoautotrophicum; identical to SEQ ID NO: 29398
  CDS (1)..(666): transl_table=11

SEQ ID NO: 91603 - protein, 221 aa, Methanobacterium thermoautotrophicum; identical to SEQ ID NO: 29399

SEQ ID NO: 91604 - DNA, 648 bp, Pyrococcus abyssi; identical to SEQ ID NO: 29400
  CDS (1)..(648): transl_table=11

SEQ ID NO: 91605 - protein, 215 aa, Pyrococcus abyssi; identical to SEQ ID NO: 29401

SEQ ID NO: 91606 - DNA, 906 bp, Pyrobaculum aerophilum; identical to SEQ ID NO: 29402
  CDS (1)..(906): transl_table=11

SEQ ID NO: 91607 - protein, 301 aa, Pyrobaculum aerophilum; identical to SEQ ID NO: 29403

SEQ ID NO: 91608 - DNA, 654 bp, Pyrococcus furiosus; identical to SEQ ID NO: 29404
  CDS (1)..(654): transl_table=11

SEQ ID NO: 91609 - protein, 217 aa, Pyrococcus furiosus; identical to SEQ ID NO: 29405

SEQ ID NO: 91610 - DNA, 759 bp, Salmonella enteritidis; identical to SEQ ID NO: 29406
  CDS (1)..(759): transl_table=11

SEQ ID NO: 91611 - protein, 252 aa, Salmonella enteritidis; identical to SEQ ID NO: 29407

SEQ ID NO: 91612 - DNA, 759 bp, Salmonella typhi; identical to SEQ ID NO: 29408
  CDS (1)..(759): transl_table=11

SEQ ID NO: 91613 - protein, 252 aa, Salmonella typhi; identical to SEQ ID NO: 29409

SEQ ID NO: 91614 - DNA, 759 bp, Shigella dysenteriae; identical to SEQ ID NO: 29410
  CDS (1)..(759): transl_table=11

SEQ ID NO: 91615 - protein, 252 aa, Shigella dysenteriae; identical to SEQ ID NO: 29411

SEQ ID NO: 91616 - DNA, 717 bp, Staphylococcus aureus; identical to SEQ ID NO: 29412
  CDS (1)..(717): transl_table=11

SEQ ID NO: 91617 - protein, 238 aa, Staphylococcus aureus; identical to SEQ ID NO: 29413

SEQ ID NO: 91618 - DNA, 717 bp, Staphylococcus aureus; identical to SEQ ID NO: 29414
  CDS (1)..(717): transl_table=11

SEQ ID NO: 91619 - protein, 238 aa, Staphylococcus aureus; identical to SEQ ID NO: 29415

SEQ ID NO: 91620 - DNA, 717 bp, Staphylococcus epidermidis; identical to SEQ ID NO: 29416
  CDS (1)..(717): transl_table=11

SEQ ID NO: 91621 - protein, 238 aa, Staphylococcus epidermidis; identical to SEQ ID NO: 29417

SEQ ID NO: 91622 - DNA, 687 bp, Streptococcus pyogenes; identical to SEQ ID NO: 29418
  CDS (1)..(687): transl_table=11

SEQ ID NO: 91623 - protein, 228 aa, Streptococcus pyogenes; identical to SEQ ID NO: 29419

SEQ ID NO: 91624 - DNA, 678 bp, Streptococcus pneumoniae; identical to SEQ ID NO: 29420
  CDS (1)..(678): transl_table=11

SEQ ID NO: 91625 - protein, 225 aa, Streptococcus pneumoniae; identical to SEQ ID NO: 29421

SEQ ID NO: 91626 - DNA, 762 bp, Enterococcus faecalis; identical to SEQ ID NO: 29422
  CDS (1)..(762): transl_table=11

SEQ ID NO: 91627 - protein, 253 aa, Enterococcus faecalis; identical to SEQ ID NO: 29423

SEQ ID NO: 91628 - DNA, 26 bp, Primer
atgaaaaccgtaactgtaaaagatct

SEQ ID NO: 91629 - DNA, 27 bp, Primer
ttatgcctggtgtaaaatagttaatac

SEQ ID NO: 91630 - protein, 163 aa, consensus; identical to SEQ ID NO: 29426
  MISC_FEATURE (1)..(163): consensus for the disclosure of xaa see table XV

SEQ ID NO: 91631 - protein, 8 aa, consensus
  MISC_FEATURE (1)..(8): consensus for the disclosure of xaa see table XV
XXXEXRXD

SEQ ID NO: 91632 - protein, 37 aa, consensus; identical to SEQ ID NO: 29428
  MISC_FEATURE (1)..(37): consensus for the disclosure of xaa see table XV

SEQ ID NO: 91633 - protein, 47 aa, consensus; identical to SEQ ID NO: 29429
  MISC_FEATURE (1)..(47): consensus for the disclosure of xaa see table XV

SEQ ID NO: 91634 - protein, 42 aa, consensus; identical to SEQ ID NO: 29430
  MISC_FEATURE (1)..(42): consensus for the disclosure of xaa see table XV

SEQ ID NO: 91635 - DNA, 2374 bp, Escherichia coli K12
  CDS (86)..(2281)
ctgcaggacaacagtaaaatcagagcgtttctgcttttactgatgtctggcggtcggagctggtgaccagtttgacccatatctcatggggcagggttttccaccttgtccggtattcttacttccccgaaacgggtttgcgcttatgaaatcaatgaatattgccgccagtagtgaactggtatcccgactttcttctcatcgtcgcgtggtggcgttgggagatactgattttacggacgtcgcggcagtcgtcattaccgctgcggatagtcgcagtggcattcttgcgttgcttaagcgcaccggttttcatctaccggtgtttttgtattccgaacatgctgttgaattacctgcgggcgttacggcggtaatcaacggcaacgagcagcagtggctggagctggaatccgcagcctgtcagtatgaagagaatttgctgccaccgttttatgacacgctgacgcagtacgttgagatgggcaacagcacctttgcttgccctggacatcaacatggtgcgttttttaaaaagcatcctgccggacgccatttttacgatttctttggtgagaacgtctttcgcgccgatatgtgtaacgctgacgtaaaattgggcgatctgcttattcatgaaggatcggcgaaagatgcgcagaaattcgcagccaaagtctttcatgccgataaaacctattttgtgctgaacggcacatcggcagcgaataaagtggtgacgaatgcgctgttaacgcgtggcgatctggtgctcttcgaccgtaacaaccataagtcgaatcatcacggcgcgctgattcaggcgggggcgacgccggtctatctggaagcttcacgcaacccgtttggtttcattggcggtattgatgcgcactgttttaatgaagagtatctgcgccagcaaattcgcgacgttgcgccagaaaaagccgacctgccgcgcccgtatcgcctggcgattattcagctgggaacctatgacggcactgtctataacgcccgtcaggtgatcgataccgttgggcatctgtgtgattacattctgtttgattccgcgtgggtcggttatgaacaatttatcccgatgatggcggatagctcgccgctgctgttagaacttaacgaaaacgatccggggatctttgtgactcagtcggtgcacaaacagcaggcgggattctcacagacgtcgcagatccataaaaaagataaccatatccgcggacaggcgcgtttttgcccgcataagcggttgaataacgcctttatgctccatgcttctaccagccctttctatccgctgtttgctgcactggatgttaacgccaaaattcatgaaggggagagtgggcgtcggctgtgggctgagtgtgttgagatagggattgaagcgcgcaaggctattcttgcgcgctgtaagctgttccgcccgtttatcccgcccgttgttgatggcaaattgtggcaggattatccgacatcagtgttagccagcgaccgccgttttttcagttttgagccgggggcgaagtggcacggctttgaaggatatgccgcggatcagtattttgttgatccgtgcaagctgttactcactacaccaggtatcgatgccgaaaccggcgaatatagcgactttggcgttccggcgacgattctggcgcactatctgcgtgagaacggcattgtgccggagaagtgcgatctcaactccattctgtttttattaactccggcggaaagccacgagaagctggcacaactggtggcgatgctggcgcaatttgaacagcatattgaggatgactcgccgctggttgaggtgttgccgagcgtttataacaagtatccggtgcgctatcgcgactacaccctgcgccagttgtgtcaggagatgcacgatctgtatgtcagtttcgacgtcaaagacctacaaaaagcgatgttccgccagcagagtttcccgtcagtggtgatgaacccccaggatgcgcatagcgcttatattcgcggtgacgtggagttggtgcggattcgtgatgccgaagggcgaattgcggcagaaggggcgttgccttatccacctggcgtgctttgcgtggtacccggggaagtctggggtggggcggttcaacgttatttccttgcactggaagaaggggtgaatttgttgccgggattttcgccggagctgcaaggtgtttatagcgaaaccgatgcggatggcgtgaaacggttgtacggttatgtgttgaagtaagaataaaaaaaacgggtcaccttctggcgacccgtttttctttgcgtaattagtggctaaccgtctgtgtgcctgtcgggacacgaacgtgtt

SEQ ID NO: 91636 - protein, 731 aa, Escherichia coli K12; identical to SEQ ID NO: 797

SEQ ID NO: 91637 - DNA, 2961 bp, Hafnia alvei
  CDS (185)..(2404)
gatcatcctgatgttctactctcgtaagatgggtagaaaccaagagaagttaaccacgccgacggatcgtcagtcttaatccactcaaccattaacacgcaagttggtaacagcacacagcacagaggatgaatttccgcctctgtgctaataacccagcccacacaagtctggagagttttgcatgaatatcattgccatcatgaacgatttaagcgcttattttaaggaagaacccctgcgcgagctgcatcaagagttagagaaggaaggcttccgtattgcttatcccaaagaccgcaacgatctgctgaagctgattgaaaacaactcccgcctgtgtggcgtcattttcgactgggataaatataacctcgaactcagcgctgaaatcagcgagctcaacaaactgctgccaatttatgccttcgccaatacctattcgacgcttgacgtcaacatgagcgacctgcgtcttaatgttcgcttctttgaatatgcattaggcagcgcgcaagacattgccaccaagatccgccaaagcaccgatcagtatattgataccattctgccaccgctgaccaaggcgctgttcaaatacgtcaaagaagagaaatacacagtctgtacgccggggcatatgggcggaactgcgttcgataaaagccctgtcggtagcctgttctatgatttcttcggtgaaaacaccatgcgttcggatatctcgatctccgtatctgagctcggatcgctgctcgatcatagcggcccacaccgtgacgccgaagagtatatcgcgcgcacgttcaacgccgatcgcagctatatcgtaaccaacggaacatctacggcgaataaaattgtcggcatgtattcatctcctgccggtgccactattctgatagaccgtaactgccataaatcattgacccatttgatgatgatgagcaacgttgtccccgtctatctgcgcccaacccgtaacgcctacggcattttaggcgggataccgcaaagcgagttcacccgcgccagcattgaagagaaagtgaaaaatacgcccaatgcgacatggccggtgcatgcggtagtcaccaactctacctatgacggcctgttctacaataccgaatacatcaaaaacacgcttgatgttaagtcgattcacttcgattcggcatgggtgccttacaccaacttccatccgatttaccaaggcaaagcagggatgagcggtgaacgtgtgccggggaaaatcatctacgagactcagtccacccacaaactgctggcggcattctcgcaggcatcgatgatccacgtgaaaggtgagatcaacgaagaaaccttcaatgaagcctatatgatgcatacctcaacatcaccgcattacgggatcgttgcgtcgacggaaaccgcggcggctatgatgaagggcaacgccggtaagcgtttaattaacggttcaattgaacgagcgatccgcttccgtaaagagatccgccgcttacgtacagaatctgatggctggttctttgacgtatggcagccggataacattgacgaggttgcttgctggccactcaatccacgtaatgaatggcatggattcccgaacatcgacaacgatcatatgtatcttgatccgatcaaagtcactctgctgaccccaggtttaagccccaatggcactctggaagaggaagggataccggcgtcgatcgtgtcgaaatatctggatgagcacggcatcatcgtggaaaaaaccgggccatataacctgctcttcctgtttagtatcgggatcgataaaaccaaggcgttgagcttgttgcgggcattaaccgatttcaaacgcgtgtatgacctcaacctgcgcgtgaaaaacgtgttgccatcgctctataacgaggcgcctgatttctataaagagatgcgaattcaggagttggctcaggggattcatgctctggtgaaacaccacaatctaccagacctgatgtatcgtgcatttgaggtattaccaaagctggtgatgacgccgcatgatgcgttccaagaagaagtgcgtggcaatattgagccatgtgccttggatgatatgttagggaaagttagcgccaacatgatcttgccgtatcctccgggtgttccggtggttatgccgggagaaatgctcactaaggagagccgccctgttctgagcttcttgcagatgctatgtgaaattggcgcacactatccgggctttgaaacggatattcacggcgttcatcgtgatggtgcaacgggtaaatacatggtcgtggtgctcaaacaaggcgcagatgaaccgggtgataaaccgagtgatacggtgaagaaagcgccgggtaaaaaaccatcagcggcgaagaagtcataacggcgagaagttacaggtaacgcttatcccctgagtgataggttcttgtcatgatggggataaagcgggtgcctgagagccaaccatgcatgaaaacaatttgagaagactgggaaggttaggcgccatcccagtctgattttgccgttacatattgccgttacaacgcgtgcttatcttcgtagtttaagaacgcggcaacctctgtttttccctgcttaattcgtagctcacacagcgaaccacgtaccatccaggtaaagatcaatagcgtaaaacacatcactattaatccgtaaagcaacagcttacgcgacatcaaagcctccaattgcattgctgcattgaagaggctatcctcacattgttcagatgtggttaggattgcctcaggttaatgtaagttgacctggggcttttactttctgcctcaccacatatttcatgctcaaggcaaaaagcctcaagcacccgccgtgattctatccaaacaatgcttagctatcgcgcgtctattgccgttacatcagagttgcttgaataactgcaaaacgctt

SEQ ID NO: 91638 - protein, 739 aa, Hafnia alvei; identical to SEQ ID NO: 289

SEQ ID NO: 91639 - DNA, 4341 bp, Escherichia coli
  CDS (660)..(2858)
ggatcccgcccgcccacgccatttcattactgaaaccggtattggctatcggtttatgctttgaatattaattttaatacagcctgccttttattaattaaagccgtaataataaatacggctttttatcttaaacaacacacaaaaataacaattcaatattttatattactgagtaaaaagctcatcattaaataaattaagattgatcattttttattgatcaccttcacagttcaaccgtatttcctggatagaatatcttcaccttcattcacatcaggaaaggtaaattaaatggaaaataacagccgcactatgccccatataaggcggacaactcatattatgaagtttgctcatcgcaatagcttcgactttcacttcttcaatgcccgttagtctaccgactaagggcacttcagcgtacaggtcttcctgactctctgtattacaggcatatgcctgtattccgcagtgctcattctctgttaacccttgtattatcagccacctgactggtaagggtttctgcattctgaaaaaagcaatctacctgatttatttatcagcggggtaactttgcttttttccggcacgatcgatttctcattcgagaaattgaggacctgctattacctaaaataaagagatgaaaaatgtcaaaattaaaaattgcggttagtgattcttgcccggactgttttaccacgcagcgagaatgtatctacattaatgaaagtcgtaatatcgatgtggcggcaatagttttatcgctcaacgatgttacatgcggaaaactcgatgaaatcgatgccacgggttatggcatcccggtatttattgctactgaaaatcaagaacgtgtacccgcagagtatttgccccgtatttcgggtgtctttgagaattgcgaatcgcgacgagaattttatggtcgccagttagaaaccgctgccagccattatgaaactcaactgcgcccacctttcttccgcgcactggtcgattatgtcaatcaaggtaacagcgcgtttgattgccctggtcatcagggcggcgaatttttccgtcgccatccggcggggaatcagtttgtggaatactttggtgaggcgctgttccgtgccgacttgtgcaacgccgacgtagcgatgggcgatctgctgattcacgaaggcgcgccatgcattgcacagcaacatgcggcaaaagtgtttaatgccgataaaacctacttcgttttaaatggcacttcatcttctaacaaagtggttttaaacgccctgctaacaccgggtgatctggtgctgtttgatcgcaataaccacaaatctaaccaccacggagcgttgctacaggctggtgcaacaccggtttatctggaaacggcacgtaacccgtatggctttatcggtggcattgatgcgcactgttttgaagaaagttacctgcgtgagctgatcgcggaagtcgcaccgcagcgggcaaaagaggctcgtcctttccgcctcgctgtgattcagttaggcacctacgacggtacgatttataacgcccgccaagtggtggataaaattggtcatctgtgtgactacatcctgtttgactcagcatgggtcggctatgaacagtttattccgatgatggcggactgttcgccgctgttgctggatcttaatgagaacgatccgggtattctggttacgcaatctgtgcataaacaacaggctggtttttctcagacttcacaaattcataaaaaagacagccacatcaaagggcaacagcgttatgtaccgcacaaacgcatgaacaacgcctttatgatgcacgcctccaccagcccgttctatccgctgtttgccgcactgaatatcaacgccaaaatgcatgaaggtgtcagcggtcgtaatatgtggatggattgtgtggtaaatggcattaatgcccgcaaactgatcctcgataactgtcagcatattcgtccgttcgtacctgaactggtggatggtaaaccctggcagtcgtatgaaacagcgcaaattgcggttgatctgcgcttcttccagtttgtaccaggggaacactggcattcttttgaaggctatgcagagaatcaatactttgtcgatccatgcaaactgttgctgacaaccccaggtattgatgcacgtaacggcgaatatgaagcgttcggtgtacccgcgacgattcttgctaacttcctgcgcgaaaatggcgtagtgccggaaaaatgcgatcttaactccatcctcttcctgctgactccggcagaagatatggccaaacttcagcaacttgttgccctgctggtacgcttcgaaaaactgcttgagtccgacgcgccattagcagaagtgctaccttccatctacaaacagcatgaagagcgctacgccggttataccctgcgtcagttgtgtcaggaaatgcatgatttgtatgcccgccacaacgtgaaacaactgcaaaaagagatgttccgtaaggagcacttcccacgcgtcagcatgaatccgcaagaagccaactacgcctatttacgcggtgaagtggaactggttcgtctgccggatgcagaaggccgtatcgctgccgaaggtgcgcttccttatcctccgggtgtgctgtgtgttgttccgggtgaaatctggggtggtgctgttctgcgttacttcagcgctctggaagaagggatcaacctgctgccaggttttgcaccggagctgcagggtgtctatatcgaagaacatgatggtcgtaagcaagtttggtgctatgtcatcaagcctcgtgatgcgcaaagcaccctgttgaaaggggaaaaattatgagtcaggctaaatcgaacaaaatgggcgtcgttcagttaaccatactgacgatggtcaacatgatgggctccggtatcatcatgctgccgacaaagcttgccgaagtcgggacaatctcaattatctcctggctggtgacagccgtaggctcaatggcactggcatgggcattcgcaaaatgcggtatgttcagccgtaaatcaggcggtatgggcggttatgccgagtatgctttcggtaaatccggtaactttatggcgaactatacctacggcgtctcactgctgattgctaacgtcgcgattgctatttcggcggttggttacggcaccgaactgctcggcgcgagtttgtcgccagtgcagattggtcttgcgaccatcggggtgctgtggatttgtaccgtggctaactttggtggtgcgcgcattaccgggcaaatcagtagcattaccgtgtggggggtcattattccggtcgtcggtctgtgcattattggctggttctggtttagcccgacgctgtacgttgattcctggaatccgcatcatgcaccgttcttcagtgcggtaggttcttccatcgctatgacgctgtgggcttttcttggtctggagtctgcgtgtgcgaatactgatgtagtggaaaacccggaacgtaatgtgccaatcgcggtactcggcggtacgttaggtgcggcggtgatttatatcgtctccaccaacgtgattgccgggattgtgccaaatatggagctggcaaattcaacggcaccatttggtctggccttcgcgcagatgttcacgccggaagtgggtaaagtcattatggcgctgatggtgatgtcctgctgcggttcgctacttggctggcagttcaccattgcccaggtgtttaaatcttcatctgatgaaggctacttccctaaaattttctcccgtgtaaccaaagtggatgcaccggtgcagggaatgttgaccattgtgattattcagagtggattggcactgatgaccattagcccgtcgctaaacagtcagttcaacgtgctggttaacctggccgtggtgaccaatatcattccgtatattctgtcaatggcggcattagtcattattcagaaggtcgctaatgtgcccccctcaaaagcgaaagttgcaaactttgttgcttttgttggcgcgatgtatagcttttatgcgctgtactcatccggggaagaagccatgctgtacggttccatcgtgaccttccttggttggacactgtatggtctggtatcaccacgctttgaactgaaaaataaacacggttaataaaacaaagtaaaaaagggcgattgaatgatcgccctttctgtttgttggcaaatagttcgttatttatgccgcatccggcagatgtagggtctaaacgcgatcgaacacagcaactatttgcgtaattatatggggcatctgcgacaaaaactggaacaggatcc

SEQ ID NO: 91640 - protein, 732 aa, Escherichia coli; identical to SEQ ID NO: 291

SEQ ID NO: 91641 - DNA, 1850 bp, Bacillus subtilis; identical to SEQ ID NO: 746
  CDS (312)..(1784)

SEQ ID NO: 91642 - protein, 490 aa, Bacillus subtilis; identical to SEQ ID NO: 265

SEQ ID NO: 91643 - DNA, 3091 bp, Lactobacillus sp
  CDS (572)..(2767)
cactgccatataggaacgatgatagtatctcttcatgagtatcgataaatactctgtaaatattaatcatgggcaattagcaccttctcattgaatatagtaatattaactattaataacagattatgattaatataatatgaacatacctaagtgtcccttccgttcaagcacttagacggtaaattacaacattcgcttacaacttctattaaatcgaaaaagttaatatttcatatataaacagtaattagttatattgatccacaaagccccctagtttccgcaataaattccgatccgccttttttatacacattctcattattgtctcagttgcaaacattccctttttcacttttaaagtaaccgttacctttacttatacgtcggcgtttgttcccattaatttttagttctatttttttattcttttaaagaaaaataaggatgattccgccttgattaaaatcaataatggtttatactagattatgtattcaagttgaattcggttacatcacatagtgtgttgtaattacggatttacatatttttaggaggttttatgatgagttcttctcttaaaattgcttcgactcaagaagcgcgtcaatatttcgatactgaccgcgttgttgtcgatgctgtaggctctgattttactgatgtcggtgctgttatcgcaatggattacgaaacagatgtcatcgacgctgctgatgcaactaagtttggtattcctgtttttgccgtaactaaggatgcccaagctatcagtgctgatgagctgaagaagattttccacatcattgatttggaaaacaaatttgatgctactgttaacgctcgtgaaatcgaaactgctgttaacaactacgaagacagcattttaccaccattcttcaagtcattgaaagaatacgttagccgtggtttaatccaattcgactgcccaggtcaccaaggtggtcaatactacagaaagcacccagctggtcgtgaattctacgacttcttcggcgaaactgtcttccgtgcagacttatgtaacgctgacgttgccttgggtgacttgctgatccacgaaggtcctgctgttgctgctgaaaagcatgctgcacgtgtttacaacgctgacaagacttacttcgttttaggtggttcttccaacgctaacaacactgtaacatctgctttagtttctaacggcgacttggtattgttcgaccggaacaaccacaagtccgtttacaactcagctttagctatggctggtggccgtcctgtttacctccaaacaaaccgtaacccatacggcttcatcggtggtatctacgacagcgacttcgatgaaaagaagatccgtgaactggcagctaaggttgacccagaacgtgctaagtggaagcgtccattccgtctggctgttatccaattaggtacttacgatggtactatctacaacgcacacgaagttgtaaagcgtatcggtcacctttgtgattacatcgaattcgactctgcttgggtaggttacgaacaattcattcctatgatgcgtaactcttcaccattattgattgatgaccttggtccagaagatcctggtatcattgttgttcaatcagttcacaagcaacaagccggcttctcacaaacttcacaaatccacaagaaggatagccacatcaagggtcaattacgttactgtgaccacaagcactttaacaactccttcaacttgttcatgtctacttcaccattctacccaatgtatgcagcattagacgttaacgctgctatgcaagaaggcgaagcaggtcgcaagttatggcatgaccttctgattactaccattgaagctcgtaagaagttgatcaaggctggctcaatgttccgtccattcgttccacctgttgttaacggcaagaagtgggaagatggcgacactgaagatatggctaacaacattgactactggcgctttgaaaagggtgctaagtggcatgcttacgaaggctacggcgacaaccaatactacgttgatccaaacaagttcatgttaactacacctggtatcaacccagaaactggtgactacgaagacttcggtgttccagctactatcgttgctaactacttacgtgaccacggtatcatccctgaaaagtctgacttgaactctatcttgttcttgatgactccagctgaaactccagctaagatgaacaacctgatcactcaacttcttcaattacaacgcttgatcgaagaagatgctccattgaagcaagttcttccttcaatctacgctgctaacgaagaacgttacaatggctacactatccgtgaactttgccaagaattgcacgacttctacaagaacaacaacacgttcacataccagaagcgtctcttcttacgtgaattcttcccagaacaaggtatgcttccatacgaagctcgtcaagaattcatccgcaaccacaacaagcttgttccattgaacaagatcgaaggcgaaatcgccctcgaaggtgctcttccataccctccaggagtattctgtgtagcaccaggtgaaaagtggtcagaaactgctgttaagtacttcactatcttacaagatggtatcaacaacttccctggattcgctccagaaatccaaggtgtatacttcaagcaagaaggcgacaaggttgttgcttacggtgaagtttacgatgcagaagttgctaagaacgatgatcgttacaacaactaataactgcattgcctgattaacaggcaggaaaaaaccggcgttatgccggttttttgttgcacaatttttcttttttaacttgattgtcaataagtaagttttatccatagtagttccatagctattgaactattaaaccaagaccaatatccgtgcaaattttaaggacctggcagaagttaacgagttagatactccttgatctctacacactacggagctcactcattgtggagattaaggttcctaacataggtagtacaccttccgatcactaaatctaacaggacgaggatatatgcagattcctcgaatccggttcca

SEQ ID NO: 91644 - protein, 731 aa, Lactobacillus sp; identical to SEQ ID NO: 415

SEQ ID NO: 91645 - DNA, 1449 bp, Bacillus halodurans; identical to SEQ ID NO: 748
  CDS (1)..(1449)

SEQ ID NO: 91646 - protein, 482 aa, Bacillus halodurans; identical to SEQ ID NO: 271

SEQ ID NO: 91647 - DNA, 2196 bp, Sinorhizobium meliloti; identical to SEQ ID NO: 750
  CDS (1)..(2196)

SEQ ID NO: 91648 - protein, 731 aa, Sinorhizobium meliloti; identical to SEQ ID NO: 297

SEQ ID NO: 91649 - DNA, 1380 bp, Listeria innocua; identical to SEQ ID NO: 282
  CDS (1)..(1380)

SEQ ID NO: 91650 - protein, 459 aa, Listeria innocua; identical to SEQ ID NO: 283

SEQ ID NO: 91651 - DNA, 2307 bp, Yersinia pestis; identical to SEQ ID NO: 302
  CDS (1)..(2307)

SEQ ID NO: 91652 - protein, 768 aa, Yersinia pestis; identical to SEQ ID NO: 303

SEQ ID NO: 91653 - DNA, 2145 bp, Salmonella enterica subsp. enterica serovar Typhi
  CDS (1)..(2145)
atgaacgttattgctatcatgaaccacatgggcgtctactttaaagaagagcctattcgtgaactgcatcgtgcactggaaggtttaaatttccgtatcgtctatccaaacgaccgagaagacctgctgaagctgattgaaaataactcccgcctttgcggcgtcattttcgactgggataaatataaccttgagctttgcgaagagattagcaagctgaacgagtatatgccgctgtacgccttcgccaacagctactctacgctggacgtcagcctcaacgatctgagaatgcaggttcgcttctttgaatatgctttaggcgccgcagccgatatcgcggcgaaaattcgccagaataccgatgaatacatcgacaatattctgccgccgctgacaaaagcgctgttcaaatatgtgcgcgaagggaaatatactttctgtacgcctggccacatgggcgggaccgctttccagaaaagccccgtcggcagcatcttttatgatttcttcggcccgaacacgatgaaatccgatatttcgatttccgtttctgaactgggttcgctgctggaccactccggcccgcataaagaagcggaagagtatatcgcccgcgtctttaacgccgaacgtagctacatggtgacgaacggcacctctacggcgaacaaaatcgtcggtatgtactccgcgccggcaggcagcacggtactgattgaccgtaactgccataaatcgctgacccatctgatgatgatgagcgacattacgccgatttatttccgcccaacccgtaacgcctacggtattcttggcggtattccgcaaagcgagttccagcacgccactatcgctaaacgggtaaaagagacgcctaacgcaacctggccggtccatgctgttattactaactcaacctatgacggtctgttgtataacactgactacatcaagaaaactctggatgtgaagtccattcattttgactccgcctgggtgccttataccaatttctcccctatttatcagggtaaatgcggtatgagcggcgaccgtgtggaaggcaaaatcatttatgaaacccagtccacgcataaactgctggcggcgttttcacaggcatccatgattcatgttaaaggcgacattaacgaagaaacctttaacgaagcctacatgatgcataccaccacttctccgcactacggtatcgtagcgtctactgaaaccgcagcggcgatgatgaaaggtaatgcgggtaaacgcctgattaacggctctattgaacgtgcgattaaattccgtaaagaaattaaacgcctgaaaagcgaatctgacggctggttctttgacgtatggcagccggaacatatcgatggagctgagtgctggccgctgcgttcagatagcgcatggcatggcttcaaaaatatcgataacgaacacatgtacctcgacccgatcaaagtcactatcctgacgccggggatgaagaaagacggtacgatggatgagttcggtattccggcaagtctggtcgccaaatatctcgatgaacgcggcatcatcgtagaaaaaaccggtccatacaacctgctgttcctgttcagcattggtatcgacaaaaccaaagctctgagcctgctgcgcgcgctcactgaatttaaacgcgcctttgacctgaacctgcgcgtcaaaaacattctgccggcactgtaccgcgaagcgcctgagttttatgaaaatatgcgcatccaggaactggcgcagaatattcataaactggtcgaacatcataatctgccggacttaatgtaccgtgcgtttgaagtgctgccgaaaatggtgatgacgccgtatactgcgttccagaaagagctgcatggcgaaacggaagaggtgtatcttgaagagatggttggacgcgtcaacgccaacatgatccttccttaccctccgggagtgccgctggtgatgcctggtgaaatgatcaccgaggaaagccgtccggtactggaattcctgcaaatgctgtgcgaaatcggcgcccactatccgggcttcgaaaccgatatccacggcgcctatcgtcaggcagacggacgttacaccgttaaggtgctgaaagaaaatacgaaataa

SEQ ID NO: 91654 - protein, 714 aa, Salmonella enterica subsp. enterica serovar Typhi; identical to SEQ ID NO: 305

SEQ ID NO: 91655 - DNA, 1467 bp, Nostoc sp. PCC 7120; identical to SEQ ID NO: 774
  CDS (1)..(1467)

SEQ ID NO: 91656 - protein, 488 aa, Nostoc sp. PCC 7120; identical to SEQ ID NO: 287

SEQ ID NO: 91657 - DNA, 2163 bp, Yersinia pestis; identical to SEQ ID NO: 776
  CDS (1)..(2163)

SEQ ID NO: 91658 - protein, 720 aa, Yersinia pestis; identical to SEQ ID NO: 307

SEQ ID NO: 91659 - DNA, 2271 bp, Salmonella enterica subsp. enterica serovar Typhi; identical to SEQ ID NO: 308
  CDS (1)..(2271)

SEQ ID NO: 91660 - protein, 756 aa, Salmonella enterica subsp. enterica serovar Typhi; identical to SEQ ID NO: 309

SEQ ID NO: 91661 - DNA, 2148 bp, Escherichia coli; identical to SEQ ID NO: 292
  CDS (1)..(2148)

SEQ ID NO: 91662 - protein, 715 aa, Escherichia coli; identical to SEQ ID NO: 293

SEQ ID NO: 91663 - DNA, 2835 bp, Escherichia coli; identical to SEQ ID NO: 740
  CDS (571)..(2712)

SEQ ID NO: 91664 - protein, 713 aa, Escherichia coli; identical to SEQ ID NO: 259

SEQ ID NO: 91665 - DNA, 1446 bp, Clostridium acetobutylicum; identical to SEQ ID NO: 786
  CDS (1)..(1446)

SEQ ID NO: 91666 - protein, 481 aa, Clostridium acetobutylicum; identical to SEQ ID NO: 277

SEQ ID NO: 91667 - DNA, 1464 bp, Clostridium acetobutylicum; identical to SEQ ID NO: 278
  CDS (1)..(1464)

SEQ ID NO: 91668 - protein, 487 aa, Clostridium acetobutylicum; identical to SEQ ID NO: 279

SEQ ID NO: 91669 - DNA, 2256 bp, Pseudomonas aeruginosa; identical to SEQ ID NO: 792
  CDS (1)..(2256)

SEQ ID NO: 91670 - protein, 751 aa, Pseudomonas aeruginosa; identical to SEQ ID NO: 311

SEQ ID NO: 91671 - DNA, 2853 bp, Mycobacterium leprae; identical to SEQ ID NO: 794
  CDS (1)..(2853)

SEQ ID NO: 91672 - protein, 950 aa, Mycobacterium leprae; identical to SEQ ID NO: 319

SEQ ID NO: 91673 - DNA, 2202 bp, Vibrio cholerae; identical to SEQ ID NO: 312
  CDS (1)..(2202)

SEQ ID NO: 91674 - protein, 733 aa, Vibrio cholerae; identical to SEQ ID NO: 313

SEQ ID NO: 91675 - DNA, 2163 bp, Vibrio cholerae; identical to SEQ ID NO: 314
  CDS (1)..(2163)

SEQ ID NO: 91676 - protein, 720 aa, Vibrio cholerae; identical to SEQ ID NO: 315

SEQ ID NO: 91677 - DNA, 2163 bp, Haemophilus influenzae; identical to SEQ ID NO: 294
  CDS (1)..(2163)

SEQ ID NO: 91678 - protein, 720 aa, Haemophilus influenzae; identical to SEQ ID NO: 295

SEQ ID NO: 91679 - DNA, 2844 bp, Mycobacterium tuberculosis; identical to SEQ ID NO: 806
  CDS (1)..(2844)

SEQ ID NO: 91680 - protein, 947 aa, Mycobacterium tuberculosis; identical to SEQ ID NO: 321

SEQ ID NO: 91681 - DNA, 1476 bp, Streptococcus pneumoniae; identical to SEQ ID NO: 808
  CDS (1)..(1476)

SEQ ID NO: 91682 - protein, 491 aa, Streptococcus pneumoniae; identical to SEQ ID NO: 275

SEQ ID NO: 91683 - DNA, 1476 bp, Bacillus halodurans; identical to SEQ ID NO: 268
  CDS (1)..(1476)

SEQ ID NO: 91684 - protein, 491 aa, Bacillus halodurans; identical to SEQ ID NO: 269

SEQ ID NO: 91685 - DNA, 2349 bp, Sinorhizobium meliloti; identical to SEQ ID NO: 316
  CDS (1)..(2349)

SEQ ID NO: 91686 - protein, 782 aa, Sinorhizobium meliloti; identical to SEQ ID NO: 317

SEQ ID NO: 91687 - DNA, 1476 bp, Streptococcus pneumoniae; identical to SEQ ID NO: 814
  CDS (1)..(1476)

SEQ ID NO: 91688 - protein, 491 aa, Streptococcus pneumoniae; identical to SEQ ID NO: 281

SEQ ID NO: 91689 - DNA, 2271 bp, Escherichia coli
  CDS (1)..(2271)
atgatgaaagtattaattgttgaaagcgagtttctccatcaagacacctgggtcggtaacgccgttgagcgtctggcagatgctttaagccagcaaaatgttaccgtgattaaatccacctcctttgatgatggttttgccattctctcttcaaacgaagccattgactgcctgatgttcagctatcaaatggaacatccggacgaacatcaaaacgtcagacaattgatcggtaagcttcatgagcgccaacaaaacgtgccggtcttcctgttgggcgatcgggaaaaagccctcgccgcaatggatcgcgacctgctggagcttgtcgatgaattcgcctggattctggaagataccgccgactttatcgccggacgcgccgttgccgcgatgacccgctaccgccagcagctgttgccgccactgttcagcgcgctgatgaaatatagtgacatccatgaatattcctgggcagcgccaggccaccagggcggcgttggttttaccaaaacacccgccggacgtttctaccatgactactatggtgaaaatctgttccgcaccgacatgggcatcgaacgaacttccctcggttctttgcttgaccatactggcgcatttggcgaaagcgaaaaatatgccgcacgcgtatttggtgccgatcgctcctggtcggtagtcgtcggtacttccggctctaaccgcaccatcatgcaggcttgcatgaccgataacgatgtcgtggtcgttgaccgtaactgccataaatccatcgaacaaggtttgatgctgacaggcgcgaaaccggtctatatggtgccaagccgcaaccgctacggcattatcgggccaatctatccgcaggaaatgcaacctgaaaccttgcagaagaaaatcagtgaaagcccgctgaccaaagacaaagccgggcaaaaaccgtcttactgcgtggtgaccaactgcacctatgacggcgtgtgttataacgctaaagaagcgcaggatctgctggaaaaaacctccgatcgtctgcactttgacgaagcctggtacggctatgcacgtttcaacccgatctatgccgatcactatgccatgcgcggcgaacctggcgatcacaacggtcctaccgttttcgccacccactccacccacaaactgctgaatgcgctgtcacaggcttcttatattcatgtacgtgaaggtcgtggggcgattaacttctcccgcttcaaccaggcctacatgatgcatgccaccacctccccgctgtatgccatctgcgcatccaacgacgtggcggtgtcgatgatggacggcaacagcggcctgtcactgacacaggaagtgattgacgaagcggttgatttccgtcaggcgatggcgcggctatataaagagttcaccgctgacggtagctggttcttcaaaccgtggaacaaagaagtcgtcaccgacccacaaaccggcaaaacctatgactttgctgacgcaccaaccaaactgctgaccaccgttcaggactgctgggtaatgcatccgggcgaaagctggcacggcttcaaagatattccggataactggagtatgctcgacccgattaaagtcagcatccttgctccgggaatgggtgaagatggtgaactggaagaaaccggtgttccggcggcgctggtcactgcctggcttggtcgccacggcattgtacctacccgcaccactgacttccaaattatgttcctgttctctatgggcgtaacccgtgggaaatggggaactctggttaacaccctttgctccttcaaacgccactatgacgccaacacaccgctggcgcaggtgatgccggaacttgttgaacaatatcctgacacttacgcgaacatggggattcacgatctgggtgacaccatgtttgcctggctgaaagaaaacaaccctggcgcacggttgaacgaagcctattccggcctgccggtggcggaagtcaccccgcgtgaagcgtacaacgcgattgtcgacaacaatgtcgaactggtatccattgaaaatctgccaggacgcatcgcggcaaactcagttatcccgtatccgccaggaatcccgatgctgctgtctggtgaaaacttcggcgataaaaacagtccgcaagtaagttatttacgctcgctgcaatcctgggaccaccatttccctggatttgaacacgaaactgaagggactgaaattattgacggtatttaccacgttatgtgcgtgaaagcgtaa

SEQ ID NO: 91690 - protein, 756 aa, Escherichia coli
MMKVLIVESEFLHQDTWVGNAVERLADALSQQNVTVIKSTSFDDGFAILSSNEAIDCLMFSYQMEHPDEHQNVRQLIGKLHERQQNVPVFLLGDREKALAAMDRDLLELVDEFAWILEDTADFIAGRAVAAMTRYRQQLLPPLFSALMKYSDIHEYSWAAPGHQGGVGFTKTPAGRFYHDYYGENLFRTDMGIERTSLGSLLDHTGAFGESEKYAARVFGADRSWSVVVGTSGSNRTIMQACMTDNDVVVVDRNCHKSIEQGLMLTGAKPVYMVPSRNRYGIIGPIYPQEMQPETLQKKISESPLTKDKAGQKPSYCVVTNCTYDGVCYNAKEAQDLLEKTSDRLHFDEAWYGYARFNPIYADHYAMRGEPGDHNGPTVFATHSTHKLLNALSQASYIHVREGRGAINFSRFNQAYMMHATTSPLYAICASNDVAVSMMDGNSGLSLTQEVIDEAVDFRQAMARLYKEFTADGSWFFKPWNKEVVTDPQTGKTYDFADAPTKLLTTVQDCWVMHPGESWHGFKDIPDNWSMLDPIKVSILAPGMGEDGELEETGVPAALVTAWLGRHGIVPTRTTDFQIMFLFSMGVTRGKWGTLVNTLCSFKRHYDANTPLAQVMPELVEQYPDTYANMGIHDLGDTMFAWLKENNPGARLNEAYSGLPVAEVTPREAYNAIVDNNVELVSIENLPGRIAANSVIPYPPGIPMLLSGENFGDKNSPQVSYLRSLQSWDHHFPGFEHETEGTEIIDGIYHVMCVKA

SEQ ID NO: 91691 - DNA, 1443 bp, Bacillus subtilis; identical to SEQ ID NO: 892
  CDS (1)..(1443)

SEQ ID NO: 91692 - protein, 480 aa, Bacillus subtilis; identical to SEQ ID NO: 273

SEQ ID NO: 91693 - DNA, 1452 bp, Synechocystis sp; identical to SEQ ID NO: 266
  CDS (1)..(1452)

SEQ ID NO: 91694 - protein, 483 aa, Synechocystis sp; identical to SEQ ID NO: 267

SEQ ID NO: 91695 - DNA, 2307 bp, Yersinia pseudotuberculosis IP 32953
  CDS (1)..(2307)
atgattgatttaagcagtcacaagaaacgcaacgttttagtggttgacagcaatattcgtgatatcaataccgctaatggtcgggcggtaaacgaacttatcattgcgcttaatgacattaattttaatgtgattgcggcggcgacgtttgaagatggcgcggcaacagtgatctccgactcttcgttgtgctgtatttttgtcgattggacttcgggtggtaatgatgatgaatcccatagtcaggcatttgcattgctacaagacattcgtcgccgtaataaatcagtgcctgtgttattgatggctgagcattcatgtatcaatagcttaagtttggagaccatgcagcttgttaatgaatttgtttggatgcatgaagatacctccgagtttatcgctgctcgtgccaaagcactcatcatcaagtattaccagcagttgctgccgccttttacgcaagcgctgtttcaatatacgcaagataatcctgaatattcatgggctgcccccggtcatcaagggggcgttgccttcagtaagacggcggttggacgcgagtttcttgatttctttggcgagaatctatttcgtacggatactggtattgaacgtgagtcattgggatctttactggatcacagtgggccgataaaagagtcagaagcgtatgccgcacaagtttttggtgcacatgcaagttactcgatgcttaatggcacatcgggctctaatcgcgccattatggccgctgtcgtgggagataagcagatcgcattgtgtgatcgtaactgtcataaatccattgagcagggattggtcctgtcgggtgcattaccggtattttttattccaacccgtaaccgctatggcattattggaccaattcctaaagcacaattccaacccacggctattgcacaaaaaattgaacaaaaccccttaaagtcattggcttgtgatagcaagcccgtctatgcagttatcacgaattgtacctatgacggtatgtgctataacgcccaacaggcacaggatttattggcaaaaagtgttgatcagattcatttcgacgaagcttggtacgcctatgcccgttttaatcccctttatcgggagcgttttgcgatgcgtggtgacccggctgaccatgatgcgctgggaccaactatttttgctacacaatcaacgcataaattattggcagcgctgtcgcaagcttcttatattcatgtgagaaatggcaaaaagccgatagaacattcgcggtttaatgagtcgtatatgttgcagtcaaccacttcgccattgtacgccattattgctgccaatgaagtgggggcggcgatgatggaaggcgggcaggggctagcattgacacaagaggtgatcgatgaagctgttgattttcggttggcgctggctcgtgcacatgatgcttttgcaaaacaaggcgaatggttctttaaaccttggaatacaccggaaataacggatagcaaaagcggtaaaaagttacctttctcccaagcatcacgagagcaactgacaaccgatcccgcctgttgggttctcaagccgggagacccgtggcatggtttcgagcagttggaagaagattggtgcatgttggatccgatcaaggccgggattatggtgccgggaatgggggatgacggtaagttgtcagaaaagggaattcccgcagcgatagtgaccgccttccttgggcagcggggaattgtaccgtcgcggaccacggattttatggtgctgtgcttgttttcggtgggtgtaacgaaaggtaaatggggcacactcattaatgtgttactggaatttaagcagcactacgatagcaatacaccgatatcggtgtgcctacctgacttggcgaaaaattatcctcatcaatacgctcataaggggttaaaagtgttgtgtgatgagatgtttgcttatatgaagatcagtgaaatggataaactgcaagctgaggcatttagccatttgcctacgccagtggtcttaccccgtcaggcttttcaagatcatatggctgggcggtgtgagctactacctatcgataagctcgctgggcgtgttaccgctgtcggggttattccatatccgccgggcatcccaattgtcatgccgggggagagttttggtagccatgaagaaccatggctacgttatatcttaagtatcaccaaatggggtcagcattttcccggcttcgagaagatcttggaagggtccgagcagaagaatgggcaatattttatttgggtactaaagcagtaa

SEQ ID NO: 91696 - protein, 768 aa, Yersinia pseudotuberculosis IP 32953
MIDLSSHKKRNVLVVDSNIRDINTANGRAVNELIIALNDINFNVIAAATFEDGAATVISDSSLCCIFVDWTSGGNDDESHSQAFALLQDIRRRNKSVPVLLMAEHSCINSLSLETMQLVNEFVWMHEDTSEFIAARAKALIIKYYQQLLPPFTQALFQYTQDNPEYSWAAPGHQGGVAFSKTAVGREFLDFFGENLFRTDTGIERESLGSLLDHSGPIKESEAYAAQVFGAHASYSMLNGTSGSNRAIMAAVVGDKQIALCDRNCHKSIEQGLVLSGALPVFFIPTRNRYGIIGPIPKAQFQPTAIAQKIEQNPLKSLACDSKPVYAVITNCTYDGMCYNAQQAQDLLAKSVDQIHFDEAWYAYARFNPLYRERFAMRGDPADHDALGPTIFATQSTHKLLAALSQASYIHVRNGKKPIEHSRFNESYMLQSTTSPLYAIIAANEVGAAMMEGGQGLALTQEVIDEAVDFRLALARAHDAFAKQGEWFFKPWNTPEITDSKSGKKLPFSQASREQLTTDPACWVLKPGDPWHGFEQLEEDWCMLDPIKAGIMVPGMGDDGKLSEKGIPAAIVTAFLGQRGIVPSRTTDFMVLCLFSVGVTKGKWGTLINVLLEFKQHYDSNTPISVCLPDLAKNYPHQYAHKGLKVLCDEMFAYMKISEMDKLQAEAFSHLPTPVVLPRQAFQDHMAGRCELLPIDKLAGRVTAVGVIPYPPGIPIVMPGESFGSHEEPWLRYILSITKWGQHFPGFEKILEGSEQKNGQYFIWVLKQ

SEQ ID NO: 91697 - DNA, 1467 bp, Symbiobacterium thermophilum
  CDS (1)..(1467)
atgaatcagcacgagactccgctgttcaccgggctggtgcggcacgccgagcgcaatccgatccagtttcacattcccggccacaagaagggcacagggatggcgccggaattccgcgcgtacatcggcgagcgcgcactggccattgacctgatcaacatcgcgccgctcgacgacctgcacaacccccacggcatcatccgggaggcgcaggccctggccgccgaggccttcggggcggaccactccttcttcagcgtccagggcaccagcggagcgatcatcgcgatgatcatgaccgtctgcggccccggcgacaagattctggtcccccgcaacgtgcacaagtcggtcctcaccggcattgtgctgtcgggggccctgcccatattcatgaaccccgacctggactacgagctgggcatcgcccatggggtgagcctggaggcggtgcgccacgccctggaccagcaccccgacgccaagggcgtgctggtgatcaacccgacctattacggcgtggcggcggacctgaaggggatcgtcgagctggcccactcccgcggggtgccggtcctggtggacgaggcccacggcgtccacctgtgctttcacgacgagctgccgctctcggccatgcaggccggcgcggacatggcggccacctcggtgcacaagctgggcggttcgctgacgcagaccagcatcctcaacgtgcgcgaggggttcatcaaccccgggcgggtgcaggcgattctgtccatgctgacgaccacttccacctcgtacctgctgctggcctcgctggacgtcgcccgcaagcaactggccacccgggggcgggagctgatcgaccgggcggtccgcctcgccgagcgcgcccgccgggagatcgcggagatccccggcctgtactgcctcgggcccgacgtggtcggccagtcgtcgtcccgcttcgacctcgacccgacgaagctctgcatcaacgtgaaggagctgggcgtgaccggcgtggaggtcgaggcgatcctccgggaggaatttaacattgaagtggaactctcggacctctacaacatcctgtgcatcatctcgctgggcgacacggcggaggacgtggacgcgctggtggccgcgctcggggagatctcccgccgcttctaccggcagcgcccggccaacgtggtgaaggtcaaggtgcctgtgacgcctatcctcgccatgcatccccgcaccgcgttctacgcggagaccgaggtggtgccgatccgcgaggcggagggccgggtgatcgccgagtcgatcatggtgtatccccccgggatccccatcctgctgccgggggagatcgtggcggaggagaacctggattacctggaggagtgcatccaggcggggctgccggtccaggggaccgaggaccccgagatccggatggtaaaggtcgtgaaggacgctcaccgttaa

SEQ ID NO: 91698 - protein, 488 aa, Symbiobacterium thermophilum
MNQHETPLFTGLVRHAERNPIQFHIPGHKKGTGMAPEFRAYIGERALAIDLINIAPLDDLHNPHGIIREAQALAAEAFGADHSFFSVQGTSGAIIAMIMTVCGPGDKILVPRNVHKSVLTGIVLSGALPIFMNPDLDYELGIAHGVSLEAVRHALDQHPDAKGVLVINPTYYGVAADLKGIVELAHSRGVPVLVDEAHGVHLCFHDELPLSAMQAGADMAATSVHKLGGSLTQTSILNVREGFINPGRVQAILSMLTTTSTSYLLLASLDVARKQLATRGRELIDRAVRLAERARREIAEIPGLYCLGPDVVGQSSSRFDLDPTKLCINVKELGVTGVEVEAILREEFNIEVELSDLYNILCIISLGDTAEDVDALVAALGEISRRFYRQRPANVVKVKVPVTPILAMHPRTAFYAETEVVPIREAEGRVIAESIMVYPPGIPILLPGEIVAEENLDYLEECIQAGLPVQGTEDPEIRMVKVVKDAHR

SEQ ID NO: 91699 - DNA, 1410 bp, Symbiobacterium thermophilum
  CDS (1)..(1410)
atggcggaggagcaggcccggacgccgctgttttcggcgctgagggagtacgttgcgcgggtccgggcgccgctgcacgtgcccgggcacaagatgggacgcgccgcgccctcggcgtggcgggagttcctggggccgaatgcactggcgatcgacctgacggaggcgccggggctggacgacctgcacgcgccggagggggtcatcgccgaggcccaggagctggcggcccgggcgttcggcgcgtggcggagttattttctggtgggcggtaccaccgccggcctgcacgccctcatcctcgccgcctgccatccgggagaggcgatcgcggtgccgcgcaacgcgcaccgctccgtgctgggcgccctgattctggccggggtccgtcctcactgggtgagggtggccttcgacccggacctgggcatcgccacgggcccggtcctcacgtcgctggaggaggcgctttccggcgccgcggccgcggtgctggtccatcccacgtattacggcatcgccggagacacggccgccgcgatcgacctgatccaccgcgcggccgtcccggccctggtggacgaggcgcacggcgcccacttcccgttccaccccgcgctgccgccctcggccctggaactgggcgcggacggcgtcgtgcagtcgctgcacaagaccgggggcagcctgacccagtcgtccctgtgccacctggggcacggcagccgcatcgcccccgaacggctgcaggagatgctgcggctcgtgcagtccacaagcccgtcgtacctgctcatggcttccctggacctggcccggcgcgagctggccctcgggggccgggaggcctgggggcgggccctggagctggcccacgaggcgaaacggcgcatcgacgccctgcccgggctccgggtgcgccccaccgacgacccgaccaagctgctcatcgacgtgcggggacggtccatttcgggcttccgggcggcggagcggctctgggaggaggccggcgtcgccgtcgaggcctccgggctgacctacgtgctcgccgtgctctcgcccggggactcccgggagcagatcgacgccctggtcgcggggctggagcggctgtcctccgagggggatgtcccggcccttccgccggagccgccctggcccgaggtggttctgccgccgcgggaggcatacttagcccgtaagaaggcggttccgcttcgccaggcccgggggcgcatcgcggcggagctggtggccccgtacccgccgggcattccggtggtggccccgggtgagcggctgacggctgacgtgctggactacctccggcgcgccgccgatgccggctggcaccttcagggcccggcagaccccgcgctgcgaagcatccaggtcgtggaggagtga

SEQ ID NO: 91700 - protein, 469 aa, Symbiobacterium thermophilum
MAEEQARTPLFSALREYVARVRAPLHVPGHKMGRAAPSAWREFLGPNALAIDLTEAPGLDDLHAPEGVIAEAQELAARAFGAWRSYFLVGGTTAGLHALILAACHPGEAIAVPRNAHRSVLGALILAGVRPHWVRVAFDPDLGIATGPVLTSLEEALSGAAAAVLVHPTYYGIAGDTAAAIDLIHRAAVPALVDEAHGAHFPFHPALPPSALELGADGVVQSLHKTGGSLTQSSLCHLGHGSRIAPERLQEMLRLVQSTSPSYLLMASLDLARRELALGGREAWGRALELAHEAKRRIDALPGLRVRPTDDPTKLLIDVRGRSISGFRAAERLWEEAGVAVEASGLTYVLAVLSPGDSREQIDALVAGLERLSSEGDVPALPPEPPWPEVVLPPREAYLARKKAVPLRQARGRIAAELVAPYPPGIPVVAPGERLTADVLDYLRRAADAGWHLQGPADPALRSIQVVEE

SEQ ID NO: 91701 - DNA, 2154 bp, Erwinia carotovora
  CDS (1)..(2154)
atgaaacagttaaaaattgcggcgaatgcagcggttgccacccgtttaatcacaacgcgcgagattgtcgcgttgagtcagactgacttcactgatgtggcggcggtcgtggtttctattgaggaagcccgtagcggtattctgtcgatattgcagcacaccggttttagtattccggcgtttgtcgaagagcctgatgaagataaagagtcagatgttctgcctgcgggcagcgaatggctgattcttgatgatgaaggtgagcacgcgagcgtgctggaacgtgcggctaaagcctatcaagatgcgttgctgccgccgtttttcgatacgctgaccaagtacgtcaaaatgaagaacacgacgtttgcctgcccagggcatcagggcggtcagttcttccgtaagcatccggcagggcgtcagttttttgagttttacggtgagaacgtttttcgttcggacatctgtaacgccgacgtcaaactgggcgatttgctgatccatgaaggggcggcgaagaaggcacagaagcacgctgcgcgggtgtttaacgccgataagacctatttcgtgttaaacggcacgtcctctgcgaacaaagtcgtgacaaacgcgctgttagcgcgtggcgatctggtgctgtttgaccgtaacaaccataaatccaaccatcacggtgcgctggttcaggcgggggcgacgcctgtctatctggaaaccgtgcgcaatccgtttggctttatcggtggtgtggatgcgcactgctttgacgaaacctatctgcgcaagctgattgcggaagtcgcgccggaacgtgctaacgagccacgcccgttccgtctagctgtcatccagcttggcacctatgacgggaccatttataacgctcgtcaggttgtcgatagcatcgggcacctgtgtgactacattctgtttgactcggcctgggtcggctacgagcagttcatcccgatgatggagcagtgctcgccgctgttgctggatctgaatgagaacgatccgggcatctttgtcacccagtcggtgcataagcagcaggcgggcttctcccagacctcgcagatccacaaaaaagatacgcatatcaaagggcagcgtcgtttttgcaaccataagcaactgaataacgcttttatgctgcatgcgtcgaccagcccgttttacccgctgttcgccgcgttggatgttaatgccaaaatgcacgaaggggccagcgggcgtcgtatgtggatggactgcgtgaagctgggcattgaggcacgtaagcaactgctgacgcgctgttcgctcatcaaaccgtttgtgcctgttacggtaggcggtgcgctctggcaggatcatgatacggagacgatcgcgcaggacgtgcgtttcttcaactttgagccgggcgagaaatggcacgcgttcgaagggtacgcggaagatcagtattttatcgatccgtgcaaattactgctgactacgccgggtattgatgcaattagcggcgattataccgaatttggtattccggcgacgatccttgctaactatctgcgcgagcacggcatcatccctgaaaaatgcgacatgaactcgatcctgttcctgttaacgccagcggaagacacggccaaaatgcaggagctggttaatgcgctggttcattttgaaacgctgatcgctcgtgatgcgccgctgagcgaagtgttgcccagcctgtatcagaaatacaaagagcgctaccgtggttatcgactgcgtcggttgtgtcaggaaatgcatgatttttatgcccagcacaacgtgaaagatctgcaaaaagcgatgttccgcaaaaccgagtttccgtcagtggcgatgttgccgcaggatgccaacagggaatttgtgcgcgggaatatcgagctggttcccatcgttgaagctgaaggacgtatcgcggcggaaggtgcattgccatacccgccgggcgtgctgtgtgtggtaccgggggaagcctggggcggagcggtacagcgctattttctggcgctggaggatgggattaacctgctgcccggtttttcaccggaattgcagggggtttacagcgttgcggaagaagatggccgcaaacggctgtacggctacgtggtagaaaagtaa

SEQ ID NO: 91702 - protein, 717 aa, Erwinia carotovora
MKQLKIAANAAVATRLITTREIVALSQTDFTDVAAVVVSIEEARSGILSILQHTGFSIPAFVEEPDEDKESDVLPAGSEWLILDDEGEHASVLERAAKAYQDALLPPFFDTLTKYVKMKNTTFACPGHQGGQFFRKHPAGRQFFEFYGENVFRSDICNADVKLGDLLIHEGAAKKAQKHAARVFNADKTYFVLNGTSSANKVVTNALLARGDLVLFDRNNHKSNHHGALVQAGATPVYLETVRNPFGFIGGVDAHCFDETYLRKLIAEVAPERANEPRPFRLAVIQLGTYDGTIYNARQVVDSIGHLCDYILFDSAWVGYEQFIPMMEQCSPLLLDLNENDPGIFVTQSVHKQQAGFSQTSQIHKKDTHIKGQRRFCNHKQLNNAFMLHASTSPFYPLFAALDVNAKMHEGASGRRMWMDCVKLGIEARKQLLTRCSLIKPFVPVTVGGALWQDHDTETIAQDVRFFNFEPGEKWHAFEGYAEDQYFIDPCKLLLTTPGIDAISGDYTEFGIPATILANYLREHGIIPEKCDMNSILFLLTPAEDTAKMQELVNALVHFETLIARDAPLSEVLPSLYQKYKERYRGYRLRRLCQEMHDFYAQHNVKDLQKAMFRKTEFPSVAMLPQDANREFVRGNIELVPIVEAEGRIAAEGALPYPPGVLCVVPGEAWGGAVQRYFLALEDGINLLPGFSPELQGVYSVAEEDGRKRLYGYVVEK

SEQ ID NO: 91703 - DNA, 2790 bp, Acinetobacter sp
  CDS (1)..(2790)
atgacgaatacaaattcattaagccagcatcgtagcgtatgggagatacgttctgatagctggattaatctcgtagaagatattgggtatctggcagatcttcagattaataaccaagatcgtgccaaagttttaactcgtttacggctcactctggattttttaattccaattgaaagttattgggcatttccaagcaagcgagtttttgctgaactctgtcagtatattgaacgtgaagattttactaccgctcgacagcttgcacgccgtattcatcgtgccttgtctgcggggacttatcgtcacgataacaaagtgctccaaagtgaacgtgaattaccctctcacattgaaaccacaagtgagcaacaggcacgtctatctcagccttattttgaagtgctcatcgtggatgaaatgtctccagcagaagaggatgcactgcgtcgtcgagtgattagcaagcgctgttctgacgatccatttatttttgatattgtggttgttccgagctttgaagatgccctgattgcatccctaattaatttcaacttacaagctgtggtgattcggcacggctttccagcacgatcggtcaatcatgttgatatgctggaacgtttatttatagatgtcgatcaggatattgaatcccttccagaaatggagcgtggaacactattaggccgccatatcgcgaagttacgtccagaactggatctctatttagtgaccgatgcaggtgtggaaaatattgcttctcatgctggcagtgaaatctttaaacgcattttctttggcgaagaagaccatatcgagctctacaatgcgattatgaaaggtgtgggtgagcgttaccgtacaccattctttaatgcattacgcgattattccaaacaaccaacaggtatgttccatgcactgccactggcacgtggtaaagccattcttaatagcaactggattggtgatctggcacagttttatggcatgaatttatttatggccgaaacatcagccacttcaggcggtctggattcattactggaacctgttggcccattaaaacatgcgcaggaatatgcagcccgtgcatttggtgccaaacggactttctttgcaaccaatggaacctccacctgtaacaagattgtggtgcaatctctggtacgtgaaggtgatattgtactggtagatcgcaactgtcataaatcacatcattatggtttggtgcttacaggcgccagtgccgcctatctcgattcgtatccactcaatgaatactcaatgtatggggcggtgccaatttggcacattaaacaaactttattgagctttaaacgagcaggtacgcttgatcgcgttaaactggttctactcaccaattgtacctttgatggtgttgtctatgacgtagaacgggtgatgatggaatgcctggccattaaacctgatctgatttttttatgggatgaagcatggtttgcttttgcaagttgtcatcccatttatcgccaacgcacagccatggccaatgccgctaagctggctgaacgttttaaaacgcctgaatatgcccgagaatatgccgagtggaaagacagtattgactgggaagatgatcaacagctcatcaacactcgtctcatgccagaccctgctttggcacgtgttcgcgtttattcaacgcattcgacacacaagaccttaactgcactgcgtcagggttccatgattcatatctgggatcaggattttaaagaaaagagcgaagaagcttttattgaagcttacatgacccatacttcaacttcggccaattatcagattctggcatcgctggatgtaggacggcgtcaggttgaaatggaaggttatcaactggtacagcgacagcttgaacttgcgatgagcctgcgcgaacaggtcatgcatcaccccttactcaagcgtcatttccacttcttgcgcgttggcaatatcattccaactgcttaccgtgaatctggagtcaatagctattttgatgaaggtaaaggctgggcaaatttagagaaagcgtggagcatggatgagtttgtcatggatcctacccgcgcaacgctgatgattggtatggtcgggatggatggagataccttcaaaaataccgaactcatgaataaatacgggattcaaatcaataagacctctcgtaatactgttctgtttattatcaatattggaaccacacgttctgcaattgcttatctgattgaagtgctggtcaagattgcacgtgatgtagatcgtcgtgtagctgacatgagctcagccgagcgtcgcattcacttaaaacgtgttaactctctcactcaagagcaaccaccattacctgatttctctgctttccatcgtgcatttcggggtcaaagtctaaacccagccattcaaacccgtgacggtaatattcgtcaggcattttttctgtcctatgaagattcgagctgtgaatatattgatatgcaggaagcagccgtagctattgcatcaggtcgtgaactggtttcagccctgtttgtaattccatatccgcctggctttccaattttagtacctgggcaggtcatcagctctgaaattttaaaattcatggcagcactggatgtgaaagaaattcatggtttccgccctgaactcggatttcgtgtctttacacaagaaacgcttgatcgagttctacacgcaaaagaatcttttgaatcgattatgcaatatcagcaaatcaataacttacgtgctggatag

SEQ ID NO: 91704 - protein, 929 aa, Acinetobacter sp
MTNTNSLSQHRSVWEIRSDSWINLVEDIGYLADLQINNQDRAKVLTRLRLTLDFLIPIESYWAFPSKRVFAELCQYIEREDFTTARQLARRIHRALSAGTYRHDNKVLQSERELPSHIETTSEQQARLSQPYFEVLIVDEMSPAEEDALRRRVISKRCSDDPFIFDIVVVPSFEDALIASLINFNLQAVVIRHGFPARSVNHVDMLERLFIDVDQDIESLPEMERGTLLGRHIAKLRPELDLYLVTDAGVENIASHAGSEIFKRIFFGEEDHIELYNAIMKGVGERYRTPFFNALRDYSKQPTGMFHALPLARGKAILNSNWIGDLAQFYGMNLFMAETSATSGGLDSLLEPVGPLKHAQEYAARAFGAKRTFFATNGTSTCNKIVVQSLVREGDIVLVDRNCHKSHHYGLVLTGASAAYLDSYPLNEYSMYGAVPIWHIKQTLLSFKRAGTLDRVKLVLLTNCTFDGVVYDVERVMMECLAIKPDLIFLWDEAWFAFASCHPIYRQRTAMANAAKLAERFKTPEYAREYAEWKDSIDWEDDQQLINTRLMPDPALARVRVYSTHSTHKTLTALRQGSMIHIWDQDFKEKSEEAFIEAYMTHTSTSANYQILASLDVGRRQVEMEGYQLVQRQLELAMSLREQVMHHPLLKRHFHFLRVGNIIPTAYRESGVNSYFDEGKGWANLEKAWSMDEFVMDPTRATLMIGMVGMDGDTFKNTELMNKYGIQINKTSRNTVLFIINIGTTRSAIAYLIEVLVKIARDVDRRVADMSSAERRIHLKRVNSLTQEQPPLPDFSAFHRAFRGQSLNPAIQTRDGNIRQAFFLSYEDSSCEYIDMQEAAVAIASGRELVSALFVIPYPPGFPILVPGQVISSEILKFMAALDVKEIHGFRPELGFRVFTQETLDRVLHAKESFESIMQYQQINNLRAG

SEQ ID NO: 91705 - DNA, 1482 bp, Bacillus thuringiensis
  CDS (1)..(1482)
atgtatagattgtcccaatacgaaacaccattgtttaccgctttagttgagcacagtaagcgaaatccaattcaattccatattccaggtcataaaaaagggcaaggcatggatcctgaatttcgcgaatttattgggcataatgcattagcaattgatttaattaacattgcgccgctcgatgatttacatcatccaaaaggtatgattaaagaagcacaagatttagcagccgctgcatttggcgcggatcatactttcttttctattcaaggtacaagtggcgcaataatgacaatggtgatgagcgtttgcggtcctggtgacaaaatactagtgccacgaaacgtgcataaatcagtaatgtcagctattattttctcaggtgcaaaacctattttcatgcatcctgaaatcgatccaaaacttggtatttcacatggaatcacaatccaatctgtcaaaaaagcacttgaagagcactcagatgcgaaaggcttacttgttattaatccaacatactttggctttgctgcggacttagaacagattgtacaattagcacattcttacgatatccctgtactcgttgatgaggctcatggtgttcatattcattttcacgatgaattgccgatgtcagcgatgcaagccggtgcagatatggcagcaacgagtgttcacaaattaggtggatctttaacgcaaagttctattcttaatgtaaaagaaggccttgtgaacgtaaaacatgttcaatctattattagcatgcttacgactacatcaacgtcttacatcttgttagcctccctagatgttgctagaaaacgtcttgctacagaaggaaaggcgctcatagaacaaacaatacaattagcggaacaagttcgtaatgctataaatgatattgaacatctttactgtccagggaaagaaatgctaggtacggatgctacttttaactatgatcctacaaagataattgtatctgtaaaagatttaggtattacaggccatcaggctgaagtatggcttagagagcaatataacattgaagtagaactctcagatttatacaacatactatgtcttgtcacttttggggatacagaaagtgagacgaatacacttattgcagcattacaagatttatcagcaacatttaaaaataaagctgataaaggtgttcgaatacaagtagaaattccagaaatacctgtgttagcactttctcctcgagatgctttttattcggaaacagaagtcatcccatttgaaaatgcagcaggtcgtattatagctgatttcgttatggtttatccgccagggattccaatctttactccgggggaaattattacacaagacaacttagagtatattcgtaaaaacttagaagcaggtttacctgtacaaggtcctgaagatatgacattacaaacattacgcgtgatcaaagagtacaagcctatcagttga

SEQ ID NO: 91706 - protein, 493 aa, Bacillus thuringiensis
MYRLSQYETPLFTALVEHSKRNPIQFHIPGHKKGQGMDPEFREFIGHNALAIDLINIAPLDDLHHPKGMIKEAQDLAAAAFGADHTFFSIQGTSGAIMTMVMSVCGPGDKILVPRNVHKSVMSAIIFSGAKPIFMHPEIDPKLGISHGITIQSVKKALEEHSDAKGLLVINPTYFGFAADLEQIVQLAHSYDIPVLVDEAHGVHIHFHDELPMSAMQAGADMAATSVHKLGGSLTQSSILNVKEGLVNVKHVQSIISMLTTTSTSYILLASLDVARKRLATEGKALIEQTIQLAEQVRNAINDIEHLYCPGKEMLGTDATFNYDPTKIIVSVKDLGITGHQAEVWLREQYNIEVELSDLYNILCLVTFGDTESETNTLIAALQDLSATFKNKADKGVRIQVEIPEIPVLALSPRDAFYSETEVIPFENAAGRIIADFVMVYPPGIPIFTPGEIITQDNLEYIRKNLEAGLPVQGPEDMTLQTLRVIKEYKPIS

SEQ ID NO: 91707 - DNA, 1422 bp, Bacillus thuringiensis
  CDS (1)..(1422)
atgaatcaaaatcgcatacctttatatgaagcattaatagagtttaaagaaagaagaccgttatcctttcatgttccaggtcataaaaatggtttaaacttccctcaggaggtagtagaggagtttaaagatatactatctatcgatgtaactgagttgtcaggattagatgatttacatagtccgtttgaatgtatagatgaggcacaacaattattagctgatgtatatggagtgaacaaaagttattttttaattaatggttcaacagtcgggaatctagcaatgattttgtcttgttgtggggaacatgatattgttcttgtacaaagaaattgtcataaatcgattattaatggtttaaaattagcgggagcaaatcctatttttttagatccatggattgatgaagcttataacgtaccagtgggaattcatgatgagattattaaggaagcgattgaaaaatacccaaatgcgaaagcactcattttaacgcatcctaattattatggtatggggatggatctagaggcaagcattgcttatgcacatacacataaaatccctgtgctagtagatgaagcacatggggctcatttttgtttaggcggggcatttccacagtcagcgttagcatatggtgcagatattgtagttcattctgcgcataaaacattacccgcgatgacgatgggatcctatttacatataaatagtcgtttagtgaaagaagaaaaagtttctacttatttaagtatgctacaatctagtagtccatcgtatccaattatggcttctcttgatattgcacgctttacaatagcacgtataaaagaaaagggacatgatgaaattgtcgagtttttacaggaatttaaagaagaattgagtactattccacaaatagctattttacaatatccattacaagacgggctaaagattcccgtacagacgcgttgtcagttatcaggatacgaattacagtctgtatttgaaaaggtcggtatatatacagaaatggcagatccatataatgtcttatttattttgcctttgcaagtaaataagaaatatatgaaggctatagagatgatccgagtagcattgcaatactatgaggtgaaagacaagacggaatctattcgttatacttataaaggagaaatttctcccctgccgtatacatataaacaactggaagaatacgaaacaaaagtagtacctatagaagaagcagttgggatggtagcagcggaaatggtaattccgtatccacctggtattccattgattatgtatggagaaagaattacttcagaacataaagaacaaattatgtatttagaaaaagcaggtgctcgttttcaaggtagcacgaaatatatgaaagtgtatgatatagaaagtaggttttag

SEQ ID NO: 91708 - protein, 473 aa, Bacillus thuringiensis
MNQNRIPLYEALIEFKERRPLSFHVPGHKNGLNFPQEVVEEFKDILSIDVTELSGLDDLHSPFECIDEAQQLLADVYGVNKSYFLINGSTVGNLAMILSCCGEHDIVLVQRNCHKSIINGLKLAGANPIFLDPWIDEAYNVPVGIHDEIIKEAIEKYPNAKALILTHPNYYGMGMDLEASIAYAHTHKIPVLVDEAHGAHFCLGGAFPQSALAYGADIVVHSAHKTLPAMTMGSYLHINSRLVKEEKVSTYLSMLQSSSPSYPIMASLDIARFTIARIKEKGHDEIVEFLQEFKEELSTIPQIAILQYPLQDGLKIPVQTRCQLSGYELQSVFEKVGIYTEMADPYNVLFILPLQVNKKYMKAIEMIRVALQYYEVKDKTESIRYTYKGEISPLPYTYKQLEEYETKVVPIEEAVGMVAAEMVIPYPPGIPLIMYGERITSEHKEQIMYLEKAGARFQGSTKYMKVYDIESRF

SEQ ID NO: 91709 - DNA, 2358 bp, Rhodopseudomonas palustris; identical to SEQ ID NO: 402
  CDS (1)..(2358)

SEQ ID NO: 91710 - protein, 785 aa, Rhodopseudomonas palustris; identical to SEQ ID NO: 403

SEQ ID NO: 91711 - DNA, 2837 bp, Shigella boydii
  CDS (165)..(2435)
ttagccgtcgataataagcagtgaaaataatttaaaataatcacataacgcattgtttataaaaataaatatttcaaaaatgtttgtttttcacgcgctttacagcccgaaaaggccggaagatacttgcccgcaacgaagattccttcataaccgggtaagcaatgatgaaagtattaattgttgaaagcgagtttctccatcaagacacctgggtcggtaacgccgttgagcgtctggcagatgctttaagccagcaaaatgttaccgtgattaaatccacctcctttgatgatggttttgccattctctcttcaaacgaagccattgactgcctgatgttcagctatcaaatggaacatccggacgaacatcaaaacgtcagacaattgatcggtaagcttcatgagcgccaacaaaacgtgccggtcttcctgttgggcgatcgggaaaaagccctcgccgcaatggatcgcgacctgctggagcttgtcgatgaattcgcctggattctggaagataccaccgactttatcgccggacgcgccgttgccgctatgacccgctaccgccagcagctgttgccgccactgttcagcgcgctgatgaaatatagcgacatccatgaatattcctgggcagcgccaggccaccagggcggcgttggttttaccaaaacacccgccggacgtttctaccatgactactatggagaaaatctgttccgcaccgatatgggcatcgaacgaacttccctcggttctttgcttgaccatactggcgcatttggggaaagcgaaaaatatgccgcacgcgtatttggtgccgatcgctcctggtcggtagtcgtcggtacttccggctctaaccgcaccatcatgcaggcttgcatgaccgataacgatgtcgtggtcgttgaccgtaactgccataaatccatcgaacaaggcttgatgctgacaggcgcgaaaccggtctacatggtgccaagccgcaaccgctacggcattatcgggccaatctatccgcaggaaatgcaacctgaaaccttgcagaagaaaatcagtgaaagcccgctgactaaagacaaagccgggcaaaaaccgtcttactgcgtggtgaccaactgcacctatgacggcgtgtgttataacgctaaagaagcgcaggatctgctggaaaaaacctccgatcgtctgcactttgacgaagcctggtacggctatgcacgtttcaacccgatctatgccgatcactatgccatgcgcggcgaacctagcgatcacaacggtcctaccgttttcgccacccactccacccacaaactgctgaatgcgctttcacaggcttcttatattcatgtacgtgaaggtcgtggggcgattaacttctcccgcttcaaccaggcctacatgatgcatgccaccacctccccgctgtatgccatctgcgcatccaacgacgtggcggtgtcgatgatggacggcaacagcggcctgtcactgacgcaggaagtgatcgacgaagcggttgatttccgtcaggcgatggcgcggctgtataaagagttcaccgctgacggtagctggttcttcaaaccgtggaacaaagaagtcgtcaccgacccacaaaccggcaaaacctatgactttgctgacgcaccaaccaaactgctgaccaccgttcaggactactgggtaatgcatccgggcgaaagctggcacggcttcaaagatattccggataactggagtatgctcgacccgattaaagtcagcatccttgctccgggaatgggtgaagatggtgaactggaagaaaccggtgttccggcggcgctggtcactgcctggcttggtcgccacggcattgtgcctacccgcaccactgacttccaaattatgttcctgttctctatgggcgtaacccgtgggaaatgggggactctggttaacaccctttgctccttcaaacgccactatgacgccaacacaccgctggcgcaggtgatgccggaacttgttgaacaatatcctgacacttacgcgaacatggggattcacgatctgggtgacaccatgtttgcctggctgaaagaaaacaaccctggcgcacggttgaacgaagcctattccggcctgccggtggcggaaatcaccccgcgtgaagcgtacaacgcgattgtcgacaacaatgtcgaattggtatccattgaaaatctgccaggacgcatcgcggcaaactcagttatcccatatccgccaggaatcccgatgctgctgtctggtgaaaacttcggcgataaaaacagtccgcaagtaagttatttacgctcgctgcaatcctgggaccaccatttccctggatttgaacacgaaactgaagggactgaaattattgacggtatttaccacgttatgtgtgtgaaagcgtaaccactattccgctgaaggcgtaattgtttaaataacattacgccgcctggccttaggccttttgagtatggcaacgttttcataaaaattgctgcaaacaaaaatgtcatactttttgcgcggccccaccccgcgcttttttttgcctgttatttaccctgtaaaaaaatatgtacatgagaaattactataaaaatttgtaatattagtaaaactcgttatttttatgtatgtttatattcgtcatacaattatataaccatttcccggtatcgctttgctttagcgagaactggtcttttattcgcactcaggagtacatgtatgaggatttgcagcgaccaaccttgtattgttttattgactgaaaaagatgtctggataagggtgaatgggaaagaa

SEQ ID NO: 91712 - protein, 756 aa, Shigella boydii
MMKVLIVESEFLHQDTWVGNAVERLADALSQQNVTVIKSTSFDDGFAILSSNEAIDCLMFSYQMEHPDEHQNVRQLIGKLHERQQNVPVFLLGDREKALAAMDRDLLELVDEFAWILEDTTDFIAGRAVAAMTRYRQQLLPPLFSALMKYSDIHEYSWAAPGHQGGVGFTKTPAGRFYHDYYGENLFRTDMGIERTSLGSLLDHTGAFGESEKYAARVFGADRSWSVVVGTSGSNRTIMQACMTDNDVVVVDRNCHKSIEQGLMLTGAKPVYMVPSRNRYGIIGPIYPQEMQPETLQKKISESPLTKDKAGQKPSYCVVTNCTYDGVCYNAKEAQDLLEKTSDRLHFDEAWYGYARFNPIYADHYAMRGEPSDHNGPTVFATHSTHKLLNALSQASYIHVREGRGAINFSRFNQAYMMHATTSPLYAICASNDVAVSMMDGNSGLSLTQEVIDEAVDFRQAMARLYKEFTADGSWFFKPWNKEVVTDPQTGKTYDFADAPTKLLTTVQDYWVMHPGESWHGFKDIPDNWSMLDPIKVSILAPGMGEDGELEETGVPAALVTAWLGRHGIVPTRTTDFQIMFLFSMGVTRGKWGTLVNTLCSFKRHYDANTPLAQVMPELVEQYPDTYANMGIHDLGDTMFAWLKENNPGARLNEAYSGLPVAEITPREAYNAIVDNNVELVSIENLPGRIAANSVIPYPPGIPMLLSGENFGDKNSPQVSYLRSLQSWDHHFPGFEHETEGTEIIDGIYHVMCVKA

SEQ ID NO: 91713 - DNA, 1380 bp, Listeria monocytogenes
  CDS (1)..(1380)
atgaggaatcaatctaaaatgcctttagtggaacggttagatgctcatgctaagtcttgcccaatatcactccatgtgccaggacacaaaagcggagccatttatccagatgcatggcaaaaatttttgaaatgggacgtaacagaaattactggaatggatgatttgcatcacccagaagatgtgattttggaagcagaggagttacttgcggaatgttatggaagcaaaaaaagctactttttagtcaatgggacaagcggaggaagcttggcagttattatggcgacgttgaagcacggggagaaagttttagtgccaagagatgcgcataaatcaatcttgcatggaatcgaactggcaggcggagaaccgattttcttaaccccagcgacaaacaaagaagttggcgtcgcgagtggcgtgacaaccgaacttctcgaagaaacattacataatcacccagatataaaactatgtattttcacttatccgagctattatggaacgacttttaacttgcataaatgtattcaaattgcgcatgattttggtgcggttgtgtttgttgatgaagcgcacggagcacattttttaacaagttctgaatttccgaaaagtgcagtggagcttggtgcggatgtggttgttcagtcggcgcataagacgttgccggcgctaacgatgggttcctatttacatgtggtgaatgatttaccgatttttgaaaaactaccttattacctgcaagtattccaaacgagcagcccatcttatttaattatggcgtcacttgatgcggcgaggaaatatgcggcaacttacacagcggcggacgtcgaagctttttggaaaatgcgtgccagatggattaaatggctgacgaagaataaatttgacgttattttgccagatgatccgcttaaaatcatcgtgcgcaaaacaggctacacgggctacgaactgcaagcaatttttgaagaaagctcttatttcccagagcttgccgatgagtcacaggtattactgattttaccattaattaaaaaagggattgatttcacgcctattagccggattcattctccggtgaaaaaagaaatcgcgaaagaaccatatgaaatgtcagcgccttttgcgtcaggtcttgcgctaacttatgaagaaatgcacgcacgcgcgaccgaattcgtattactagatgaagctacgacacgcgtttcggctgaaacaatctcgctctatccgccgggaattccagcaatcatccgcggagaaagcatcacagaaaagcatattcgcgaactaaaaaacattcgcacacgccactaccaaggcggcgaaaaactagccgagaattacatccgtgtattccgctaa

SEQ ID NO: 91714 - protein, 459 aa, Listeria monocytogenes
MRNQSKMPLVERLDAHAKSCPISLHVPGHKSGAIYPDAWQKFLKWDVTEITGMDDLHHPEDVILEAEELLAECYGSKKSYFLVNGTSGGSLAVIMATLKHGEKVLVPRDAHKSILHGIELAGGEPIFLTPATNKEVGVASGVTTELLEETLHNHPDIKLCIFTYPSYYGTTFNLHKCIQIAHDFGAVVFVDEAHGAHFLTSSEFPKSAVELGADVVVQSAHKTLPALTMGSYLHVVNDLPIFEKLPYYLQVFQTSSPSYLIMASLDAARKYAATYTAADVEAFWKMRARWIKWLTKNKFDVILPDDPLKIIVRKTGYTGYELQAIFEESSYFPELADESQVLLILPLIKKGIDFTPISRIHSPVKKEIAKEPYEMSAPFASGLALTYEEMHARATEFVLLDEATTRVSAETISLYPPGIPAIIRGESITEKHIRELKNIRTRHYQGGEKLAENYIRVFR

SEQ ID NO: 91715 - DNA, 1482 bp, Bacillus cereus
  CDS (1)..(1482)
atgtatagattgtcccaatacgaaacaccattgtttaccgctttagttgagcacagtaagcgaaatccaattcaattccatattccagggcataaaaaaggacagggcatggatcctgaatttcgcgaatttattgggcataatgcattagcaattgatttaattaatattgcgccgctcgatgatttacatcatccaaaaggtatgattaaagaagcacaggatttagcagccgctgcatttggtgcggatcatactttcttttctattcaaggtacaagtggcgcaattatgacaatggtgatgagcgtttgcggtcctggtgacaaaatactagtaccacgaaacgtgcataaatcagtaatgtcagctattattttctcaggtgcaaaacctattttcatgcatcctgaaattgatccaaaacttggtatttcacatggaatcacaattcaatctgtcaaaaaggcacttgaagagcactcagatgcgaaaggcctacttgttattaacccaacatactttggctttgctgcggacttagaacagattgtacaattagcacattcttacgatatccctgtactcgttgatgaggctcatggtgttcatattcattttcacgatgaactgccgatgtcagcgatgcaagccggtgcagatatggcagcaacaagtgttcacaaattaggtggatctttaacgcaaagttctattcttaatgtaaaagaaggccttgtgaacgtaaaacatgttcaatctattattagcatgcttacgactacatcaacgtcttacatcttgttagcctccctagatgttgctagaaaacgtcttgctacagaaggaacggcactcatagaacaaacaatacaattagcggaacaagttcgtgatgctataaatgatatcgaacatctttactgtccagggaaagaaatgctaggtacggatgctacttttaactatgatcctacaaagataattgtatctgtaaaagatttaggtattacaggccatcaggctgaagtatggcttagagagcaatataacattgaagtagagctctcagatttatacaacatactatgtcttgtcacttttggggatacagaaagtgagacaaatacacttattgcagcattacaagatttatcagcaacatttaaaaataaagctgataaaggtgttcaagtgcaagtagaaattccagaaatacctgttttagcactttctcctcgagatgctttttattcggaaacagaagtcatcccatttgaaaatgcagcaggtcgtattatagctgatttcgttatggtttatccgccagggattccaatctttactccgggggaaattattacacaagataacttagagtatattcgtaaaaacttagaagcaggtttacctgtacaaggtcctgaagatatgacattacaaacattacgcgtgattaaagagtacaagcctatcagttga

SEQ ID NO: 91716 - protein, 493 aa, Bacillus cereus
MYRLSQYETPLFTALVEHSKRNPIQFHIPGHKKGQGMDPEFREFIGHNALAIDLINIAPLDDLHHPKGMIKEAQDLAAAAFGADHTFFSIQGTSGAIMTMVMSVCGPGDKILVPRNVHKSVMSAIIFSGAKPIFMHPEIDPKLGISHGITIQSVKKALEEHSDAKGLLVINPTYFGFAADLEQIVQLAHSYDIPVLVDEAHGVHIHFHDELPMSAMQAGADMAATSVHKLGGSLTQSSILNVKEGLVNVKHVQSIISMLTTTSTSYILLASLDVARKRLATEGTALIEQTIQLAEQVRDAINDIEHLYCPGKEMLGTDATFNYDPTKIIVSVKDLGITGHQAEVWLREQYNIEVELSDLYNILCLVTFGDTESETNTLIAALQDLSATFKNKADKGVQVQVEIPEIPVLALSPRDAFYSETEVIPFENAAGRIIADFVMVYPPGIPIFTPGEIITQDNLEYIRKNLEAGLPVQGPEDMTLQTLRVIKEYKPIS

SEQ ID NO: 91717 - DNA, 1422 bp, Bacillus cereus
  CDS (1)..(1422)
atgaatcaaaatcgcatacctttatatgaagcattaatagagtttaaagaaagaaggccgttatcttttcatgttccaggtcataaaaatggtttaaacttccctcaaggggcagtagaggagtttaaagatatactatctatcgatgtaactgagttatcagggttagatgatttacatagtccgtttgaatgtatagatgaggcacaacaattattagctgatgtatatgaagtggaaaaaagttattttttaattaatggttcaacagtcgggaacttagcaatgattttgtcttgctgtagggaacatgatattgttcttgtacaaagaaattgtcataaatcaattattaatggtttaaaattagcaggagcaaatccaatttttttagattcatggattgatgaagcttataacgtacccgtgggaattcatgatgagattattaaggaagcaattgaaaaatacccaaatgcgaaagcacttattttaacacatcctaattattatggtatggggatggatttagaggcaagcattgcttatgcacatgcacataaaattcctgtgttagtagatgaagcgcatggagctcatttttgtttaggcggggcatttccaaagtcagctttagcatatggtgcagatattgtagttcattccgcacataaaacattacctgcgatgacgatgggatcctatttacatataaatagccgcttagtgaaagaagaaagagtttctacttatttaagtatgctacaatctagtagtccatcgtatccaattatggcttctcttgatattgcacgctttacgatagcgcgtataaaagaaaagggacatgatgaaattgtcgagtttttacgggagtttaaagaagaattgtcttctatcccacaaatagctattttacaatatccattacaagacgagctaaaagttaccgtacagacgcgttgtcagttatcaggatacgaattacagtctgtattagaaaaggttggtatatataccgaaatggcagatccatataatgtcttatttattttacctttgcaagtaaataagacgtatatgaaggctgtagagatgatccgggcggcattgcaatcttatgaggtgaaagacaagacggaatctattcgttatacttataaaggagaaatttctcctttaccgtatacatataaacaactggaaggatatgaaacaaaagtagtatctgtagaagaagcagttgggatgatagcggcggaaatggtaattccatatccacctggtattccattgattatgtatggggaaagaattacttcagaacataaagagcaaattatgcatttagagagagcaggcgcccgttttcaaggtagcacgaaatatatgaaagtgtatgatatagaaagtaggttttag

SEQ ID NO: 91718 - protein, 473 aa, Bacillus cereus
MNQNRIPLYEALIEFKERRPLSFHVPGHKNGLNFPQGAVEEFKDILSIDVTELSGLDDLHSPFECIDEAQQLLADVYEVEKSYFLINGSTVGNLAMILSCCREHDIVLVQRNCHKSIINGLKLAGANPIFLDSWIDEAYNVPVGIHDEIIKEAIEKYPNAKALILTHPNYYGMGMDLEASIAYAHAHKIPVLVDEAHGAHFCLGGAFPKSALAYGADIVVHSAHKTLPAMTMGSYLHINSRLVKEERVSTYLSMLQSSSPSYPIMASLDIARFTIARIKEKGHDEIVEFLREFKEELSSIPQIAILQYPLQDELKVTVQTRCQLSGYELQSVLEKVGIYTEMADPYNVLFILPLQVNKTYMKAVEMIRAALQSYEVKDKTESIRYTYKGEISPLPYTYKQLEGYETKVVSVEEAVGMIAAEMVIPYPPGIPLIMYGERITSEHKEQIMHLERAGARFQGSTKYMKVYDIESRF

SEQ ID NO: 91719 - DNA, 1458 bp, Mycobacterium paratuberculosis; identical to SEQ ID NO: 760
  CDS (1)..(1458)

SEQ ID NO: 91720 - protein, 485 aa, Mycobacterium paratuberculosis; identical to SEQ ID NO: 407

SEQ ID NO: 91721 - DNA, 2853 bp, Mycobacterium paratuberculosis; identical to SEQ ID NO: 758
  CDS (1)..(2853)

SEQ ID NO: 91722 - protein, 950 aa, Mycobacterium paratuberculosis; identical to SEQ ID NO: 405

SEQ ID NO: 91723 - DNA, 2100 bp, Lactobacillus johnsonii; identical to SEQ ID NO: 762
  CDS (1)..(2100)

SEQ ID NO: 91724 - protein, 699 aa, Lactobacillus johnsonii; identical to SEQ ID NO: 409

SEQ ID NO: 91725 - DNA, 3625 bp, Vibrio parahaemolyticus
  CDS (1451)..(3625)
gacttgagtagaatagatttggagatgttatgtcatcgaatacgaaaaaaatcggcctaattgcctgtacgggtgtagtcgccggtaacatgatgggtagtggtattgcactgttaccttccagcctagcttcagtaggctctgtttcaattttcagctggctgatctgtttgatcggtgcactgagccttgcgtttgtttacgctcgtctggcaaccaaaaaccctcaagaaggtggtcctatcgcttatgcgggcgaagtttccccagtctttggtttccaaacgggcgtgctttattaccacgcgaactggattggtaacctagctattgctattacaggtgtttcttacctttcagtattcttccctgtgcttaatgacccaatcccagcgggtattgcgacgattgcatcggtatggatcttcactttcgtcaacctacttggtggtagctgggtaagccgtctatgtacgcttggtcttgttctaattctaattccagttgttggtaccgctctatttggttggacgcacttcgacactgcgctatacagccaaaactggaacgtatctgcgggtactgatagccatgcgattgtgactgcggttcttatctgtctatggtcattcgttggtgtggaatcagctgcagtatcgacaggtatggtagaaaaccctaaacgtactgtaccgctagcaaccatgctgggtactggtattgcaggtgtgatttacatcctatcaactcaaatgatcagcggcatgttccctgcttctgaagttgcggcatcaggtgcgccatttgcattggctaccactgagctattcggtagctggactgcaccattcgtatcagcattcactgcactagcatgttttacttcgctaggttcttggatgatgctggtgggcgaagctggtaaacgtgcagcaagcgatggcaacttccctaaaatctacggcgaaactgacaaaaacggtgtgcctaagaaaggtctaatccttgcgtcaatcaagatgacagcattaatggttgtactgatgttcttcagctctaaaacagcacatgcatcagacctgttcaaccaactaacgactgatgcagttctactaactatgctgccttacttctactcaagcattaacttgattcgcttcgaaggtatgacaacacgcaacggcttcgtaatgctgttctctggtgtagcttgtttgttctgcttcattgcccttgctggtgcagaaggcggtacgctaacagcaaccttcatcgtgtctctcgttatcttgatgttctacagcaaaaaagccggcttagctcagtacatgaagctacacgctgacgacatgcctgctcaagcaagcaactaatccccaaacgctggcacttcggtgccagccaataaaaaacaaattcactcggcgctcaccttactcactgcctgtaaatggcagagagcgccttcattcgccttggagatgtccaaatgaatattttcgctatcttgaaccacatgggtgtgttctttaaagaagagccagttcgtcaacttcacgctgctcttgagaaagcgggctacgaagtggtttacccagtagatgataaagacttgatcaaaatgattgagatgaacccgcgcatttgcggtgtgctgttcgactgggataaatactcactagagctatgtgaacgtattagccaaatcaacgaaaaactgcctgttcacgcatttgctaacgaacagtctactctcgatatttcactaacagacctacgtctgaacgtgagcttcttcgagtacgctttaggtatggctgacgacatcgctatcaaaatcaaccaagcgacagaggcatacaaagatgccatcatgcctccattcactaaagcgctattcaaatacgtagaagaaggtaaatacaccttctgtactccaggtcacatgggcggtactgcattccagaaaagccctgctggtagcatcttctatgatttttacggtccaaatacattcaaagcggacgtatcaatctcaatgcctgagctaggttctctactagaccactcaggtccacataaagatgcagaagaatacatcgcacgtacattcaatgcagacagctcgtacatcgtaactaacggtacgtctacatcgaacaaaatcgttggtatgtactcagcacctgcgggcagcacagtactgattgaccgtaactgtcacaaatctctgactcacctaatgatgatgagcgacgtgacaccaatctacttccgtccaactcgtaacgcatacggcatccttggtggtattccacaaagcgaattcagccgtgatgtcattgcagagaaagtggcgaaaacaccaggtgcaacagcgccaagttacgcagtagtgactaactcaacttacgatggtctgttgtacaacacacaattcatcaaagagtcgctagactgtaaacacatccacttcgacagtgcttgggtgccttacactaacttcaacccaatttacgaaggtaaatgtggtatgagtggtgaagcgatgccaggcaaagtgttctacgagacacaatcaacacacaaactgttggcagcgttctcacaagcttcaatgattcacgtgaaaggtgactttgatagagagtctttcaacgaagcattcatgatgcacacttcaacttcacctcagtacggcattgttgcttctactgaaactgcagcggcaatgatgcgcggcaacactggtaagaagttgacgcaagactctatcgatcgcgcaattcgcttccgtaaagagatcaaacgcctagaagcagaaagtgacagctggttcttcgatgtatggcaaccagaaaacatcgataccacagaatgttggaaactagaccctagcgatacatggcacggcttcaagaacatggatgacaaccacatgtatcttgacccaatcaaagtcacgctactgactccggggatgaataaagaaggcgaactagaagaatcaggtattcctgcttcgctggtggctaaattcctagacgagcgcggcatcgtggtagagaaaacaggtccatacaacttgttgttcctattctcaattggtatcgacaaatcaaaagcaatgcaattgctacgcggtctgactgaatttaaacgtggctacgacttaaacctaaccatcaagagcttcctaccttcgctatataacgaagatccaagcttctatgaaggcatgcgcgttcaagaattggcacaagcaattcataacctaactaagaaatacaacctaccagagctaatgtacaaagcgttcgatgttcttccagaaatgaaagtaacaccacacgcagcatggcaagaagagcttcgcggtaacgtagaagaaatcaaactggaagaaatggttggtcgcgtaagtgcgaacatgatccttccctaccttccatatgtgccactagtacttcctggtgaaatggtgactcaagagtctcgccctgtgctggacttcctagagatgctttgtgagatcggggcgcattacccaggtttcgaaaccgatatccacggtctgtaccaacaaaaagatggtagctacaccgtaaaagtattgaagaactaa

SEQ ID NO: 91726 - protein, 724 aa, Vibrio parahaemolyticus; identical to SEQ ID NO: 401

SEQ ID NO: 91727 - DNA, 2142 bp, Shigella flexneri; identical to SEQ ID NO: 384
  CDS (1)..(2142)

SEQ ID NO: 91728 - protein, 713 aa, Shigella flexneri; identical to SEQ ID NO: 385

SEQ ID NO: 91729 - DNA, 2181 bp, Vibrio vulnificus
  CDS (1)..(2181)
atgaagcgtttagttattggtgttagtaattacatgccagaagattttagtttattagctgaatctttagatgaacaatttaatcgtcatcttcatcctttagagcaagtagaattaaccgatgttggtgctgccattattacgtcggcagatattaaggctggtctacacaaagtgatttctgaaacgggttatggcattccggttttcttggtcacagatgaaaacccagtgtcagccgaagattacgtatggttaaccggcgttatcgatttagaaagacaatccattgaatactactgtcgccaaatcaatgaagcggtaaccaaatacgaatgccgcctattgccgcctttcttcaaacaactgacgcactacgtggaaatgggcaactctgcattcgactgtccaggacaccaaggcggtcagttcttcaaaaaacacccagcaggtaaacagttctacgatttcttcggtgaaaacctattccgtagtgacttgtgtaacgcggacgtagatttaggtgacttgttgatccacgaaggctctgcccaccaagctcaagcgcacgcagcaaaagtgttcaactcagacaaaacttacttcgtactcaacggcacttcggcttcaaacaaagtggtttgtaacgcgttagtgaccgagggtgacttggtgatgtttgaccgtaacaaccacaaatcaaaccaccacggcgcattaatccaagcgggcggtatgccagtttacctagaaacggcgcgtaacccttggggctttattggtggcatggatgagcactgttttgatgaagaatacatccgtgcccaaatcgccaaagtatcacccgaacgtgcgcgtgatgcgcgtccattccgtcttgcgatcatccaattgggtacttacgacggtaccatctacaacgcacgctacgtgatggataagattggtcatctatgtgactacatcctgtttgactcggcatgggtaggctacgagcagttcattcctatgatgaaagactgttcgccactgctactggatctgaaaccagaagatgcgggtgtgatcgtgactcagtctgttcacaagcagcaagcaggcttctctcaaacctcgcaaatccacaaaaaagaccaccacatcaaaggtcaggctcgctactgcaaccacaaacgcttcaacaacgcgtttatgatgcacgcgtcaacctcacctttctacgcactgttctccgcattggatgtgaacgcgaagatccacgatggtgaagcgggtctgcgcctatggcgtgatgcggttaagacaggtatcgaagcgcgtaaagaaatcctcaaaagttgtgagctgatccgtccgttcattccagaccaagttgatggtcaaccatggggcagctacgacacggatgtcatcgccaccaacaagaaattcttcatgtttgagccaaacgcaagctggcataaattcgaaggttacggcgaaggccaatacttcgttgacccatgtaaattgctactcaccacagccggtattgccgaagatggtagctacgcagactttggtattcctgccacgctattggcgaacttcctacgtgagaacggcatcatccctgagaagtgtgacttgaactctatcttgttccttcttactccagcagaggacatgggtaagatccgtcatcttgtggcgcaaattaaccgcttcgagaaattcattcgtgatgatgcgccgctaaacatcgtgctgcctcgcgtttacgaagcgaacaaagagcgctaccgtggctacaccattcgtcagctatgtcaggaaatgcatgacatgtacaaagagctgaacgtgaaacagctacaaaaagcgatgttccgtagcgagtacttcccaaccatggtgcacaaaccggatgtggcaacacgcaaatacttccgcggcgagtgtgattacttgccgctgaaagaagcggtcggtcgtgtcgctgcagaaggtgcgcttccttaccctccaggcattatctgtgtgatcacgggcgaaatctggactcaacaagtggtcgattacttcttatctctagaagaaggcatcaaccgattcccaggcttcgcaccagagattcaaggtgtgtacctagaagacgtcaatggccgcaccaccgcccattgctacgcccttaaagattaa

SEQ ID NO: 91730 - protein, 726 aa, Vibrio vulnificus
MKRLVIGVSNYMPEDFSLLAESLDEQFNRHLHPLEQVELTDVGAAIITSADIKAGLHKVISETGYGIPVFLVTDENPVSAEDYVWLTGVIDLERQSIEYYCRQINEAVTKYECRLLPPFFKQLTHYVEMGNSAFDCPGHQGGQFFKKHPAGKQFYDFFGENLFRSDLCNADVDLGDLLIHEGSAHQAQAHAAKVFNSDKTYFVLNGTSASNKVVCNALVTEGDLVMFDRNNHKSNHHGALIQAGGMPVYLETARNPWGFIGGMDEHCFDEEYIRAQIAKVSPERARDARPFRLAIIQLGTYDGTIYNARYVMDKIGHLCDYILFDSAWVGYEQFIPMMKDCSPLLLDLKPEDAGVIVTQSVHKQQAGFSQTSQIHKKDHHIKGQARYCNHKRFNNAFMMHASTSPFYALFSALDVNAKIHDGEAGLRLWRDAVKTGIEARKEILKSCELIRPFIPDQVDGQPWGSYDTDVIATNKKFFMFEPNASWHKFEGYGEGQYFVDPCKLLLTTAGIAEDGSYADFGIPATLLANFLRENGIIPEKCDLNSILFLLTPAEDMGKIRHLVAQINRFEKFIRDDAPLNIVLPRVYEANKERYRGYTIRQLCQEMHDMYKELNVKQLQKAMFRSEYFPTMVHKPDVATRKYFRGECDYLPLKEAVGRVAAEGALPYPPGIICVITGEIWTQQVVDYFLSLEEGINRFPGFAPEIQGVYLEDVNGRTTAHCYALKD

SEQ ID NO: 91731 - DNA, 2307 bp, Photorhabdus luminescens; identical to SEQ ID NO: 816
  CDS (1)..(2307)

SEQ ID NO: 91732 - protein, 768 aa, Photorhabdus luminescens; identical to SEQ ID NO: 399

SEQ ID NO: 91733 - DNA, 1404 bp, Gloeobacter violaceus; identical to SEQ ID NO: 396
  CDS (1)..(1404)

SEQ ID NO: 91734 - protein, 467 aa, Gloeobacter violaceus; identical to SEQ ID NO: 397

SEQ ID NO: 91735 - DNA, 2259 bp, Chromobacterium violaceum; identical to SEQ ID NO: 394
  CDS (1)..(2259)

SEQ ID NO: 91736 - protein, 752 aa, Chromobacterium violaceum; identical to SEQ ID NO: 395

SEQ ID NO: 91737 - DNA, 1251 bp, Chromobacterium violaceum; identical to SEQ ID NO: 822
  CDS (1)..(1251)

SEQ ID NO: 91738 - protein, 416 aa, Chromobacterium violaceum; identical to SEQ ID NO: 393

SEQ ID NO: 91739 - DNA, 2352 bp, Fusobacterium nucleatum subsp
  CDS (1)..(2352)
atgtctaaattagaccaaaataagacaccattatttacagtattaaaagatgaatatgtgagaagaaatatacttccatttcatgttcctggacataaaagaggaaggggagttgataaagaattttttaattttatgggagaagctcctttttcaatagatgtaacaatttttaaaatggttgatggtttacatcatccaaaaagttgtataaaagaagctcaagaattacttgcagatgcttatggagttaaacatagtttttttgcagtaaatggaacttctggtgcaatacaagcaatgataatgtcagttataaaagcaggagaaaaaatattagtaccaagaaatgtgcataaatcagtttcagcaggaattattttaagtggttctgaacctgtatatatgaatcctgaaattgatgaaaatttaggaattgccttaggagttaaaccacaaactgttgaaaatatgctaaaacaagatcctgatatagcagcagttcttattataaatccaacttattatggggtggcaacagatattaaaaaaatagctgatatagttcatagctatgatatacctcttattgtagatgaagctcatggaccacatctacatttccatgatgagttaccaatttcagctgttgatgctggagcagatatttgtactcaaagtacacataaaattttaggtgctatgactcaaatgtcagttatccatgtaaattctgatagagttaatgttgaaaaagtaaaacaaattttaagtttacttcatacaacttctccatcatatccattaatggcatctcttgattgttcaagaaggcaaatagctacacaaggtcaagagctacttacaagaactattgagcttgctaagtattttagaagagaggctaatagaatcccaggaatttattgttttggagaagaacttattggaaaagatggttttttcgcttttgatccaacaaagattacaatatctgcaaaagaattaggactaaaaggtggagaacttgaaagcctacttgtagatgattataatattcaaatggaattatcagattactataacactttgggacttattacaataggagatacggaagaaagtgtaaacaaattacttgatgctttaagagatataagtagaagattttttggaaaagggaaaacattggaaaaaaatattataaagcttcctgaaactcctgaattagtattaatgccaagagaagctttttacagtgaaaagaataaagttccatttaaagaaagtgttggaaaaatttctggtgaaatgataatggcatatcctcctggtattccaataatcattgcaggagaaagaattagccaagatatagttgattatattgaagaattaaaagaagctaatttacatattcaaggtatggaggaccctgaacttgaaactataaatgtaattgaagaagaagatgctatttacttatatactgaaaagatgaaaaatgttcttattggagtacaaacaaatcttggagttaacaagacaggaactgaatttggacctgatgatttaattcaagcatacccagatacttttgatgaaatggaattaatttctgtcgaaagacaaaaggaagatttcaatgataaaaaattgaaattcaaaaatacagttttagatacttgtgaaaaaatagctaagagagttaatgaagctgtaattgatggatatagaccaatacttgttggaggagaccactcaatttcattaggaagtgtatcaggtgtttctctagaaaaagaaattggaattttatggataagtgctcatggagatatgaacactcctgaaagtacacttacaggtaatattcatggaatgccattagctttacttcaaggtttaggagatagagaacttgtaaactgtttctatgaaggtgctaaacttgacagcagaaacatagtcatctttggtgcaagagaaattgaagtagaagaaagaaaaattattgaaaaaactggtgtaaaaattgtttactatgatgatattctaagaaaaggtatagacaatgttttagatgaaataaaagattatttaaaaattgataatttgcatattagtatagatatgaatgtatttgacccagaaattgctcctggtgtatctgtacctgttagaagaggaatgtcttatgatgaaatgtttaaatcattgaaatttgtatttaaaaattactcagttacatcagcagatattacagaatttaacccattaaatgatattaatggaaaaactgctgaacttgtaaatggtatagtgcaatatatgatgaacccagattattaa

SEQ ID NO: 91740 - protein, 783 aa, Fusobacterium nucleatum subsp
MSKLDQNKTPLFTVLKDEYVRRNILPFHVPGHKRGRGVDKEFFNFMGEAPFSIDVTIFKMVDGLHHPKSCIKEAQELLADAYGVKHSFFAVNGTSGAIQAMIMSVIKAGEKILVPRNVHKSVSAGIILSGSEPVYMNPEIDENLGIALGVKPQTVENMLKQDPDIAAVLIINPTYYGVATDIKKIADIVHSYDIPLIVDEAHGPHLHFHDELPISAVDAGADICTQSTHKILGAMTQMSVIHVNSDRVNVEKVKQILSLLHTTSPSYPLMASLDCSRRQIATQGQELLTRTIELAKYFRREANRIPGIYCFGEELIGKDGFFAFDPTKITISAKELGLKGGELESLLVDDYNIQMELSDYYNTLGLITIGDTEESVNKLLDALRDISRRFFGKGKTLEKNIIKLPETPELVLMPREAFYSEKNKVPFKESVGKISGEMIMAYPPGIPIIIAGERISQDIVDYIEELKEANLHIQGMEDPELETINVIEEEDAIYLYTEKMKNVLIGVQTNLGVNKTGTEFGPDDLIQAYPDTFDEMELISVERQKEDFNDKKLKFKNTVLDTCEKIAKRVNEAVIDGYRPILVGGDHSISLGSVSGVSLEKEIGILWISAHGDMNTPESTLTGNIHGMPLALLQGLGDRELVNCFYEGAKLDSRNIVIFGAREIEVEERKIIEKTGVKIVYYDDILRKGIDNVLDEIKDYLKIDNLHISIDMNVFDPEIAPGVSVPVRRGMSYDEMFKSLKFVFKNYSVTSADITEFNPLNDINGKTAELVNGIVQYMMNPDY

SEQ ID NO: 91741 - DNA, 2196 bp, Shigella flexneri; identical to SEQ ID NO: 390
  CDS (1)..(2196)

SEQ ID NO: 91742 - protein, 731 aa, Shigella flexneri; identical to SEQ ID NO: 391

SEQ ID NO: 91743 - DNA, 2271 bp, Bordetella pertussis
  CDS (1)..(2271)
atgaaattccgcttccccattttcatcatcgacgaagactatcgctccgagaacgcctcggggctgggcattcgcgcgctggcttcggcgatcgaggccgagggcgtggaggtcatcggggtgaccagctacggcgacctgagctcgtttgcccagcagcaaagccgcgccagcgccttcatcctgtcgatcgacgatgaggagttcgacgtcgattctccggaagacgtggcgggcgcgatcaagaacctgcgcacgttcatcggcgagctgcgtttccgcaacgccgacatccccatctacctgtacggcgagacgcgcacgtcggaacacatcccgaacgacatcctgcgcgagctgcacggcttcatccacatgttcgaggacacgccggagttcgtggcgcgccacatcatccgcgaagcgcgcagctacgtggacggcctgccgccgccgttcttccgcgagctggtcaaatatgcccaggacggttcgtattcctggcactgcccggggcactcgggcggcgtggcgttcctcaagagcccggtgggccagatgttccaccagttcttcggcgagaacatgctgcgcgccgacgtctgcaacgcggtcgacgagctgggccagctgctggaccacaccggcccggtggccgagtccgagctgaatgccgcgcgcattttccatgccgaccactgcttcttcgtcaccaacggcacctcgacgtcgaacaaggtcgtctggcatgccaacgtggccgccggcgacgtggtggtggtggaccgcaactgccacaagtcgatcctgcacgccatcaccatgaccggcgcgatcccggtgttcctgcgccccacgcgcaaccacctgggcatcatcggaccgatcccgctcgacgaattcgacccggaaaacatccgccgcaagatcgaggccaacccgttcgcgcgcgaggcgctgaacaagaagccgcgcatcctcacgctgacgcagagcacctatgacggcgtcatctacaacgtcgagatgatcaaggaaaagctgggcacctacgtcgacacgctgcatttcgacgaggcctggctgccgcacgcggccttccacgagtactaccgcgacatgcacgcgatcggcccggaccgcccgcgcagccaggacgccatggtgttcgccacgcactccacgcacaagctgctggccggcatctcgcaggcctcgcagatcatcgtgcaggagtccgagagccgcaagctggaccgcaacctcttcaacgaggcctacctgatgcatacgtcgacctcgccgcagtacgcgatcatcgcgtcgtgcgacgtggccgccgccatgatggagccgccgggcggcaccgccctggtcgaggaaagcatccgcgaggccatggactttcgccgcgccatgcgcaaggtggcctccgagttcggcaaggacgactggtggttcaaggtgtggggccccaaccgcctcgcgcccgagggcatcggccatcgcgacgactgggtgctggagtcgggcgaccactggcacggctttggcgacctggcgccgggcttcaacatgctcgacccgatcaaggccaccatcatcaccccgggcctggacatgtcgggcagcttcggcgaaagcggcataccggccgcgctggtgtcgaagtacctggccgagcacggcgtcgtggtggagaagaccggcctgtattcgttcttcatcctgttcaccatcggtatcaccaagggccgctggaacaccctgctgaccgcgctgcagcagttcaaggacgactacgaccgcaaccagcccctgtggcgcatcctgcccgagttctgccgcggtcaccgccgctacgagcgcatgggcctgcgcgacctatgccagcagatccacgaggcctatcgcgaacgcgacgtggcgcgcctgaccaccgagatgtacctgagcgacatggtgccggcgctcaagccctcggacgccttcgcccgcatggcgcaccgcgaagtcgagcgcgtcgagatcgaccagctcgaaggccgcgtgaccggcgtgctgctcacgccgtacccgccgggcattccgctgctgatcccgggcgagcgcttcaaccggaccatcgtgcaatacctgcagttcgcgcgcgagttcaacgagcgcttccccggcttcgagacctacatccacggcctggccgacgaagagggccccgatggcgccaagcgctattacgtcgactgcctgaaggacgccggcgagcagtaa

SEQ ID NO: 91744 - protein, 756 aa, Bordetella pertussis
MKFRFPIFIIDEDYRSENASGLGIRALASAIEAEGVEVIGVTSYGDLSSFAQQQSRASAFILSIDDEEFDVDSPEDVAGAIKNLRTFIGELRFRNADIPIYLYGETRTSEHIPNDILRELHGFIHMFEDTPEFVARHIIREARSYVDGLPPPFFRELVKYAQDGSYSWHCPGHSGGVAFLKSPVGQMFHQFFGENMLRADVCNAVDELGQLLDHTGPVAESELNAARIFHADHCFFVTNGTSTSNKVVWHANVAAGDVVVVDRNCHKSILHAITMTGAIPVFLRPTRNHLGIIGPIPLDEFDPENIRRKIEANPFAREALNKKPRILTLTQSTYDGVIYNVEMIKEKLGTYVDTLHFDEAWLPHAAFHEYYRDMHAIGPDRPRSQDAMVFATHSTHKLLAGISQASQIIVQESESRKLDRNLFNEAYLMHTSTSPQYAIIASCDVAAAMMEPPGGTALVEESIREAMDFRRAMRKVASEFGKDDWWFKVWGPNRLAPEGIGHRDDWVLESGDHWHGFGDLAPGFNMLDPIKATIITPGLDMSGSFGESGIPAALVSKYLAEHGVVVEKTGLYSFFILFTIGITKGRWNTLLTALQQFKDDYDRNQPLWRILPEFCRGHRRYERMGLRDLCQQIHEAYRERDVARLTTEMYLSDMVPALKPSDAFARMAHREVERVEIDQLEGRVTGVLLTPYPPGIPLLIPGERFNRTIVQYLQFAREFNERFPGFETYIHGLADEEGPDGAKRYYVDCLKDAGEQ

SEQ ID NO: 91745 - DNA, 2271 bp, Bordetella parapertussis; identical to SEQ ID NO: 386
  CDS (1)..(2271)

SEQ ID NO: 91746 - protein, 756 aa, Bordetella parapertussis; identical to SEQ ID NO: 387

SEQ ID NO: 91747 - DNA, 1422 bp, Bacillus cereus; identical to SEQ ID NO: 832
  CDS (1)..(1422)

SEQ ID NO: 91748 - protein, 473 aa, Bacillus cereus; identical to SEQ ID NO: 381

SEQ ID NO: 91749 - DNA, 1422 bp, Bacillus anthracis; identical to SEQ ID NO: 836
  CDS (1)..(1422)

SEQ ID NO: 91750 - protein, 473 aa, Bacillus anthracis; identical to SEQ ID NO: 377

SEQ ID NO: 91751 - DNA, 2271 bp, Shigella flexneri
  CDS (1)..(2271)
atgatgaaagtattaattgttgaaagcgagtttctccatcaagacacctgggtcggtaacgccgttgagcgtctggcagatgctttaagccagcaaaatgttaccgtgattaaatccacctcctttgatgatggttttgccattctctcttcaaacgaagccattgactgcctgatgttcagctatcaaatggagcatccggacgaacatcaaaacgtcagacaattgatcggtaagcttcatgagcgccaacaaaacgtgccggtcttcctgttgggcgatcgggaaaaagccctcgccgcaatggaccgggatctgctggagcttgtcgatgaattcgcctggattctggaagataccgccgactttatcgccggacgcgccgttgccgcgatgacccgctaccgccagcagctgttgccgccactgttcagcgcgctgatgaaatatagtgacatccatgaatattcctgggcagcgccaggccaccagggcggcgttggttttaccaaaacacccgccggacgtttctaccatgactactatggtgaaaatctgttccgcaccgacatgggcatcgaacgaacttccctcggttctttgcttgaccatactggcgcatttggcgaaagcgaaaaatatgccgcacgcgtatttggtgccgatcgctcctggtcggtagtcgtcggtacttccggctctaaccgcaccatcatgcaggcttgcatgaccgataacgatgtcgtggtcgttgaccgtaactgccataaatccatcgaacaaggtttgatgctgacaggcgcgaaaccggtctatatggtgccaagccgcaaccgctacggcattatcgggccaatctatccgcaggaaatgcaacctgaaaccttgcaaaagaaaatcagtgaaagcccgctgaccaaagacaaagccgggcaaaaaccgtcttactgcgtggtaaccaactgcacctatgacggcgtgtgttataacgctaaagaagcgcaggatctgctggaaaaaacctccgatcgtctgcactttgacgaagcctggtacggctatgcacgtttcaacccgatctatgccgatcactatgccatgcgcggcgaacctggcgatcacaacggtcctaccgttttcgccacccactccatccacaaactgctgaatgcgctgtcacaggcttcttatattcatgtacgtgaaggtcgtggggcgattaacttctcccgcttcaaccaggcctacatgatgcatgccaccacctccccgctgtatgccatctgcgcatccaacgacgtggcggtgtcgatgatggacggcaacagcggcctgtcactgacacaggaagtgattgacgaagcggttgatttccgtcaggcgatggcgcggctatataaagagttcaccgctgacggtagctggttcttcaaaccgtggaacaaagaagtcgtcaccgacccacaaaccggcaaaacctatgactttgctgacgcaccaaccaaactgctgaccaccgttcaggactgctgggtaatgcatccgggcgaaagctggcacggcttcaaagatattccggataactggagtatgctcgacccaattaaagtcagcatccttgctccgggaatgggtgaagatggtgaactggaagaaaccggtgttccggcggcgctggtcactgcctggcttggtcgccacggcattgtgcctacccgcaccactgacttccaaattatgttcctgttctctatgggcgtaacccgtgggaaatgggggactctggttaacaccctttgctccttcaaacaccactatgacgccaacacaccgctggcgcaggtgatgccggaacttgttgaacaatatcctgacacttacgcgaacatggggattcacgatctgggtgacaccatgtttgcctggctgaaagaaaacaaccctggcgcacggttgaacgaagcctattccggcctgccggtggcggaaatcaccccgcgtgaagcgtacaacgcgattgtcgacaacaatgtcgaactggtatccattgaaaatctgccaggacgcatcgcggcaaactcagttatcccgtatccgccaggaatcccgatgctgctgtctggtgaaaacttcggcgataaaaacagtccgcaagtaagttatttacgctcgctgcaatcctgggaccaccatttccctagatttgaacacgaaactgaagggactgaaattattgacggtatttaccacgttatgtgcgtgaaagcgtaa

SEQ ID NO: 91752 - protein, 756 aa, Shigella flexneri
MMKVLIVESEFLHQDTWVGNAVERLADALSQQNVTVIKSTSFDDGFAILSSNEAIDCLMFSYQMEHPDEHQNVRQLIGKLHERQQNVPVFLLGDREKALAAMDRDLLELVDEFAWILEDTADFIAGRAVAAMTRYRQQLLPPLFSALMKYSDIHEYSWAAPGHQGGVGFTKTPAGRFYHDYYGENLFRTDMGIERTSLGSLLDHTGAFGESEKYAARVFGADRSWSVVVGTSGSNRTIMQACMTDNDVVVVDRNCHKSIEQGLMLTGAKPVYMVPSRNRYGIIGPIYPQEMQPETLQKKISESPLTKDKAGQKPSYCVVTNCTYDGVCYNAKEAQDLLEKTSDRLHFDEAWYGYARFNPIYADHYAMRGEPGDHNGPTVFATHSIHKLLNALSQASYIHVREGRGAINFSRFNQAYMMHATTSPLYAICASNDVAVSMMDGNSGLSLTQEVIDEAVDFRQAMARLYKEFTADGSWFFKPWNKEVVTDPQTGKTYDFADAPTKLLTTVQDCWVMHPGESWHGFKDIPDNWSMLDPIKVSILAPGMGEDGELEETGVPAALVTAWLGRHGIVPTRTTDFQIMFLFSMGVTRGKWGTLVNTLCSFKHHYDANTPLAQVMPELVEQYPDTYANMGIHDLGDTMFAWLKENNPGARLNEAYSGLPVAEITPREAYNAIVDNNVELVSIENLPGRIAANSVIPYPPGIPMLLSGENFGDKNSPQVSYLRSLQSWDHHFPRFEHETEGTEIIDGIYHVMCVKA

SEQ ID NO: 91753 - DNA, 2136 bp, Shigella flexneri; identical to SEQ ID NO: 824
  CDS (1)..(2136)

SEQ ID NO: 91754 - protein, 711 aa, Shigella flexneri; identical to SEQ ID NO: 825

SEQ ID NO: 91755 - DNA, 2127 bp, Escherichia coli; identical to SEQ ID NO: 334
  CDS (1)..(2127)

SEQ ID NO: 91756 - protein, 708 aa, Escherichia coli; identical to SEQ ID NO: 335

SEQ ID NO: 91757 - DNA, 1563 bp, Oryza sativa; identical to SEQ ID NO: 842
  CDS (1)..(1563)

SEQ ID NO: 91758 - protein, 520 aa, Oryza sativa; identical to SEQ ID NO: 327

SEQ ID NO: 91759 - DNA, 2181 bp, Vibrio parahaemolyticus
  CDS (1)..(2181)
atgaaacgtttaattataggtgttagtaattacatgccagaagacttcagtttattagctgaatctttagatgaacaatttaatcgtcatttacaacctttagagcaagttgaattaaccgacgttggtgcggctattattacttcagcagacattaaagcaggtctgcataaaatgatttctgaaacgggttacggtattccagttttcttagtaacggatgaaaacccagtttcggcagaagattacgtttggctaactggcgttatcgatttagaaagacaatctattgagtactactgtcgtcaaatcaacgaagcagtaaccaagtacgaatgtcgtctgcttcctcctttcttcaagcaattaacgcactatgttgagatgggtaactcagcgtttgactgtccgggacaccaaggtggtcagttcttcaaaaaacacccagctggtaaacaattctacgatttctttggcgaaaacctgttccgtagtgacttgtgtaacgcggacgtggatttaggtgacttgctgatccacgaaggttctgcacaccaagcgcaagcgcacgctgcaaaagtatttaacgcggacaaaacttacttcgtactcaacggtacttctgcttcaaacaaagtggtgtgtaacgcgctagtaactgaaggtgatttggtactgttcgaccgtaacaaccacaaatcgaaccaccacggtgcgttaatccaagcgggtggtatgccagtttacttagaaacggcgcgtaacccttggggcttcatcggtggtatggatgagcactgtttcgatgaagaatacattcgtgctcaaatcgcgaaagtggatccagaacgtgcacgcgatgaacgtcctttccgtcttgctattatccagcttggtacttacgacggtactatctataacgctcgctacgtgatggataagatcggtcatctttgtgactacatcctgtttgactctgcgtgggttggttatgagcagttcatccctatgatgaaagactgttcaccactgctgctggatttgaaaccagaagacgcaggtgtgatcgtgactcagtctgttcacaaacaacaagctggtttctctcaaacatcgcaaatccacaaaaaagaccgccatatcaaaggtcaagctcgttactgtaaccacaaacgctttaacaacgcgtttatgatgcacgcatcgacttcaccattctacgcactgttctctgcgcttgatgtgaacgcgaagatccacgacggcgaagccggtctgcgtttatggcgcgatgcggttaagactggtatcgaagcgcgtaaagaaatccttaagagttgtgaattgattcgtccgttcattccagacgaagtcgaaggtcaaccttggggcagctacgacactgacgtgatcgcaacgaacaagaaattcttcatgtttgagccaaacgcaagctggcacaaatttgaaggttacggtgaaggtcaatacttcgttgacccatgtaaattgttgctaactactgcgggtattgcagaagacggcagctacgcagatttcggtattcctgcaacgctattggcgaacttccttcgtgaaaacggcatcatccctgagaagtgtgacttgaactctatcttgttcctactcactcctgcggaagatatgggtaagatccgtcaccttgtggctcaaattaaccgattcgaaaaattcatccgtgatgatgcgcctctaagtatcgtacttccaagcgtctacgaagcgaataaagaacgctaccgtggctacaccatccgtcagctatgtcaggaaatgcatgacatgtacaaagagctgaacgtgaaacagctacaaaaagcgatgttccgcagcgagtacttcccacaaatggttcacaaaccagacgtggcaacacgcaaatacttccgtggtgaatgcgattacctaccacttaaagaggccgttggtcgcgtagccgctgagggtgcacttccttaccctccaggcatcatctgtgtgatcactggtgaaatctggaccccacacgtggtggattacttcctatctctagaagaaggcatcaaccgcttcccaggcttcgcgccagaaattcaaggcgtgtaccttgaagatgttaacggtcgcactaccgcacattgttatgtcctaaaagattaa

SEQ ID NO: 91760 - protein, 726 aa, Vibrio parahaemolyticus
MKRLIIGVSNYMPEDFSLLAESLDEQFNRHLQPLEQVELTDVGAAIITSADIKAGLHKMISETGYGIPVFLVTDENPVSAEDYVWLTGVIDLERQSIEYYCRQINEAVTKYECRLLPPFFKQLTHYVEMGNSAFDCPGHQGGQFFKKHPAGKQFYDFFGENLFRSDLCNADVDLGDLLIHEGSAHQAQAHAAKVFNADKTYFVLNGTSASNKVVCNALVTEGDLVLFDRNNHKSNHHGALIQAGGMPVYLETARNPWGFIGGMDEHCFDEEYIRAQIAKVDPERARDERPFRLAIIQLGTYDGTIYNARYVMDKIGHLCDYILFDSAWVGYEQFIPMMKDCSPLLLDLKPEDAGVIVTQSVHKQQAGFSQTSQIHKKDRHIKGQARYCNHKRFNNAFMMHASTSPFYALFSALDVNAKIHDGEAGLRLWRDAVKTGIEARKEILKSCELIRPFIPDEVEGQPWGSYDTDVIATNKKFFMFEPNASWHKFEGYGEGQYFVDPCKLLLTTAGIAEDGSYADFGIPATLLANFLRENGIIPEKCDLNSILFLLTPAEDMGKIRHLVAQINRFEKFIRDDAPLSIVLPSVYEANKERYRGYTIRQLCQEMHDMYKELNVKQLQKAMFRSEYFPQMVHKPDVATRKYFRGECDYLPLKEAVGRVAAEGALPYPPGIICVITGEIWTPHVVDYFLSLEEGINRFPGFAPEIQGVYLEDVNGRTTAHCYVLKD

SEQ ID NO: 91761 - DNA, 4026 bp, Vibrio parahaemolyticus
  CDS (1779)..(3914)
gatagaggttgataacttttatcgcgattaccgacgagttgatgagagtttatctatcggtagaaggtttgatgtttttcttataactgcatgaataatatggttttatatttttgtgtttatcatatttatctcaacttgatgttgattaactaatcattttattgataacgccaagtttatttttttcccgatttttgggcgtagtcttcacttcgaaatttagcgaggtcgagcaggtatccacttcatagcatctcgctaataaccgttcagtttgagtcacgttgacttgagtggaatagatttggagatgttatgtcatcgaatacgaaaaaaatcggcctaattgcctgtacgggtgtagtcgccggtaacatgatgggtagtggtattgcactgttaccttccagcctagcttcagtaggctctgtttcaattttcagctggctgatctgtttgatcggtgcactgagccttgcgtttgtttacgctcgtctggcaatcaaaaaccctcaagaaggtggtcctatcgcttatgcgggcgaagtttccccagtctttggtttccaaacgggcgtgctttattaccacgcgaactggattggtaacctagctattgctattacaggtgtttcttacctttcagtattcttccctgtgcttaatgacccaatcccagcgggtattgcgacgattgcatcggtatggatcttcactttcgtcaacctacttggtggtagctgggtaagccgtctatgtacgcttggtcttgttctaattctaattccagttgttggtaccgctctatttggttggacgcacttcgacactgcgctatacagccaaaactggaacgtatctgcgggtactgatagccatgcgattgtgactgcggttcttatctgtctatggtcattcgttggtgtggaatcagcagcagtatcgacaggtatggtagaaaaccctaaacgtactgtaccgctagcaaccatgctgggtactggtatcgcaggtgtgatttacatcctatcaactcaaatgatcagcggcatgttccctgcttctgaagttgcggcatcaggtgcgccatttgcattggcaaccactgagctattcggtagctggactgcaccattcgtatcagcattcactgcactagcatgttttacttcgctaggttcttggatgatgctggtgggcgaagctggtaaacgtgcagcaagcgatggcaacttccctaaaatctacggcgaaactgacaaaaacggtgtgcctaagaaaggtttaatccttgcgtcaatcaagatgacagcattaatggttgtactgatgttcttcagctctaaaacagcacacgcatcagacctgttcaaccagctaacgactgatgcagttctactaactatgctgccttacttctactcaagcattaacttgatccgctttgaaggtatgacaacacgcaacggcttcgtaatgctgttctctggtgtggcttgtctgttctgcttcattgcccttgctggtgcagaaggcggtacgctaacagcaaccttcatcgtgtctctcgttatcttgatgttctacagcaaaaaagccggcttagctcagtacatgaagctacacgctgacgacatgcctgctcaagcaagcaactaatccccaaacgctggcacttcggtgccagccaataaaaaacaaattcactcggcgctcaccttactcactgcctgtaaatggcagagagcgccttcattcgccttggagatgtccaaatgaatattttcgctatcttgaaccacatgggtgtgttctttaaagaagagccagttcgtcaacttcacgctgctcttgagaaagcgggctacgaagtggtttacccagtagatgataaagacttgatcaaaatgattgagatgaacccacgcatttgcggtgtgctgttcgactgggataaatactcactagagctatgtgaacgtattagccagatcaacgaaaaactgcctgttcacgcatttgctaacgaacagtctactctcgatatttcactaacagacctacgtctaaacgtgagcttcttcgagtacgctttaggtatggctgacgacatcgctatcaaaatcaaccaagcgactgaggcatacaaagatgccatcatgcctccattcactaaagcgctattcaaatacgtagaagaaggtaaatacaccttctgtactccaggtcacatgggcggtactgcattccagaaaagccctgctggtagcatcttctatgatttttacggtccaaacacattcaaagcggacgtatcaatctcaatgcctgagttaggttctctactagaccactcaggtcctcataaagatgcagaagaatacatcgcacgtaccttcaatgcagacagttcttacatcgtaactaacggtacgtctacatcgaacaaaatcgtgggcatgtactcagcacctgcgggcagcacagtactgattgaccgtaactgtcacaaatctctgactcacctaatgatgatgagcgacgtgacaccaatctacttccgcccaactcgtaacgcatacggcatccttggtggtattccacaaagcgaattcagccgtgatgtcattgcagagaaagtggcgaaaacaccaggtgcaacagcgccaagttacgcagtagtgactaactcaacttacgatggtctgttgtacaacacacaattcatcaaagagtcgctagactgtaaacacatccacttcgacagtgcttgggtgccttacactaacttcaacccaatttacgaaggtaaatgtggtatgagtggtgaagcgatgccaggcaaagtgttctacgagacacaatcaacacacaaactgttggcagcgttctcacaagcttcaatgattcacgtgaaaggtgactttgataaagagtctttcaacgaagcattcatgatgcacacttcaacttcacctcagtacggcattgttgcttctactgaaactgcagcggcaatgatgcgcggcaacactggtaagaagttgatgcaagactctatcgatcgcgcaattcgcttccgtaaagagatcaaacgcctagaagcagaaagtgacagctggttcttcgatgtatggcaaccagaaaacatcgataccacagaatgttggaaactagaccctagcgatacatggcacggcttcaagaacatggatgacaaccacatgtatcttgacccaatcaaagtaacgctactgactccagggatgaacaaagaaggcgaactagaagaatcaggtattcctgcttcgctggtggctaaattcctagacgagcgcggcatcgtggttgagaaaacaggcccatacaacttgttgttcctattctcaatcggtatcgacaaatcaaaagcaatgcaattactacgcggtctgactgaatttaaacgtggctacgacttgaacctaaccatcaagagcttccttccttcgctatataacgaagatccaagcttctatgaaggcatgcgcgttcaagaattggcacaagcaattcatgacctaactaagaaatacaacctaccagagctaatgtacaaagcgttcgatgttcttccagaaatgaaagtaacaccacacgcagcatggcaagaagagcttcgcggtaacgtagaagaaatcaaactggaagaaatggttggtcgcgtaagtgcgaacatgatccttccttatcctccaggtgtgccactagtacttcctggtgaaatggtgactcaagagtctcgccctgtgctggacttcctagagatgctttgtgagatcggggcgcattacccaggtttcgaaaccgatatccacggtctgtaccaacaaaaagatggtagctacaccgtaaaagtattgaagaactaagttcctctcgaagatgacgccattgggaatgcaagcatgctccactcttacgagctcaatgtgtcatcgaacaaccacgacatttagatatacccctagctaatctgtcgta

SEQ ID NO: 91762 - protein, 711 aa, Vibrio parahaemolyticus
MNIFAILNHMGVFFKEEPVRQLHAALEKAGYEVVYPVDDKDLIKMIEMNPRICGVLFDWDKYSLELCERISQINEKLPVHAFANEQSTLDISLTDLRLNVSFFEYALGMADDIAIKINQATEAYKDAIMPPFTKALFKYVEEGKYTFCTPGHMGGTAFQKSPAGSIFYDFYGPNTFKADVSISMPELGSLLDHSGPHKDAEEYIARTFNADSSYIVTNGTSTSNKIVGMYSAPAGSTVLIDRNCHKSLTHLMMMSDVTPIYFRPTRNAYGILGGIPQSEFSRDVIAEKVAKTPGATAPSYAVVTNSTYDGLLYNTQFIKESLDCKHIHFDSAWVPYTNFNPIYEGKCGMSGEAMPGKVFYETQSTHKLLAAFSQASMIHVKGDFDKESFNEAFMMHTSTSPQYGIVASTETAAAMMRGNTGKKLMQDSIDRAIRFRKEIKRLEAESDSWFFDVWQPENIDTTECWKLDPSDTWHGFKNMDDNHMYLDPIKVTLLTPGMNKEGELEESGIPASLVAKFLDERGIVVEKTGPYNLLFLFSIGIDKSKAMQLLRGLTEFKRGYDLNLTIKSFLPSLYNEDPSFYEGMRVQELAQAIHDLTKKYNLPELMYKAFDVLPEMKVTPHAAWQEELRGNVEEIKLEEMVGRVSANMILPYPPGVPLVLPGEMVTQESRPVLDFLEMLCEIGAHYPGFETDIHGLYQQKDGSYTVKVLKN

SEQ ID NO: 91763 - DNA, 1461 bp, Clostridium tetani; identical to SEQ ID NO: 846
  CDS (1)..(1461)

SEQ ID NO: 91764 - protein, 486 aa, Clostridium tetani; identical to SEQ ID NO: 847

SEQ ID NO: 91765 - DNA, 1416 bp, Clostridium tetani; identical to SEQ ID NO: 372
  CDS (1)..(1416)

SEQ ID NO: 91766 - protein, 471 aa, Clostridium tetani; identical to SEQ ID NO: 373

SEQ ID NO: 91767 - DNA, 2766 bp, Bradyrhizobium japonicum; identical to SEQ ID NO: 370
  CDS (1)..(2766)

SEQ ID NO: 91768 - protein, 921 aa, Bradyrhizobium japonicum; identical to SEQ ID NO: 371

SEQ ID NO: 91769 - DNA, 2517 bp, Bradyrhizobium japonicum; identical to SEQ ID NO: 852
  CDS (1)..(2517)

SEQ ID NO: 91770 - protein, 838 aa, Bradyrhizobium japonicum; identical to SEQ ID NO: 369

SEQ ID NO: 91771 - DNA, 2181 bp, Vibrio vulnificus; identical to SEQ ID NO: 366
  CDS (1)..(2181)

SEQ ID NO: 91772 - protein, 726 aa, Vibrio vulnificus; identical to SEQ ID NO: 367

SEQ ID NO: 91773 - DNA, 2109 bp, Vibrio vulnificus
  CDS (1)..(2109)
atgggtgtgttctttaaagaagagccagttcgccaattgcatgcagcacttgaaaaagccggttatgaagttgtttatccagtggatgacaaagatttgatcaagatgatcgaaatgaacccgcgcatttgtggtgtgctgtttgactgggataaatactcgcttgagctttgtgagcgtattagccaaatcaacgaaaaactgccagtacacgcgtttgctaacgagcaatcaacgctggatatttcgcttaccgatctacgcctaaacgtgcatttctttgaatacgcattgggcatggcggacgacatcgccatcaagatcaaccaagcgacacaagaatacaaagacgcgattacaccgccattcaccaaagcgctgtttaaatacgtggaagaaggcaaatacaccttctgtactccaggtcacatgggtggtacggcttttcaaaaaagtccagtcggcagcattttctacgatttctacggtccaaatactttcaaagcggacgtgtcgatttctatgccagagctaggctcactgcttgaccattcaggtccacacaaagaagcggaagagtacattgcgcgtacgttcaacgctgacgcatcgtacatcgtgacgaacggtacttcgacgtcaaacaaaattgtcggcatgttctctgcgccagcgggcagcacggtattggttgaccgtaactgtcataaatcattgactcacctaatgatgatgacggacgtaacacctatttacttccgcccaacccgtaacgcttacggcattcttggtggtattccacaaagtgaattcagccgtgaagtgatcgcagaaaaagtggctaaaacaccaggtgcgagcgcgccaagctacgcggtgattaccaactcaacttacgatggtttgttgtacaacacacaattcatcaaagagtctctcgactgtaaacacatccactttgatagtgcgtgggtgccttacactaacttcaaccgtatttacgaaggcaaatgcggcatgagtggcgaagcgatgccaggcaaagtgttctacgaaacacaatccactcacaaactgttggcggcgttctcgcaagcgtcaatgattcacgtaaaaggtgaatttgaccgtgagtcgttcaacgaagcctttatgatgcacacttccacctcgcctcaatacggcattgtggcatcaacagaaaccgcggcggcaatgatgcgtggtaacacgggccgtaagttgatgcaagattcaatcgaccgtgcgattcgtttccgtaaagagatcaaacgcttaaaaggtgaaagtgacggttggttctttgatgtttggcaaccagagaacattgagacaaccgaatgctggaaacttgaccctaaccaagactggcatggcttcaagaacatggacgatgaccacatgtatcttgacccaatcaaaatcactttgctgactcctggaatgagcaaagatggtgagttggaaaccagtggtattcctgcttcattggtggcgaaatatcttgatgaacgtggcattgtggtagaaaaaacaggcccttacaacttgttgttcttgttctcaattggtatcgacaaatcaaaagcgatgcaattgctacgtggtttgactgagttcaaacgtggttacgatctgaacctaacgattcgcaccatgctgcctgcgctgtaccgtgaagatccagcgttctacgaaggcatgcgtattcaagagctggcacaaggcattcacgatctgactcgtaagtaccgtctaccagaattgatgtacaaagcgttcgatgtgctaccagagatgaaagtcacgccacacgcagcttggcaacaagagcttcgtggtcaaaccgaagagatcttgctgaatgatatggtgggccgcgtgagtgccaacatgatccttccttaccctccaggtgtgcctctagtgctaccaggtgaagtggtgacagaaagctctcgtccagtactggatttcttggaaatgttgtgtgaaatcggcgcacattacccaggcttcgagaccgacatccacggcctataccgccaaaaagatggccgttacaccgtaaaagtactgaaagactga

SEQ ID NO: 91774 - protein, 702 aa, Vibrio vulnificus
MGVFFKEEPVRQLHAALEKAGYEVVYPVDDKDLIKMIEMNPRICGVLFDWDKYSLELCERISQINEKLPVHAFANEQSTLDISLTDLRLNVHFFEYALGMADDIAIKINQATQEYKDAITPPFTKALFKYVEEGKYTFCTPGHMGGTAFQKSPVGSIFYDFYGPNTFKADVSISMPELGSLLDHSGPHKEAEEYIARTFNADASYIVTNGTSTSNKIVGMFSAPAGSTVLVDRNCHKSLTHLMMMTDVTPIYFRPTRNAYGILGGIPQSEFSREVIAEKVAKTPGASAPSYAVITNSTYDGLLYNTQFIKESLDCKHIHFDSAWVPYTNFNRIYEGKCGMSGEAMPGKVFYETQSTHKLLAAFSQASMIHVKGEFDRESFNEAFMMHTSTSPQYGIVASTETAAAMMRGNTGRKLMQDSIDRAIRFRKEIKRLKGESDGWFFDVWQPENIETTECWKLDPNQDWHGFKNMDDDHMYLDPIKITLLTPGMSKDGELETSGIPASLVAKYLDERGIVVEKTGPYNLLFLFSIGIDKSKAMQLLRGLTEFKRGYDLNLTIRTMLPALYREDPAFYEGMRIQELAQGIHDLTRKYRLPELMYKAFDVLPEMKVTPHAAWQQELRGQTEEILLNDMVGRVSANMILPYPPGVPLVLPGEVVTESSRPVLDFLEMLCEIGAHYPGFETDIHGLYRQKDGRYTVKVLKD

SEQ ID NO: 91775 - DNA, 2163 bp, Shewanella oneidensis; identical to SEQ ID NO: 362
  CDS (1)..(2163)

SEQ ID NO: 91776 - protein, 720 aa, Shewanella oneidensis; identical to SEQ ID NO: 363

SEQ ID NO: 91777 - DNA, 1419 bp, Oceanobacillus iheyensis; identical to SEQ ID NO: 860
  CDS (1)..(1419)

SEQ ID NO: 91778 - protein, 472 aa, Oceanobacillus iheyensis; identical to SEQ ID NO: 361

SEQ ID NO: 91779 - DNA, 2154 bp, Escherichia coli O6
  CDS (1)..(2154)
atgactatgaacgttattgcaatattgaatcacatgggggtttattttaaagaagaacccatccgtgaacttcatcgcgcgcttgaacgtctgaacttccagattgtttacccgaacgaccgtgacgacttattaaaactgatcgaaaacaatgcgcgtctgtgcggcgttatttttgactgggataaatataatctcgagctgtgcgaagaaattagcaaaatgaacgagaacctgccgttgtacgcgttcgctaatacgtattccactctcgatgtaagcctgaatgacctgcgtttacagattagcttctttgaatatgcgctgggtgctgctgatgatattgctaacaagatcaagcagaccactgacgaatatatcaacactattctgcctccgctgaccaaagcactgtttaaatatgttcgtgaaggtaaatatactttctgtactcctggtcacatgggtggtactgcattccagaaaagcccggtaggtagcctgttctatgatttctttggtccgaacaccatgaaatctgatatttccatttcagtatctgaattgggttctctgctggatcacagtggtccacacaaagaagcagaacagtatatcgctcgcgtctttaacgcagaccgcagctacatggtgaccaacggtacttccactgcgaacaaaattgttggtatgtactctgctccggcaggcagcaccattctgattgaccgtaactgccacaaatcgctgacccacctgatgatgatgagcgatgttacgccaatctatttccgcccgacccgtaacgcttacggtattcttggtggtatcccacagagtgaattccagcacgctaccattgctaagcgcgtgaaagaaacaccaaacgcaacctggccggtacatgctgtaattaccaactctacctatgatggtctgctgtacaacaccgacttcatcaagaaaacactggatgtgaaatccatccactttgactccgcgtgggtgccttacaccaacttctcaccgatttacgaaggtaaatgcggtatgagcggtggccgtgtagaagggaaagtgatttacgaaacccagtctactcacaaactgctggcggcgttctctcaggcttccatgatccacgttaaaggtgacgtaaacgaagaaacctttaacgaagcctacatgatgcacaccaccacctctccgcactacggtatcgtggcgtccactgaaaccgctgcggcgatgatgaaaggcaatgcaggtaaacgtctgatcaatggttccattgaacgtgcgatcaaattccgtaaagagatcaaacgtctgagaacggaatctgatggctggttctttgatgtatggcagccggatcatatcgatacgactgaatgctggccgctgcgttctgacagcacatggcacggcttcaaaaacatcgataacgagcacatgtatcttgacccgatcaaagtcaccctgctgactccggggatggaaaaagacggcaccatgagcgactttggtattccggccagcatcgtggcgaaatacctcgacgaacatggcatcgttgttgagaaaaccggtccgtataacctgctgttcctgttcagcatcggtatcgataagaccaaagcactgagcctgctgcgtgctctgactgacttcaaacgtgcgttcgacctgaacctgcgtgtgaaaaacatgctgccgtctctgtatcgtgaagatcctgaattctatgaaaacatgcgtattcaggaactggctcagaatatccacaaactgattgttcaccacaatctgccggatctgatgtatcgcgcatttgaagttctgccgactatggtaatgactccgtatgctgcgttccagaaagagctgcacggtatgaccgaagaagtttacctcgacgaaatggtcggtcgtattaacgccaatatgatccttccgtatccgccgggagttcctctggtaatgccgggtgaaatgatcaccgaagaaagccgtccggttctggagttcctgcagatgctgtgtgaaatcggcgctcactatccgggctttgaaaccgatattcacggtgcataccgtcaggctgatggccgctataccgttaaagtattgaaagaagaaagcaaaaaataa

SEQ ID NO: 91780 - protein, 717 aa, Escherichia coli O6
MTMNVIAILNHMGVYFKEEPIRELHRALERLNFQIVYPNDRDDLLKLIENNARLCGVIFDWDKYNLELCEEISKMNENLPLYAFANTYSTLDVSLNDLRLQISFFEYALGAADDIANKIKQTTDEYINTILPPLTKALFKYVREGKYTFCTPGHMGGTAFQKSPVGSLFYDFFGPNTMKSDISISVSELGSLLDHSGPHKEAEQYIARVFNADRSYMVTNGTSTANKIVGMYSAPAGSTILIDRNCHKSLTHLMMMSDVTPIYFRPTRNAYGILGGIPQSEFQHATIAKRVKETPNATWPVHAVITNSTYDGLLYNTDFIKKTLDVKSIHFDSAWVPYTNFSPIYEGKCGMSGGRVEGKVIYETQSTHKLLAAFSQASMIHVKGDVNEETFNEAYMMHTTTSPHYGIVASTETAAAMMKGNAGKRLINGSIERAIKFRKEIKRLRTESDGWFFDVWQPDHIDTTECWPLRSDSTWHGFKNIDNEHMYLDPIKVTLLTPGMEKDGTMSDFGIPASIVAKYLDEHGIVVEKTGPYNLLFLFSIGIDKTKALSLLRALTDFKRAFDLNLRVKNMLPSLYREDPEFYENMRIQELAQNIHKLIVHHNLPDLMYRAFEVLPTMVMTPYAAFQKELHGMTEEVYLDEMVGRINANMILPYPPGVPLVMPGEMITEESRPVLEFLQMLCEIGAHYPGFETDIHGAYRQADGRYTVKVLKEESKK

SEQ ID NO: 91781 - DNA, 2271 bp, Escherichia coli O6
  CDS (1)..(2271)
atgatgaaagtattaattgttgaaagcgagtttctccatcaagacacctgggtcggtaacgccgttgagcgtctggcagatgctttaagccagcaaaatgttaccgtgattaaatccacctcctttgatgatggttttgccattctctcttcaaacgaagccattgactgcctgatgttcagctatcaaatggaacatccggacgaacatcaaaacgtcagacaattgatcggtaagcttcatgagcgccaacaaaacgtgccggtcttcctgttgggcgatcgggaaaaagccctcgccgcaatggaccgggatctgctggagcttgtcgatgaattcgcctggattctggaagatactgccgactttatcgccggacgcgccgttgccgcgatgacccgctaccgccagcagctgttgccgccactgttcagcgcgctgatgaaatatagcgacatccatgaatattcctgggcagcgccaggccaccagggcggcgttggttttactaaaacacccgccggacgtttctaccatgactactatggtgaaaatctgttccgcaccgacatgggcatcgaacgcacttccctcggttctttgcttgaccatactggcgcatttggcgaaagcgaaaaatatgccgcacgcgtatttggtgccgatcgctcctggtcggtagtcgtcggtacttccggctctaaccgcaccatcatgcaggcttgcatgaccgataacgatgtcgtggtcgttgaccgtaactgccataaatccatcgaacaaggcttgatgctgacaggcgcgaaaccggtctacatggtgccaagccgcaaccgctacggcattatcgggccaatctatccgcaggaaatgcaacctgaaaccttgcagaagaaaatcagtgaaagcccgctgaccaaagacaaagtcgggcaaaaaccgtcttactgcgtggtgaccaactgtacctatgacggcgtgtgttataacgctaaagaagcgcaggatctgctggaaaaaacctccgatcgtctgcactttgacgaagcctggtacggctatgcacgtttcaacccgatctatgccgatcactatgccatgcgcggcgaacctggcgatcacaacggtcctaccgttttcgccacccactccacccacaaactgctgaatgcgctgtcccaggcctcttatattcatgtacgtgaaggtcgtggggcgattaacttctcccgcttcaaccaggcctacatgatgcatgccaccacctccccgctgtatgccatctgcgcatccaacgacgtggcagtgtcgatgatggacggcaacagcggcctgtcactgacccaggaagtgatcgacgaagcggttgatttccgtcaggcgatggcgcggctgtataaagagttcaccgctgacggtagctggttcttcaaaccgtggaacaaagaagtcgtcaccgacccacaaaccggcaaaacctatgactttgctgacgcaccaaccaaactgctgaccaccgttcaggactgctgggtcatgcatccgggcgaaagctggcacggcttcaaagatattccggataactggagtatgctcgacccgattaaagtcagcatccttgctccgggaatgggtgaagatggtgaactggaagaaatcggtgttccggcggcgctggtcacagcctggcttggtcgccacggcattgtgcctacccgtaccactgacttccagattatgttcctgttctctatgggcgtgacccgtgggaaatgggggactctggttaacaccctttgctccttcaaacgccactatgatgccaacacaccgctggcgcaggtgatgccggaacttgttgaacaatatcctgacacttacgcgaacatggggattcacgatctgggtgacaccatgtttgcctggctgaaagaaaacaaccctggcgcacggttgaatgaagcctattctggcctaccggtggcggaaatcaccccgcgtgaagcgtacaacgcgattgtcgacaacaatgtcgaactggtatccattgaaaatctgccaggacgtatcgcggcaaactcagttatcccgtatccgccaggaatcccgatgctgctgtctggtgaaaacttcggcgataaaaacagtccgcaagtaagttatttacgctcactgcaatcctgggaccatcatttccctggatttgaacacgaaacagaagggacagaaattattgacggtatttaccacgttatgtgtgtgaaagcgtaa

SEQ ID NO: 91782 - protein, 756 aa, Escherichia coli O6
MMKVLIVESEFLHQDTWVGNAVERLADALSQQNVTVIKSTSFDDGFAILSSNEAIDCLMFSYQMEHPDEHQNVRQLIGKLHERQQNVPVFLLGDREKALAAMDRDLLELVDEFAWILEDTADFIAGRAVAAMTRYRQQLLPPLFSALMKYSDIHEYSWAAPGHQGGVGFTKTPAGRFYHDYYGENLFRTDMGIERTSLGSLLDHTGAFGESEKYAARVFGADRSWSVVVGTSGSNRTIMQACMTDNDVVVVDRNCHKSIEQGLMLTGAKPVYMVPSRNRYGIIGPIYPQEMQPETLQKKISESPLTKDKVGQKPSYCVVTNCTYDGVCYNAKEAQDLLEKTSDRLHFDEAWYGYARFNPIYADHYAMRGEPGDHNGPTVFATHSTHKLLNALSQASYIHVREGRGAINFSRFNQAYMMHATTSPLYAICASNDVAVSMMDGNSGLSLTQEVIDEAVDFRQAMARLYKEFTADGSWFFKPWNKEVVTDPQTGKTYDFADAPTKLLTTVQDCWVMHPGESWHGFKDIPDNWSMLDPIKVSILAPGMGEDGELEEIGVPAALVTAWLGRHGIVPTRTTDFQIMFLFSMGVTRGKWGTLVNTLCSFKRHYDANTPLAQVMPELVEQYPDTYANMGIHDLGDTMFAWLKENNPGARLNEAYSGLPVAEITPREAYNAIVDNNVELVSIENLPGRIAANSVIPYPPGIPMLLSGENFGDKNSPQVSYLRSLQSWDHHFPGFEHETEGTEIIDGIYHVMCVKA

SEQ ID NO: 91783 - DNA, 2370 bp, Escherichia coli O6; identical to SEQ ID NO: 862
  CDS (1)..(2370)

SEQ ID NO: 91784 - protein, 789 aa, Escherichia coli O6; identical to SEQ ID NO: 359

SEQ ID NO: 91785 - DNA, 2136 bp, Escherichia coli O6
  CDS (1)..(2136)
atgaaatcaatgaatattgccgccagtagtgaactggtatcccgactttctactcatcgccgcgtggtggcgttgggagatactgattttacggacgtcgcggcagtcgtcattaccgctgcggatagtcgcagtggcattcttgcattgcttaagcgcaccggttttcatctaccggtgtttttgtattccgaacatgctgttgaattacctgcgggcgttacggcggtaatcaacggcaacgagcagcagtggctggagctggaatccgcagcctgtcagtatgaagagaatttgctgccaccgttttatgacacgctgacgcagtacgttgagatgggtaatagcacctttgcttgccctggacatcaacatggtgcgttctttaaaaagcatcctgccggacgccatttttacgatttctttggcgagaacatctttcgcgccgatatgtgtaacgctgacgtaaaattgggcgatctgcttattcatgaaggatcggcgaaagatgcgcagaaatttgcagccaaagtctttcatgccgataaaacctattttgtgctgaacggcacatcggcagcgaataaagtggtgacgaatgcgctgttaacgcgtggcgatctggtgctcttcgaccgtaacaaccataagtcgaatcatcatggcgcgttgattcaggcgggggcgacaccggtctatctggaagcttcacgtaacccgtttggtttcattggcggtattgatgcgcactgttttaatgaagagtatctgcgccagcaaattcgcgacgttgcgccagaaaaagccgacctgccgcgcccgtttcgcctggcgattattcagctgggaacctatgacggcactgtctataacgcccgtcaggtgatcgataccgttgggcatctgtgtgattacattctgtttgattccgcgtgggtcggttacgaacagtttatcccgatgatggcggatagctcgccgctgctgttagaacttaacgaaaacgatccggggatctttgtgactcagtcggtgcacaaacagcaggcgggattctcacagacgtcgcagatccataaaaaagataaccatatccgtggacaggcgcgtttttgcccgcataagcggttgaataatgcctttatgctccatgcttctaccagcccgttctatccgctgttcgccgccctggacgttaacgccaaaattcatgaaggggagagtgggcgtcggctgtgggctgagtgcgttgagttgggtattgagtcgcgcaaggctattcttgcgcgctgtaagctgttccgcccgtttatcccgcccgttgttgatggcaaattgtggcaggattatccgacgtcagtgttagccagcgaccgccgttttttcagttttgagccgggggcgaattggcacggctttgaaggatatgccgcggatcagtattttgttgatccgtgcaagctgttactcaccacgccgggtatcgatgccgaaaccggcgaatatagcgactttggcgttccggcgacgattctggcgcactacctgcgtgagaacggcattgtgccggagaagtgcgatctcaactccattctgttcttattaactccggcggaaagccacgagaagctggcacaactggtggcgatgctggcgcagtttgaacagcatattgaggatgattcgccgctggctgaggtgttgccgagcgtttataacaaatatccggtgcgctatcgcgactacaccctgcgccagttgtgtcaggagatgcacgatttgtatgtcagtttcgacgtcaaagacctacaaaaagcgatgttccgccagcagagtttcccgtcagtggtgatgaatccccaggatgcgcatagcgcttatattcgcggtgaagtggagttggtgcggattcgtgatgccgaagggcgaattgcggcagaaggggcgttgccttatccacctggcgtgctttgcgtggtacccggggaagtctggggtggggcggttcaacgttatttccttgcgctggaagaaggcgtgaatttgttgccgggattttcgccggagttgcaaggtgtctatagcgaaaccgatgcggatggcatgaaacggttgtacggttatgtgttgaagtaa

SEQ ID NO: 91786 - protein, 711 aa, Escherichia coli O6
MKSMNIAASSELVSRLSTHRRVVALGDTDFTDVAAVVITAADSRSGILALLKRTGFHLPVFLYSEHAVELPAGVTAVINGNEQQWLELESAACQYEENLLPPFYDTLTQYVEMGNSTFACPGHQHGAFFKKHPAGRHFYDFFGENIFRADMCNADVKLGDLLIHEGSAKDAQKFAAKVFHADKTYFVLNGTSAANKVVTNALLTRGDLVLFDRNNHKSNHHGALIQAGATPVYLEASRNPFGFIGGIDAHCFNEEYLRQQIRDVAPEKADLPRPFRLAIIQLGTYDGTVYNARQVIDTVGHLCDYILFDSAWVGYEQFIPMMADSSPLLLELNENDPGIFVTQSVHKQQAGFSQTSQIHKKDNHIRGQARFCPHKRLNNAFMLHASTSPFYPLFAALDVNAKIHEGESGRRLWAECVELGIESRKAILARCKLFRPFIPPVVDGKLWQDYPTSVLASDRRFFSFEPGANWHGFEGYAADQYFVDPCKLLLTTPGIDAETGEYSDFGVPATILAHYLRENGIVPEKCDLNSILFLLTPAESHEKLAQLVAMLAQFEQHIEDDSPLAEVLPSVYNKYPVRYRDYTLRQLCQEMHDLYVSFDVKDLQKAMFRQQSFPSVVMNPQDAHSAYIRGEVELVRIRDAEGRIAAEGALPYPPGVLCVVPGEVWGGAVQRYFLALEEGVNLLPGFSPELQGVYSETDADGMKRLYGYVLK

SEQ ID NO: 91787 - DNA, 2208 bp, Escherichia coli O6
  CDS (1)..(2208)
atgaacaaaatgtcagaattaaaaattgccgttagccgttcttgcccggattgcttttccactcatcgtgaatgcgtgaatattgacaaaagtaattatattgacgttgccgctattattttatcagtcaatgatgttgaacgtggaaaactcgatgaaatagacgctactggctatggcattcctgtttttattgcaacggaaaatgaagaacgtgtaccagcagaatatctgccacgtatttctggtgtcttcgagcattgcgaatcacggaaagagttttatggacgtcagttagaaaccgctgccagccattatgaaacgcaactgcgcccgcccttcttccgcgcactggtcgattatgtcaatcagggcaatagcgcttttgactgcccgggtcatcagggaggtgagtttttccgtcgccatccggcaggcaatcagttcgtggaatattttggcgaaatgctcttccgctccgacttgtgtaatgccgacgttgcaatgggtgatcttctgattcatgaaggtgcgccatgcattgcacagcaacatgcggctaaagtgtttaatgccgataaaacgtactttgttttaaacggcacctcctcctccaacaaagtggttttaaacgccctgctgacaccgggtgatctggtgctgtttgaccgcaataaccataagtctaaccatcacggggccttgctacaggctggtgcaacaccggtttatctggaaacagcacgtaacccgtatggttttatcggtggcattgatgcgcactgcttcgaagaaagttatctgcgtgaactgattacagaagttgcaccgcaacgggcaaaagaagcgcgtccgttccgcctcgctgtgattcagttaggcacctacgacggtactatttataacgcccgccaggtggtggataaaatcggtcatctgtgtgactacatcctgtttgactcagcatgggtcggctatgaacagtttattccgatgatggcggactgttcgccgctgctgctggagcttaatgagaacgatccgggtattctggttacgcaatctgtgcataaacaacaggctggtttttctcagacttcacaaattcataaaaaagacagccatatcaaagggcaacagcgttatgtaccgcacaaacgcatgaacaacgcctttatgatgcacgcctccaccagcccgttctatccgctgtttgccgcactggatatcaacgccaaaatgcatgaaggtgtcagcggtcgtaatatgtggatggattgtgtggttaacggtattaatgcccgcaaattgatcctcgataactgccagcacattcgcccgttcgttcctgaactggtggatggtaaaccctggcagtcgtatgaaacagcgcaaattgcggttgatctgcgcttctttaaatttgtacccggtgagcactggcattcttttgaaggctacgcagagaaccaatactttgtcgatccgtgcaaactgttgctgacaactccaggtattgatgcacgtaacggcgaatatgaagcgttcggtgtacctgcaacgattcttgctaacttcctgcgcgaaaatggcgtagtgccggaaaaatgcgatcttaactccatcctcttcctgctgactccggcagaagatatggccaaactgcagcaacttgttgccctgctggtacgcttcgaaaaactactggaagctgatgcgcctctggcggaagtactgccttccatctacaaacagcatgaagagcgctacgccggttataccctgcgtcagttgtgccaggaaatgcatgatttgtatgcccgtcacaacgtgaaacaactgcaaaaagagatgttccgtaaggaacacttccctcgcgtcagcatgaatccgcaagaagccaactacgcctacttacgcggtgaagtggagctggttcgtctgccggatgcagaaggccgtatcgctgccgaaggtgcgcttccttatcctccgggtgtgctgtgtgttgttcctggtgaaatctggggtggtgctgttttgcgttacttcagcgctctggaagaaggcatcaacctgctgccaggttttgcaccggagctgcagggtgtctatatcgaagaacatgatggtcgtaagcaagtttggtgctatgtcatcaagcctcgtgatgcgcaaagcaccctgttgaaaggggaaaaattatga

SEQ ID NO: 91788 - protein, 735 aa, Escherichia coli O6
MNKMSELKIAVSRSCPDCFSTHRECVNIDKSNYIDVAAIILSVNDVERGKLDEIDATGYGIPVFIATENEERVPAEYLPRISGVFEHCESRKEFYGRQLETAASHYETQLRPPFFRALVDYVNQGNSAFDCPGHQGGEFFRRHPAGNQFVEYFGEMLFRSDLCNADVAMGDLLIHEGAPCIAQQHAAKVFNADKTYFVLNGTSSSNKVVLNALLTPGDLVLFDRNNHKSNHHGALLQAGATPVYLETARNPYGFIGGIDAHCFEESYLRELITEVAPQRAKEARPFRLAVIQLGTYDGTIYNARQVVDKIGHLCDYILFDSAWVGYEQFIPMMADCSPLLLELNENDPGILVTQSVHKQQAGFSQTSQIHKKDSHIKGQQRYVPHKRMNNAFMMHASTSPFYPLFAALDINAKMHEGVSGRNMWMDCVVNGINARKLILDNCQHIRPFVPELVDGKPWQSYETAQIAVDLRFFKFVPGEHWHSFEGYAENQYFVDPCKLLLTTPGIDARNGEYEAFGVPATILANFLRENGVVPEKCDLNSILFLLTPAEDMAKLQQLVALLVRFEKLLEADAPLAEVLPSIYKQHEERYAGYTLRQLCQEMHDLYARHNVKQLQKEMFRKEHFPRVSMNPQEANYAYLRGEVELVRLPDAEGRIAAEGALPYPPGVLCVVPGEIWGGAVLRYFSALEEGINLLPGFAPELQGVYIEEHDGRKQVWCYVIKPRDAQSTLLKGEKL

SEQ ID NO: 91789 - DNA, 2142 bp, Escherichia coli O6
  CDS (1)..(2142)
atgaacatcattgccattatgggaccgcatggcgtcttttataaagatgagcccatcaaagaactggagtcggcgctggtggcgcaaggctttcagattatctggccacaaaacagcgttgatttgctgaagtttatcgaacataacccacgaatttgcggcgtgatttttgactgggatgagtacagtctcgatttatgtagcgatatcaatcaacttaatgaatatctcccgctttatgccttcatcaacacccactcgacgatggatgtcagcgtgcaggatatgcggatggcgctctggttttttgaatatgcgctggggcaggcggaagatatcgccattcgtatgcgtcagtacaccaacgaatatcttgataacattacgccgccgttcacgaaagccttgtttacctacgtcaaagagcggaagtacaccttttgtacgccggggcatatgggcggcaccgcatatcaaaaaagcccggttggctgtctgttttatgattttttcggcgggaataccctcaaggcggacgtctctatttcggtcaccgagcttggttcgttgctcgaccacaccgggccacacctggaagcggaagagtacatcgcgcggacgtttggcgcggaacagagttatatcgttaccaacggaacatcgacgtcgaacaaaattgtgggtatgtacgccgcgccatccggcagtacgctgttgatcgaccgcaattgtcataaatcgctggcgcatctgttgatgatgaacgatgtagtgccagtctggctgaaaccgacgcgtaatgcgttggggattctgggtgggatcccgcgcggtgaatttactcgcgacagcatcgaagagaaagtcgctgccaccacgcaggcacaatggccggttcatgcggtgatcaccaactccacctatgatggcttgctctacaacaccgactggatcaaacagacgctggatgtcccgtcgattcacttcgattctgcctgggtgccgtacacccattttcatccaatctaccagggtaaaagtggtatgagcggcgagcgtgttgcaggaaaagtgatcttcgaaacgcagtcgacccacaaaatgctggcggcgttatcgcaggcgtcgctgatccacattaaaggtgagtatgacgaagaggcgtttaacgaagcctttatgatgcataccaccacctcgcccagttatcccattgttgcttctgttgagacggcggcggcgatgttgcgtggtaatccgggcaaacggctgattaaccgttcagtagaacgagctctgcattttcgcaaagaggtccagcggctgcgggaagagtctgacggctggtttttcgatatctggcaaccgccgcaggtggatgaagccgaatgctggcccgttgcgcctggcgaacagtggcacggctttagcgatgcggatgccaatcacatgtttctcgatccggttaaagtcactattttgacaccggggatggacgagcagggcaatatgagcgaggaggggatcccggcggcgctggtggcaaaattcctcgacgaacgtgggatcgtagtagagaaaaccggcccttataacctgctgtttctctttagtattggcatcgataaaaccaaagcaatgggattattgcgtgggttgacggaatttaagcgctcttacgatctcaacctgcggatcaaaaatatgctgcccgatctctatgcagaagatcccgatttctaccgcaatatgcgtattcaggatctggcgcaagggatccataagctgattcgtaaacacgatcttcccggtttgatgttgcgggcatttgataccttgccggagatgatcatgacgccacatcaggcatggcagagacagattaaaggcgaagtagaaaccattgcgctggaacaactggtcggtagagtatcggcaaatatgatcctgccttatccacccggcgtaccgctgctgatgccgggagaaatgcttaccgaagagagccgcacggtactcgattttctactgatgctttgttccgtagggcaacattaccccggttttgaaacggatattcacggcgcgaaacaggacgaagacggtgtttaccgcgtacgagtcctaaaaatggcaggataa

SEQ ID NO: 91790 - protein, 713 aa, Escherichia coli O6
MNIIAIMGPHGVFYKDEPIKELESALVAQGFQIIWPQNSVDLLKFIEHNPRICGVIFDWDEYSLDLCSDINQLNEYLPLYAFINTHSTMDVSVQDMRMALWFFEYALGQAEDIAIRMRQYTNEYLDNITPPFTKALFTYVKERKYTFCTPGHMGGTAYQKSPVGCLFYDFFGGNTLKADVSISVTELGSLLDHTGPHLEAEEYIARTFGAEQSYIVTNGTSTSNKIVGMYAAPSGSTLLIDRNCHKSLAHLLMMNDVVPVWLKPTRNALGILGGIPRGEFTRDSIEEKVAATTQAQWPVHAVITNSTYDGLLYNTDWIKQTLDVPSIHFDSAWVPYTHFHPIYQGKSGMSGERVAGKVIFETQSTHKMLAALSQASLIHIKGEYDEEAFNEAFMMHTTTSPSYPIVASVETAAAMLRGNPGKRLINRSVERALHFRKEVQRLREESDGWFFDIWQPPQVDEAECWPVAPGEQWHGFSDADANHMFLDPVKVTILTPGMDEQGNMSEEGIPAALVAKFLDERGIVVEKTGPYNLLFLFSIGIDKTKAMGLLRGLTEFKRSYDLNLRIKNMLPDLYAEDPDFYRNMRIQDLAQGIHKLIRKHDLPGLMLRAFDTLPEMIMTPHQAWQRQIKGEVETIALEQLVGRVSANMILPYPPGVPLLMPGEMLTEESRTVLDFLLMLCSVGQHYPGFETDIHGAKQDEDGVYRVRVLKMAG

SEQ ID NO: 91791 - DNA, 1488 bp, Thermoanaerobacter tengcongensis; identical to SEQ ID NO: 354
  CDS (1)..(1488)

SEQ ID NO: 91792 - protein, 495 aa, Thermoanaerobacter tengcongensis; identical to SEQ ID NO: 355

SEQ ID NO: 91793 - DNA, 1419 bp, Thermoanaerobacter tengcongensis; identical to SEQ ID NO: 866
  CDS (1)..(1419)

SEQ ID NO: 91794 - protein, 472 aa, Thermoanaerobacter tengcongensis; identical to SEQ ID NO: 353

SEQ ID NO: 91795 - DNA, 2352 bp, Fusobacterium nucleatum; identical to SEQ ID NO: 350
  CDS (1)..(2352)

SEQ ID NO: 91796 - protein, 783 aa, Fusobacterium nucleatum; identical to SEQ ID NO: 351

SEQ ID NO: 91797 - DNA, 1431 bp, Clostridium perfringens; identical to SEQ ID NO: 346
  CDS (1)..(1431)

SEQ ID NO: 91798 - protein, 476 aa, Clostridium perfringens; identical to SEQ ID NO: 347

SEQ ID NO: 91799 - DNA, 1455 bp, Clostridium perfringens; identical to SEQ ID NO: 872
  CDS (1)..(1455)

SEQ ID NO: 91800 - protein, 484 aa, Clostridium perfringens; identical to SEQ ID NO: 345

SEQ ID NO: 91801 - DNA, 2280 bp, Ralstonia solanacearum; identical to SEQ ID NO: 874
  CDS (1)..(2280)

SEQ ID NO: 91802 - protein, 759 aa, Ralstonia solanacearum; identical to SEQ ID NO: 349

SEQ ID NO: 91803 - DNA, 2271 bp, Salmonella typhimurium
  CDS (1)..(2271)
atgatgaaagtattaattgttgaaagtgagtttctgcatcaggacacctgggttggcaacgcggttgagcgtctggcagatgccttgagccaacaaaatgttaccgtcattaaatcgacatccttcgatgacggctatgccatcttgtccgcgaacgaagccattgactgtctgatgtttagctaccaaatggaacaaccggatgagcacctgagcgtcaggcaattgatcggtaagcttcacgagcgtcagcaaaacgtgcccgttttcctgttaggcgacagggaaaaagcgacggcatcgctggaccgcgacctgctggagcttgtcgatgaattcgcctggattctggaagacaccgctgactttatcgccggacgcgccgttgccgccatgacccggtatcgccagcaactgttaccgccgctgtttaacgcgttgatgaaatacagcgacattcatgaatattcatgggcggcgccgggacaccagggcggcgtcggtttcactaaaacgccttccggtcgcttttatcacgattattatggcgaaaacctgttccgcagcgatatggggattgagcgtaccacgctcggttcactcctcgaccataccggcgcgtttggcgaaagcgagaaaaacgccgcccgcgtattcggtgctgaccgctcctggtccgtagttgtcgggacctcaggttctaaccgtactattatgcaggcctgtatgacggataatgatgtcgttgtactggatcgtaactgccataaatccatcgagcaggggctgatcctcactggggccaaaccggtatatatggtgccaagccgtaaccgttacggcattattgggccaatctacccgcaggaaatgcagcctgaaaccttgcagaaaaaaatcagcgccagcccgctgaccaaaactaaagccggacagaaaccgtcttacagcgtagtgaccaactgtacctatgacggcgtatgctataacgccaaagaggcgcaggatctgctggcaaaaaccagcgatcgcattcacttcgacgaagcatggtacggctatgcgcgcttcaacccgatttattgcgatcactacgcgatgcgcggcgagccaggcgaccataacggtccgaccgtgtttgccacccactccacgcacaaactactgaatgcgctttcacaagcttcctacattcacgtccgtgaaggccgtggcgcggtgaatttctcccgcttcaaccaggcctatatgatgcatgccaccacctctccgttatatgccatctgcgcatccaacgatgtggcggtatcgatgatggacggtaacagcggcctgtccctgactcaagaggtgattgacgaagcggttgatttccgtcaggcgatggcgcgtctttataaagagtttaccgatgaaggcgactggttctttaaaccgtggaataaggacgtcgtcaccgatccacaaaccggtaaaacgtatgacttcgccgacgcgccggcaaaactgctagccactgaccagaactgctgggtcatgcgccccggggaaacctggcacggctttaaagacctgccggataactggagtatgctggacccgattaaagtcagtatcctggcgccgggtatgggcgacgatggcgaactggaagcatccggcgtacctgctgcgctggtcacagcatggcttggccgccacggtatcgtgccgacccgcaccaccgactttcagattatgttcctgttctctatgggggtaactcgcgggaaatggggaacgctgatcaacacgctgtgctccttcaaacatcattacgacgcgaatacgccgctggcgcaggtgatgccggaactggtgcaggattatcctgacacttacgcgaacatgggtattcatgacctgggcgataaaatgtttgcctggctacgtgaaaataacccgggcgcccgtctcaacgccgcctattccaccctgccggttgcggagattaccccgcgcgacgcctacaacgcgattgtgaacaacaatattgaaatggtggcgattgaaaatctaccgggtcgcattgcggcgaactccgttattccttacccgccaggcatcccgatgctgctctccggcgaaaactttggcgatgaaaacagtccgcaggtgggttacttacgctcactgcaatcctgggatcatcacttccctggctttgagcatgaaaccgaaggcacggaaattattgatggcgtatatcacgttatgtgcgtgaaagcctaa

SEQ ID NO: 91804 - protein, 756 aa, Salmonella typhimurium
MMKVLIVESEFLHQDTWVGNAVERLADALSQQNVTVIKSTSFDDGYAILSANEAIDCLMFSYQMEQPDEHLSVRQLIGKLHERQQNVPVFLLGDREKATASLDRDLLELVDEFAWILEDTADFIAGRAVAAMTRYRQQLLPPLFNALMKYSDIHEYSWAAPGHQGGVGFTKTPSGRFYHDYYGENLFRSDMGIERTTLGSLLDHTGAFGESEKNAARVFGADRSWSVVVGTSGSNRTIMQACMTDNDVVVLDRNCHKSIEQGLILTGAKPVYMVPSRNRYGIIGPIYPQEMQPETLQKKISASPLTKTKAGQKPSYSVVTNCTYDGVCYNAKEAQDLLAKTSDRIHFDEAWYGYARFNPIYCDHYAMRGEPGDHNGPTVFATHSTHKLLNALSQASYIHVREGRGAVNFSRFNQAYMMHATTSPLYAICASNDVAVSMMDGNSGLSLTQEVIDEAVDFRQAMARLYKEFTDEGDWFFKPWNKDVVTDPQTGKTYDFADAPAKLLATDQNCWVMRPGETWHGFKDLPDNWSMLDPIKVSILAPGMGDDGELEASGVPAALVTAWLGRHGIVPTRTTDFQIMFLFSMGVTRGKWGTLINTLCSFKHHYDANTPLAQVMPELVQDYPDTYANMGIHDLGDKMFAWLRENNPGARLNAAYSTLPVAEITPRDAYNAIVNNNIEMVAIENLPGRIAANSVIPYPPGIPMLLSGENFGDENSPQVGYLRSLQSWDHHFPGFEHETEGTEIIDGVYHVMCVKA

SEQ ID NO: 91805 - DNA, 2136 bp, Salmonella typhimurium; identical to SEQ ID NO: 342
  CDS (1)..(2136)

SEQ ID NO: 91806 - protein, 711 aa, Salmonella typhimurium; identical to SEQ ID NO: 343

SEQ ID NO: 91807 - DNA, 2199 bp, Salmonella typhimurium; identical to SEQ ID NO: 878
  CDS (1)..(2199)

SEQ ID NO: 91808 - protein, 732 aa, Salmonella typhimurium; identical to SEQ ID NO: 341

SEQ ID NO: 91809 - DNA, 2142 bp, Salmonella typhimurium; identical to SEQ ID NO: 880
  CDS (1)..(2142)

SEQ ID NO: 91810 - protein, 713 aa, Salmonella typhimurium; identical to SEQ ID NO: 339

SEQ ID NO: 91811 - DNA, 2136 bp, Vibrio vulnificus; identical to SEQ ID NO: 882
  CDS (1)..(2136)

SEQ ID NO: 91812 - protein, 711 aa, Vibrio vulnificus; identical to SEQ ID NO: 331

SEQ ID NO: 91813 - DNA, 2163 bp, Pasteurella multocida; identical to SEQ ID NO: 336
  CDS (1)..(2163)

SEQ ID NO: 91814 - protein, 720 aa, Pasteurella multocida; identical to SEQ ID NO: 337

SEQ ID NO: 91815 - DNA, 2139 bp, Moritella japonica; identical to SEQ ID NO: 886
  CDS (1)..(2139)

SEQ ID NO: 91816 - protein, 712 aa, Moritella japonica; identical to SEQ ID NO: 329

SEQ ID NO: 91817 - DNA, 1479 bp, Streptomyces coelicolor; identical to SEQ ID NO: 888
  CDS (1)..(1479)

SEQ ID NO: 91818 - protein, 492 aa, Streptomyces coelicolor; identical to SEQ ID NO: 357

SEQ ID NO: 91819 - DNA, 2130 bp, Eikenella corrodens; identical to SEQ ID NO: 332
  CDS (1)..(2130)

SEQ ID NO: 91820 - protein, 709 aa, Eikenella corrodens; identical to SEQ ID NO: 333

SEQ ID NO: 91821 - DNA, 2271 bp, Escherichia coli; identical to SEQ ID NO: 91689
  CDS (4)..(2271)

SEQ ID NO: 91822 - protein, 755 aa, Escherichia coli; identical to SEQ ID NO: 411

SEQ ID NO: 91823 - DNA, 2196 bp, Lactobacillus sp; identical to SEQ ID NO: 414
  CDS (1)..(2196)

SEQ ID NO: 91824 - protein, 731 aa, Lactobacillus sp; identical to SEQ ID NO: 415

SEQ ID NO: 91825 - DNA, 1482 bp, Bacillus anthracis; identical to SEQ ID NO: 378
  CDS (1)..(1482)

SEQ ID NO: 91826 - protein, 493 aa, Bacillus anthracis; identical to SEQ ID NO: 379

SEQ ID NO: 91827 - DNA, 1383 bp, Bacillus cereus; identical to SEQ ID NO: 382
  CDS (1)..(1383)

SEQ ID NO: 91828 - protein, 460 aa, Bacillus cereus; identical to SEQ ID NO: 383

SEQ ID NO: 91829 - DNA, 20 bp, Primer
atggggcagggttttccacc

SEQ ID NO: 91830 - DNA, 25 bp, Primer
ttacttcaacacataaccgtacaac

SEQ ID NO: 91831 - protein, 642 aa, consensus
  MISC_FEATURE (1)..(642): consensus for the disclosure of xaa see table XV
PXXXXLXXXXXXXXXXXXXXXXXXXXXXXXXXXXXXXXXXXXXXXXXXXXXXXXXXXXLXXLXXXXGXXXXAXXXXAXXXXXXXXXXXXXGXSXXXXXXXXXXXXXXXXXXXXRNXHKSXXXXXXXXXXXXPXXXXXXXXXXXXXXXXXXXXXXXXXXXXXXXXXXXXXXXXXXXXXXXXXXXXXXXXTYXGXXXXXXXXXXXXXXXXXXXXXXXDXAXXXXXXFXXXXXXXXXXXXXXXXXXXXXXXXXXXXXXXXXXXXXXXXXXXXXXXXXXXXXXXXXXXXXXXXXSXHKXXXXXXQXSXXHXXXXXXXXXXXXXXXXXXXXXXXXXXXTSPXYXXXAXXXXXXXXXXXXXGXXXXXXXXXXXXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXDPXKXXXXXXXXXXXXXXXXXXXXXXXXXXXXXXXXXIXXEXXXXXXXLXXXXXXXXXXXXXXLXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXAXXXXXYPPGXXXXXXGE

SEQ ID NO: 91832 - protein, 101 aa, consensus; identical to SEQ ID NO: 18650
  MISC_FEATURE (1)..(101): consensus for the disclosure of xaa see table XV

SEQ ID NO: 91833 - protein, 76 aa, consensus
  MISC_FEATURE (1)..(76): consensus for the disclosure of xaa see table XV
XXXXXXXXXXXXXXXXXXXXXXXXXXXXXXXXGXXXXXXXXXXXXXXXXXXXXXXRXXHXXXXXXXXXXXXXXXXX

SEQ ID NO: 91834 - protein, 39 aa, consensus
  MISC_FEATURE (1)..(39): consensus for the disclosure of xaa see table XV
XXXXXXXXGXXXXXXXXXXXXXXXXXXXXXXXDXAXXXX

SEQ ID NO: 91835 - protein, 84 aa, consensus
  MISC_FEATURE (1)..(84): consensus for the disclosure of xaa see table XV
XXHKXXXXXXXXXXXXXXXXXXXXXXXXXXXXXXXXXXXXXXXXSXXXXXXXXXXXXXXXXXXXXXXXXXXXXXXXXXXXXXXX

SEQ ID NO: 91836 - protein, 31 aa, consensus
  MISC_FEATURE (1)..(31): consensus for the disclosure of xaa see table XV
XXXXXXXXXXXXXXXXXXXYPPGXXXXXXGX

SEQ ID NO: 91837 - DNA, 858 bp, Escherichia coli; identical to SEQ ID NO: 61757
  CDS (1)..(858)

SEQ ID NO: 91838 - protein, 285 aa, Escherichia coli; identical to SEQ ID NO: 61758

SEQ ID NO: 91839 - DNA, 735 bp, Staphylococcus aureus subsp. aureus COL; identical to SEQ ID NO: 61759
  CDS (1)..(735)

SEQ ID NO: 91840 - protein, 244 aa, Staphylococcus aureus subsp. aureus COL; identical to SEQ ID NO: 61760

SEQ ID NO: 91841 - DNA, 741 bp, Gluconobacter oxydans 621H; identical to SEQ ID NO: 61761
  CDS (1)..(741)

SEQ ID NO: 91842 - protein, 246 aa, Gluconobacter oxydans 621H; identical to SEQ ID NO: 61762

SEQ ID NO: 91843 - DNA, 738 bp, Vibrio fischeri ES114; identical to SEQ ID NO: 61763
  CDS (1)..(738)

SEQ ID NO: 91844 - protein, 245 aa, Vibrio fischeri ES114; identical to SEQ ID NO: 61764

SEQ ID NO: 91845 - DNA, 777 bp, Mesorhizobium loti MAFF303099; identical to SEQ ID NO: 61765
  CDS (1)..(777): transl_table=11

SEQ ID NO: 91846 - protein, 258 aa, Mesorhizobium loti MAFF303099; identical to SEQ ID NO: 61766

SEQ ID NO: 91847 - DNA, 732 bp, Mesorhizobium loti MAFF303099; identical to SEQ ID NO: 61767
  CDS (1)..(732): transl_table=11

SEQ ID NO: 91848 - protein, 243 aa, Mesorhizobium loti MAFF303099; identical to SEQ ID NO: 61768

SEQ ID NO: 91849 - DNA, 765 bp, Mesorhizobium loti MAFF303099; identical to SEQ ID NO: 61769
  CDS (1)..(765): transl_table=11

SEQ ID NO: 91850 - protein, 254 aa, Mesorhizobium loti MAFF303099; identical to SEQ ID NO: 61770

SEQ ID NO: 91851 - DNA, 777 bp, Mesorhizobium loti MAFF303099; identical to SEQ ID NO: 61771
  CDS (1)..(777): transl_table=11

SEQ ID NO: 91852 - protein, 258 aa, Mesorhizobium loti MAFF303099; identical to SEQ ID NO: 61772

SEQ ID NO: 91853 - DNA, 738 bp, Mesorhizobium loti MAFF303099; identical to SEQ ID NO: 7296
  CDS (1)..(738): transl_table=11

SEQ ID NO: 91854 - protein, 245 aa, Mesorhizobium loti MAFF303099; identical to SEQ ID NO: 7297

SEQ ID NO: 91855 - DNA, 771 bp, Mesorhizobium loti MAFF303099; identical to SEQ ID NO: 61775
  CDS (1)..(771): transl_table=11

SEQ ID NO: 91856 - protein, 256 aa, Mesorhizobium loti MAFF303099; identical to SEQ ID NO: 61776

SEQ ID NO: 91857 - DNA, 747 bp, Chlamydia trachomatis D/UW-3/CX; identical to SEQ ID NO: 7338
  CDS (1)..(747): transl_table=11

SEQ ID NO: 91858 - protein, 248 aa, Chlamydia trachomatis D/UW-3/CX; identical to SEQ ID NO: 61778

SEQ ID NO: 91859 - DNA, 774 bp, Thermotoga maritima MSB8; identical to SEQ ID NO: 61779
  CDS (1)..(774): transl_table=11

SEQ ID NO: 91860 - protein, 257 aa, Thermotoga maritima MSB8; identical to SEQ ID NO: 61780

SEQ ID NO: 91861 - DNA, 747 bp, Vibrio cholerae O1 biovar eltor str. N16961; identical to SEQ ID NO: 61781
  CDS (1)..(747): transl_table=11

SEQ ID NO: 91862 - protein, 248 aa, Vibrio cholerae O1 biovar eltor str. N16961; identical to SEQ ID NO: 61782

SEQ ID NO: 91863 - DNA, 741 bp, Bacillus halodurans C-125; identical to SEQ ID NO: 7050
  CDS (1)..(741): transl_table=11

SEQ ID NO: 91864 - protein, 246 aa, Bacillus halodurans C-125; identical to SEQ ID NO: 7051

SEQ ID NO: 91865 - DNA, 741 bp, Bacillus halodurans C-125; identical to SEQ ID NO: 7090
  CDS (1)..(741): transl_table=11

SEQ ID NO: 91866 - protein, 246 aa, Bacillus halodurans C-125; identical to SEQ ID NO: 7091

SEQ ID NO: 91867 - DNA, 729 bp, Pasteurella multocida subsp. multocida str. Pm70; identical to SEQ ID NO: 7306
  CDS (1)..(729): transl_table=11

SEQ ID NO: 91868 - protein, 242 aa, Pasteurella multocida subsp. multocida str. Pm70; identical to SEQ ID NO: 7307

SEQ ID NO: 91869 - DNA, 783 bp, Pseudomonas aeruginosa PAO1; identical to SEQ ID NO: 61789
  CDS (1)..(783): transl_table=11

SEQ ID NO: 91870 - protein, 260 aa, Pseudomonas aeruginosa PAO1; identical to SEQ ID NO: 61790

SEQ ID NO: 91871 - DNA, 732 bp, Lactococcus lactis subsp. lactis Il1403; identical to SEQ ID NO: 7068
  CDS (1)..(732): transl_table=11

SEQ ID NO: 91872 - protein, 243 aa, Lactococcus lactis subsp. lactis Il1403; identical to SEQ ID NO: 7069

SEQ ID NO: 91873 - DNA, 780 bp, Streptococcus pyogenes M1 GAS; identical to SEQ ID NO: 61793
  CDS (1)..(780): transl_table=11

SEQ ID NO: 91874 - protein, 259 aa, Streptococcus pyogenes M1 GAS; identical to SEQ ID NO: 61794

SEQ ID NO: 91875 - DNA, 744 bp, Xylella fastidiosa 9a5c; identical to SEQ ID NO: 7066
  CDS (1)..(744): transl_table=11

SEQ ID NO: 91876 - protein, 247 aa, Xylella fastidiosa 9a5c; identical to SEQ ID NO: 7067

SEQ ID NO: 91877 - DNA, 750 bp, Clostridium acetobutylicum ATCC 824; identical to SEQ ID NO: 7072
  CDS (1)..(750): transl_table=11

SEQ ID NO: 91878 - protein, 249 aa, Clostridium acetobutylicum ATCC 824; identical to SEQ ID NO: 7073

SEQ ID NO: 91879 - DNA, 918 bp, Agrobacterium tumefaciens str. C58; identical to SEQ ID NO: 61799
  CDS (1)..(918): transl_table=11

SEQ ID NO: 91880 - protein, 305 aa, Agrobacterium tumefaciens str. C58; identical to SEQ ID NO: 61800

SEQ ID NO: 91881 - DNA, 819 bp, Staphylococcus aureus subsp. aureus Mu50; identical to SEQ ID NO: 61801
  CDS (1)..(819): transl_table=11

SEQ ID NO: 91882 - protein, 272 aa, Staphylococcus aureus subsp. aureus Mu50; identical to SEQ ID NO: 61802

SEQ ID NO: 91883 - DNA, 753 bp, Sulfolobus tokodaii str. 7; identical to SEQ ID NO: 7294
  CDS (1)..(753): transl_table=11

SEQ ID NO: 91884 - protein, 250 aa, Sulfolobus tokodaii str. 7; identical to SEQ ID NO: 7295

SEQ ID NO: 91885 - DNA, 738 bp, Sinorhizobium meliloti 1021; identical to SEQ ID NO: 7316
  CDS (1)..(738): transl_table=11

SEQ ID NO: 91886 - protein, 245 aa, Sinorhizobium meliloti 1021; identical to SEQ ID NO: 7317

SEQ ID NO: 91887 - DNA, 759 bp, Sinorhizobium meliloti 1021; identical to SEQ ID NO: 7282
  CDS (1)..(759): transl_table=11

SEQ ID NO: 91888 - protein, 252 aa, Sinorhizobium meliloti 1021; identical to SEQ ID NO: 7283

SEQ ID NO: 91889 - DNA, 741 bp, Caulobacter crescentus CB15; identical to SEQ ID NO: 7026
  CDS (1)..(741): transl_table=11

SEQ ID NO: 91890 - protein, 246 aa, Caulobacter crescentus CB15; identical to SEQ ID NO: 7027

SEQ ID NO: 91891 - DNA, 780 bp, Sinorhizobium meliloti 1021; identical to SEQ ID NO: 61811
  CDS (1)..(780): transl_table=11

SEQ ID NO: 91892 - protein, 259 aa, Sinorhizobium meliloti 1021; identical to SEQ ID NO: 61812

SEQ ID NO: 91893 - DNA, 735 bp, Sinorhizobium meliloti 1021; identical to SEQ ID NO: 61813
  CDS (1)..(735): transl_table=11

SEQ ID NO: 91894 - protein, 244 aa, Sinorhizobium meliloti 1021; identical to SEQ ID NO: 61814

SEQ ID NO: 91895 - DNA, 744 bp, Listeria monocytogenes EGD-e; identical to SEQ ID NO: 61815
  CDS (1)..(744): transl_table=11

SEQ ID NO: 91896 - protein, 247 aa, Listeria monocytogenes EGD-e; identical to SEQ ID NO: 61816

SEQ ID NO: 91897 - DNA, 756 bp, Nostoc sp. PCC 7120; identical to SEQ ID NO: 7036
  CDS (1)..(756): transl_table=11

SEQ ID NO: 91898 - protein, 251 aa, Nostoc sp. PCC 7120; identical to SEQ ID NO: 7037

SEQ ID NO: 91899 - DNA, 798 bp, Ralstonia solanacearum GMI1000; identical to SEQ ID NO: 61819
  CDS (1)..(798): transl_table=11

SEQ ID NO: 91900 - protein, 265 aa, Ralstonia solanacearum GMI1000; identical to SEQ ID NO: 61820

SEQ ID NO: 91901 - DNA, 738 bp, Agrobacterium tumefaciens str. C58; identical to SEQ ID NO: 7054
  CDS (1)..(738): transl_table=11

SEQ ID NO: 91902 - protein, 245 aa, Agrobacterium tumefaciens str. C58; identical to SEQ ID NO: 7055

SEQ ID NO: 91903 - DNA, 777 bp, Agrobacterium tumefaciens str. C58; identical to SEQ ID NO: 61823
  CDS (1)..(777): transl_table=11

SEQ ID NO: 91904 - protein, 258 aa, Agrobacterium tumefaciens str. C58; identical to SEQ ID NO: 61824

SEQ ID NO: 91905 - DNA, 735 bp, Brucella melitensis 16M; identical to SEQ ID NO: 61825
  CDS (1)..(735): transl_table=11

SEQ ID NO: 91906 - protein, 244 aa, Brucella melitensis 16M; identical to SEQ ID NO: 61826

SEQ ID NO: 91907 - DNA, 741 bp, Clostridium perfringens str. 13; identical to SEQ ID NO: 7272
  CDS (1)..(741): transl_table=11

SEQ ID NO: 91908 - protein, 246 aa, Clostridium perfringens str. 13; identical to SEQ ID NO: 7273

SEQ ID NO: 91909 - DNA, 732 bp, Fusobacterium nucleatum subsp. nucleatum ATCC 25586; identical to SEQ ID NO: 7268
  CDS (1)..(732): transl_table=11

SEQ ID NO: 91910 - protein, 243 aa, Fusobacterium nucleatum subsp. nucleatum ATCC 25586; identical to SEQ ID NO: 7269

SEQ ID NO: 91911 - DNA, 780 bp, Streptococcus pyogenes MGAS8232; identical to SEQ ID NO: 61831
  CDS (1)..(780): transl_table=11

SEQ ID NO: 91912 - protein, 259 aa, Streptococcus pyogenes MGAS8232; identical to SEQ ID NO: 61832

SEQ ID NO: 91913 - DNA, 735 bp, Streptococcus pyogenes MGAS8232; identical to SEQ ID NO: 61833
  CDS (1)..(735): transl_table=11

SEQ ID NO: 91914 - protein, 244 aa, Streptococcus pyogenes MGAS8232; identical to SEQ ID NO: 61834

SEQ ID NO: 91915 - DNA, 903 bp, Xanthomonas campestris pv. campestris str. ATCC 33913; identical to SEQ ID NO: 61835
  CDS (1)..(903): transl_table=11

SEQ ID NO: 91916 - protein, 300 aa, Xanthomonas campestris pv. campestris str. ATCC 33913; identical to SEQ ID NO: 61836

SEQ ID NO: 91917 - DNA, 771 bp, Xanthomonas axonopodis pv. citri str. 306; identical to SEQ ID NO: 61837
  CDS (1)..(771): transl_table=11

SEQ ID NO: 91918 - protein, 256 aa, Xanthomonas axonopodis pv. citri str. 306; identical to SEQ ID NO: 61838

SEQ ID NO: 91919 - DNA, 741 bp, Bacillus anthracis str. A2012; identical to SEQ ID NO: 61839
  CDS (1)..(741): r means g or a, n means a or g or c or t/u

SEQ ID NO: 91920 - protein, 246 aa, Bacillus anthracis str. A2012; identical to SEQ ID NO: 61840
  misc_feature (17)..(17): Xaa can be Glu or Gly
  misc_feature (109)..(109): Xaa can be Arg or Gln or Leu or Pro

SEQ ID NO: 91921 - DNA, 741 bp, Bacillus anthracis str. A2012; identical to SEQ ID NO: 61841
  CDS (1)..(741): transl_table=11

SEQ ID NO: 91922 - protein, 246 aa, Bacillus anthracis str. A2012; identical to SEQ ID NO: 61842

SEQ ID NO: 91923 - DNA, 738 bp, Chlorobium tepidum TLS; identical to SEQ ID NO: 7248
  CDS (1)..(738): transl_table=11

SEQ ID NO: 91924 - protein, 245 aa, Chlorobium tepidum TLS; identical to SEQ ID NO: 7249

SEQ ID NO: 91925 - DNA, 741 bp, Yersinia pestis KIM; identical to SEQ ID NO: 61845
  CDS (1)..(741): transl_table=11

SEQ ID NO: 91926 - protein, 246 aa, Yersinia pestis KIM; identical to SEQ ID NO: 61846

SEQ ID NO: 91927 - DNA, 735 bp, Streptococcus agalactiae 2603V/R; identical to SEQ ID NO: 7232
  CDS (1)..(735): transl_table=11

SEQ ID NO: 91928 - protein, 244 aa, Streptococcus agalactiae 2603V/R; identical to SEQ ID NO: 7233

SEQ ID NO: 91929 - DNA, 765 bp, Oceanobacillus iheyensis HTE831; identical to SEQ ID NO: 7238
  CDS (1)..(765): transl_table=11

SEQ ID NO: 91930 - protein, 254 aa, Oceanobacillus iheyensis HTE831; identical to SEQ ID NO: 7239

SEQ ID NO: 91931 - DNA, 741 bp, Oceanobacillus iheyensis HTE831; identical to SEQ ID NO: 7236
  CDS (1)..(741): transl_table=11

SEQ ID NO: 91932 - protein, 246 aa, Oceanobacillus iheyensis HTE831; identical to SEQ ID NO: 7237

SEQ ID NO: 91933 - DNA, 735 bp, Brucella suis 1330; identical to SEQ ID NO: 61853
  CDS (1)..(735): transl_table=11

SEQ ID NO: 91934 - protein, 244 aa, Brucella suis 1330; identical to SEQ ID NO: 61854

SEQ ID NO: 91935 - DNA, 741 bp, Brucella suis 1330; identical to SEQ ID NO: 61855
  CDS (1)..(741): transl_table=11

SEQ ID NO: 91936 - protein, 246 aa, Brucella suis 1330; identical to SEQ ID NO: 61856

SEQ ID NO: 91937 - DNA, 792 bp, Shigella flexneri 2a str. 301; identical to SEQ ID NO: 61857
  CDS (1)..(792): transl_table=11

SEQ ID NO: 91938 - protein, 263 aa, Shigella flexneri 2a str. 301; identical to SEQ ID NO: 61858

SEQ ID NO: 91939 - DNA, 771 bp, Leptospira interrogans serovar Lai str. 56601; identical to SEQ ID NO: 61859
  CDS (1)..(771): transl_table=11

SEQ ID NO: 91940 - protein, 256 aa, Leptospira interrogans serovar Lai str. 56601; identical to SEQ ID NO: 61860

SEQ ID NO: 91941 - DNA, 780 bp, Leptospira interrogans serovar Lai str. 56601; identical to SEQ ID NO: 61861
  CDS (1)..(780): transl_table=11

SEQ ID NO: 91942 - protein, 259 aa, Leptospira interrogans serovar Lai str. 56601; identical to SEQ ID NO: 7243

SEQ ID NO: 91943 - DNA, 765 bp, Leptospira interrogans serovar Lai str. 56601; identical to SEQ ID NO: 61863
  CDS (1)..(765): transl_table=11

SEQ ID NO: 91944 - protein, 254 aa, Leptospira interrogans serovar Lai str. 56601; identical to SEQ ID NO: 7241

SEQ ID NO: 91945 - DNA, 735 bp, Streptococcus mutans UA159; identical to SEQ ID NO: 7230
  CDS (1)..(735): transl_table=11

SEQ ID NO: 91946 - protein, 244 aa, Streptococcus mutans UA159; identical to SEQ ID NO: 7231

SEQ ID NO: 91947 - DNA, 750 bp, Corynebacterium efficiens YS-314; identical to SEQ ID NO: 7244
  CDS (1)..(750): transl_table=11

SEQ ID NO: 91948 - protein, 249 aa, Corynebacterium efficiens YS-314; identical to SEQ ID NO: 7245

SEQ ID NO: 91949 - DNA, 819 bp, Staphylococcus epidermidis ATCC 12228; identical to SEQ ID NO: 61869
  CDS (1)..(819): transl_table=11

SEQ ID NO: 91950 - protein, 272 aa, Staphylococcus epidermidis ATCC 12228; identical to SEQ ID NO: 61870

SEQ ID NO: 91951 - DNA, 807 bp, Bradyrhizobium japonicum USDA 110; identical to SEQ ID NO: 61871
  CDS (1)..(807)

SEQ ID NO: 91952 - protein, 268 aa, Bradyrhizobium japonicum USDA 110; identical to SEQ ID NO: 61872

SEQ ID NO: 91953 - DNA, 810 bp, Bradyrhizobium japonicum USDA 110; identical to SEQ ID NO: 61873
  CDS (1)..(810)

SEQ ID NO: 91954 - protein, 269 aa, Bradyrhizobium japonicum USDA 110; identical to SEQ ID NO: 61874

SEQ ID NO: 91955 - DNA, 738 bp, Bradyrhizobium japonicum USDA 110; identical to SEQ ID NO: 7216
  CDS (1)..(738)

SEQ ID NO: 91956 - protein, 245 aa, Bradyrhizobium japonicum USDA 110; identical to SEQ ID NO: 7217

SEQ ID NO: 91957 - DNA, 744 bp, Xylella fastidiosa Temecula1; identical to SEQ ID NO: 7198
  CDS (1)..(744): transl_table=11

SEQ ID NO: 91958 - protein, 247 aa, Xylella fastidiosa Temecula1; identical to SEQ ID NO: 7199

SEQ ID NO: 91959 - DNA, 756 bp, Clostridium tetani E88; identical to SEQ ID NO: 7214
  CDS (1)..(756): transl_table=11

SEQ ID NO: 91960 - protein, 251 aa, Clostridium tetani E88; identical to SEQ ID NO: 7215

SEQ ID NO: 91961 - DNA, 750 bp, Clostridium tetani E88; identical to SEQ ID NO: 7212
  CDS (1)..(750): transl_table=11

SEQ ID NO: 91962 - protein, 249 aa, Clostridium tetani E88; identical to SEQ ID NO: 7213

SEQ ID NO: 91963 - DNA, 756 bp, Lactobacillus plantarum WCFS1; identical to SEQ ID NO: 61883
  CDS (1)..(756): transl_table=11

SEQ ID NO: 91964 - protein, 251 aa, Lactobacillus plantarum WCFS1; identical to SEQ ID NO: 61884

SEQ ID NO: 91965 - DNA, 765 bp, Pseudomonas syringae pv. tomato str. DC3000; identical to SEQ ID NO: 61885
  CDS (1)..(765): transl_table=11

SEQ ID NO: 91966 - protein, 254 aa, Pseudomonas syringae pv. tomato str. DC3000; identical to SEQ ID NO: 61886

SEQ ID NO: 91967 - DNA, 735 bp, Vibrio parahaemolyticus RIMD 2210633; identical to SEQ ID NO: 61887
  CDS (1)..(735): transl_table=11

SEQ ID NO: 91968 - protein, 244 aa, Vibrio parahaemolyticus RIMD 2210633; identical to SEQ ID NO: 61888

SEQ ID NO: 91969 - DNA, 747 bp, Bacteroides thetaiotaomicron VPI-5482; identical to SEQ ID NO: 7220
  CDS (1)..(747): transl_table=11

SEQ ID NO: 91970 - protein, 248 aa, Bacteroides thetaiotaomicron VPI-5482; identical to SEQ ID NO: 7221

SEQ ID NO: 91971 - DNA, 738 bp, Enterococcus faecalis V583; identical to SEQ ID NO: 61891
  CDS (1)..(738): transl_table=11

SEQ ID NO: 91972 - protein, 245 aa, Enterococcus faecalis V583; identical to SEQ ID NO: 7185

SEQ ID NO: 91973 - DNA, 831 bp, Streptomyces avermitilis MA-4680; identical to SEQ ID NO: 61893
  CDS (1)..(831)

SEQ ID NO: 91974 - protein, 276 aa, Streptomyces avermitilis MA-4680; identical to SEQ ID NO: 61894

SEQ ID NO: 91975 - DNA, 747 bp, Chlamydophila caviae GPIC; identical to SEQ ID NO: 7182
  CDS (1)..(747): transl_table=11

SEQ ID NO: 91976 - protein, 248 aa, Chlamydophila caviae GPIC; identical to SEQ ID NO: 7183

SEQ ID NO: 91977 - DNA, 744 bp, Bacillus cereus ATCC 14579; identical to SEQ ID NO: 61897
  CDS (1)..(744): transl_table=11

SEQ ID NO: 91978 - protein, 247 aa, Bacillus cereus ATCC 14579; identical to SEQ ID NO: 61898

SEQ ID NO: 91979 - DNA, 741 bp, Bacillus cereus ATCC 14579; identical to SEQ ID NO: 61899
  CDS (1)..(741): transl_table=11

SEQ ID NO: 91980 - protein, 246 aa, Bacillus cereus ATCC 14579; identical to SEQ ID NO: 61900

SEQ ID NO: 91981 - DNA, 741 bp, Bacillus cereus ATCC 14579; identical to SEQ ID NO: 7176
  CDS (1)..(741): transl_table=11

SEQ ID NO: 91982 - protein, 246 aa, Bacillus cereus ATCC 14579; identical to SEQ ID NO: 7177

SEQ ID NO: 91983 - DNA, 753 bp, Prochlorococcus marinus subsp. marinus str. CCMP1375; identical to SEQ ID NO: 7156
  CDS (1)..(753): transl_table=11

SEQ ID NO: 91984 - protein, 250 aa, Prochlorococcus marinus subsp. marinus str. CCMP1375; identical to SEQ ID NO: 7157

SEQ ID NO: 91985 - DNA, 768 bp, Bordetella pertussis Tohama I; identical to SEQ ID NO: 61905
  CDS (1)..(768): transl_table=11

SEQ ID NO: 91986 - protein, 255 aa, Bordetella pertussis Tohama I; identical to SEQ ID NO: 61906

SEQ ID NO: 91987 - DNA, 753 bp, Bordetella parapertussis 12822; identical to SEQ ID NO: 61907
  CDS (1)..(753): transl_table=11

SEQ ID NO: 91988 - protein, 250 aa, Bordetella parapertussis 12822; identical to SEQ ID NO: 61908

SEQ ID NO: 91989 - DNA, 738 bp, Bordetella parapertussis 12822; identical to SEQ ID NO: 7164
  CDS (1)..(738): transl_table=11

SEQ ID NO: 91990 - protein, 245 aa, Bordetella parapertussis 12822; identical to SEQ ID NO: 7165

SEQ ID NO: 91991 - DNA, 753 bp, Bordetella bronchiseptica RB50; identical to SEQ ID NO: 61911
  CDS (1)..(753): transl_table=11

SEQ ID NO: 91992 - protein, 250 aa, Bordetella bronchiseptica RB50; identical to SEQ ID NO: 61912

SEQ ID NO: 91993 - DNA, 738 bp, Bordetella bronchiseptica RB50; identical to SEQ ID NO: 61913
  CDS (1)..(738): transl_table=11

SEQ ID NO: 91994 - protein, 245 aa, Bordetella bronchiseptica RB50; identical to SEQ ID NO: 61914

SEQ ID NO: 91995 - DNA, 750 bp, Prochlorococcus marinus subsp. pastoris str. CCMP1986; identical to SEQ ID NO: 7152
  CDS (1)..(750): transl_table=11

SEQ ID NO: 91996 - protein, 249 aa, Prochlorococcus marinus subsp. pastoris str. CCMP1986; identical to SEQ ID NO: 7153

SEQ ID NO: 91997 - DNA, 753 bp, Prochlorococcus marinus str. MIT 9313; identical to SEQ ID NO: 7154
  CDS (1)..(753): transl_table=11

SEQ ID NO: 91998 - protein, 250 aa, Prochlorococcus marinus str. MIT 9313; identical to SEQ ID NO: 7155

SEQ ID NO: 91999 - DNA, 741 bp, Chromobacterium violaceum ATCC 12472; identical to SEQ ID NO: 7132
  CDS (1)..(741): transl_table=11

SEQ ID NO: 92000 - protein, 246 aa, Chromobacterium violaceum ATCC 12472; identical to SEQ ID NO: 7133

SEQ ID NO: 92001 - DNA, 747 bp, Porphyromonas gingivalis W83; identical to SEQ ID NO: 7128
  CDS (1)..(747): transl_table=11

SEQ ID NO: 92002 - protein, 248 aa, Porphyromonas gingivalis W83; identical to SEQ ID NO: 7129

SEQ ID NO: 92003 - DNA, 735 bp, Photorhabdus luminescens subsp. laumondii TTO1; identical to SEQ ID NO: 7138
  CDS (1)..(735): transl_table=11

SEQ ID NO: 92004 - protein, 244 aa, Photorhabdus luminescens subsp. laumondii TTO1; identical to SEQ ID NO: 7139

SEQ ID NO: 92005 - DNA, 747 bp, Vibrio vulnificus YJ016; identical to SEQ ID NO: 7224
  CDS (1)..(747): transl_table=11

SEQ ID NO: 92006 - protein, 248 aa, Vibrio vulnificus YJ016; identical to SEQ ID NO: 7225

SEQ ID NO: 92007 - DNA, 789 bp, Rhodopseudomonas palustris CGA009; identical to SEQ ID NO: 61927
  CDS (1)..(789): transl_table=11

SEQ ID NO: 92008 - protein, 262 aa, Rhodopseudomonas palustris CGA009; identical to SEQ ID NO: 61928

SEQ ID NO: 92009 - DNA, 768 bp, Rhodopseudomonas palustris CGA009; identical to SEQ ID NO: 61929
  CDS (1)..(768): transl_table=11

SEQ ID NO: 92010 - protein, 255 aa, Rhodopseudomonas palustris CGA009; identical to SEQ ID NO: 61930

SEQ ID NO: 92011 - DNA, 735 bp, Rhodopseudomonas palustris CGA009; identical to SEQ ID NO: 61931
  CDS (1)..(735): transl_table=11

SEQ ID NO: 92012 - protein, 244 aa, Rhodopseudomonas palustris CGA009; identical to SEQ ID NO: 61932

SEQ ID NO: 92013 - DNA, 747 bp, Rhodopseudomonas palustris CGA009; identical to SEQ ID NO: 61933
  CDS (1)..(747): transl_table=11

SEQ ID NO: 92014 - protein, 248 aa, Rhodopseudomonas palustris CGA009; identical to SEQ ID NO: 61934

SEQ ID NO: 92015 - DNA, 741 bp, Geobacter sulfurreducens PCA; identical to SEQ ID NO: 7370
  CDS (1)..(741): transl_table=11

SEQ ID NO: 92016 - protein, 246 aa, Geobacter sulfurreducens PCA; identical to SEQ ID NO: 7371

SEQ ID NO: 92017 - DNA, 807 bp, Mycobacterium avium subsp. paratuberculosis str. k10; identical to SEQ ID NO: 61937
  CDS (1)..(807): transl_table=11

SEQ ID NO: 92018 - protein, 268 aa, Mycobacterium avium subsp. paratuberculosis str. k10; identical to SEQ ID NO: 61938

SEQ ID NO: 92019 - DNA, 750 bp, Mycobacterium avium subsp. paratuberculosis str. k10; identical to SEQ ID NO: 61939
  CDS (1)..(750): transl_table=11

SEQ ID NO: 92020 - protein, 249 aa, Mycobacterium avium subsp. paratuberculosis str. k10; identical to SEQ ID NO: 61940

SEQ ID NO: 92021 - DNA, 795 bp, Bacillus cereus ATCC 10987; identical to SEQ ID NO: 61941
  CDS (1)..(795): transl_table=11

SEQ ID NO: 92022 - protein, 264 aa, Bacillus cereus ATCC 10987; identical to SEQ ID NO: 61942

SEQ ID NO: 92023 - DNA, 741 bp, Bacillus cereus ATCC 10987; identical to SEQ ID NO: 7378
  CDS (1)..(741): transl_table=11

SEQ ID NO: 92024 - protein, 246 aa, Bacillus cereus ATCC 10987; identical to SEQ ID NO: 7379

SEQ ID NO: 92025 - DNA, 738 bp, Canis familiaris; identical to SEQ ID NO: 61945
  CDS (1)..(738)

SEQ ID NO: 92026 - protein, 245 aa, Canis familiaris; identical to SEQ ID NO: 61946

SEQ ID NO: 92027 - DNA, 744 bp, Desulfovibrio vulgaris subsp. vulgaris str. Hildenborough; identical to SEQ ID NO: 7384
  CDS (1)..(744): transl_table=11

SEQ ID NO: 92028 - protein, 247 aa, Desulfovibrio vulgaris subsp. vulgaris str. Hildenborough; identical to SEQ ID NO: 7385

SEQ ID NO: 92029 - DNA, 777 bp, Desulfovibrio vulgaris subsp. vulgaris str. Hildenborough; identical to SEQ ID NO: 61949
  CDS (1)..(777): transl_table=11

SEQ ID NO: 92030 - protein, 258 aa, Desulfovibrio vulgaris subsp. vulgaris str. Hildenborough; identical to SEQ ID NO: 61950

SEQ ID NO: 92031 - DNA, 738 bp, Bartonella henselae str. Houston-1; identical to SEQ ID NO: 61951
  CDS (1)..(738): transl_table=11

SEQ ID NO: 92032 - protein, 245 aa, Bartonella henselae str. Houston-1; identical to SEQ ID NO: 61952

SEQ ID NO: 92033 - DNA, 741 bp, Bacillus thuringiensis serovar konkukian str. 97-27; identical to SEQ ID NO: 61953
  CDS (1)..(741): transl_table=11

SEQ ID NO: 92034 - protein, 246 aa, Bacillus thuringiensis serovar konkukian str. 97-27; identical to SEQ ID NO: 61954

SEQ ID NO: 92035 - DNA, 735 bp, Erwinia carotovora subsp. atroseptica SCRI1043; identical to SEQ ID NO: 61955
  CDS (1)..(735)

SEQ ID NO: 92036 - protein, 244 aa, Erwinia carotovora subsp. atroseptica SCRI1043; identical to SEQ ID NO: 61956

SEQ ID NO: 92037 - DNA, 762 bp, Propionibacterium acnes KPA171202; identical to SEQ ID NO: 61957
  CDS (1)..(762): transl_table=11

SEQ ID NO: 92038 - protein, 253 aa, Propionibacterium acnes KPA171202; identical to SEQ ID NO: 61958

SEQ ID NO: 92039 - DNA, 780 bp, Streptococcus pyogenes MGAS10394; identical to SEQ ID NO: 61959
  CDS (1)..(780): transl_table=11

SEQ ID NO: 92040 - protein, 259 aa, Streptococcus pyogenes MGAS10394; identical to SEQ ID NO: 61960

SEQ ID NO: 92041 - DNA, 765 bp, Symbiobacterium thermophilum IAM 14863; identical to SEQ ID NO: 61961
  CDS (1)..(765): transl_table=11

SEQ ID NO: 92042 - protein, 254 aa, Symbiobacterium thermophilum IAM 14863; identical to SEQ ID NO: 61962

SEQ ID NO: 92043 - DNA, 744 bp, Bacillus licheniformis ATCC 14580; identical to SEQ ID NO: 61963
  CDS (1)..(744): transl_table=11

SEQ ID NO: 92044 - protein, 247 aa, Bacillus licheniformis ATCC 14580; identical to SEQ ID NO: 61964

SEQ ID NO: 92045 - DNA, 747 bp, Bacteroides fragilis YCH46; identical to SEQ ID NO: 61965
  CDS (1)..(747): transl_table=11

SEQ ID NO: 92046 - protein, 248 aa, Bacteroides fragilis YCH46; identical to SEQ ID NO: 61966

SEQ ID NO: 92047 - DNA, 744 bp, Burkholderia mallei ATCC 23344; identical to SEQ ID NO: 61967
  CDS (1)..(744): transl_table=11

SEQ ID NO: 92048 - protein, 247 aa, Burkholderia mallei ATCC 23344; identical to SEQ ID NO: 61968

SEQ ID NO: 92049 - DNA, 834 bp, Burkholderia mallei ATCC 23344; identical to SEQ ID NO: 61969
  CDS (1)..(834): transl_table=11

SEQ ID NO: 92050 - protein, 277 aa, Burkholderia mallei ATCC 23344; identical to SEQ ID NO: 61970

SEQ ID NO: 92051 - DNA, 780 bp, Burkholderia pseudomallei K96243; identical to SEQ ID NO: 61971
  CDS (1)..(780): transl_table=11

SEQ ID NO: 92052 - protein, 259 aa, Burkholderia pseudomallei K96243; identical to SEQ ID NO: 61972

SEQ ID NO: 92053 - DNA, 738 bp, Methylococcus capsulatus str. Bath; identical to SEQ ID NO: 61973
  CDS (1)..(738): transl_table=11

SEQ ID NO: 92054 - protein, 245 aa, Methylococcus capsulatus str. Bath; identical to SEQ ID NO: 61974

SEQ ID NO: 92055 - DNA, 735 bp, Photobacterium profundum SS9; identical to SEQ ID NO: 7394
  CDS (1)..(735): transl_table=11

SEQ ID NO: 92056 - protein, 244 aa, Photobacterium profundum SS9; identical to SEQ ID NO: 7395

SEQ ID NO: 92057 - DNA, 807 bp, Haloarcula marismortui ATCC 43049; identical to SEQ ID NO: 61977
  CDS (1)..(807): transl_table=11

SEQ ID NO: 92058 - protein, 268 aa, Haloarcula marismortui ATCC 43049; identical to SEQ ID NO: 61978

SEQ ID NO: 92059 - DNA, 744 bp, Haloarcula marismortui ATCC 43049; identical to SEQ ID NO: 61979
  CDS (1)..(744): transl_table=11

SEQ ID NO: 92060 - protein, 247 aa, Haloarcula marismortui ATCC 43049; identical to SEQ ID NO: 61980

SEQ ID NO: 92061 - DNA, 735 bp, Streptococcus thermophilus LMG 18311; identical to SEQ ID NO: 61981
  CDS (1)..(735): transl_table=11

SEQ ID NO: 92062 - protein, 244 aa, Streptococcus thermophilus LMG 18311; identical to SEQ ID NO: 61982

SEQ ID NO: 92063 - DNA, 744 bp, Geobacillus kaustophilus HTA426; identical to SEQ ID NO: 61983
  CDS (1)..(744): transl_table=11

SEQ ID NO: 92064 - protein, 247 aa, Geobacillus kaustophilus HTA426; identical to SEQ ID NO: 61984

SEQ ID NO: 92065 - DNA, 738 bp, Idiomarina loihiensis L2TR; identical to SEQ ID NO: 61985
  CDS (1)..(738): transl_table=11

SEQ ID NO: 92066 - protein, 245 aa, Idiomarina loihiensis L2TR; identical to SEQ ID NO: 61986

SEQ ID NO: 92067 - DNA, 747 bp, Azoarcus sp. EbN1; identical to SEQ ID NO: 61987
  CDS (1)..(747): transl_table=11

SEQ ID NO: 92068 - protein, 248 aa, Azoarcus sp. EbN1; identical to SEQ ID NO: 61988

SEQ ID NO: 92069 - DNA, 738 bp, Silicibacter pomeroyi DSS-3; identical to SEQ ID NO: 61989
  CDS (1)..(738): transl_table=11

SEQ ID NO: 92070 - protein, 245 aa, Silicibacter pomeroyi DSS-3; identical to SEQ ID NO: 61990

SEQ ID NO: 92071 - DNA, 774 bp, Bacillus clausii KSM-K16; identical to SEQ ID NO: 61991
  CDS (1)..(774): transl_table=11

SEQ ID NO: 92072 - protein, 257 aa, Bacillus clausii KSM-K16; identical to SEQ ID NO: 61992

SEQ ID NO: 92073 - DNA, 744 bp, Dehalococcoides ethenogenes 195; identical to SEQ ID NO: 61993
  CDS (1)..(744): transl_table=11

SEQ ID NO: 92074 - protein, 247 aa, Dehalococcoides ethenogenes 195; identical to SEQ ID NO: 61994

SEQ ID NO: 92075 - DNA, 744 bp, Xylella fastidiosa Ann-1; identical to SEQ ID NO: 61995
  CDS (1)..(744)

SEQ ID NO: 92076 - protein, 247 aa, Xylella fastidiosa Ann-1; identical to SEQ ID NO: 61996

SEQ ID NO: 92077 - DNA, 741 bp, Magnetospirillum magnetotacticum MS-1; identical to SEQ ID NO: 61997
  CDS (1)..(741)

SEQ ID NO: 92078 - protein, 246 aa, Magnetospirillum magnetotacticum MS-1; identical to SEQ ID NO: 61998

SEQ ID NO: 92079 - DNA, 774 bp, Magnetospirillum magnetotacticum MS-1; identical to SEQ ID NO: 61999
  CDS (1)..(774)

SEQ ID NO: 92080 - protein, 257 aa, Magnetospirillum magnetotacticum MS-1; identical to SEQ ID NO: 62000

SEQ ID NO: 92081 - DNA, 759 bp, Azotobacter vinelandii; identical to SEQ ID NO: 62001
  CDS (1)..(759)

SEQ ID NO: 92082 - protein, 252 aa, Azotobacter vinelandii; identical to SEQ ID NO: 62002

SEQ ID NO: 92083 - DNA, 747 bp, Nostoc punctiforme PCC 73102; identical to SEQ ID NO: 62003
  CDS (1)..(747)

SEQ ID NO: 92084 - protein, 248 aa, Nostoc punctiforme PCC 73102; identical to SEQ ID NO: 62004

SEQ ID NO: 92085 - DNA, 726 bp, Haemophilus somnus 129PT; identical to SEQ ID NO: 62005
  CDS (1)..(726)

SEQ ID NO: 92086 - protein, 241 aa, Haemophilus somnus 129PT; identical to SEQ ID NO: 62006

SEQ ID NO: 92087 - DNA, 765 bp, Pseudomonas syringae pv. syringae B728a; identical to SEQ ID NO: 62007
  CDS (1)..(765)

SEQ ID NO: 92088 - protein, 254 aa, Pseudomonas syringae pv. syringae B728a; identical to SEQ ID NO: 62008

SEQ ID NO: 92089 - DNA, 729 bp, Haemophilus somnus 2336; identical to SEQ ID NO: 62009
  CDS (1)..(729)

SEQ ID NO: 92090 - protein, 242 aa, Haemophilus somnus 2336; identical to SEQ ID NO: 62010

SEQ ID NO: 92091 - DNA, 726 bp, Actinobacillus pleuropneumoniae serovar 1 str. 4074; identical to SEQ ID NO: 62011
  CDS (1)..(726)

SEQ ID NO: 92092 - protein, 241 aa, Actinobacillus pleuropneumoniae serovar 1 str. 4074; identical to SEQ ID NO: 62012

SEQ ID NO: 92093 - DNA, 783 bp, Pseudomonas aeruginosa UCBPP-PA14; identical to SEQ ID NO: 62013
  CDS (1)..(783)

SEQ ID NO: 92094 - protein, 260 aa, Pseudomonas aeruginosa UCBPP-PA14; identical to SEQ ID NO: 62014

SEQ ID NO: 92095 - DNA, 756 bp, Ralstonia eutropha JMP134; identical to SEQ ID NO: 62015
  CDS (1)..(756)

SEQ ID NO: 92096 - protein, 251 aa, Ralstonia eutropha JMP134; identical to SEQ ID NO: 62016

SEQ ID NO: 92097 - DNA, 819 bp, Ralstonia eutropha JMP134; identical to SEQ ID NO: 62017
  CDS (1)..(819)

SEQ ID NO: 92098 - protein, 272 aa, Ralstonia eutropha JMP134; identical to SEQ ID NO: 62018

SEQ ID NO: 92099 - DNA, 732 bp, Exiguobacterium sp. 255-15; identical to SEQ ID NO: 62019
  CDS (1)..(732)

SEQ ID NO: 92100 - protein, 243 aa, Exiguobacterium sp. 255-15; identical to SEQ ID NO: 62020

SEQ ID NO: 92101 - DNA, 783 bp, Exiguobacterium sp. 255-15; identical to SEQ ID NO: 62021
  CDS (1)..(783)

SEQ ID NO: 92102 - protein, 260 aa, Exiguobacterium sp. 255-15; identical to SEQ ID NO: 62022

SEQ ID NO: 92103 - DNA, 768 bp, Rubrobacter xylanophilus DSM 9941; identical to SEQ ID NO: 62023
  CDS (1)..(768)

SEQ ID NO: 92104 - protein, 255 aa, Rubrobacter xylanophilus DSM 9941; identical to SEQ ID NO: 62024

SEQ ID NO: 92105 - DNA, 780 bp, Rubrobacter xylanophilus DSM 9941; identical to SEQ ID NO: 62025
  CDS (1)..(780)

SEQ ID NO: 92106 - protein, 259 aa, Rubrobacter xylanophilus DSM 9941; identical to SEQ ID NO: 62026

SEQ ID NO: 92107 - DNA, 771 bp, Rubrobacter xylanophilus DSM 9941; identical to SEQ ID NO: 62027
  CDS (1)..(771)

SEQ ID NO: 92108 - protein, 256 aa, Rubrobacter xylanophilus DSM 9941; identical to SEQ ID NO: 62028

SEQ ID NO: 92109 - DNA, 738 bp, Mesorhizobium sp. BNC1; identical to SEQ ID NO: 62029
  CDS (1)..(738)

SEQ ID NO: 92110 - protein, 245 aa, Mesorhizobium sp. BNC1; identical to SEQ ID NO: 62030

SEQ ID NO: 92111 - DNA, 777 bp, Mesorhizobium sp. BNC1; identical to SEQ ID NO: 62031
  CDS (1)..(777)

SEQ ID NO: 92112 - protein, 258 aa, Mesorhizobium sp. BNC1; identical to SEQ ID NO: 62032

SEQ ID NO: 92113 - DNA, 747 bp, Rubrobacter xylanophilus DSM 9941; identical to SEQ ID NO: 62033
  CDS (1)..(747)

SEQ ID NO: 92114 - protein, 248 aa, Rubrobacter xylanophilus DSM 9941; identical to SEQ ID NO: 62034

SEQ ID NO: 92115 - DNA, 774 bp, Burkholderia cepacia R18194; identical to SEQ ID NO: 62035
  CDS (1)..(774)

SEQ ID NO: 92116 - protein, 257 aa, Burkholderia cepacia R18194; identical to SEQ ID NO: 62036

SEQ ID NO: 92117 - DNA, 810 bp, Burkholderia cepacia R18194; identical to SEQ ID NO: 62037
  CDS (1)..(810)

SEQ ID NO: 92118 - protein, 269 aa, Burkholderia cepacia R18194; identical to SEQ ID NO: 62038

SEQ ID NO: 92119 - DNA, 780 bp, Burkholderia cepacia R18194; identical to SEQ ID NO: 62039
  CDS (1)..(780)

SEQ ID NO: 92120 - protein, 259 aa, Burkholderia cepacia R18194; identical to SEQ ID NO: 62040

SEQ ID NO: 92121 - DNA, 741 bp, Burkholderia cepacia R18194; identical to SEQ ID NO: 62041
  CDS (1)..(741)

SEQ ID NO: 92122 - protein, 246 aa, Burkholderia cepacia R18194; identical to SEQ ID NO: 62042

SEQ ID NO: 92123 - DNA, 759 bp, Burkholderia cepacia R1808; identical to SEQ ID NO: 62043
  CDS (1)..(759)

SEQ ID NO: 92124 - protein, 252 aa, Burkholderia cepacia R1808; identical to SEQ ID NO: 62044

SEQ ID NO: 92125 - DNA, 741 bp, Bacillus cereus G9241; identical to SEQ ID NO: 62045
  CDS (1)..(741): transl_table=11

SEQ ID NO: 92126 - protein, 246 aa, Bacillus cereus G9241; identical to SEQ ID NO: 62046

SEQ ID NO: 92127 - DNA, 786 bp, Rubrivivax gelatinosus PM1; identical to SEQ ID NO: 62047
  CDS (1)..(786)

SEQ ID NO: 92128 - protein, 261 aa, Rubrivivax gelatinosus PM1; identical to SEQ ID NO: 62048

SEQ ID NO: 92129 - DNA, 750 bp, Rubrivivax gelatinosus PM1; identical to SEQ ID NO: 62049
  CDS (1)..(750)

SEQ ID NO: 92130 - protein, 249 aa, Rubrivivax gelatinosus PM1; identical to SEQ ID NO: 62050

SEQ ID NO: 92131 - DNA, 819 bp, Pseudomonas fluorescens PfO-1; identical to SEQ ID NO: 62051
  CDS (1)..(819)

SEQ ID NO: 92132 - protein, 272 aa, Pseudomonas fluorescens PfO-1; identical to SEQ ID NO: 62052

SEQ ID NO: 92133 - DNA, 774 bp, Pseudomonas fluorescens PfO-1; identical to SEQ ID NO: 62053
  CDS (1)..(774)

SEQ ID NO: 92134 - protein, 257 aa, Pseudomonas fluorescens PfO-1; identical to SEQ ID NO: 62054

SEQ ID NO: 92135 - DNA, 741 bp, Ralstonia metallidurans CH34; identical to SEQ ID NO: 62055
  CDS (1)..(741)

SEQ ID NO: 92136 - protein, 246 aa, Ralstonia metallidurans CH34; identical to SEQ ID NO: 62056

SEQ ID NO: 92137 - DNA, 744 bp, Burkholderia fungorum LB400; identical to SEQ ID NO: 62057
  CDS (1)..(744)

SEQ ID NO: 92138 - protein, 247 aa, Burkholderia fungorum LB400; identical to SEQ ID NO: 62058

SEQ ID NO: 92139 - DNA, 768 bp, Burkholderia fungorum LB400; identical to SEQ ID NO: 62059
  CDS (1)..(768)

SEQ ID NO: 92140 - protein, 255 aa, Burkholderia fungorum LB400; identical to SEQ ID NO: 62060

SEQ ID NO: 92141 - DNA, 804 bp, Thermobifida fusca; identical to SEQ ID NO: 62061
  CDS (1)..(804)

SEQ ID NO: 92142 - protein, 267 aa, Thermobifida fusca; identical to SEQ ID NO: 62062

SEQ ID NO: 92143 - DNA, 741 bp, Geobacter metallireducens GS-15; identical to SEQ ID NO: 62063
  CDS (1)..(741)

SEQ ID NO: 92144 - protein, 246 aa, Geobacter metallireducens GS-15; identical to SEQ ID NO: 62064

SEQ ID NO: 92145 - DNA, 768 bp, Geobacter metallireducens GS-15; identical to SEQ ID NO: 62065
  CDS (1)..(768)

SEQ ID NO: 92146 - protein, 255 aa, Geobacter metallireducens GS-15; identical to SEQ ID NO: 62066

SEQ ID NO: 92147 - DNA, 741 bp, Novosphingobium aromaticivorans DSM 12444; identical to SEQ ID NO: 62067
  CDS (1)..(741)

SEQ ID NO: 92148 - protein, 246 aa, Novosphingobium aromaticivorans DSM 12444; identical to SEQ ID NO: 62068

SEQ ID NO: 92149 - DNA, 747 bp, Novosphingobium aromaticivorans DSM 12444; identical to SEQ ID NO: 62069
  CDS (1)..(747)

SEQ ID NO: 92150 - protein, 248 aa, Novosphingobium aromaticivorans DSM 12444; identical to SEQ ID NO: 62070

SEQ ID NO: 92151 - DNA, 747 bp, Cytophaga hutchinsonii; identical to SEQ ID NO: 62071
  CDS (1)..(747)

SEQ ID NO: 92152 - protein, 248 aa, Cytophaga hutchinsonii; identical to SEQ ID NO: 62072

SEQ ID NO: 92153 - DNA, 744 bp, Clostridium thermocellum ATCC 27405; identical to SEQ ID NO: 62073
  CDS (1)..(744)

SEQ ID NO: 92154 - protein, 247 aa, Clostridium thermocellum ATCC 27405; identical to SEQ ID NO: 62074

SEQ ID NO: 92155 - DNA, 759 bp, Trichodesmium erythraeum IMS101; identical to SEQ ID NO: 62075
  CDS (1)..(759)

SEQ ID NO: 92156 - protein, 252 aa, Trichodesmium erythraeum IMS101; identical to SEQ ID NO: 62076

SEQ ID NO: 92157 - DNA, 735 bp, Streptococcus suis 89/1591; identical to SEQ ID NO: 62077
  CDS (1)..(735)

SEQ ID NO: 92158 - protein, 244 aa, Streptococcus suis 89/1591; identical to SEQ ID NO: 62078

SEQ ID NO: 92159 - DNA, 750 bp, Silicibacter sp. TM1040; identical to SEQ ID NO: 62079
  CDS (1)..(750)

SEQ ID NO: 92160 - protein, 249 aa, Silicibacter sp. TM1040; identical to SEQ ID NO: 62080

SEQ ID NO: 92161 - DNA, 738 bp, Silicibacter sp. TM1040; identical to SEQ ID NO: 62081
  CDS (1)..(738)

SEQ ID NO: 92162 - protein, 245 aa, Silicibacter sp. TM1040; identical to SEQ ID NO: 62082

SEQ ID NO: 92163 - DNA, 741 bp, Ralstonia eutropha JMP134; identical to SEQ ID NO: 62083
  CDS (1)..(741)

SEQ ID NO: 92164 - protein, 246 aa, Ralstonia eutropha JMP134; identical to SEQ ID NO: 62084

SEQ ID NO: 92165 - DNA, 771 bp, Rubrobacter xylanophilus DSM 9941; identical to SEQ ID NO: 62085
  CDS (1)..(771)

SEQ ID NO: 92166 - protein, 256 aa, Rubrobacter xylanophilus DSM 9941; identical to SEQ ID NO: 62086

SEQ ID NO: 92167 - DNA, 759 bp, Chloroflexus aurantiacus; identical to SEQ ID NO: 62087
  CDS (1)..(759)

SEQ ID NO: 92168 - protein, 252 aa, Chloroflexus aurantiacus; identical to SEQ ID NO: 62088

SEQ ID NO: 92169 - DNA, 753 bp, Chloroflexus aurantiacus; identical to SEQ ID NO: 62089
  CDS (1)..(753)

SEQ ID NO: 92170 - protein, 250 aa, Chloroflexus aurantiacus; identical to SEQ ID NO: 62090

SEQ ID NO: 92171 - DNA, 750 bp, Chloroflexus aurantiacus; identical to SEQ ID NO: 62091
  CDS (1)..(750)

SEQ ID NO: 92172 - protein, 249 aa, Chloroflexus aurantiacus; identical to SEQ ID NO: 62092

SEQ ID NO: 92173 - DNA, 732 bp, Polaromonas sp. JS666; identical to SEQ ID NO: 62093
  CDS (1)..(732)

SEQ ID NO: 92174 - protein, 243 aa, Polaromonas sp. JS666; identical to SEQ ID NO: 62094

SEQ ID NO: 92175 - DNA, 750 bp, Polaromonas sp. JS666; identical to SEQ ID NO: 62095
  CDS (1)..(750)

SEQ ID NO: 92176 - protein, 249 aa, Polaromonas sp. JS666; identical to SEQ ID NO: 62096

SEQ ID NO: 92177 - DNA, 780 bp, Streptococcus pyogenes M49 591; identical to SEQ ID NO: 62097
  CDS (1)..(780)

SEQ ID NO: 92178 - protein, 259 aa, Streptococcus pyogenes M49 591; identical to SEQ ID NO: 62098

SEQ ID NO: 92179 - DNA, 774 bp, Nocardioides sp; identical to SEQ ID NO: 62099
  CDS (1)..(774): transl_table=11

SEQ ID NO: 92180 - protein, 257 aa, Nocardioides sp; identical to SEQ ID NO: 62100

SEQ ID NO: 92181 - DNA, 783 bp, uncultured bacterium; identical to SEQ ID NO: 62101
  CDS (1)..(783): transl_table=11

SEQ ID NO: 92182 - protein, 260 aa, uncultured bacterium; identical to SEQ ID NO: 62102

SEQ ID NO: 92183 - DNA, 798 bp, uncultured bacterium; identical to SEQ ID NO: 62103
  CDS (1)..(798): transl_table=11

SEQ ID NO: 92184 - protein, 265 aa, uncultured bacterium; identical to SEQ ID NO: 62104

SEQ ID NO: 92185 - DNA, 738 bp, Homo sapiens; identical to SEQ ID NO: 62105
  CDS (1)..(738)

SEQ ID NO: 92186 - protein, 245 aa, Homo sapiens [sequence omitted]

SEQ ID NO: 92187 - DNA, 750 bp, Brachyspira pilosicoli; identical to SEQ ID NO: 7366
  CDS (1)..(750): transl_table=11

SEQ ID NO: 92188 - protein, 249 aa, Brachyspira pilosicoli; identical to SEQ ID NO: 7367

SEQ ID NO: 92189 - DNA, 777 bp, Mycobacterium smegmatis; identical to SEQ ID NO: 62109
  CDS (1)..(777): transl_table=11

SEQ ID NO: 92190 - protein, 258 aa, Mycobacterium smegmatis; identical to SEQ ID NO: 62110

SEQ ID NO: 92191 - DNA, 759 bp, Terrabacter sp; identical to SEQ ID NO: 62111
  CDS (1)..(759): transl_table=11

SEQ ID NO: 92192 - protein, 252 aa, Terrabacter sp; identical to SEQ ID NO: 62112

SEQ ID NO: 92193 - DNA, 777 bp, Sinorhizobium sp; identical to SEQ ID NO: 62113
  CDS (1)..(777): transl_table=11

SEQ ID NO: 92194 - protein, 258 aa, Sinorhizobium sp; identical to SEQ ID NO: 62114

SEQ ID NO: 92195 - DNA, 786 bp, Azospirillum brasilense; identical to SEQ ID NO: 62115
  CDS (1)..(786): transl_table=11

SEQ ID NO: 92196 - protein, 261 aa, Azospirillum brasilense; identical to SEQ ID NO: 62116

SEQ ID NO: 92197 - DNA, 747 bp, Azoarcus evansii; identical to SEQ ID NO: 7270
  CDS (1)..(747): transl_table=11

SEQ ID NO: 92198 - protein, 248 aa, Azoarcus evansii; identical to SEQ ID NO: 7271

SEQ ID NO: 92199 - DNA, 822 bp, Streptomyces antibioticus; identical to SEQ ID NO: 62119
  CDS (1)..(822): transl_table=11

SEQ ID NO: 92200 - protein, 273 aa, Streptomyces antibioticus; identical to SEQ ID NO: 7311

SEQ ID NO: 92201 - DNA, 768 bp, Pseudomonas sp; identical to SEQ ID NO: 62121
  CDS (1)..(768): transl_table=11

SEQ ID NO: 92202 - protein, 255 aa, Pseudomonas sp; identical to SEQ ID NO: 62122

SEQ ID NO: 92203 - DNA, 747 bp, Thauera aromatica; identical to SEQ ID NO: 62123
  CDS (1)..(747): transl_table=11

SEQ ID NO: 92204 - protein, 248 aa, Thauera aromatica; identical to SEQ ID NO: 62124

SEQ ID NO: 92205 - DNA, 738 bp, Rhizobium leguminosarum; identical to SEQ ID NO: 7318
  CDS (1)..(738): transl_table=11

SEQ ID NO: 92206 - protein, 245 aa, Rhizobium leguminosarum; identical to SEQ ID NO: 7319

SEQ ID NO: 92207 - DNA, 738 bp, Homo sapiens; identical to SEQ ID NO: 62127
  CDS (1)..(738)

SEQ ID NO: 92208 - protein, 245 aa, Homo sapiens; identical to SEQ ID NO: 62128

SEQ ID NO: 92209 - DNA, 744 bp, Bacillus megaterium; identical to SEQ ID NO: 7330
  CDS (1)..(744): transl_table=11

SEQ ID NO: 92210 - protein, 247 aa, Bacillus megaterium; identical to SEQ ID NO: 7331

SEQ ID NO: 92211 - DNA, 786 bp, Bacillus subtilis; identical to SEQ ID NO: 62131
  CDS (1)..(786): transl_table=11

SEQ ID NO: 92212 - protein, 261 aa, Bacillus subtilis; identical to SEQ ID NO: 62132

SEQ ID NO: 92213 - DNA, 786 bp, Streptomyces cinnamonensis; identical to SEQ ID NO: 62133
  CDS (1)..(786): transl_table=11

SEQ ID NO: 92214 - protein, 261 aa, Streptomyces cinnamonensis; identical to SEQ ID NO: 62134

SEQ ID NO: 92215 - DNA, 747 bp, Chlamydia muridarum; identical to SEQ ID NO: 7060
  CDS (1)..(747): transl_table=11

SEQ ID NO: 92216 - protein, 248 aa, Chlamydia muridarum; identical to SEQ ID NO: 7061

SEQ ID NO: 92217 - DNA, 747 bp, Chlamydia trachomatis; identical to SEQ ID NO: 7338
  CDS (1)..(747)

SEQ ID NO: 92218 - protein, 248 aa, Chlamydia trachomatis; identical to SEQ ID NO: 61778

SEQ ID NO: 92219 - DNA, 735 bp, Escherichia coli; identical to SEQ ID NO: 62139
  CDS (1)..(735): transl_table=11

SEQ ID NO: 92220 - protein, 244 aa, Escherichia coli; identical to SEQ ID NO: 7021

SEQ ID NO: 92221 - DNA, 735 bp, Salmonella typhimurium; identical to SEQ ID NO: 7030
  CDS (1)..(735): transl_table=11

SEQ ID NO: 92222 - protein, 244 aa, Salmonella typhimurium; identical to SEQ ID NO: 7031

SEQ ID NO: 92223 - DNA, 741 bp, Staphylococcus aureus; identical to SEQ ID NO: 62143
  CDS (1)..(741): transl_table=11

SEQ ID NO: 92224 - protein, 246 aa, Staphylococcus aureus; identical to SEQ ID NO: 7043

SEQ ID NO: 92225 - DNA, 741 bp, Thermotoga maritima; identical to SEQ ID NO: 7088
  CDS (1)..(741): transl_table=11

SEQ ID NO: 92226 - protein, 246 aa, Thermotoga maritima; identical to SEQ ID NO: 7089

SEQ ID NO: 92227 - DNA, 735 bp, Vibrio cholerae; identical to SEQ ID NO: 7346
  CDS (1)..(735)

SEQ ID NO: 92228 - protein, 244 aa, Vibrio cholerae; identical to SEQ ID NO: 7347

SEQ ID NO: 92229 - DNA, 738 bp, Rhizobium meliloti; identical to SEQ ID NO: 7046
  CDS (1)..(738): transl_table=11

SEQ ID NO: 92230 - protein, 245 aa, Rhizobium meliloti; identical to SEQ ID NO: 7047

SEQ ID NO: 92231 - DNA, 738 bp, Rhizobium sp; identical to SEQ ID NO: 7348
  CDS (1)..(738): transl_table=11

SEQ ID NO: 92232 - protein, 245 aa, Rhizobium sp; identical to SEQ ID NO: 7349

SEQ ID NO: 92233 - DNA, 747 bp, Acinetobacter sp; identical to SEQ ID NO: 7352
  CDS (1)..(747): transl_table=11

SEQ ID NO: 92234 - protein, 248 aa, Acinetobacter sp; identical to SEQ ID NO: 7353

SEQ ID NO: 92235 - DNA, 792 bp, Salmonella typhimurium; identical to SEQ ID NO: 62155
  CDS (1)..(792): transl_table=11

SEQ ID NO: 92236 - protein, 263 aa, Salmonella typhimurium; identical to SEQ ID NO: 62156

SEQ ID NO: 92237 - DNA, 744 bp, Mycobacterium tuberculosis; identical to SEQ ID NO: 62157
  CDS (1)..(744): transl_table=11

SEQ ID NO: 92238 - protein, 247 aa, Mycobacterium tuberculosis; identical to SEQ ID NO: 62158

SEQ ID NO: 92239 - DNA, 756 bp, Thermotoga maritima; identical to SEQ ID NO: 62159
  CDS (1)..(756): transl_table=11

SEQ ID NO: 92240 - protein, 251 aa, Thermotoga maritima; identical to SEQ ID NO: 62160

SEQ ID NO: 92241 - DNA, 768 bp, Bacillus subtilis; identical to SEQ ID NO: 62161
  CDS (1)..(768): transl_table=11

SEQ ID NO: 92242 - protein, 255 aa, Bacillus subtilis; identical to SEQ ID NO: 62162

SEQ ID NO: 92243 - DNA, 822 bp, Bacillus subtilis; identical to SEQ ID NO: 62163
  CDS (1)..(822): transl_table=11

SEQ ID NO: 92244 - protein, 273 aa, Bacillus subtilis; identical to SEQ ID NO: 62164

SEQ ID NO: 92245 - DNA, 26 bp, Primer
atgtttatcctgtattttcagaggga

SEQ ID NO: 92246 - DNA, 24 bp, Primer
ttagataccgacgctaaccgtctc

SEQ ID NO: 92247 - protein, 285 aa, consensus; identical to SEQ ID NO: 62167
  MISC_FEATURE (1)..(285): consensus for the disclosure of xaa see table XV

SEQ ID NO: 92248 - protein, 26 aa, consensus
  MISC_FEATURE (1)..(26): consensus for the disclosure of xaa see table XV
XXXXXXXXXGXGXXXXXXXXXXGXXX

SEQ ID NO: 92249 - protein, 9 aa, consensus
  MISC_FEATURE (1)..(9): consensus for the disclosure of xaa see table XV
XXXXXXXAG

SEQ ID NO: 92250 - protein, 58 aa, consensus; identical to SEQ ID NO: 62170
  MISC_FEATURE (1)..(58): consensus for the disclosure of xaa see table XV

SEQ ID NO: 92251 - protein, 37 aa, consensus; identical to SEQ ID NO: 62171
  MISC_FEATURE (1)..(37): consensus for the disclosure of xaa see table XV

SEQ ID NO: 92252 - DNA, 960 bp, Escherichia coli
  CDS (1)..(960)
atgacgcatattcggatcgaaaaaggaacgggtggctggggcggcccgcttgagctgaaagccacgccgggaaaaaaaatcgtctatatcaccgccggtacccggcctgcgattgttgacaaactggcacagcttactggctggcaggctattgacggatttaaagaaggtgaacccgcggaggcggaaattggtgtcgcggtaatcgactgtggcggcacattacgctgcggcatctatccgaaacgacgtattcccaccattaatatccactcgacgggcaagtccggtccgctggcgcagtacattgtggaagatatttatgtctctggcgtaaaagaagaaaacatcactgtagtaggtgatgcgacaccacaaccctcttccgtgggccgtgactatgacaccagtaagaaaatcaccgaacaaagcgatggtttactggcgaaggtgggaatgggcatggggtccaccgttgcggtgctgtttcaatctggtcgtgacaccatcgacactgtattaaaaaccattctgccgtttatggcattcgtctcggcgctcattggcatcattatggcttctggccttggtgactggattgcccacggtcttgctccgctggcgagccatccactgggtctggtcatgctggcgctcatctgttccttcccactgctttcacctttcctcggcccaggcgcagttatcgcacaggttatcggcgtattgattggcgtgcagattggtctcggcaatattccgccgcatctggctttaccggcactgtttgccatcaacgcgcaggcggcctgcgacttcatcccggtcggtttgtcgctggcggaagcccgtcaggacacggttcgcgtcggtgtcccttctgtactggtgagccgctttttaaccggcgcgccgactgtactgatcgcctggtttgtctccggttttatctatcaatag

SEQ ID NO: 92253 - protein, 319 aa, Escherichia coli [sequence omitted]

SEQ ID NO: 92254 - DNA, 1005 bp, Mesorhizobium loti MAFF303099
  CDS (1)..(1005): transl_table=11
atggacaggacattcaaagccgtaaagatctcccggggcaacacaggctggggcggcccgctcgtcatcgagccgaccgcgcagcgcgacaaggtcgtctccgtcaccggcggcggcatccatcccgtcgcccaactcatcgccgacatgaccggcgccacggccgtcgacggcttcaaggcgccgccaatcgaaggtgagatggcggtggtcgtcgtcgattgcggcggcaccgcacgttgcggcgtctatccgcgcaagcgcatcccgaccgtcaatctgacgccggtcggccaggctgggccgctcgcccagttcatcacggaggacatctacgtttcgggcgtgaagccggccaacgtcactatggcggacgggtccgaggcggtcaccactgcggggggagcagcatcgatgagttcaggcaataacactgctgccgcggcgccacagccgctgccgagcgaaggcgggctgatcggcctgatcagctcgatcggccgcgtcatgggccgggtggtcggcatcttcttcaatgccggccgccgcacgatcgaccaggtggtgcgcaacgtgctgccgttcatggccttcgtgaccatgctcatcggcctgatcctctacaccggcatcggcgacgtgctcgcccagccgatggggccgctggccaacaatattgtcggcctgctgatcatctcggccatttgcggcctgccattcctgtcgcccatcctcgggccaggcgccgtcatcgcgcaggtcatcggcgtcgccatcatcggcccgcagatcgccaacggcacgatttcgccggcaatggcgctgccggcgctgtttgcctacaatacccaggtgggttgcgacttcgtccccgtcggcctggcgctcggtgaagccaagccgaagacgatcgaaatcggtgtgccggcggtgctcatcagccgccagatcatgggtccggtctcggtgctgatcgcctgggtcgtcagcctgatcgtgttttaa

SEQ ID NO: 92255 - protein, 334 aa, Mesorhizobium loti MAFF303099
MDRTFKAVKISRGNTGWGGPLVIEPTAQRDKVVSVTGGGIHPVAQLIADMTGATAVDGFKAPPIEGEMAVVVVDCGGTARCGVYPRKRIPTVNLTPVGQAGPLAQFITEDIYVSGVKPANVTMADGSEAVTTAGGAASMSSGNNTAAAAPQPLPSEGGLIGLISSIGRVMGRVVGIFFNAGRRTIDQVVRNVLPFMAFVTMLIGLILYTGIGDVLAQPMGPLANNIVGLLIISAICGLPFLSPILGPGAVIAQVIGVAIIGPQIANGTISPAMALPALFAYNTQVGCDFVPVGLALGEAKPKTIEIGVPAVLISRQIMGPVSVLIAWVVSLIVF

SEQ ID NO: 92256 - DNA, 1008 bp, Bacillus halodurans C-125
  CDS (1)..(1008): transl_table=11
atgaattatcaagcggtgaaaattaccaaaggatcaggaggctggggtggcccactcgttgtcctacctgctggtgagaagaaatatatcgtctctgtcacagggggaggtattcatcctgtcgcacagagaatcgctgaactaacaggagccgaggcggtagacggatttaaaagctcctatgaaaaagaaacgatggcatgcgtcgttattgattgtgggggaacggctcgttgtggtgtttatccaaaaatgggagtgttgacggttaatattaatgcgacttctccttcgggacctttaatgaagtttattaacgaacaaaacttcgtctcaggggtaacggaaagtgatattcaattaaccgacggagaggcagcggccgccatagaaccacaagaggaaaagaagctgtctgctcaagagctgaaagaggaagcaaagaaaaaagcagctcaatatacagggaaagagaagaaaccgaacattattgaaaaagtaggtcgcggtgctgggaaagtagtcggtgtattttatcaagcagggcgagaaacggttgagcaagtcataaaaaacattttaccgttcatggctttcgtaagtacgctcatcggaattattttatacacaggtattggagacgtgatcgccaatgtcgtctctccacttgcaggaaacattgtcgggttattaatcatctcggtcgtttgtgcgattcctattttatcgccattgcttggaccaggggctgttattgctcaagtggttggggtgcttatcggtgtagaaattggtcgtggcaacattccgcctagcttggcacttcctgcgttgtttgcgatcaatccacaagtaggagcggattttgtacctgtcggcctaacattaggggaagccaaacctgagacaattgaagtcggggttccggctgtgttaatgtctcgcttaattacaggcccattagctgttgtgttggcctacttgtttagcattggattatacaactaa

SEQ ID NO: 92257 - protein, 335 aa, Bacillus halodurans C-125
MNYQAVKITKGSGGWGGPLVVLPAGEKKYIVSVTGGGIHPVAQRIAELTGAEAVDGFKSSYEKETMACVVIDCGGTARCGVYPKMGVLTVNINATSPSGPLMKFINEQNFVSGVTESDIQLTDGEAAAAIEPQEEKKLSAQELKEEAKKKAAQYTGKEKKPNIIEKVGRGAGKVVGVFYQAGRETVEQVIKNILPFMAFVSTLIGIILYTGIGDVIANVVSPLAGNIVGLLIISVVCAIPILSPLLGPGAVIAQVVGVLIGVEIGRGNIPPSLALPALFAINPQVGADFVPVGLTLGEAKPETIEVGVPAVLMSRLITGPLAVVLAYLFSIGLYN

SEQ ID NO: 92258 - DNA, 990 bp, Pasteurella multocida subsp. multocida str. Pm70
  CDS (1)..(990): transl_table=11
atgaataaagcaatttatattgaaaaaggaaacggtggttggggaggccctttaactttgccattagttgaaggaaaaaagatcctgtatatgacaggcggtactcgtcctgctattgttgatagattaattgagctgactggttgggaagccgtagatggttttaaagagggtgaacctgcaacagaagaaattggtattgcgattgttgattgtggtggcacactacgttgcggtctttatcccaaacgccgtattccaacaattaacgtacatgcaacagggaaatctggtccactcgccgcatatattgtggaagatatttatgtatcagcggttaaaccacaacatatacagttaattgatgccgatctgagcgtaacagaaagcgtgacagaaacccctacgccagctcaacaatataaagaatatgatgctaataaaaaaattactgaacaaagtgatggcttactcgcgagaattggtattggcatgggcgctattgttgctgtttttttccaagctggacgagatactatcgatactgtcttaaaaacaattctgccattcatggcattcgtttccgccttaattggtattatcattgcttcaggtttaggtgatgtaattgcacatggcttaacgcctttagcaaatagccctataggtctcatcacgcttgccttgatctgttctttcccgctcctctcgccattcttaggacctggtgcagtaatcgcccaagtgattggtgttttagtcggaacacagataggtttaggcaatattccaccacacttagcactacccgcattattcgctatcaacgctcaggcagcttgtgatttcatccctgtaggtttatctatggcagaagccaagcaagatactgtacgcgttggcgtacccgctgtattagttggacgtttcttaactggagcaccaacagtattagtcgcgtggttagtttctgcttttatctatcactaa

SEQ ID NO: 92259 - protein, 329 aa, Pasteurella multocida subsp. multocida str. Pm70
MNKAIYIEKGNGGWGGPLTLPLVEGKKILYMTGGTRPAIVDRLIELTGWEAVDGFKEGEPATEEIGIAIVDCGGTLRCGLYPKRRIPTINVHATGKSGPLAAYIVEDIYVSAVKPQHIQLIDADLSVTESVTETPTPAQQYKEYDANKKITEQSDGLLARIGIGMGAIVAVFFQAGRDTIDTVLKTILPFMAFVSALIGIIIASGLGDVIAHGLTPLANSPIGLITLALICSFPLLSPFLGPGAVIAQVIGVLVGTQIGLGNIPPHLALPALFAINAQAACDFIPVGLSMAEAKQDTVRVGVPAVLVGRFLTGAPTVLVAWLVSAFIYH

SEQ ID NO: 92260 - DNA, 981 bp, Salmonella typhimurium LT2
  CDS (1)..(981): transl_table=11
atgaacacggtacttattcctcccggtcccggcggctacggtaaagggctttggctgcccgttgccagcggcaaaaaggtgctgtcactgaccgggcgcgagattcatccggtggcgatagaaatcggtgcgctcactgaatcggaagtggtgaacggcttctccgatatcccgcctgataacgacatcctgtgcgtggtgattaactgcgccgggtccctgcgctgcggcctgtatccgcagaagggcatcccgaccatcaatgtgctgcccacctggcgcgcggggccgctggcgcagtttattagcgaggataactacgtctccggcgtgacgatagagcaactggttctggtggatacggccgaagcgccggacggtgaaccggagccagtgtctgtcacggcaccacggattatcaccactccgccgcctgcacgtggcgcggaaaaactggttcgcatggtcgagcgtaccggcaccgccgtcggacacgttatcgccctgctgtttgccgccagccgtgaggcggtggacgtgtcgctgcgcaacgttatcccgtttatggcctttgtctcactgctgattgccctggtgcaggaaaccgcactcggcagcctgattgcccacgccctgacgccgctggcgaactcgctgtggggactggtgctgctgtcgctcatctgcggcattccgtttctctccccggtgctcgggccgggggcagccatctcgcaggtcatcggcgtgatgattggcacccagattggcgcgggcgcgatatccccggccttcgccctgcccgcgctgttcgccatcaacgtgcaggtcggctgcgacttcgtgccggtaggtctttcgatgcaggaggcgaagccggagaccatcgcgaagggcgtccctgcctttctgctctcacgtcagttaacggggccgctggcggtcatcatcggctggctgttttccctgggcttattctga

SEQ ID NO: 92261 - protein, 326 aa, Salmonella typhimurium LT2
MNTVLIPPGPGGYGKGLWLPVASGKKVLSLTGREIHPVAIEIGALTESEVVNGFSDIPPDNDILCVVINCAGSLRCGLYPQKGIPTINVLPTWRAGPLAQFISEDNYVSGVTIEQLVLVDTAEAPDGEPEPVSVTAPRIITTPPPARGAEKLVRMVERTGTAVGHVIALLFAASREAVDVSLRNVIPFMAFVSLLIALVQETALGSLIAHALTPLANSLWGLVLLSLICGIPFLSPVLGPGAAISQVIGVMIGTQIGAGAISPAFALPALFAINVQVGCDFVPVGLSMQEAKPETIAKGVPAFLLSRQLTGPLAVIIGWLFSLGLF

SEQ ID NO: 92262 - DNA, 987 bp, Listeria innocua Clip11262
  CDS (1)..(987): transl_table=11
atgtatcaatcaattcatgtgaataaaggccaaggcggttggggaactgggctagaccttactccaagcgaaccaagaacaaaagttgtttctattactggcggcggtatccaccccgtagctttgaaaattgctgaattatccggtgcagaagccgtcgatggttttaaaaactccattcccgaagaagaaatgatgtgtgttgtcattgactgtggtggtacggctcgaattggcgtctatccaatgaaacgtattccaactgttgatattctcccttcttctccatcaggtccactagcaaaacatattacagaagatatttttgtttcgggagtgaagccagaagatattatggttacctcatcagaagcagatcccggaaaaccttttgacagagaaaaatttaaagaagattatgccaagattaaagaagatcaacaagaagcgagtgatttaaaagaaggctatcttgtgaaattttctcgcggtattggtaaggcaatgggcgtattctatcaagctggtcgtgattctgttgatatgctcattaaaaacattattccttttatggcttttattagtatgattatcggtattattaactacactgggattggaaaattaattgcgaatacactctccccgctcgctggttccatttggggaatgcttttaattgcttttatttgtagtctacctttcctatcaccgattcttggtcctggcgcagttatcgcccaagttattggtgtcttaattggttcacaaattgcgattggcgccatcccggtaacttacgccttacctgctttattcgctattaacgcacaagccggatgtgactttattccagtcgggctatctcttgcagaagctaaaccaaaaacggttcaattcggtgttccggccattttgtatagccgtatgattacaggtgtccttgctgttgttatcgcttgggtattcagtatcggcatgtattaa

SEQ ID NO: 92263 - protein, 328 aa, Listeria innocua Clip11262
MYQSIHVNKGQGGWGTGLDLTPSEPRTKVVSITGGGIHPVALKIAELSGAEAVDGFKNSIPEEEMMCVVIDCGGTARIGVYPMKRIPTVDILPSSPSGPLAKHITEDIFVSGVKPEDIMVTSSEADPGKPFDREKFKEDYAKIKEDQQEASDLKEGYLVKFSRGIGKAMGVFYQAGRDSVDMLIKNIIPFMAFISMIIGIINYTGIGKLIANTLSPLAGSIWGMLLIAFICSLPFLSPILGPGAVIAQVIGVLIGSQIAIGAIPVTYALPALFAINAQAGCDFIPVGLSLAEAKPKTVQFGVPAILYSRMITGVLAVVIAWVFSIGMY

SEQ ID NO: 92264 - DNA, 1011 bp, Streptococcus mutans UA159
  CDS (1)..(1011): transl_table=11
atggcttacagaaacattaaaattgtaaaaggaaatggtgggtttggtggccctttgattattgcaccaactgatgaaaagcataaatttatctatatcacaggtggtggtgaaaaacctgaaattgttgataaaattgttgaattaacaggaatggaagctgttaatggttttaaaacctctattccggatgaagaaatcgctctggctattgttgactgtggtggcaccctacgttgtggtatttatcctaaaaaagggattcctacgattaatattgttgcaactggtaagagcggacctttagcccaatacattactgaagatatttatgtttcggctgttggtatggagcagattacctcaattgaggaatcagcaggcagtattgaaacgaaagaagcgaaagctgagactgctcaatctcaaacaggcaccggcacctatgataccagtaaaaaaatcactgagcaacgtgcacaacagagtgttattgctcgtattggtatgggggctggtaaagtggttgctgtttttaatcaagcagcgcgtgatgctattcaaacattattaaatactattcttccttttatggcttttgtatcacttctgattggttttattcaaggctcaggtgtgggtaaatggttagctaaactcatggtgccgctggctggtaatatttggggacttatcctgatcggattcatttgttcactaccattcttatcacctcttcttggacctggtgctgttatttcacaaattattggcaccttgattggggttgaaattggtaagggaactatcccgccgcaaatggctctcccagctctttttgctattaatacgcaaaatggttgtgattttatccctgtggcgcttggcttgtctgagtcaactgctgaaacagtagaagtcggtgttccatctgttctttactcgcgtttcctaaatggtgtaccacgtgttattgtagcatggattgcaagtattggactttatcaataa

SEQ ID NO: 92265 - protein, 336 aa, Streptococcus mutans UA159
MAYRNIKIVKGNGGFGGPLIIAPTDEKHKFIYITGGGEKPEIVDKIVELTGMEAVNGFKTSIPDEEIALAIVDCGGTLRCGIYPKKGIPTINIVATGKSGPLAQYITEDIYVSAVGMEQITSIEESAGSIETKEAKAETAQSQTGTGTYDTSKKITEQRAQQSVIARIGMGAGKVVAVFNQAARDAIQTLLNTILPFMAFVSLLIGFIQGSGVGKWLAKLMVPLAGNIWGLILIGFICSLPFLSPLLGPGAVISQIIGTLIGVEIGKGTIPPQMALPALFAINTQNGCDFIPVALGLSESTAETVEVGVPSVLYSRFLNGVPRVIVAWIASIGLYQ

SEQ ID NO: 92266 - DNA, 1020 bp, Lactobacillus plantarum WCFS1
  CDS (1)..(1020): transl_table=11
atggcaaaggaatatcatagtatcaaagttgttaaaggctctggtggctggggcggcccgctaattattacaccaactatcacgaagcataaatttgtttatgtcactggaggtaataaaccagcaattgttgataagattgctaagttgacaggaatggaagctgttgatggctttaagacgtcaattcctgatgaagaaacagcattagcggttgtagactgtggtgggacattaaggtgtggaatttatcccaagaagggtatcaaaacaattaacgtattaccgactggtaagagcggtcccttagcgcaatttatgaatgaagctaattatgtttccaatgtagatgttgatcagattatgttggtaacatctgaggaggagcaattttctgacagtcaaaatgaaagcgctaaccaatttgagaatgtagatgacgatacgaaattcgataatacaaagacactaacagcacaaacaaaaaatcctgggatcttaactaagattgggattggtgctgggcgagtcgtttcgacgtttaatcaggccgcaaaagatgctgttcaaacagttattaatactattattccatttatggcatttgtggcattaattattgggattattaatggctctggaattggtaaggtttttgccagtatcatggagccgttagcaggcaatgtctggggcttgatggttttaggatttatttgctcattaccattcttatctccattgcttgggccaggcgcagttatcggtcaagttatcgggaccttgattggcgttgaaatcgggaaaggtaatattccaccacagtatgcattaccagcattattcgcgattaacacgcaaaatggttgtgactttattccagttggcttaggactagctgaggctgattctaagacggttgaagttggggtgccatcagtgttatatagtcggtttatcaacggcgttccgcgggtctttattgcttggattgcaagttttggattatattcaaaataa

SEQ ID NO: 92267 - protein, 339 aa, Lactobacillus plantarum WCFS1
MAKEYHSIKVVKGSGGWGGPLIITPTITKHKFVYVTGGNKPAIVDKIAKLTGMEAVDGFKTSIPDEETALAVVDCGGTLRCGIYPKKGIKTINVLPTGKSGPLAQFMNEANYVSNVDVDQIMLVTSEEEQFSDSQNESANQFENVDDDTKFDNTKTLTAQTKNPGILTKIGIGAGRVVSTFNQAAKDAVQTVINTIIPFMAFVALIIGIINGSGIGKVFASIMEPLAGNVWGLMVLGFICSLPFLSPLLGPGAVIGQVIGTLIGVEIGKGNIPPQYALPALFAINTQNGCDFIPVGLGLAEADSKTVEVGVPSVLYSRFINGVPRVFIAWIASFGLYSK

SEQ ID NO: 92268 - DNA, 972 bp, Salmonella enterica subsp. enterica serovar Typhi Ty2
  CDS (1)..(972): transl_table=11
atgacacgggttcgcattgagaaaggtgccggcggctggggcggcccgcttgaactggacgttacgccaggcaaaaagatcgtctatatcacagccggtacgcgcccggcgatcgtcgacaaactggcgcaactaacaggctggcaagcggtggacggctttaaagaaggcgaaccgccggaagcggagatcggcgcggccattatcgactgcggcggtacgctgcgctgcggtatctacccgaaacgccggattccaaccattaatattcactcgacgggtaagtccggcccactggcgcagtatattgttgaagatatttatgtctccggcgtaaaagaagaaaacattactctagtcggcgaaacatctgccagaccccagcctgccaaaacgacattaggacgtgactacgacaccagcaaaaaaatcaccgagcagagcgacgggctgctggcaaaagtcggtatgggaatgggttctgccgtggcggtactgttccagtccggtcgcgacaccattgatacggtcctgaaaacaattctgccgtttatggcgttcgtttcggcgctaatcggcatcattatggcctcaggtcttggcgactggatcgcccacggcctggcgccattagccagccatccactggggctggtgacgctggcattgatctgctctttcccgctgctgtcgccctttctcggcccaggcgcggttatcgctcaggttattggcgttctgatcggcgttcagataggtctgggcaatatccccccgcatctggcgctgcccgccctgttcgcgattaacgcgcaggcggcctgcgactttatcccggtcggcctgtcactggcggaagcgaaacaagacaccgttcgcgtcggcgtaccttctgtgctggtcggacgcttcctgaccggcgcgcccacggtacttatcgcctggtttgtttccggctttatctatcaataa

SEQ ID NO: 92269 - protein, 323 aa, Salmonella enterica subsp. enterica serovar Typhi Ty2
MTRVRIEKGAGGWGGPLELDVTPGKKIVYITAGTRPAIVDKLAQLTGWQAVDGFKEGEPPEAEIGAAIIDCGGTLRCGIYPKRRIPTINIHSTGKSGPLAQYIVEDIYVSGVKEENITLVGETSARPQPAKTTLGRDYDTSKKITEQSDGLLAKVGMGMGSAVAVLFQSGRDTIDTVLKTILPFMAFVSALIGIIMASGLGDWIAHGLAPLASHPLGLVTLALICSFPLLSPFLGPGAVIAQVIGVLIGVQIGLGNIPPHLALPALFAINAQAACDFIPVGLSLAEAKQDTVRVGVPSVLVGRFLTGAPTVLIAWFVSGFIYQ

SEQ ID NO: 92270 - DNA, 996 bp, Enterococcus faecalis V583
  CDS (1)..(996): transl_table=11
atgacgtacaatagtattaaggtagttaaaggaaatggcggttatggtgggcccttagtgattacaccgacagaagaaaaacataaatttatttacattacaggtggcggcgagaaacccgcaatcgttgataaaatcgtagaattgacaggaatggaagcggtcaatggttttaagacatcgattccagatgatgaaatcgcattagccattattgattgtggaggcactcttcgttgcggaatttatcctaaaaaaggaattcctactattaacgttgttccaactggcaaaagtggtcccttagcacaatacattaatgagacaatttatgtttccgctgtaggcccgaaacagattacattgacatcagaagaagcttctgctgatacagaaaagcccacctcgaaaaaaacagaatttaaatatgatacaagtaaaaaaattactgaacaaaaagcggaacaacaaagttttgttgcaaaaattggtatgggtgcaggaaaagttgtagcgacattcaaccaatcagcccgtgaaggcgtacaaacgatgatcaacacagtgattccgtttatggcatttgtttctttattaattggtgtgattcaaggttcaggaattggtgaattttttgccaatatcatggcgccattggcaggaaacattgtggggttaacaattattggttttatttgttctctgccgtttctttctcctttattaggtcctggagcagtaatcagccaagtaattggtacgttaattggtgtggaaattgggaaaggcaacattccgccacaactagccttaccagcattgtttgctattaatacacaaaacgcgtgcgactttattcccgtgggtttaggcttggaagaagctgaagctgaaaccgttgaagtcggggtcccttctgttttatattctcgtttcttaaatggtgcccctcgagtactagttgcttggttagcaagttttggattgtatagttaa

SEQ ID NO: 92271 - protein, 331 aa, Enterococcus faecalis V583
MTYNSIKVVKGNGGYGGPLVITPTEEKHKFIYITGGGEKPAIVDKIVELTGMEAVNGFKTSIPDDEIALAIIDCGGTLRCGIYPKKGIPTINVVPTGKSGPLAQYINETIYVSAVGPKQITLTSEEASADTEKPTSKKTEFKYDTSKKITEQKAEQQSFVAKIGMGAGKVVATFNQSAREGVQTMINTVIPFMAFVSLLIGVIQGSGIGEFFANIMAPLAGNIVGLTIIGFICSLPFLSPLLGPGAVISQVIGTLIGVEIGKGNIPPQLALPALFAINTQNACDFIPVGLGLEEAEAETVEVGVPSVLYSRFLNGAPRVLVAWLASFGLYS

SEQ ID NO: 92272 - DNA, 1050 bp, Propionibacterium acnes KPA171202
  CDS (1)..(1050): transl_table=11
atgaccgagtaccgctccgtcaccgtttcccatggctccggcggctacggcggccccctcaccatcacccctaccgaggctaaacacaagctcgtctacatcgtcggcggaggcgtccggcccccggtcgttgatcgcatcgccgagctgtctggtgccgaaccggtcaatgggtttaacacctccatccccgacgaggagatgatggccgtcatcatcgactgcggggggaccctaaggtgcggaatctaccctcgcaagggaatcccgactatcaacgtcatgccaaccggtaagagcggtccgctggcccaatacatcaacgagtcgatctacgtctccgccgtcgacgtcgaccaggtccggttggccgactcacctacatcctccgccactgtcacctcccccgctatagccgccgctgccgcgccacggtcaaaagccggaacagcaggcaccgtccagggggaatggagcactgacaagaagatttccgaagtcgtcgccgagaagaagaacaagaccgtcatggacaagatcggcctgggcgccggcaaggtcatctcggtgttctaccaagccgctcgagacgcggtgcaggccatgctgaccaccatcatccccttcatggggttcgtagccatgcttatcggcatcatcaacgcctccggattcggtacctggttcaccaaacttctcatcccgctagccggcaacggcatcgggctcatcgtccttggcctcatctgctcgctgcccttcctgtcgcccctgctcggcccaggagccgtcatcggtcagatcatcggaactctcatcggcgtagagatcggcaagcacaacatccatcccagcttggcccttccagcgctgttcgccattaacacccagaacgcctgcgacttcatcccggtcggcctaggactagctgaggctgccccggaaacagtcgaggttggcgtccccagcgtcttgtactcgcgattccttaacggcgtcccacgagtcgccatcgcctggctgtgcagcatcggcctgtacgcatcctga

SEQ ID NO: 92273 - protein, 349 aa, Propionibacterium acnes KPA171202
MTEYRSVTVSHGSGGYGGPLTITPTEAKHKLVYIVGGGVRPPVVDRIAELSGAEPVNGFNTSIPDEEMMAVIIDCGGTLRCGIYPRKGIPTINVMPTGKSGPLAQYINESIYVSAVDVDQVRLADSPTSSATVTSPAIAAAAAPRSKAGTAGTVQGEWSTDKKISEVVAEKKNKTVMDKIGLGAGKVISVFYQAARDAVQAMLTTIIPFMGFVAMLIGIINASGFGTWFTKLLIPLAGNGIGLIVLGLICSLPFLSPLLGPGAVIGQIIGTLIGVEIGKHNIHPSLALPALFAINTQNACDFIPVGLGLAEAAPETVEVGVPSVLYSRFLNGVPRVAIAWLCSIGLYAS

SEQ ID NO: 92274 - DNA, 1008 bp, Bacillus licheniformis ATCC 14580
  CDS (1)..(1008): transl_table=11
atgagttcctatcgttcggttgaagtttcaaaagggcctggagggtttggcggacctctggtgatcacgcctgatgaagagagaaataaaatcgtgtacgtcaccggcggaaacaaacccgattttgcggatcatttagctgagctgacggggtgcaccctggtcgacggctttaaaacgacagtacccgaaagcgaaatggccgctgtgatcatcgactgcggagggacgctgcgctgcggactttacccgcaaaagcgaattccgacgatcaatgtgatggcgaccgggaaaagcgggccgcttgccgcccatattacagaagatatatatgtttccggagtaaaaaaagagaatattaaactgctgggagctgtggaggagcctgaacagtctaatattccagaagaaaaacaaatacaaaataaacaaaaccattatagcacagagaaaaagattagtgaacagcagtcgccgaaagggatgatggcgaaaatcgggatggccatgggatcgatcgtcagcacattttatcaagctggacgggaagcgattgaaaccgttatcaaaacaattcttccgttcatggcttttgtggctctattgatcggcatcattaaagagtcaggcatcggagacatttttgccaaatatttatcaccatttgcaggctcactgcccgggttgctactaatctcgcttgtttgttcatttccactgctttccccgttccttggaccgggggcggtgattgcacaagttgtcggttctctgatcggcgttgagattggcaaaggaaacattccgccgaatttggcgctgcctgcgttatttgcaatcaattcacaagccgctgccgactttgttccagtcggtctgggtcttgcggaagcggaagtcgaaacggttgaagtcggggtgccgtcggtgctgtattcgcgttttctcacgggggcgccaaccgtttttattgcttggctggccagctttggcatgtatgacagctga

SEQ ID NO: 92275 - protein, 335 aa, Bacillus licheniformis ATCC 14580
MSSYRSVEVSKGPGGFGGPLVITPDEERNKIVYVTGGNKPDFADHLAELTGCTLVDGFKTTVPESEMAAVIIDCGGTLRCGLYPQKRIPTINVMATGKSGPLAAHITEDIYVSGVKKENIKLLGAVEEPEQSNIPEEKQIQNKQNHYSTEKKISEQQSPKGMMAKIGMAMGSIVSTFYQAGREAIETVIKTILPFMAFVALLIGIIKESGIGDIFAKYLSPFAGSLPGLLLISLVCSFPLLSPFLGPGAVIAQVVGSLIGVEIGKGNIPPNLALPALFAINSQAAADFVPVGLGLAEAEVETVEVGVPSVLYSRFLTGAPTVFIAWLASFGMYDS

SEQ ID NO: 92276 - DNA, 996 bp, Haemophilus somnus 129PT
  CDS (1)..(996)
atgagtaataaagcagtttatattgaaaaaggtaacggtggctggggtggtccattaacattacctattattgaaggcaaaaaaatactttatatgaccggaggcactcgtcctgctattgtgaataaattggtggaattaactggctgggaagcagtagatggttttaaagaaggcgaaccgccagcagaagaaattggaattgcaattgttgactgtggtggtgtattacgttgtgggctttacccaaaacgtcgcattccaactattaatattcacgcaaccggcaaatcaggacctttagcagaatttattgttgaagatatttatgtttctgccgtaaaagaaaataatatttcgttaattgatgtggatgccgcagccctttctgtcatatctgaagaaaaaattgcttcatcaactaccgcaaaagagtatgattcaagtaaaaaaatcaccgaacaaagtaatggtttattggcaaaaataggtatgggaatgggttctgtcgccgcactctttttccaagccggacgtgatactattgatacagtcctgaaaaccattttaccgtttatggcattcgtttccgccttgattggaatcattattgcttccggtttgggggatttaattgctcatggtttaacaccgcttgcaaatagcccactcggtttagttactcttgcgttaatttgttctttcccactactctctccattcttaggtcccggagctgttattgctcaagttatcggtgtattagtaggcacacaaatcggtttagggaacattccaccacatttagccctgccggcactttttgccatcaatgctcaagccgcttgtgatttcattcccgtggggctttcaatggcagaagcgaaacaagatactgtgcgagtgggcgtaccttctgtattagtcagtcgttttttgactggtgcaccgacagtattaattgcatgggcggtatctgcattcatttatcagtaa

SEQ ID NO: 92277 - protein, 331 aa, Haemophilus somnus 129PT
MSNKAVYIEKGNGGWGGPLTLPIIEGKKILYMTGGTRPAIVNKLVELTGWEAVDGFKEGEPPAEEIGIAIVDCGGVLRCGLYPKRRIPTINIHATGKSGPLAEFIVEDIYVSAVKENNISLIDVDAAALSVISEEKIASSTTAKEYDSSKKITEQSNGLLAKIGMGMGSVAALFFQAGRDTIDTVLKTILPFMAFVSALIGIIIASGLGDLIAHGLTPLANSPLGLVTLALICSFPLLSPFLGPGAVIAQVIGVLVGTQIGLGNIPPHLALPALFAINAQAACDFIPVGLSMAEAKQDTVRVGVPSVLVSRFLTGAPTVLIAWAVSAFIYQ

SEQ ID NO: 92278 - DNA, 948 bp, Pantoea agglomerans
  CDS (1)..(948): transl_table=11
atgacgcatattcggatcgaaaaaggaacgggtggctggggcggcccgcttgagctgaaagccacgccgggaaaaaaaatcgtctatatcaccgccggtacccggcctgcgattgttgacaaactggcacagcttactggctggcaggctattcccaaatttggagaaggtgaagacgcggaggcggaaggtgtcgtaatcgacggcggcacattacgctgcatctatccgaaacgacacattcccaccattaatatccgtaagtccccgtcgacgggtggcctggcgatttaccaggtgaacgatggctataaatctattgtagtcgaagaagaaatcactgtagtaggtgatgcgacaccagacccctcttccgtgggcgaccaatatgacaccagtaagaaaatcaccgaacaaagcgatggtttactggcgaaggtgggaatgggcatggggtccaccgttgcggtgctgtttcaatctggtcgtgacaccactgacatcgtattaaaaaccattctgccgtttatggcattcgtctcggcgctcattggcatcattatggcttctggccttggtgacctgattgcccttggtcacgctccgtgggcgagccatccactgggtctggtcatgctggcgctcatctgttccttcccactgctttcacctttcctcggcccaggcgcagttatcgcacaggttatcggcgtattgattggcgtgcagattggtctcggcaatattccgccgcatctgaacttaccggcactgtttcaggcggctatcgccgcggcctgcgacgccatcccggtcctgttgtcgggtgcggaattccgtcaggacacggttcgcgtcggtgtcccttctgtactggtgagccgctttttaaccggcgcgccgactgtactgatcgccgtcttttggtccggttttatctatcaatag

SEQ ID NO: 92279 - protein, 315 aa, Pantoea agglomerans
MTHIRIEKGTGGWGGPLELKATPGKKIVYITAGTRPAIVDKLAQLTGWQAIPKFGEGEDAEAEGVVIDGGTLRCIYPKRHIPTINIRKSPSTGGLAIYQVNDGYKSIVVEEEITVVGDATPDPSSVGDQYDTSKKITEQSDGLLAKVGMGMGSTVAVLFQSGRDTTDIVLKTILPFMAFVSALIGIIMASGLGDLIALGHAPWASHPLGLVMLALICSFPLLSPFLGPGAVIAQVIGVLIGVQIGLGNIPPHLNLPALFQAAIAAACDAIPVLLSGAEFRQDTVRVGVPSVLVSRFLTGAPTVLIAVFWSGFIYQ

SEQ ID NO: 92280 - DNA, 1011 bp, Clostridium beijerinckii
  CDS (1)..(1011): transl_table=11
atggaaaaatataatgcaattaaaattgtaaaaggtagtggaggctttggcggtccacttacagtaaaacctgaagaaggaaaagatacattattatatattacaggtggtggagctgaacctgaaattgtagaaaagattgttaacttaacaggatgtaaagcggtaaatggatttaaaacatctgtaccagaggaacaaattttcttagttattattgattgtggtggaacacttcgctgtggaatatacccacaaaagagaattccgacaataaatgttatgccagtaggtaaaagtgggcctttagcaaaattcattacagaagacatttatgtatctgcagttggcttaaatcaaatttctttagctgattcaagtgcagagcctataaagagcacaaaagtgcctgaagaaggaaaaagagaatttaaatatagtgctgataagaaagtatcacaaagtttggctgaaaacagtaaatctagtattgtccaaaaaattggtatgggagcaggtaaagttgtaaatacactataccaagcaggccgtgatgcagttcaatcaatgattacaacaatattaccattcatggcatttgttgcaatgctaataggaattatacaaggttcgggatttggtaattggttcgctaaaatattagtaccattagcaggaaacggaattggacttatgattcttggattcatatgctctattcctctattatcagcattacttggaccaggtgctgttatagcacaaatcgtaggtactttaattggtgttgaaataggtaaagggactattcctccaagcttagcattaccagcattattcgctattaatacacaatgtgcatgtgactttattccagtaggtttaggtctagctgaagcagaaccagaaacagtagaggttggtgttccatctgtattgtattcacgtttcatgattggtgtacctagagtagcagttgcatgggttgcaagtataggattgtatcaataa

SEQ ID NO: 92281 - protein, 336 aa, Clostridium beijerinckii
MEKYNAIKIVKGSGGFGGPLTVKPEEGKDTLLYITGGGAEPEIVEKIVNLTGCKAVNGFKTSVPEEQIFLVIIDCGGTLRCGIYPQKRIPTINVMPVGKSGPLAKFITEDIYVSAVGLNQISLADSSAEPIKSTKVPEEGKREFKYSADKKVSQSLAENSKSSIVQKIGMGAGKVVNTLYQAGRDAVQSMITTILPFMAFVAMLIGIIQGSGFGNWFAKILVPLAGNGIGLMILGFICSIPLLSALLGPGAVIAQIVGTLIGVEIGKGTIPPSLALPALFAINTQCACDFIPVGLGLAEAEPETVEVGVPSVLYSRFMIGVPRVAVAWVASIGLYQ

SEQ ID NO: 92282 - DNA, 1002 bp, Erwinia amylovora
  CDS (1)..(1002): transl_table=11
atggccaatacaattgagatacgtaaaggggaaagtggttggggcggccctctctctattaacgtcactgcgggaaaaaaaatcgtttatatcactgccggcaccaaaccagcgattgttgaccacctggtagcgcttaccggttgggaggcggtagacggattcaaacagggcgagccgccggctgaagagattggcgtagccgttattgactgtggcgggactctgcgatgcgggctttaccctaagcgacgtattccaactattaacatccatgccaccgggaaatcaggcccgctggcgcaattcatcaccgaagatatctatgtgtcaggcgtcagggtggccgatatacgtgtcgccaatgacgcagaggctgcgccgccagaagtcgcagtggcggacgttgccgtcaatgccggcaaaggcacggggcgtgattacgacaccagtaaaaagatcaccgagcaaagcgatggcctgctggccaaagtcgggatgggaatgggctccgccgtcgccattttgttccagtcaggacgcgaaaccatcgataccgtgctgaaaaccatattgccttttatggcattcgtttcagctttaatcggcatcatcatggcttccggactcggtgactttatcgcacacggtttgacgccgctggcaaacagcccggtaggattagtcacgctggcgctgatttgttctttcccgctgctgtcaccgtttctggggccgggcgcggttattgctcaggttattggcgtgctggttggggtgcagataggccagggcacgatacctccacatctggcgctgcctgccttattcgcgattaacgcccaggcggcatgtgactttattccggtcgggttgtcgctggctaatgcgcgccaggagaccgtacgtgttggcgtacctgccgtgctggtcggacgtttcattaccggggcgcccaccgttcttctggcctgggcggcatccagctttatctaccattaa

SEQ ID NO: 92283 - protein, 333 aa, Erwinia amylovora
MANTIEIRKGESGWGGPLSINVTAGKKIVYITAGTKPAIVDHLVALTGWEAVDGFKQGEPPAEEIGVAVIDCGGTLRCGLYPKRRIPTINIHATGKSGPLAQFITEDIYVSGVRVADIRVANDAEAAPPEVAVADVAVNAGKGTGRDYDTSKKITEQSDGLLAKVGMGMGSAVAILFQSGRETIDTVLKTILPFMAFVSALIGIIMASGLGDFIAHGLTPLANSPVGLVTLALICSFPLLSPFLGPGAVIAQVIGVLVGVQIGQGTIPPHLALPALFAINAQAACDFIPVGLSLANARQETVRVGVPAVLVGRFITGAPTVLLAWAASSFIYH

SEQ ID NO: 92284 - DNA, 23 bp, Primer
atgacgcatattcggatcgaaaa

SEQ ID NO: 92285 - DNA, 27 bp, Primer
ttattgatagataaaaccggagacaaa

SEQ ID NO: 92286 - protein, 339 aa, consensus
  MISC_FEATURE (1)..(339): consensus for the disclosure of xaa see table XV
KGXGGXGGPLXXXXXXXKXKXXXXTXGXXXXXXXXXXXXLTGXXAVXGFKXXXPXXXEXXXXXXDCGGTLRCGXYPXXXIPTINXXXXXXSGPLAXXIXEXXYVSXVXXXXIXXXXXXXXXXXXXXXXXXXXXXXXXXXXXXXXXXXXXXXXKKXXXXXXXXXXXXXXXXXGXGXGXXXXXXXQXXRXXXXXXXXXIXPFMAFVXXLIGXIXXXGXGXXXAXXXXPLAXXXXGLXXXXXICSXPXLSPXLGPGAVIXQVIGXXLIGXXIGXGXIPPXXALPALFAINXQXXCDFXPVGLXXXEAXXXTVXVGVPXVLXSRXXXGXXXVXXAWXXSXXXY

SEQ ID NO: 92287 - protein, 42 aa, consensus
  MISC_FEATURE (1)..(42): consensus for the disclosure of xaa see table XV
XXGXXRXXXYPXXXXXTXXXXXXXXXGXLXXXXXXXXXXSXV

SEQ ID NO: 92288 - protein, 63 aa, consensus
  MISC_FEATURE (1)..(63): consensus for the disclosure of xaa see table XV
PFMXFXXXXIXXXXXXXXGXXXXXXXXPXAXXXXGXXXXXXXCXXPXLSXXLGPGAXIXQXXG

SEQ ID NO: 92289 - protein, 70 aa, consensus
  MISC_FEATURE (1)..(70): consensus for the disclosure of xaa see table XV
GXXIXXXXIXXXXXLPALFXXXXXXXXDXXPVXLXXXXXXXXTXXXGVPXXLXXRXXXGXXXVXXXXXXS

SEQ ID NO: 92290 - DNA, 1122 bp, Escherichia coli
  CDS (1)..(1122)
atgcgttttgttgatgaatatcgcgcgccggaacaggtgatgcagttaattgagcatctgcgcgaacgtgcttcacatctctcttacaccgccgaacgccctctgcggattatggaagtgtgtggcggtcatacccacgctatctttaaattcggcctcgaccagttactgccggaaaacgttgagtttatccacggtccggggtgcccggtgtgcgtactgccgatgggtagaatcgacacctgcgtggagattgccagccatccggaagtcatcttctgtacctttggcgacgcgatgcgcgtgccggggaaacagggatcgctgttgcaggcaaaagcacgcggtgccgatgtgcgcatcgtttactcgccgatggatgcgttgaaactggcgcaggagaatccaacccgcaaagtggtgttcttcggcttaggttttgaaaccactatgccgaccaccgctatcactctgcaacaggcgaaagcgcgtgatgtgcagaatttttacttcttctgccagcacattacgcttatcccgacgttgcgcagtttgctggaacagccggataacggtatcgatgcgttcctcgcgccgggtcacgtcagtatggttatcggcaccgacgcctataattttatcgccagcgattttcatcgtccgctggtggttgctggattcgaaccccttgatctactacaaggcgtggtcatgctggtgcagcagaaaatagcggcccacagcaaggtagagaatcagtatcgtcgagtggtaccggatgccggtaacctgctggcgcaacaggcgattgccgatgtgttctgtgtcaacggcgacagcgaatggcgcggcttaggcgtgattgaatcttctggcgtgcacctgacgccggattatcaacgattcgatgccgaagcacatttccgcccggcaccgcagcaggtctgcgatgacccgcgcgcgcgttgtggtgaggtattaacgggcaaatgtaagccgcatcaatgcccgctgtttggtaacacctgtaatcctcaaaccgcgtttggtgcgctgatggtttcctccgaaggagcgtgcgccgcgtggtatcagtatcgtcagcaggagagtgaagcgtga

SEQ ID NO: 92291 - protein, 373 aa, Escherichia coli
MRFVDEYRAPEQVMQLIEHLRERASHLSYTAERPLRIMEVCGGHTHAIFKFGLDQLLPENVEFIHGPGCPVCVLPMGRIDTCVEIASHPEVIFCTFGDAMRVPGKQGSLLQAKARGADVRIVYSPMDALKLAQENPTRKVVFFGLGFETTMPTTAITLQQAKARDVQNFYFFCQHITLIPTLRSLLEQPDNGIDAFLAPGHVSMVIGTDAYNFIASDFHRPLVVAGFEPLDLLQGVVMLVQQKIAAHSKVENQYRRVVPDAGNLLAQQAIADVFCVNGDSEWRGLGVIESSGVHLTPDYQRFDAEAHFRPAPQQVCDDPRARCGEVLTGKCKPHQCPLFGNTCNPQTAFGALMVSSEGACAAWYQYRQQESEA

SEQ ID NO: 92292 - DNA, 1116 bp, Archaeoglobus fulgidus DSM 4304
  CDS (1)..(1116): transl_table=11
atgaggaggaggcaaaaaagacttgggagttgctggagagagttgcagatgaaaccggtaatcaggctttctgagaaaataagggagctctcaaaggagtttgagtcggtcaaaataatgcacctctgcggaactcatgaagataccatcacaaagtacaatctccgctccctcctcccggaaaacatctccctgctgagcggtcccggctgtccagtttgcataactcccgacgaggacatacagatggtaatgcacctgctggagaaggaaaacatcaccctcgccaccttcggggatatggcgagagtcccctttcaggggaagagcctattcactttaagggcagaggggtatgacataagaatcgtttacagcatctttgactccttaaagcttgcagaaagctcggataggccagttgttcacttcgccatcggctttgaaacgaccatgccctcaacagctatagcccttcttgatgagaaggagaacttctacgtcttctcagcccaccgcttcttcatccctgcagtgcatgcgctctgcgaaaacacgaccgttgatgccttcataaaccccggacacgtctcaacgataatcggcgtgaaaccgtacagggagattctgaagaaatacggaataccgcaggtgattgcaggattcgagcctgaagatgttatgcttgccatctatcttctccttgaggcgatgagtgatggcagaagggaggttatcaacgagtacagcagagcggtaaaggaggagggaaacgtcagggctttggaggccatggacagggttttcaggaaggaagactggagctggagggggcttggagtggtgaaggggagtggtggagcattggcaaaaagattcgagcagttcgatgcgaggaaggtttttgaagatgccttcgccgattttcagcctgtggaagacaaaagcaagaggttatgcaggtgcggggacgtgctgaagggcatcgccacaccaaaggactgcccgctgttcatgaaagcctgcaacccgagaaaccccgttggagcgtgcatggtgagtgtggaggggacgtgcaacatctgggctacctccggcacatctcgtacgcaatga

SEQ ID NO: 92293 - protein, 371 aa, Archaeoglobus fulgidus DSM 4304
MRRRQKRLGSCWRELQMKPVIRLSEKIRELSKEFESVKIMHLCGTHEDTITKYNLRSLLPENISLLSGPGCPVCITPDEDIQMVMHLLEKENITLATFGDMARVPFQGKSLFTLRAEGYDIRIVYSIFDSLKLAESSDRPVVHFAIGFETTMPSTAIALLDEKENFYVFSAHRFFIPAVHALCENTTVDAFINPGHVSTIIGVKPYREILKKYGIPQVIAGFEPEDVMLAIYLLLEAMSDGRREVINEYSRAVKEEGNVRALEAMDRVFRKEDWSWRGLGVVKGSGGALAKRFEQFDARKVFEDAFADFQPVEDKSKRLCRCGDVLKGIATPKDCPLFMKACNPRNPVGACMVSVEGTCNIWATSGTSRTQ

SEQ ID NO: 92294 - DNA, 1104 bp, Pyrococcus abyssi GE5
  CDS (1)..(1104): transl_table=11
atgctagagaagttcagggataaagagattgcccaaaagatagtccgaaagattcacaaggaagctaaaggttttgacgagcttaggttcatgcacgtctgtggaacacatgaagatacagtcactagggctggaataagatcactccttccagaaaacgtcaagataatgagcggtcccgggtgccctgtttgcataacgcctgttgaggatatagttaggatgatggagatcatgaggaaagcaaaggaagagggagaggatataatcttaacaacgtttggagacatgtataggatcccaaccccaatgggtagctttgccgaccttaagagtgaaggcttcgacgttagggtggtgtactcgatatacgattcctacaagatagcccaggaaaacagggataaactggtggttcacttctctccaggattcgaaacaactactgcacctactgcaggcatgcttgaaaccgtaataaacgaaggtttggataatttcaagatatactcggttcacaggttgacacctccagctgttgaggctctcctaaaggcaggaaccgttttccacgggttaatagatcctgggcacgtttcgacgataataggagttaggggatgggcatatttaacggagaagtacaacattccccaagtggttgcaggctttgagccggttgatgttcttcttgggatactaatcttgattcgcatggtgaaggagggagaagctaagataatcaacgagtactctagggtagttaagtgggaaggaaacgttaaggctcaagaattaatcaataaattctttgaggtcaaggatgctaagtggagggccctggggattattccgcaaagcggcctagagctcaagagggaatggaaggatcttgagataagaaccctctacaatccagatgttccaaagcttccagaccttgaaaagggctgcctttgcggtgctatactgaggggactggcattgcctccccagtgtccccacttcggaaagacgtgcaccccgaggcatcctataggcccgtgcatggtttcctacgagggcacctgttcaatattctacaagtacggagccctgttctaa

SEQ ID NO: 92295 - protein, 367 aa, Pyrococcus abyssi GE5
MLEKFRDKEIAQKIVRKIHKEAKGFDELRFMHVCGTHEDTVTRAGIRSLLPENVKIMSGPGCPVCITPVEDIVRMMEIMRKAKEEGEDIILTTFGDMYRIPTPMGSFADLKSEGFDVRVVYSIYDSYKIAQENRDKLVVHFSPGFETTTAPTAGMLETVINEGLDNFKIYSVHRLTPPAVEALLKAGTVFHGLIDPGHVSTIIGVRGWAYLTEKYNIPQVVAGFEPVDVLLGILILIRMVKEGEAKIINEYSRVVKWEGNVKAQELINKFFEVKDAKWRALGIIPQSGLELKREWKDLEIRTLYNPDVPKLPDLEKGCLCGAILRGLALPPQCPHFGKTCTPRHPIGPCMVSYEGTCSIFYKYGALF

SEQ ID NO: 92296 - DNA, 1113 bp, Helicobacter pylori 26695
  CDS (1)..(1113): transl_table=11
atgagcgttgatcacctcatttcgccctttagagacaagcgaacccttttagcgctctctaatgcaatcaaaaaactcgctttcaaacttgaaaaaaaattagtcatcatggaagtgtgcggagggcatacgcattctatcatgaaatacgggcttttagatttgatgcctaacaatttagagtttgtgcatgggccgggctgcccggtatgcgtgatgccaagagcgcgccttgatgaagcttatgaactcgctactatcaaagatagcattgttttgagtttaggggatatgatgagagtccccgggagctatgggagtttgatacaagccagagaaaaggggttggatgcacgctttttgtattcgcccatgcaagctttagagatcgctaaagaaaaccctactaaaaaagtcatttatattgcgatcggttttgaaaccacaacgcccatgagcgctagcgttttatggagcgccaaaaaagaaaaaattaataacctttttttccacattaaccacattctagtgcctcccagcgtgagcgcgattttaaaagatccagcatgccagattaacgcccttttagcccctagccatgtgagcgtgatcagcggcgctcaaatctatgctcctttagtggatcgctttaaaatccccattatcgtgagcggttttgagccggtggatatattagaaagcgtgctgatgcttatcaaacaagccctaaacaaagaagccaagctagaaatccaatacaaaagagcggtgagttttgaggggaatgtgaaagcgcaagagttagtcaatgcttgcatggaagttagggaaaattttgaatggagaggtttggggaatatcaaacgatccgctctcaaactcaaagaagcgttcgcttcttatgacgctgaagaagtctttaaagaatatttaagccacaaaacctctaaagaaaacaaagcatgcaagtgcggggagattttaaaaggcatcgctaagcccctagactgctcgttattcgctacaacttgcaccccacaaaacccgatcggcagttgcatggtcagctctgagggggcgtgcgcggcgtattatcgttacaagcgcgtttga

SEQ ID NO: 92297 - protein, 370 aa, Helicobacter pylori 26695
MSVDHLISPFRDKRTLLALSNAIKKLAFKLEKKLVIMEVCGGHTHSIMKYGLLDLMPNNLEFVHGPGCPVCVMPRARLDEAYELATIKDSIVLSLGDMMRVPGSYGSLIQAREKGLDARFLYSPMQALEIAKENPTKKVIYIAIGFETTTPMSASVLWSAKKEKINNLFFHINHILVPPSVSAILKDPACQINALLAPSHVSVISGAQIYAPLVDRFKIPIIVSGFEPVDILESVLMLIKQALNKEAKLEIQYKRAVSFEGNVKAQELVNACMEVRENFEWRGLGNIKRSALKLKEAFASYDAEEVFKEYLSHKTSKENKACKCGEILKGIAKPLDCSLFATTCTPQNPIGSCMVSSEGACAAYYRYKRV

SEQ ID NO: 92298 - DNA, 1143 bp, Aquifex aeolicus VF5
  CDS (1)..(1143): transl_table=11
atgagggttgaagaaatttccatctttgaggcctataaagataaagaaagggttttaaaactctccgaaaagataaaaaaactttctgaaaagataggaagaacggtaaacataatggagttttgcggagggcacacccacgccataatgaagtacggcatagaccagctcctaaaaggtgtcgtgcgttttatccacgggccggggtgtcctgtttgcgttatgcccatgcagaggatagacctcgccatagagcttgcaaaaaggaaagacgtcattatgtgctcctacggagacctcctgagggttccgggctcgaaaaggaagagcctactcaacgtccgggcggaaggtgcggacgtcaggatggtttactcgtgcttagatacgctaaaaatagcaaaagaaaatcctgataaaaaggttatcttctttgccataggttttgaaaccactactccccaaaccgccgttcttataaagaaggcaaaggaagaagggattaaaaacctcttcgtggtttccaaccacgttataacgcccgctgcgatccagcacatacttaacgccccggaaatcagggagataggaaaagtggagatagacgccttcataggaccggggcacgtgagcgtgataatagggacgaaaccttaccactactttgccgaggaattccagaaaccggtggtgatagcggggtttgaaccattaaacgtcctgaaggccgtttacctaatactgaaacaaatttacaaggggagggctgaggttaaaaacaattacacaaggttcgttacttacaaggggaacttgaaggctcaaaacctcgttgcggaattatttgaactgaggaaggaatttgagtggagaggactcggcacaataccttacagcgccctgaagataaggaaagagtacgaagagtttgacgcggaaaaggtctttgaggttgaacttccagagccaaaggaacaccccgcctgtatatgcggaaaggtaataaggggcgttgcgagacctacggactgcaagctcttcggaacagtatgcacgccttcaaacccgctcggttcctgtatggtttcttcggaaggagcctgtgcggcttactacaagtacagaagggctttagttcagtaa

SEQ ID NO: 92299 - protein, 380 aa, Aquifex aeolicus VF5
MRVEEISIFEAYKDKERVLKLSEKIKKLSEKIGRTVNIMEFCGGHTHAIMKYGIDQLLKGVVRFIHGPGCPVCVMPMQRIDLAIELAKRKDVIMCSYGDLLRVPGSKRKSLLNVRAEGADVRMVYSCLDTLKIAKENPDKKVIFFAIGFETTTPQTAVLIKKAKEEGIKNLFVVSNHVITPAAIQHILNAPEIREIGKVEIDAFIGPGHVSVIIGTKPYHYFAEEFQKPVVIAGFEPLNVLKAVYLILKQIYKGRAEVKNNYTRFVTYKGNLKAQNLVAELFELRKEFEWRGLGTIPYSALKIRKEYEEFDAEKVFEVELPEPKEHPACICGKVIRGVARPTDCKLFGTVCTPSNPLGSCMVSSEGACAAYYKYRRALVQ

SEQ ID NO: 92300 - DNA, 1113 bp, Helicobacter pylori J99
  CDS (1)..(1113): transl_table=11
atgagcgttgatcacctcatttcgccctttagagacaagcggattattttagcgctctctaatgaaatcaaaaaattcgcttccaaactcactaaaaaattagtcatcatggaagtgtgcggagggcatacgcattccatcatgaaatacgggcttttagatttgatgcctaaaaatttagagtttgcgcatgggccagggtgtccggtgtgcgtgatgccaagagcgcgccttgatgaagcttacgaactcgctagcatgaaagatagcattgttttgagtttgggggatatgatgagagtccctgggagctatgggagtttgatacaagccagagaaaaggggttagatgcgcgttttttgtattcgcccatgcaagctttagagatcgctaaagaaaaccctcataaaaaagtcatctacattgcgatcggttttgaaaccaccacgcccatgacggcgagcgttttgctcaatgccaaaaaagaaaaattaaaaaatctttttttccacattaaccacattctagtgcctccaagcgtgagcacgattttagaagataaagcatgccggatcaacgcccttttagcccctagccatgtgagcgtgatcagcggcgctcaaatctacgctcctttagtggatcgctttaaactccccattattgtgagcggttttgagccggtggatatattagaaagcgtgctgatgctcactaaacaagccctaaacaaagaagccaagctagaaatccaatacaaaagagcggtgagctatgaagggaatacaaaagcgcaagaattagtgaatgcatgcatggaagttagggaaaattttgaatggagaggtttggggaatatcaaacgatccgccctaaagcttaaagaagcgttcgcttcttacgacgctgaaaaagtttttaaagcatacttaagccacaaaacctccaaagaaaacaaggcatgcaagtgcggggagattttaaaaggcatcgctaagcccctagactgctcactattcgccacaacttgcaccccgcaaaacccgatcggcagttgcatggtcagctctgagggggcgtgtgcggcgtattatcgttacaagcgcgtttga

SEQ ID NO: 92301 - protein, 370 aa, Helicobacter pylori J99
MSVDHLISPFRDKRIILALSNEIKKFASKLTKKLVIMEVCGGHTHSIMKYGLLDLMPKNLEFAHGPGCPVCVMPRARLDEAYELASMKDSIVLSLGDMMRVPGSYGSLIQAREKGLDARFLYSPMQALEIAKENPHKKVIYIAIGFETTTPMTASVLLNAKKEKLKNLFFHINHILVPPSVSTILEDKACRINALLAPSHVSVISGAQIYAPLVDRFKLPIIVSGFEPVDILESVLMLTKQALNKEAKLEIQYKRAVSYEGNTKAQELVNACMEVRENFEWRGLGNIKRSALKLKEAFASYDAEKVFKAYLSHKTSKENKACKCGEILKGIAKPLDCSLFATTCTPQNPIGSCMVSSEGACAAYYRYKRV

SEQ ID NO: 92302 - DNA, 1047 bp, Methanothermobacter thermautotrophicus str. Delta H
  CDS (1)..(1047): transl_table=11
atgaagaatctttcaagggaactggtttcaaggatacaggagatatcacgtccagttaagataatgcatgtatgcgggtcacatgagcacacaataatgcagcatggtgtaaggtccctccttcctgaggaggtggaggtggtcgccgggcctggctgtccggtctgctgtgtcccggcaagggaaatcgacgagtgcattgaacttgcaaggcagggtgtcaccataacaaccttcggtgacatgctccgggtcccgggctccaggggatccctcgcggatgccagggcggacggtgcggatgtcaggatagtctacggtgtgggcaacgcagtggagatagcaaggaaacttgaccgggaagtcgtattcatggcagcgggatttgagaccacggcgccaacaacagcctcggagatactctcaggaccacctgagaacttctcggttctttcatgccacaggctcataccacccgccctcaggtttctcatagagtcaggtgaggtgaacctcaacgccctcatagaaccaggtcacgtgtcaaccataatcggcatgaaaccctatgagcccttctcaagggactacaacataccacaggtcatagcgggcttcaaccccctggatatactcatggcggtctacatgatactccgacagatcgataggggagaggcaaaggttgagaacgagtataagagggccgtgaaacccgagggtaacctcaaggcccagaaggtgatggatgaggtcttcaaggtaaccgagagggagtggaggggattcccggtcatacccgaatcagtctatgagataagggatgagttctctgaattcaatgcccgggagaaattcgatatagaggttgaagatacggttgatacaccggcgggatgcatatgcggtgctgtattgaggggtgttgcaaggccggaggaatgcaaactcttcaagaatgagtgcacccccaccagtcccatcggggcatgcatggtgtcaagggagggcacctgtaacatagcctaccggtacagctcattctag

SEQ ID NO: 92303 - protein, 348 aa, Methanothermobacter thermautotrophicus str. Delta H
MKNLSRELVSRIQEISRPVKIMHVCGSHEHTIMQHGVRSLLPEEVEVVAGPGCPVCCVPAREIDECIELARQGVTITTFGDMLRVPGSRGSLADARADGADVRIVYGVGNAVEIARKLDREVVFMAAGFETTAPTTASEILSGPPENFSVLSCHRLIPPALRFLIESGEVNLNALIEPGHVSTIIGMKPYEPFSRDYNIPQVIAGFNPLDILMAVYMILRQIDRGEAKVENEYKRAVKPEGNLKAQKVMDEVFKVTEREWRGFPVIPESVYEIRDEFSEFNAREKFDIEVEDTVDTPAGCICGAVLRGVARPEECKLFKNECTPTSPIGACMVSREGTCNIAYRYSSF

SEQ ID NO: 92304 - DNA, 1086 bp, Clostridium acetobutylicum ATCC 824
  CDS (1)..(1086): transl_table=11
atgaaatatgttgatgaatttagaaatggggattatgcaaaaactcttgtgagattaatacagaaacttactaagaaaaaaataaatataatggagatatgcggcagtcatactatggctatatttagatatggaattaaagatatacttccaagtaatataaggttgatttctgggccggggtgtcccgtttgtgttacgtctcaaggttatattgatactgctttagagctttctttaagtagagaggttatcattgcaacttttggagatatgataagggttccgggaacaaaaacttctctaatgaaaagaaaagctgagggagctgatattaaaatagtttattcaccaatggatgcattgactttggcagaaaataatccgttaaaaaaagtagtctttctttctgtaggttttgaaacaacaacacctattacagcaattacaatattggaggctaaaaaaagaggtgttaagaatatattttttttgacgtcaaataagatggttcctccagttatgaggacacttgtagaagataaggaacttaacataactggttttttacttcctggaaatgttagtgctattattggaaaaaaaccatatgaatttttgagcagtgagtataatgtatctggtgttgtaacaggctttgagccgttggatatacttaagggcttaaaggtacttatagatattataaataacaatgcttcagtaatagtaaatgaatataagagggtagtaagagatgagggtaacgttacggcattaagatatataaaagaagtatttgaagttactgatagcacatggagaggaatagggaacattgaaaaaagtggatataagattaatacagaatatgagcaatttgatgctgtaaaacagtttaatataaattataaagaatgcgatagcagttctgaatgtagatgtggagatatacttaaagggaaaataactccaatagaatgttcgctatttaaaaaagcatgcacacctgatcatcctgtaggttcttgtatggtgtcttatgaaggtgtatgtgcagcgtattataaattccttaatacatga

SEQ ID NO: 92305 - protein, 361 aa, Clostridium acetobutylicum ATCC 824
MKYVDEFRNGDYAKTLVRLIQKLTKKKINIMEICGSHTMAIFRYGIKDILPSNIRLISGPGCPVCVTSQGYIDTALELSLSREVIIATFGDMIRVPGTKTSLMKRKAEGADIKIVYSPMDALTLAENNPLKKVVFLSVGFETTTPITAITILEAKKRGVKNIFFLTSNKMVPPVMRTLVEDKELNITGFLLPGNVSAIIGKKPYEFLSSEYNVSGVVTGFEPLDILKGLKVLIDIINNNASVIVNEYKRVVRDEGNVTALRYIKEVFEVTDSTWRGIGNIEKSGYKINTEYEQFDAVKQFNINYKECDSSSECRCGDILKGKITPIECSLFKKACTPDHPVGSCMVSYEGVCAAYYKFLNT

SEQ ID NO: 92306 - DNA, 1125 bp, Synechocystis sp. PCC 6803
  CDS (1)..(1125): transl_table=11
atgaaatacgttgatgaatatcgggatgcccaggcggtggcccattaccgtcaggcgatcgccagggagataaccaaaccttggacgctgatggagatttgcggcggccagacccacagcattgtcaaatatggcttggatgctttgttgccgaagaatttgactctgatccatggtcccggctgtcctgtgtgcgtcactccgatggaattaattgaccaggctttgtggttagctaagcaaccggagatcattttttgttcctttggcgatatgttgcgggtgcccggcagtggggcggatttgctgagcattaaagcccagggcggcgatgtgcgcattgtctattctcctttggattgtttggcgatcgccagggagaatcctaatcgggaagtggtatttttcggagtaggttttgaaactacagcccctgccacggccatgactctccaccaagctagggcccagggaattagcaatttcagtttactttgcgcccatgtattggtgcccccggctatggaggctttattaggcaatcccaattccctcgtgcagggctttttggcggcagggcatgtctgtacggtgaccggggaaagggcctatcaacatatcgctgaaaaataccaagtacccattgtcatcactggctttgaacctgtggatattatgcagggcatctttgcctgtgtgcgccaactggagtcgggacaattcacctgcaacaatcaatatcggcgatcggtccaaccccagggcaatgcccatgctcagaaaattattgaccaagtgtttgagccagtcgatcgccattggcggggtttgggattaattccggccagcggtttgggtttaaggccagcatttgccccctgggatgccgcagttaaattcgccaatttattgcaaaccatggccccaacgatgggagaaacagtgtgtattagcggggaaattttacagggacaacggaagcccagcgattgtccagcctttggtactatctgcaccccagaacaacccttgggggctcccatggtttcctcggaaggagcctgtgccgcctattaccgttatcgccaacaattaccggaaccagtgggagcggccagagtttag

SEQ ID NO: 92307 - protein, 374 aa, Synechocystis sp. PCC 6803
MKYVDEYRDAQAVAHYRQAIAREITKPWTLMEICGGQTHSIVKYGLDALLPKNLTLIHGPGCPVCVTPMELIDQALWLAKQPEIIFCSFGDMLRVPGSGADLLSIKAQGGDVRIVYSPLDCLAIARENPNREVVFFGVGFETTAPATAMTLHQARAQGISNFSLLCAHVLVPPAMEALLGNPNSLVQGFLAAGHVCTVTGERAYQHIAEKYQVPIVITGFEPVDIMQGIFACVRQLESGQFTCNNQYRRSVQPQGNAHAQKIIDQVFEPVDRHWRGLGLIPASGLGLRPAFAPWDAAVKFANLLQTMAPTMGETVCISGEILQGQRKPSDCPAFGTICTPEQPLGAPMVSSEGACAAYYRYRQQLPEPVGAARV

SEQ ID NO: 92308 - DNA, 1104 bp, Pyrococcus furiosus DSM 3638
  CDS (1)..(1104): transl_table=11
atgcttgaaaaatttggagacaaagctgtagctcaaaagattttagaaaaaattaaagaggaagctaaagggatagaagagctacgatttatgcacgtttgtgggactcatgaggacacagtaactaggagtggaatcagatcacttcttccagaaaatgtaaaaatcatgagtggcccaggatgtcccgtctgtataacccccgttgaggacatagtgaagatgatggaaattatgaaagttgcgagagaggagagggaagaaattattctcactacttttggtgacatgtatagaattccaactccaataggaagctttgcagacttaaagagtcagggttacgatgtgaggatagtttactctatatacgactcctataaaatagccaaggaaaatccagataagcttgtagtgcacttttctcctgggtttgagactaccgccgctccaacagctggaatgcttgagagcattgtggaagaggggctagagaactttaagatttattccgttcataggttaacccctcctgcagttgaagctctcctaaatgcggggactgtttttcacggtttaatagatcctggtcatgtctctacaataattggggtgaaaggatgggcgtatctcacagaaaagtttggaattcctcaagttgtggctggctttgagccagttgatgttttactcggaatacttattctcattaggcttgtgaagaggggcgaagcgaaaataatcaacgagtataatagagttgtaaagtgggaaggaaatgtcaaggcccaagaactgatttggaagtactttgaagttaaagatgcaaagtggagggccctaggagtaattccaaggagcggattggaacttaagaaagagtggaaggagctagaaattagaacttattacaatcccgaggttccaaagctcccagatcttgaaaaaggatgtctctgtggggcagtccttagaggattagccttaccgacccagtgccaacactttggaaagacatgtacaccaagacatccggtaggtccttgtatggtttcgtacgaaggaacttgtcacatattttacaaatatggcgccctgatgtag

SEQ ID NO: 92309 - protein, 367 aa, Pyrococcus furiosus DSM 3638
MLEKFGDKAVAQKILEKIKEEAKGIEELRFMHVCGTHEDTVTRSGIRSLLPENVKIMSGPGCPVCITPVEDIVKMMEIMKVAREEREEIILTTFGDMYRIPTPIGSFADLKSQGYDVRIVYSIYDSYKIAKENPDKLVVHFSPGFETTAAPTAGMLESIVEEGLENFKIYSVHRLTPPAVEALLNAGTVFHGLIDPGHVSTIIGVKGWAYLTEKFGIPQVVAGFEPVDVLLGILILIRLVKRGEAKIINEYNRVVKWEGNVKAQELIWKYFEVKDAKWRALGVIPRSGLELKKEWKELEIRTYYNPEVPKLPDLEKGCLCGAVLRGLALPTQCQHFGKTCTPRHPVGPCMVSYEGTCHIFYKYGALM

SEQ ID NO: 92310 - DNA, 1053 bp, Methanopyrus kandleri AV19
  CDS (1)..(1053): transl_table=11
ttgaaaatgacacgtcgggagttcgtgagaaagctcgtccgtcgaatccataaggaggccgagaccctcgatcgtgatgtgacgatcatgcacgtgtgtggatcccatgaacggactatagtcgaacacggtctcagatcgttgcttcccgagaacgtccgtttagtctgcggtccagggtgccccgtgtgtgtgaccactacgggagagctcgccgcggccataaaggctgcggaagatggcatggtcgtgtgcgctttcggggacgtgtacagggtccccactcctgtcggatccctctcctcatgcgatggggacgtcagggtggtccagagcgttaggaaggccgaggagatcgccgagtccgaggaccgtgatgtcctctacctggcggtagggttcgagactacggcaccgaccaccgcggccgtgctcctcgatgacccgccctccaacttctacgtgctgtcggctcaccggttgataccacctgcgatggagtggttgctggagtcgggcgagtgccgtctcgacgcgttcatatgtcccggtcacgtgtccacgatcatcgggacggggccctacgagtccgtagcccgggagctcccgtgcgtggtcgccggcttcgagcccgaggacgttctgatcgcggtactggcgtgcctcaagatgctcagaaggggacgtgtgggagtcaccaacgagtacctcagggcagtcgaggacagggggaacccggtcgcgaaggaactgatggaaagggcgttcgagcccgaagataggccgtggcggggtttcccgaccatccccgagtcggcgttgaagctgcgtgaggacctcgcagatcacgatgcgattgagattggaatacggccggattacaccctgggacacgacgaatcctgcatatgtgatcggatactgcgagggttggccgagccccgggactgcccgttgttcggcacgaaatgtactccgacggatcccgtaggcccgtgcatggtgtcggaggaaggcccgtgtttcatagagtacaggttcggcggagggtga

SEQ ID NO: 92311 - protein, 350 aa, Methanopyrus kandleri AV19
MKMTRREFVRKLVRRIHKEAETLDRDVTIMHVCGSHERTIVEHGLRSLLPENVRLVCGPGCPVCVTTTGELAAAIKAAEDGMVVCAFGDVYRVPTPVGSLSSCDGDVRVVQSVRKAEEIAESEDRDVLYLAVGFETTAPTTAAVLLDDPPSNFYVLSAHRLIPPAMEWLLESGECRLDAFICPGHVSTIIGTGPYESVARELPCVVAGFEPEDVLIAVLACLKMLRRGRVGVTNEYLRAVEDRGNPVAKELMERAFEPEDRPWRGFPTIPESALKLREDLADHDAIEIGIRPDYTLGHDESCICDRILRGLAEPRDCPLFGTKCTPTDPVGPCMVSEEGPCFIEYRFGGG

SEQ ID NO: 92312 - DNA, 1062 bp, Thermoanaerobacter tengcongensis MB4
  CDS (1)..(1062): transl_table=11
atgatgcagcagagggaaatagttgaaaaagccaaaaaagccattgaaacactaaatccgggtatcccttttaacataatggaagtgtgtggatctcacacgatggcaatttcaaaatttggcttaaggcaggttctccctaaaaacataaggctcatatcaggacccgggtgtcccgtgtgcgtgactgcccagaacgaaatagacgcagtgatagagctttcaaataaaaatatagtgattgccacttttggggatttaataagagttccagggaataagtcctcccttcagaaggaaagagctaaagggaaagaggtaagagtgttttactctcctttggacgctttgaagtacgcagaggagaatccgcaaaaggaagttgtcttcataggtataggctttgagaccactgtccctacagtggctttgacgataaaagaggcaaaagagagaaaaataaaaaattacagtgtgtattcgcttcacaagacaatgcctgaagccttaagagctcttctggtagggggttctaatgttcagggatttttactgccgggacatgtgagtgcaataacaggaagccgcatatatgagtttttgccaagagagtttggagtaggtggtgtgatatcaggttttgaggcagaagatattttgatgagcatagtaatgcttttaaaaaattataaaaatcctacaattgagatccagtacaaaagggttgtgaaagaagaaggaaatattgaagcgcagaagataattgaagaagtttttgaaccctgtgacagcacatggagagggcttggcgagataaaaggttcaggccttaagataagggacaaatacaaagactttgatgcagccttaaaatttgacataaagcctgttggagatgaaatagagataaagggatgtagatgcggagatgttctaaaagggcgcatatatccaaatgaatgtccgctatttggtagagtctgcaccccagacaatccggttgggccttgcatggtgtcttcggaagggtcctgtgcagcgttttacaagtatggcgcataa

SEQ ID NO: 92313 - protein, 353 aa, Thermoanaerobacter tengcongensis MB4
MMQQREIVEKAKKAIETLNPGIPFNIMEVCGSHTMAISKFGLRQVLPKNIRLISGPGCPVCVTAQNEIDAVIELSNKNIVIATFGDLIRVPGNKSSLQKERAKGKEVRVFYSPLDALKYAEENPQKEVVFIGIGFETTVPTVALTIKEAKERKIKNYSVYSLHKTMPEALRALLVGGSNVQGFLLPGHVSAITGSRIYEFLPREFGVGGVISGFEAEDILMSIVMLLKNYKNPTIEIQYKRVVKEEGNIEAQKIIEEVFEPCDSTWRGLGEIKGSGLKIRDKYKDFDAALKFDIKPVGDEIEIKGCRCGDVLKGRIYPNECPLFGRVCTPDNPVGPCMVSSEGSCAAFYKYGA

SEQ ID NO: 92314 - DNA, 1137 bp, Methanosarcina mazei Go1
  CDS (1)..(1137): transl_table=11
gtggacgctgataatatggaaaacggaaaatctctttcaaaaacagcggtttcagacatagaaaagaaactccttgaaaggattaaaggttctgaggtatcacttcgtattatgcatgtctgtggaacgcacgaaagaaccatagcaaaatacgggttaagaagtgtgcttcctcagtatattgaagtaataagtggtcccggctgccctgtctgtgtcactcctgaaagagatattgacattgcaattgccctcgcaaagagcggagcaactgtggtcactttcggggatatgatgcgagtacctggctcttcagacagcctcctgaacgcaaagtctgaaggggcggatgtaaggatggtttacagtatagatgatgcagttgcccttgcaggaaaaaagccagatctgaaagtagtctttttcgggataggttttgagaccacagtccctgcaaacgcggcagcccttttgcggaaggatctacctgacaacttcagcctccttgcttctcagaagcagactcctcctgcagtcaatcttcttgccagtgataccaatgttgatgcttttatagcaccagggcatgtggcaaccataataggcacagaacctttcgaaccgcttgcaaaaaagggctttcctgttgttgttagtggatttgaagccgcagatatacttcttggaataaacatcttacagatgcaggtagagaaaggaatctcaagggtggacaacggatatcccagggtcgtaaagccagaaggaaatacaatagccctgaaaatgatggatgaggtattcaaaacttctgactctgagtggagaggtataggaaatatagaagattcgggactcgtcctcagggaagagtttgaagaaaaagacgctgcgaaaatacatgaagatctttattctgcttctcttgcagagataaaatcgaaagctgaaggaaaagataaaaaacgctgcatctgtgcagctatcctgacaggaaaagcaaaaccttcccagtgtcctaacttcgggaaagaatgcactccaaaaaaaccagcgggtccctgcatggtaagtcaggaaggtatgtgctataactggtataaatattctcgagaaggaggtagtaaaaatgcatga

SEQ ID NO: 92315 - protein, 378 aa, Methanosarcina mazei Go1
MDADNMENGKSLSKTAVSDIEKKLLERIKGSEVSLRIMHVCGTHERTIAKYGLRSVLPQYIEVISGPGCPVCVTPERDIDIAIALAKSGATVVTFGDMMRVPGSSDSLLNAKSEGADVRMVYSIDDAVALAGKKPDLKVVFFGIGFETTVPANAAALLRKDLPDNFSLLASQKQTPPAVNLLASDTNVDAFIAPGHVATIIGTEPFEPLAKKGFPVVVSGFEAADILLGINILQMQVEKGISRVDNGYPRVVKPEGNTIALKMMDEVFKTSDSEWRGIGNIEDSGLVLREEFEEKDAAKIHEDLYSASLAEIKSKAEGKDKKRCICAAILTGKAKPSQCPNFGKECTPKKPAGPCMVSQEGMCYNWYKYSREGGSKNA

SEQ ID NO: 92316 - DNA, 1095 bp, Chlorobium tepidum TLS
  CDS (1)..(1095): transl_table=11
atgaaattcatcgacgaataccgcgaccccgctcgcgctcgcgctttgcttgaccgcatccggcaggtggcgcgtcatgactggacgatcatggaaatctgcggcgggcagacgcattcgattttgcgcaacggcatcgaccagcttttgccgccgaacgtgcagcttgtgcatgggccggggtgtccggtgtgcgtgacgccgctggagactatcgagcgggcgctggcgattgcggccaggccgaatacgattctgacgagcttcggcgacatgctgcgcgtgccgggcaactcgaaagacctgttcatggcgcggagcgagggagcggatgtgcgggtcgttttttcgccgctcgaagcgttgcaaatcgcgcgcgacaatccgtcgaaagaggtggtgtttctcggcgtcggttttgagaccacggctccggccaacgcgatggccgtgcatcaggcggcacgggaagggcttacgaatttcagcgagctggtgagccaggtgatggtgccgccggcgatgcgcgcaatgctgtcgtcgcccggcaaccgcgtgcaggggttccttgccgcagggcacgtctgcgccatcatggggtacgaggagtacgagccggtggcggcggagttcggcgtgccgatcgtgcccgccgggttcgagccggtcgatctgctcgacgcgattctgaagacggtcgagctcctcgaagctggccggtcgggcgtggtgaacgcttacgggcgcgtggtgagccgcgagggcaatccagaggcgcggcgggtgatgcaggaggtgttcgaggtcgccgaccgtccgtggcgcggcatcggcgtcattccggcaagcgggcttgtgctgcgcccggagtacaagcgtttcgacgccgaaaagcgcttcgatgtgggccacatcgccccgcaggagtcgcccctgtgcaggagcggcgaggtgctgcaaggccacctcaaaccctccgactgcccggccttcggcaaagaatgcaccccgcaaaccccgttcggcgcaaccatggtttccagcgaaggcgcctgcgccgcgtattatcggtatcaccgcaacagtaacacttga

SEQ ID NO: 92317 - protein, 364 aa, Chlorobium tepidum TLS
MKFIDEYRDPARARALLDRIRQVARHDWTIMEICGGQTHSILRNGIDQLLPPNVQLVHGPGCPVCVTPLETIERALAIAARPNTILTSFGDMLRVPGNSKDLFMARSEGADVRVVFSPLEALQIARDNPSKEVVFLGVGFETTAPANAMAVHQAAREGLTNFSELVSQVMVPPAMRAMLSSPGNRVQGFLAAGHVCAIMGYEEYEPVAAEFGVPIVPAGFEPVDLLDAILKTVELLEAGRSGVVNAYGRVVSREGNPEARRVMQEVFEVADRPWRGIGVIPASGLVLRPEYKRFDAEKRFDVGHIAPQESPLCRSGEVLQGHLKPSDCPAFGKECTPQTPFGATMVSSEGACAAYYRYHRNSNT

SEQ ID NO: 92318 - DNA, 1140 bp, Shewanella oneidensis MR-1
  CDS (1)..(1140): transl_table=11
atgcttgaattaaaacaactttatcaaggctttcgcgatccgcaaaccattgcctcacttgcacaggatattgccaaggtcgcccgtacactcaaagagcccatcaacattatggaagtctgcggcggccatacccacaccatcatgaaatacggcttactggatttgctgccggacaatattgagtttatccatggcccaggctgcccagtgtgcattatgcctaaagagcgtatcgaccaagcggcagtgcttgcccagcaggaagacgtgattttagtgaccctaggggatatgatccgcgtccctggctctaaaggttcactcgccagtttcagggccaaaggctgcgatattcggcctatctatgaccctttagacacgctcaaaatcgcccgtgataatccacataaaacggtggtgtttttcgccatcggctttgaaacttcaacgccaatgaccgccgtattattgcaactggcagaacaacaaaagctggcgaatgtgttttttcatatcaaccatgtattagtcccccccgcaattgatgcggtgatgcacgatcccaacgccagggtcaatgcctttatcggccccgcccacgtgagtgtgatcagtggcgccaaaatctatcgcccagctgttgagcaatatggcacaccagtagtggtctccggctttgaacccgtggatgtgatggaatcgattttgcggatcatgcggcaaaaagccgcgggcaaggcagaactcgatatccaatacagccgcgccgtgtcggagcaaggcaatcttgccgcacaagcaaaagttgagcagtttttccagatcaggccgcaatttcgctggcgcggcctagggcctatcccaaattcagcactgcaactcaagcccgaatatgcccatagggatgccgaactgcgttttaaaaactgtttgcccgtcaaagaaatcgatgatcataaagcctgccaatgcggcgatattctacgcggtctcgctaaaccgaaggactgtaaagtatttggccgcggctgcaatcctgaaacccccctcggtagctgtatggtcagctccgaaggcgcttgtaatgcttattaccgctatcaaggtatcgatagcaaggagcaacatcatggctga

SEQ ID NO: 92319 - protein, 379 aa, Shewanella oneidensis MR-1
MLELKQLYQGFRDPQTIASLAQDIAKVARTLKEPINIMEVCGGHTHTIMKYGLLDLLPDNIEFIHGPGCPVCIMPKERIDQAAVLAQQEDVILVTLGDMIRVPGSKGSLASFRAKGCDIRPIYDPLDTLKIARDNPHKTVVFFAIGFETSTPMTAVLLQLAEQQKLANVFFHINHVLVPPAIDAVMHDPNARVNAFIGPAHVSVISGAKIYRPAVEQYGTPVVVSGFEPVDVMESILRIMRQKAAGKAELDIQYSRAVSEQGNLAAQAKVEQFFQIRPQFRWRGLGPIPNSALQLKPEYAHRDAELRFKNCLPVKEIDDHKACQCGDILRGLAKPKDCKVFGRGCNPETPLGSCMVSSEGACNAYYRYQGIDSKEQHHG

SEQ ID NO: 92320 - DNA, 1152 bp, Bradyrhizobium japonicum USDA 110
  CDS (1)..(1152)
atgccgatcgtgaaatattccagcgaatttcgcgacaagactatcgcgcagggacttgcgcgagcaattgacgctgaggtcagttcacaacgagcctaccggttcgtggaattttgcggtggacacactcatgcaatctcccgctacggtcttgaggatctgctgcccgcgaacgttcggatgatccacgggcccggttgtcccgtctgcgttctgccggcgagccgtatcgacatggcgatccggctcgccgagcggccagaggtcattctgtgcgtctacggcgacctgatgcgcgcgcctgggtcgcaagggcagtccctgttgcttgccaaagcgctgggtgcccacattcggatggtctactcgaccctcgacgctatccggctcgccgaacagacgccgggccgcgaagtggtcttctttgccatcggatttgagaccacgacgcccccgacggcggtcatgatcaggattgccgagcacaagcggctcgagggccttagcgtgttctgcaatcacgttcttacgccctctgcgatgcaccgcattctcgagaacccgaagatccgcaacacgggcggggtccccattgacggcttcatcgggcctgcacatgtcagcaccattgtcggtacgcagccttacgagcccatggcggaacaattcgagaagccgatcgtggtcgccggatttgaacccctcgacgtgctgcaggctgtcctgatgctggtgcggcaagtgaaccaaaaccgccacgaggtggaaaaccaatacagccgtgcagtgacacgcgaaggcaaccggcgcgccaaggaggaggtctcgcaggtcttcgagctgcgtgagcagtttgaatggcgcgggcttggactggtacccaacagcggactgaagctgaagcaatcatatgcaaaattcgacgccgagacgcgctttgcgatccatgacctgcgtgtcgcagacaatccggcctgcgaatgctgcgcgatcctgcgtggcgccaaacggccgatcgattgcaagttgtttggcaatatctgcacgccggaaacgcccataggagcctgcatggtgtcatcagaaggagcttgtgcggcgtattggacctatcgccgagttcgcgatgagcaggcgaggcagacgtcatga

SEQ ID NO: 92321 - protein, 383 aa, Bradyrhizobium japonicum USDA 110
MPIVKYSSEFRDKTIAQGLARAIDAEVSSQRAYRFVEFCGGHTHAISRYGLEDLLPANVRMIHGPGCPVCVLPASRIDMAIRLAERPEVILCVYGDLMRAPGSQGQSLLLAKALGAHIRMVYSTLDAIRLAEQTPGREVVFFAIGFETTTPPTAVMIRIAEHKRLEGLSVFCNHVLTPSAMHRILENPKIRNTGGVPIDGFIGPAHVSTIVGTQPYEPMAEQFEKPIVVAGFEPLDVLQAVLMLVRQVNQNRHEVENQYSRAVTREGNRRAKEEVSQVFELREQFEWRGLGLVPNSGLKLKQSYAKFDAETRFAIHDLRVADNPACECCAILRGAKRPIDCKLFGNICTPETPIGACMVSSEGACAAYWTYRRVRDEQARQTS

SEQ ID NO: 92322 - DNA, 1122 bp, Salmonella enterica subsp. enterica serovar Typhi Ty2
  CDS (1)..(1122): transl_table=11
atgcgttttgttgacgagtaccgtgcgccggaacaggtaatgcagctcattgaacacctgcgtgaacgcgccgcccttcttccttacactgctgaacgaccgctgcgcattatggaagtctgcgggggtcatacccacgcgatttttaaatttggtctcgatcagttactgcccgaaaacgtggagtttattcacggccccggttgtccggtctgcgtgctgccaatgggacgcatcgacagttgcgtggaaatcgccagccatccggaggtgattttctgcacctttggcgatgccatgcgcgtgccggggaaacagggttctctgttgcaggctaaagcgcgcggcgcggatgtgcgtattgtttattctccgatggacgcgctgaagctggcgcaggataacccgacccgcaaagtggtatttttcgggctgggctttgaaaccaccatgccgaccaccgccatcacgctacagcaggcaaaacagcgtgacgtgcgaaacttctactttttctgccagcacattacactgatcccgacgctgcgtagcctactggagcagccggacaacggcattgacgcctttcttgcgccaggccacgtcagcatggtcatcggcaccgaggcgtaccagtttatcgccgccgattttcatcgcccgctggtggtggctggattcgaaccgcttgatctactgcaaggcgtggtcatgctggttgagcagaaaatagcggccctaagccaggttgaaaaccaataccgtcgcgtggtgccggatgccggaaacatgctggcgcagcaggccatcgccgatgtgttctgcgttaatggcgacagcgagtggcgcggcctgggcgtgattgaatcctccggcgtccacctgacgccggagtatcagcgctttgacgccgaagcgcatttccgcccagcgccacagcaggtctatgacgatccgcgcgcccgctgcggcgaagtgctgaccggcagatgcaagccgcatcagtgcccgctatttggtaaaacatgtaatccagagaccgcgttcggcgcgctgatggtctcttccgaaggcgcatgcgccgcctggtatcagtatcgtcagcaggagtgtgaagtttga

SEQ ID NO: 92323 - protein, 373 aa, Salmonella enterica subsp. enterica serovar Typhi Ty2
MRFVDEYRAPEQVMQLIEHLRERAALLPYTAERPLRIMEVCGGHTHAIFKFGLDQLLPENVEFIHGPGCPVCVLPMGRIDSCVEIASHPEVIFCTFGDAMRVPGKQGSLLQAKARGADVRIVYSPMDALKLAQDNPTRKVVFFGLGFETTMPTTAITLQQAKQRDVRNFYFFCQHITLIPTLRSLLEQPDNGIDAFLAPGHVSMVIGTEAYQFIAADFHRPLVVAGFEPLDLLQGVVMLVEQKIAALSQVENQYRRVVPDAGNMLAQQAIADVFCVNGDSEWRGLGVIESSGVHLTPEYQRFDAEAHFRPAPQQVYDDPRARCGEVLTGRCKPHQCPLFGKTCNPETAFGALMVSSEGACAAWYQYRQQECEV

SEQ ID NO: 92324 - DNA, 1125 bp, Streptomyces avermitilis MA-4680
  CDS (1)..(1125)
atgaagtacatcgacgaattccaggacccggaactggcgcgccggctcctcgacgacatccactccacggtgaccaggccgtgggccctgatggaggtctgcggaggtcagacgcacaccatcatccggcacggcatcgaccaactcctcccggaacaggtcgagttgatccacggcccgggctgtcccgtgtgcgtgaccccgctggaggtcatcgacaaggctctggagatcgcctcccggccggaggtgatcttctgctccttcggtgacatgctccgtgtgcccggcaccggtcgcgacctgttccaggtacgcagcgaaggcggcgatgtacgcgtcgtctactcgccgctcgacgccctgcggatcgcgcggcagaacccggaccgcgaggtggtgttcttcggcatcggcttcgagacgacggcaccccccaacgccatgacggtccatcaggcccgtcggctcggcatcccgaacttcagcctgctggtgtcccacgtccgggtgccgcccgccatcgaggcgatcatgtcggcgccgaactgccgcgtccaggccttcctcgcggccgggcacgtgtgcagcgtgatgggcgtgggggagtacccggaactggccgaacgcttccgcgtcccgatcgtcgtgaccgggttcgagccactggacatcctcgaaggcgtacgccgcaccgttctccagctggaacggggtgagcacaccgtcgacaacgcgtacgcccgtgccgtccgcccggagggcaacccggccgcgcaggccatgctcgaggatgtcttcgaggtcaccgaccgggcctggcgaggcatcggtgtgatccccgacagcggctggcggctgtcacccaagtaccgcgaccacgacgccgagtaccgcttctcggtcgacgggatccagacgcgcgaaccggccgaatgccgcagcggcgaggttctgcagggaatgctgaagccgcacgagtgcgaggccttcggcaccgtctgcacaccccgtacccccctgggagccaccatggtctccagcgagggcgcctgcgccgcgtactacctctaccggcgactggacatcaccaccgccgcccgggaggcgagccccgttgtctga

SEQ ID NO: 92325 - protein, 374 aa, Streptomyces avermitilis MA-4680
MKYIDEFQDPELARRLLDDIHSTVTRPWALMEVCGGQTHTIIRHGIDQLLPEQVELIHGPGCPVCVTPLEVIDKALEIASRPEVIFCSFGDMLRVPGTGRDLFQVRSEGGDVRVVYSPLDALRIARQNPDREVVFFGIGFETTAPPNAMTVHQARRLGIPNFSLLVSHVRVPPAIEAIMSAPNCRVQAFLAAGHVCSVMGVGEYPELAERFRVPIVVTGFEPLDILEGVRRTVLQLERGEHTVDNAYARAVRPEGNPAAQAMLEDVFEVTDRAWRGIGVIPDSGWRLSPKYRDHDAEYRFSVDGIQTREPAECRSGEVLQGMLKPHECEAFGTVCTPRTPLGATMVSSEGACAAYYLYRRLDITTAAREASPVV

SEQ ID NO: 92326 - DNA, 1122 bp, Wolinella succinogenes DSM 1740
  CDS (1)..(1122): transl_table=11
atgagtgatcactatctcatcgattcttttcgagacaaagagatcatccaaaaatttgctaagaaaatcgcccaaaatgcctctttattgcctagaaaagtgaaaattatggaggtttgcggggggcacacccacaccatcatgaaatatggactgcttcagcttatgcccaaagaggtggagtttgtccatgggcctgggtgccctgtttgcgtgatgcccaaagagagaatcaatcaagcctatgagattgctctgcaagagggggtgattcttgtcaccttgggagatatgatcaaagtcccgggctctcaagggtcgctccagagcgctagagctctagggcgtgatgttcgattcgtctattcacccctagaggtgctcaaaattgccaaagagaatccccaccaaaaagtggtctttttcgccattggatttgagaccaccacgcctatgagtgcagcgcttttggagcgagccatgggagaaggggtcaaaaacctcctttttcatatcaatcatatcacggttccagagcccgtgagagcgattctagatgatccctcctcaacccttgacgccctcattggcccctcccatgtgagcgtgattgcaggagcgaaaatctatgagcccttggtgcaagactatcgacttcctattgtggtgtcgggttttgaacctgtggatgtgatggagagcgtggatagaatcgtccaccagctggctcaccaagaggctaggctagagattcaatacgcgcgaagcgtcacgatggaggggaatcttaaggctcaggcgatgatagagcgctactttgaaaagcgcgagagcttcacatggcgaggaatcggtcctattccctgctcggctttgcgccttagagaggagtttaaggagtgggacgcggagcgctattttgcctcgattcttcatcatgaagagattcctgatcataaatcttgcaaatgcggcgacatcttaagaggggtggccaagccctttgattgcaaggtttttgccaaggcgtgcaccccagaaaatcctctaggaagctgtatggtgagtagcgagggggcgtgtgcggcctattacaaatatggtcgggagcacctgaattaa

SEQ ID NO: 92327 - protein, 373 aa, Wolinella succinogenes DSM 1740
MSDHYLIDSFRDKEIIQKFAKKIAQNASLLPRKVKIMEVCGGHTHTIMKYGLLQLMPKEVEFVHGPGCPVCVMPKERINQAYEIALQEGVILVTLGDMIKVPGSQGSLQSARALGRDVRFVYSPLEVLKIAKENPHQKVVFFAIGFETTTPMSAALLERAMGEGVKNLLFHINHITVPEPVRAILDDPSSTLDALIGPSHVSVIAGAKIYEPLVQDYRLPIVVSGFEPVDVMESVDRIVHQLAHQEARLEIQYARSVTMEGNLKAQAMIERYFEKRESFTWRGIGPIPCSALRLREEFKEWDAERYFASILHHEEIPDHKSCKCGDILRGVAKPFDCKVFAKACTPENPLGSCMVSSEGACAAYYKYGREHLN

SEQ ID NO: 92328 - DNA, 1116 bp, Corynebacterium diphtheriae NCTC 13129
  CDS (1)..(1116): transl_table=11
atgaagtacgtagatgagttccgcgatcctgaagcagccaaagcacttctgaatcgtatcgaaaaagacgcggcccagcttggcgagatctcgctcatggagatctgtggtggtcacacgcacacgatctatcgctacggcttggaaaatctcctccccgacaacattgacctcgtccatggcccaggttgtcctgtgtgcgtcatccccatgggacgcgtcgacgatgccttgtggttggcttcccaacccaacgtcatcttgaccaccttcggcgatatgatgcgcgttcctggttctaccggctcgcttctcgacgcccgcgcgaacggcgccgacgtccgcttcgtgtactcgcctctcgacgcccttaaagtagccaaggacaatcccaccaaaatggtggtgtttttcgccgtaggttttgaaacgactgccccgtcgactgctgtaacactcgaggcggccaaacgcgagaatgtgaccaactttgcggtgtttagcaaccatgtgaccatcgagccacctctacgtgttttggtcaacgacaccaaagttgatggctttatcggcccaggccacgtggccaccatcgtcggaaccgacacgtttaagttcctccccgaggaatttaacaagcccgttgtcgtcgcaggattcgagcctctcgacgttcttcaaaccgtggacatgctgctccagcagttcctccgcggcacctccgaggtaggaaaccaatacgcccgcgttgtgcgccccgagggcaacactgccgcactcaacttgatgtcacgagtgttccgtgttcgcgagaccttcgaatggcgcggtcttggctggatccccaactctggcctcggaatcgcagacgagtatgcgcagtgggatgcagaaaagcttttcgacgtccccggccgccgaatccccgaccccgtcgcctgcgagtgcggctccgttttgaccggaaaaatcaagccgtggcaatgccgtgtctttggcaccgcctgcaccccgcagacccccatcggaacgtgcatggtatcgcccgaaggcgcctgcgctgcatattacaacttcggacgtatcaaccgtgaggaggccgcggcgctacgctag

SEQ ID NO: 92329 - protein, 371 aa, Corynebacterium diphtheriae NCTC 13129
MKYVDEFRDPEAAKALLNRIEKDAAQLGEISLMEICGGHTHTIYRYGLENLLPDNIDLVHGPGCPVCVIPMGRVDDALWLASQPNVILTTFGDMMRVPGSTGSLLDARANGADVRFVYSPLDALKVAKDNPTKMVVFFAVGFETTAPSTAVTLEAAKRENVTNFAVFSNHVTIEPPLRVLVNDTKVDGFIGPGHVATIVGTDTFKFLPEEFNKPVVVAGFEPLDVLQTVDMLLQQFLRGTSEVGNQYARVVRPEGNTAALNLMSRVFRVRETFEWRGLGWIPNSGLGIADEYAQWDAEKLFDVPGRRIPDPVACECGSVLTGKIKPWQCRVFGTACTPQTPIGTCMVSPEGACAAYYNFGRINREEAAALR

SEQ ID NO: 92330 - DNA, 1212 bp, Cupriavidus necator
  CDS (1)..(1212): transl_table=11
atgaagtacgtcgacgaattccgcgatcccgccaaggcgcaggcgctggcgcgggaaatccgtgatctggtggcaggcatgggccgcgccaggcggcgcccgctgcagatcatggaggtgtgcggcggccatacgcatacgattttccgctacggcatccagcaactcttgcccgacgaggtggagttcgtgcatggcccggggtgcccggtatgcgtgctgccgatggggcgcgtcgacgactgcgtggcgctggccgagcgccccgaagtgatattcacaacgttcggcgacgccatgcgcgtgcccggctcccgcaaaagcctgctcaaggccaaggcggatggcgccgatgtgcggatggtctactcgccgatcgacgcgctggcgctcgcgcgcaaccatccggaccgcgaagtgatcttcttcggcctgggcttcgagaccaccatgccgagcaccgccatgaccgttctgcgcgcgcgggccgagggcgtgcgcaacttctcgctgttctgcaaccacatcacgatcatcccgaccatcaaggccattctcgattcacctgacctgcagatcgacggcttcctcggtccgggccatgtcagcatggtgatcggcacgcaaccgtacgagtttatcgcccggcactaccgcaagccgatcaccgtggcgggcttcgagccgctggacgtgctgcagtcgatgtggatggtcctcaggcagatcgcgcagggccgctgcgaagtggagaaccagtacggacggatcgtgccggcagcgggcaatgcgcaggcgctggcggcgattcaggaagtgttcgagctgcgcgagttcttcgaatggcgcggactgggctcgatcgacttctcgggtgtgcggatgcgcgaggcattctccgcgttcgacgccgagcgcaagttcaccgtgcccgacgtcaagatcgccgaccccaaggcctgccagtgcggcgaggtgctcaagggcgtgatcaagccccatcaatgcaaggtgttcggcaccgcctgcacgccggagtcgccgctggggtcgctgatggtctcgagcgagggcgcctgcgcggcgtactaccattactgccgcatcgacacctcccggctcgggcgacatggcgcgcgagcggccgggcaaacggcaaccagggatgcggttgccaacgagcgggccgcagccggagccggccatgaatga

SEQ ID NO: 92331 - protein, 403 aa, Cupriavidus necator
MKYVDEFRDPAKAQALAREIRDLVAGMGRARRRPLQIMEVCGGHTHTIFRYGIQQLLPDEVEFVHGPGCPVCVLPMGRVDDCVALAERPEVIFTTFGDAMRVPGSRKSLLKAKADGADVRMVYSPIDALALARNHPDREVIFFGLGFETTMPSTAMTVLRARAEGVRNFSLFCNHITIIPTIKAILDSPDLQIDGFLGPGHVSMVIGTQPYEFIARHYRKPITVAGFEPLDVLQSMWMVLRQIAQGRCEVENQYGRIVPAAGNAQALAAIQEVFELREFFEWRGLGSIDFSGVRMREAFSAFDAERKFTVPDVKIADPKACQCGEVLKGVIKPHQCKVFGTACTPESPLGSLMVSSEGACAAYYHYCRIDTSRLGRHGARAAGQTATRDAVANERAAAGAGHE

SEQ ID NO: 92332 - DNA, 1143 bp, Rhodopseudomonas palustris CGA009
  CDS (1)..(1143): transl_table=11
atgaaatacgtggacgaatatcgcgacggcaaggtggcgcggcagatcgcggcggcgatcgcacaggcggccgatccatcgcgcagctatcacttcatggagttctgcggcggccacacccacgcgatctcgcgctatggcctggaagacctgctgccgccgaatgttcggatggtccacggccccggctgtccggtctgcgtgctgccggtcggccggatcgacatggcgatccagctcgcgcagcgcccagaggtgacgctgtgcacctatggcgacctgatgcgggtgcccggttcgcatggcacctcgctgctgcgcgccaaggcggccggcgccgacatccgcatggtgtattcgacgctggatgcgatcgcgatcgccgaggtggagccgaaccgcgaggtggtgttcttcgccatcggtttcgaaaccacgacgccgccgaccgcattggcgatcaagctcgcggccgccaagcggctgaccaattttagcgtgttctgcaaccacgtgctgacgccgccggcgatccgcggcatcctcgaacatcccgatctcgatggtcagccggggccgcgcctcgacggcttcatcggtcccgcgcatgtcagcgcagtgatcggcgccgatgcgttcgccgagttcgcgcgcgattttgccaagccggtggtggtcgccggcttcgaaccgctcgatgtgatgcagtcgatcctgatgctggtgcagcaggtcaatgacggccgccacgtcgtcgagaaccagtacatccgcgcggtgacgccggggggcaaccgcatcgcgcaggctgaagtcgcggcgatcttcgagctgcgcgacagtttcgaatggcgcggcttcggccgcgtgccggcgagcggcctgcggttgcgcgaggcctatgcggccttcgacgccgagcgccgcttcgcgatggcggagatctccgccgccgacaatccggcttgcgactgcggcgcgatcctgcgcggcatcaagcgtccgaccgattgcaaattgttcggcacgctatgcacgccggagacgccgatgggatcttgcatggtgtcttcggaaggcgcctgcgcagcgcattggacctacggtcgcttccgcgaccacgcacggagggcggtggcatga

SEQ ID NO: 92333 - protein, 380 aa, Rhodopseudomonas palustris CGA009
MKYVDEYRDGKVARQIAAAIAQAADPSRSYHFMEFCGGHTHAISRYGLEDLLPPNVRMVHGPGCPVCVLPVGRIDMAIQLAQRPEVTLCTYGDLMRVPGSHGTSLLRAKAAGADIRMVYSTLDAIAIAEVEPNREVVFFAIGFETTTPPTALAIKLAAAKRLTNFSVFCNHVLTPPAIRGILEHPDLDGQPGPRLDGFIGPAHVSAVIGADAFAEFARDFAKPVVVAGFEPLDVMQSILMLVQQVNDGRHVVENQYIRAVTPGGNRIAQAEVAAIFELRDSFEWRGFGRVPASGLRLREAYAAFDAERRFAMAEISAADNPACDCGAILRGIKRPTDCKLFGTLCTPETPMGSCMVSSEGACAAHWTYGRFRDHARRAVA

SEQ ID NO: 92334 - DNA, 1092 bp, Geobacter sulfurreducens PCA
  CDS (1)..(1092): transl_table=11
atgaattaccaggacgagtttcgcgatcgggccctggtgcaggggtatgcgcagcgcatcgcccggttggtggagggacgcacggacgtcatgaccttcatggaggtctgcggcacccacaccatgtcgatctaccagtacggcctccgcagcctcctgccgccccaggtgcggctcatctccggcccgggctgccccgtctgcgtgacccccaacgaatacctggaccgggccgtggccctctgccgtctccccggtgtcatcgtcgccaccttcggcgacatggtccgggtgccgggctcctcctcgtcgctccaagaggagcgggccatgggggcagacgtgcgcatcgtctattccccgctcgacgccgttgccctggcggcggcgaatccggaccggaaagtggtttttctcggggttggtttcgaaaccacggctccggccatcggcggaagcattctcgcggcccggaagcaggggcttgccaactacttcgtcctggctgcccacaagaccatgccgatccccatgcgtgttctggccaatgaccccgagctcggcatcgacggctacctgtgcccggcccacgtcagcactataatcggtgccgacgcgtaccgcttccttcccgaggagttcggcatcccctgtgtggtaacgggcttcgagccggtcgacgtcatgcagggggtggagatgcttgtccgccaggtcgtggagggaaagccccgggtcgagatccagtacagccgtgtggccacctgggaggggaaccgcaaggccctggacgtactcgcccaggtattcactccctttgacgcaccctggcgggggatcggcatcattccgggaagtggcctccggatcgccgatgcctacgccgccttcgacgccgagcgggagatcgcggtggaggtcgaagagaccaaagagcaccaggggtgtctctgcggggagatcctcaaggggaaagtgacacccttcgactgtcccctgtttgccaacgcctgcacccccgagtcgcccgtgggcgcctgcatggtttccagcgaggggacctgcgcggcggcctacaagtacgggcaataa

SEQ ID NO: 92335 - protein, 363 aa, Geobacter sulfurreducens PCA
MNYQDEFRDRALVQGYAQRIARLVEGRTDVMTFMEVCGTHTMSIYQYGLRSLLPPQVRLISGPGCPVCVTPNEYLDRAVALCRLPGVIVATFGDMVRVPGSSSSLQEERAMGADVRIVYSPLDAVALAAANPDRKVVFLGVGFETTAPAIGGSILAARKQGLANYFVLAAHKTMPIPMRVLANDPELGIDGYLCPAHVSTIIGADAYRFLPEEFGIPCVVTGFEPVDVMQGVEMLVRQVVEGKPRVEIQYSRVATWEGNRKALDVLAQVFTPFDAPWRGIGIIPGSGLRIADAYAAFDAEREIAVEVEETKEHQGCLCGEILKGKVTPFDCPLFANACTPESPVGACMVSSEGTCAAAYKYGQ

SEQ ID NO: 92336 - DNA, 1083 bp, Methanococcus maripaludis S2
  CDS (1)..(1083): transl_table=11
atggatgcaaagatcatgaacatcaataataaagaattaattaagaaatctattcagacaatccaaaaactctctgaaaaactggacgaagtaaaaataatgcacgtttgtggttcacatgaacatacaatctgcaaatatggaataagagacgttttacccgataatattacggtagttccaggacccggatgccctgtgtgtgttacaacacaaaaagaaatcgataaagcaatgtatcttgcagaacagggatatactattgcaacgttaggagatatgtatagggtcccaggaagtaaaaaatcattaatgcaacttcaatcggaaggagcagatgtaaaaatcgtttacggaattggagatgctgtaaaacttgcaaaaaaacaggatgaaaaggtagtatttgttgcaatcggatttgaaactactgctccaacaactgccgcagaactactaaataaacctgaaaatttctacatattaaattcacacaggcagaccccaccagtaatgggatttttactcggcggtggaacttcacttaacctagatggatttatatgtcctggccacgtttcaacgattacaggtttaaaaccatactacgacccttgtaagacgtaccatgcaccaatggttgttgctggctttgaaccaattgatgtaatggcttcaatcgtgatgattttaaaacagctcgtaaatggtgaagcaaaagttgaaaatgagtacacgagaggagtgagggaagaaggaaacgttattgctcaaaaaattatgaataaagtttttgaacccgctgatgttgcatggagaggctttccagtcattaaagacggcggtatgaaattaagagaagaattcaaaaaatacgatgttcatgaaaatattgatgttccagacattaaagaaacaataaacaaagcctgcatttgcagtgaaattttaaggggagaaaaacttccgcacgactgtaaactctttggaaaaacttgtgatccgatgaatcctgttggaagctgcatggtttctgacgaaggaacttgcagaatcttttacaaatacagcaaattcagataa

SEQ ID NO: 92337 - protein, 360 aa, Methanococcus maripaludis S2
MDAKIMNINNKELIKKSIQTIQKLSEKLDEVKIMHVCGSHEHTICKYGIRDVLPDNITVVPGPGCPVCVTTQKEIDKAMYLAEQGYTIATLGDMYRVPGSKKSLMQLQSEGADVKIVYGIGDAVKLAKKQDEKVVFVAIGFETTAPTTAAELLNKPENFYILNSHRQTPPVMGFLLGGGTSLNLDGFICPGHVSTITGLKPYYDPCKTYHAPMVVAGFEPIDVMASIVMILKQLVNGEAKVENEYTRGVREEGNVIAQKIMNKVFEPADVAWRGFPVIKDGGMKLREEFKKYDVHENIDVPDIKETINKACICSEILRGEKLPHDCKLFGKTCDPMNPVGSCMVSDEGTCRIFYKYSKFR

SEQ ID NO: 92338 - DNA, 1098 bp, Desulfovibrio vulgaris subsp. vulgaris str. Hildenborough
  CDS (1)..(1098): transl_table=11
gtgagcgtcgatttcacctcttcgttcaaggaccccgcgctgtgtcgcgggctgctcgaccggctgcaccgggaactggacaggcctctgcggttcatggaggtgtgcggtacgcacaccgtggccatcttccagagtggcatccgtccgcttctgcccgagggcgtccgccatctttccgggccggggtgcccggtctgcgtcacccatgaaagtgaggtggcggcgtatctccagcttgcggaacgcggcgacgtcatcatcgccaccttcggcgacctcatgcgcgtaccgggccccggcgggcgcaatctcaagctggcacaggcgcagggcgcacgcatcgaggtggtgtactcctcgttcgacgcgctgaagctggctgcggacaaccccggcgagaaagtcgtcttcctcggcatcggcttcgagaccaccgcacccaccgtggctggcactgtgcagatggcccgtgcacaggggctggacaatttcatggtgctctcgttccataaactggtgccgcccgcgttgcgcgccctgctggtcgacccggaatgtgccgtcgacgccttcctgctgcccggccacgtctccacggtgctgggcatcgaaccctatcgcttcgtggccaccgaattcggtacgccgggggtcatcgccggtttcgaccctgtggacatccttcaggcgttgctcatcatggtcgaacagcgcaagacgggagagtatggcatcgtcaacgcctaccgtcgcgcagtggacgatgcgggcaacccgcgggcacgacaggtcatggacgacgtgttcatgcagtccgatgcgctgtggcgtggcatcggcctcctgccgggcagcgggctggtcttccgccccgagtatgcaaggttcgacgccatgcagcgtctgggactgactctgcccgaagcgcgcgatacgcccggttgcaagtgcggtgatgtgctcaagggcaagatgcagcccaacgaatgtcctcttttcggcaaggcctgcgtgcccgcaaaaccggtgggcccgtgcatggtctccaccgaaggcagctgtgccgcctactacaaatacaacgtcgaggcgtaa

SEQ ID NO: 92339 - protein, 365 aa, Desulfovibrio vulgaris subsp. vulgaris str. Hildenborough
MSVDFTSSFKDPALCRGLLDRLHRELDRPLRFMEVCGTHTVAIFQSGIRPLLPEGVRHLSGPGCPVCVTHESEVAAYLQLAERGDVIIATFGDLMRVPGPGGRNLKLAQAQGARIEVVYSSFDALKLAADNPGEKVVFLGIGFETTAPTVAGTVQMARAQGLDNFMVLSFHKLVPPALRALLVDPECAVDAFLLPGHVSTVLGIEPYRFVATEFGTPGVIAGFDPVDILQALLIMVEQRKTGEYGIVNAYRRAVDDAGNPRARQVMDDVFMQSDALWRGIGLLPGSGLVFRPEYARFDAMQRLGLTLPEARDTPGCKCGDVLKGKMQPNECPLFGKACVPAKPVGPCMVSTEGSCAAYYKYNVEA

SEQ ID NO: 92340 - DNA, 1119 bp, Erwinia carotovora subsp. atroseptica SCRI1043
  CDS (1)..(1119)
atgcatcttgtcgatgaataccgcgatcccgagaaagtgatggcgcttattgcccaccttaaccagcgggccccgatgctttcttataccaaacagcgtccattgcgcattatggaggtctgcggaggccatacgcacgcgatataccgctttggtattgatcaactgttgccggaaaatattgaatttattcacggcccaggctgcccggtgtgcgtcctgccgatggggcgtatcgacaactgccttgagatagccagccatccagaaacgcttttttgtaccttcggtgacgccatccgtgttccggggaaaaatggctctttactggatgcccgcgcccacggagcagacatccgcgtggtttactcccctctggatgcactaaaactggctcgcgataatccgcagcgcaaagtggtatttttcgccctggggtttgaaaccaccatgccagcaaccgcactcaccctgcaacaagccaaggccgatggcgtcgacaatttttaccttttttgtcagcacattactatcatccccaccctacgcagcctgctgttacagccggataacagcattgacgcttttatcgcgccgggacatgtcagcatggtaatcggggttgatgcttaccagtttatcgccactgaattccagcgaccgttggtcatagcaggatttgaaccggttgacctgctgcaaagtgttctcatgttgatcgagcaaaaactcgccggtcaacctgatattgaaaatcagtaccgccgtgtggtgccagatgcaggcaacacgctagcgcaaaaagcgatagcggatgttttcatgctgaaaggtgacgccgaatggcgtggtttggggattattggtgaatccggcgtgacattaaccccagattaccagcagttcgatgcggaacgttattttcgcctacagccgcaagaaaccagtgacgatccgcgggcatgctgtggagacgtattaaccgggcgctgtaaaccccaccaatgttcgctcttcggcacaatctgcacgccacaaagtgccttcggtgcgctgatggtttcttccgagggcgcgtgcgccgcctggtatcaatatcgcgcacaggagactgcatga

SEQ ID NO: 92341 - protein, 372 aa, Erwinia carotovora subsp. atroseptica SCRI1043
MHLVDEYRDPEKVMALIAHLNQRAPMLSYTKQRPLRIMEVCGGHTHAIYRFGIDQLLPENIEFIHGPGCPVCVLPMGRIDNCLEIASHPETLFCTFGDAIRVPGKNGSLLDARAHGADIRVVYSPLDALKLARDNPQRKVVFFALGFETTMPATALTLQQAKADGVDNFYLFCQHITIIPTLRSLLLQPDNSIDAFIAPGHVSMVIGVDAYQFIATEFQRPLVIAGFEPVDLLQSVLMLIEQKLAGQPDIENQYRRVVPDAGNTLAQKAIADVFMLKGDAEWRGLGIIGESGVTLTPDYQQFDAERYFRLQPQETSDDPRACCGDVLTGRCKPHQCSLFGTICTPQSAFGALMVSSEGACAAWYQYRAQETA

SEQ ID NO: 92342 - DNA, 1089 bp, Desulfotalea psychrophila LSv54
  CDS (1)..(1089): transl_table=11
atgaaacatattgacgaatatcgagacgccaagctcgccaaaccactggtcgccgagctcagaaggtcagtaaccaagcccctgcgcataatggaagtctgtggctcccacaccatgtcaatttttcgcaacggtatccgttcaatcctacccgagggaatggagttgctgtcgggccccggatgtcccgtttgcgttacctctgccgcccatatggatgcctttatctccatagccgaaagagatggggtacgggtcgccatcttcggtgatctcttccgggtaccgggaagccaagggtcgctagccaacgccagttcccgcggggccaaggtagacattgtctactcacccatggacgccctggaaattgccaagaacaatccagacgaactggtggtctttctcggcgttggttttgaaacaaccaccccgacaattgccgccaccatcatggcggccaagatacaaaagattaagaattttgctgttttttccacccaaaaaacaatgcctgcccccctgattgccctgcttcaggaccccgaactcaaaatcgacggtctgctctgccccggccatgtttctgccattatcggctcagaggtctacgaacccctggcccgggactataatcttgcctgtgtggttgccggttttgaaaccgctgacatccttggcagcctcatccaactggccagacaggtaaacgcaggcgagttcaaggtagaaaactgctacaacagggtagtatgcaaagatggcaatccacgtgcacgagccatggtcgaacgcatctttgagccctgcgatatgcagtggcgcggccttggcatgattccggaaagtggtttgaaaatccgggaagaatatggtgagtttgatgcagagagacgtttagagatagagctaacagaagtagcggagcccaagggttgtctctgtggagaaatacttaagggccagaccatccccccacgctgccctctcttcaacaaaggttgtacgccaatgaacccggtgggtccctgcatggttagtagcgaaggcacatgtgccgcctattacaaatatggccaggacctgtag

SEQ ID NO: 92343 - protein, 362 aa, Desulfotalea psychrophila LSv54
MKHIDEYRDAKLAKPLVAELRRSVTKPLRIMEVCGSHTMSIFRNGIRSILPEGMELLSGPGCPVCVTSAAHMDAFISIAERDGVRVAIFGDLFRVPGSQGSLANASSRGAKVDIVYSPMDALEIAKNNPDELVVFLGVGFETTTPTIAATIMAAKIQKIKNFAVFSTQKTMPAPLIALLQDPELKIDGLLCPGHVSAIIGSEVYEPLARDYNLACVVAGFETADILGSLIQLARQVNAGEFKVENCYNRVVCKDGNPRARAMVERIFEPCDMQWRGLGMIPESGLKIREEYGEFDAERRLEIELTEVAEPKGCLCGEILKGQTIPPRCPLFNKGCTPMNPVGPCMVSSEGTCAAYYKYGQDL

SEQ ID NO: 92344 - DNA, 1107 bp, Desulfotalea psychrophila LSv54
  CDS (1)..(1107): transl_table=11
gtggacgtgataaaccaacttccaagcccagaagcattgcttgaagagctgcatcgtgttgtaagtaagcccattcgtttaatggttgtttgtggtacccataaccgagccatccttcggtatggaatcagagaagagttacccgattttatcgaacttgttgctggacctggttgtagcgtctgtgtgatgccgacgggacatgttgacgcctttgttaaggttgcccgccagccggacgttattactgccacctgtgaagacctgttgaaggtacgcgggagcaaggagtctttggccgatgtcctcaatgagggagtgcaccgtgttgaaattatctcttctcctcgtcaggcccttgagctggcctatgtagaggaggataagattgttgtttatcctgccgtgggttttgaggctacggctcccagtattgccgagactattttagaggcggcccaaaatggggtgggaaatttttgtgttattccttccattcgcctgcttccaccaaccattgatgccctcctccttgatccccagttgagtattcagggattgctctgttcagatcatatcaataccatttctgacaccgaagcctatgccgatcttgcccgtaaacatagcctgagctgttgtattgcaggttttgaaaaggcagagattctacaggggattctcagcatggttaagcagatccatcgtggtgaatccatggtggatgccagtggtgccatggtttattcaatggaagagacagcccgggcccggagggtggtggaagaggttttctttccaacggaaacggcttggagaggtttgggctctattgctgagagtggttttgttatccgtgatgagttggccctctatgacgccactaaacgttttaatgttcgttttgctgagggtacggatcaatgcatgtgtcactgtaatgaaattatttctggacgcgccctgccgcctgactgtcctgcctttggtatggcctgtaccctgcagaatcccgtggggccctgtatgatttccaatgagggcatttgtgctgcatactttaagtataagttggagtcttccagattttcccgtttagatgtctag

SEQ ID NO: 92345 - protein, 368 aa, Desulfotalea psychrophila LSv54
MDVINQLPSPEALLEELHRVVSKPIRLMVVCGTHNRAILRYGIREELPDFIELVAGPGCSVCVMPTGHVDAFVKVARQPDVITATCEDLLKVRGSKESLADVLNEGVHRVEIISSPRQALELAYVEEDKIVVYPAVGFEATAPSIAETILEAAQNGVGNFCVIPSIRLLPPTIDALLLDPQLSIQGLLCSDHINTISDTEAYADLARKHSLSCCIAGFEKAEILQGILSMVKQIHRGESMVDASGAMVYSMEETARARRVVEEVFFPTETAWRGLGSIAESGFVIRDELALYDATKRFNVRFAEGTDQCMCHCNEIISGRALPPDCPAFGMACTLQNPVGPCMISNEGICAAYFKYKLESSRFSRLDV

SEQ ID NO: 92346 - DNA, 1113 bp, Mannheimia succiniciproducens MBEL55E
  CDS (1)..(1113): transl_table=11
atgcagttcgtggatgaatttcgcgatcctaaattggctaaacatttagttgaacgattaacaaaattaatgaaaaatttaccgcagttttcggcaaaaaatccattgtatttaatggaagtctgcggcgggcatactcatagtatttttaaattcggtttagatcggttattgcccgagtctatcgaatttatacacggaccgggttgcccggtttgcgtgttgcctatggggcggattgacctgtgtattgagattgcacaaaatcccaatgtgattttttgcacttttggcgatgccatgcgggtaaaagggcgtaaaggttccttgctggaagcaaaagcccagggttgtgacgtacgcattgtttattctccgctggatgcgttaaatatcgccttaagcaatcccgataaaaaagtggtatttttttcgcttggttttgagactacaatgcccgccgccgccgtgactttgcaacaggcaaaacggcggaatattgccaatttttggatcgtttctcaaaacattactattattccaacattgcgcagtttgctttcgcaggatcaaattaaaattgacggttttattgcgccgggtcatgtgagtatggtgattggctccgcaccttatagggaactttgtaaaaaattccgtaaaccttttgtaatcgccgggtttgaacctttagatattctgcaatctattgttatgttggtagagcagtttgcggacgggcgttgcgaagttgaaaatcaatataagcgaatcgtgcacgaacagggcaatatgttggcgcaaaaagctatggcggaagtgtttcaacttaaagcccgcagcgaatggcgaggtcttggtgaaattgaagaatccggcgtggaattaaccgtcgattatcgccgctttgatgcggagatctactttaacagtaaggcgcagcaagtcgccgatgatccgaattcccgttgcggcgatgtgctaaccggcaaatgcaaacctgccgactgcccgttatttggcagtgactgtaaccctgataacgcttacggcgcattgatggtttcttcggaaggtgcctgtgcggcttattatcagtatcgcagagagtaa

SEQ ID NO: 92347 - protein, 370 aa, Mannheimia succiniciproducens MBEL55E
MQFVDEFRDPKLAKHLVERLTKLMKNLPQFSAKNPLYLMEVCGGHTHSIFKFGLDRLLPESIEFIHGPGCPVCVLPMGRIDLCIEIAQNPNVIFCTFGDAMRVKGRKGSLLEAKAQGCDVRIVYSPLDALNIALSNPDKKVVFFSLGFETTMPAAAVTLQQAKRRNIANFWIVSQNITIIPTLRSLLSQDQIKIDGFIAPGHVSMVIGSAPYRELCKKFRKPFVIAGFEPLDILQSIVMLVEQFADGRCEVENQYKRIVHEQGNMLAQKAMAEVFQLKARSEWRGLGEIEESGVELTVDYRRFDAEIYFNSKAQQVADDPNSRCGDVLTGKCKPADCPLFGSDCNPDNAYGALMVSSEGACAAYYQYRRE

SEQ ID NO: 92348 - DNA, 1101 bp, Methylococcus capsulatus str. Bath
  CDS (1)..(1101): transl_table=11
atgagcgacgcacggctttggctggagcggatcagggagctgccgattccggacggtatccgcatcatgaacgtctgcggcgggcacgagcgctcgatcagcatggcgggattgcgtaccgccctgccgcccgccatccgcctgatccccggccccggctgcccggtctgcatctgcccggaggaagacatctatcaggccatccggctcggtctcgagggcgaggccgtcgtcgccaccttcggcgacatgctgcgggtgccggtcaacctcgggcgccaggccgtgcgcacgctggaacaggccaaggcggcaggcgccgacatccggcccatcgcctcgcccatcgaggcacggatcatcgccgaaaaggcggccggcaagccggtggtactgttcgcggtcggcttcgagaccaccatggcgccggtcgccgccctgatggccgaaggactgcccgacaacctctacatcctgtgcagcggccggttgacctggccggcggtcaagctgctgctcgattccgacgaatgcgtgctggacgccctggtcgcgcccggccacgtggccacggtgatggggccggaagaatgggccttcgtcgccgacgactaccgcttgccggtggcgatcgccggcttcacccccgccagcctgctccgggccatccactcgacgatcgtccagtggctggaggaaacgccgcggctggacaattgctatccggaggcggtgaagccggggggcaatccgaaggctcgggaattcctggaccgcagcttcgacgtcgccgccggcaactggcgcggcatcgggccgatcgcggcttcggcctacgcgctgaagccgggattcgccgcgcacgacgcccgcctgcatttccccgactacgacgcgggcgaccggcgccatgccggcgagatgccggcgggctgcgactgcgcccgcgtcgtgctcggcaggatccagccggacgagtgccgcatctacggcaaaccctgcagcccccgcagcccggtcgggccctgcatggtctcggacgaaggcgcctgccggatctggtgggcggccggcgtgcgcaaggactccgccgccgcctga

SEQ ID NO: 92349 - protein, 366 aa, Methylococcus capsulatus str. Bath
MSDARLWLERIRELPIPDGIRIMNVCGGHERSISMAGLRTALPPAIRLIPGPGCPVCICPEEDIYQAIRLGLEGEAVVATFGDMLRVPVNLGRQAVRTLEQAKAAGADIRPIASPIEARIIAEKAAGKPVVLFAVGFETTMAPVAALMAEGLPDNLYILCSGRLTWPAVKLLLDSDECVLDALVAPGHVATVMGPEEWAFVADDYRLPVAIAGFTPASLLRAIHSTIVQWLEETPRLDNCYPEAVKPGGNPKAREFLDRSFDVAAGNWRGIGPIAASAYALKPGFAAHDARLHFPDYDAGDRRHAGEMPAGCDCARVVLGRIQPDECRIYGKPCSPRSPVGPCMVSDEGACRIWWAAGVRKDSAAA

SEQ ID NO: 92350 - DNA, 1107 bp, Legionella pneumophila str. Paris
  CDS (1)..(1107): transl_table=11
gtgaaatacatagaagagtttcgtaacggtgcttacgcacaagccattatcaatgaaattatcgcaacagcagagccgcaaagacattatcagtttatggagttttgtggaggccatactcatgctattcatcgttatgggattccaagtttgcttcccaacaatgttgaaatgattcatggccccggttgtcctgtttgcgttttgcctatagcgagaattgataaggctattgcgcttgcctcaatgcagcaagtgatcctgtgcagttatgctgacatgttgcgtgtcccgggaagtgggcaaaaaagtttgttaaccaccaaagcatgtggcgctgatgtcaggatgatctattctgcgaatgatgcattaaaaatcgctcaggaaaaccccgataaagacgttgtgttttttgctataggctttgaaacaacaacacctcccactgcttttgtcattaagcaagctaaaaaattaaacatcactaatttcagtgtattttgtaaccatgtgctaactcccattgctatggatagtttgctgcaggccaatgaagttgccttggacggttttgttggcccagctcatgtcagtatcgtgattgggagttttccttatgagcaagtttgtaaaaaataccaaaaacctatcgtgatatcagggtttgagccactggatgtgttgcattctattctgatgttaattcaacaattgaaagaggggcgttgtgatgtggaaattcaatacactcgtgcagtgaatcgtaagggtaatcttttgtcacaatgcatcatggctgaagtcctggaaatacgcgatcgttttgaatggcgtggtttgggttttattccatccagcgcattaaagatcaaagagtctttttctgagtttgatgctgaacagcgtttcgaattaccggagagtgcagcgcaggaacataagcaatgtctttgtggtgaggtattaagaggagtaaaaaaaccaactgattgcaaattatttgccaaggcttgcttgccagaaaatcctttaggatcctgtatggtttcatcggagggagcttgtgcagcagtttatgcttatggacgggttaatgctttatga

SEQ ID NO: 92351 - protein, 368 aa, Legionella pneumophila str. Paris
MKYIEEFRNGAYAQAIINEIIATAEPQRHYQFMEFCGGHTHAIHRYGIPSLLPNNVEMIHGPGCPVCVLPIARIDKAIALASMQQVILCSYADMLRVPGSGQKSLLTTKACGADVRMIYSANDALKIAQENPDKDVVFFAIGFETTTPPTAFVIKQAKKLNITNFSVFCNHVLTPIAMDSLLQANEVALDGFVGPAHVSIVIGSFPYEQVCKKYQKPIVISGFEPLDVLHSILMLIQQLKEGRCDVEIQYTRAVNRKGNLLSQCIMAEVLEIRDRFEWRGLGFIPSSALKIKESFSEFDAEQRFELPESAAQEHKQCLCGEVLRGVKKPTDCKLFAKACLPENPLGSCMVSSEGACAAVYAYGRVNAL

SEQ ID NO: 92352 - DNA, 1107 bp, Legionella pneumophila str. Lens
  CDS (1)..(1107): transl_table=11
gtgaaatacatagaagagtttcgtaacggtgtttacgcacaagccattgtcaatgaaattattgcgacagcagatccgcaaagacattatcagtttatggagttttgcggtggccacacgcatgctattcatcgttatgggatcccgagtttgcttcccaacaatgttgaaatgattcatggccccggttgtccggtttgtgttttgcctgttgcgagaattgataaggctattgcgctggcctcgatgcctcaagtgatactgtgcagctacgctgacatgctgcgagttccgggtactggacaaagaagtttgttaaccgccaaagcaggcggggctgatgtcaggatgatttactctgcggatgatgcattaaaaatcgctcaggaaaatcccgataaagacgttgtattttttgctataggctttgaaacaacaacccctccgactgcttttgtcatcaagcaagctaaaaaattaaacatcactaatttcagtgtattttgtaaccatgtgttaactcccattgctatggatagtttgctacaggccaatgaagttgccctggacggctttgttggcccagcccatgtcagtattgtgataggaagctatccttatgagcatgtgtgtaaaaaataccaaaagccgatagtgatatcagggtttgaacccttggatgtgttgcattctattctcatgttaattcaacaattgaatgaggggcggtgtgaagtggaaattcaatatactcgtgcagtgaatcgtacgggtaatcttttgtcgcaacacatcatggctgaaatcctggaaatacgggatcgttttgaatggcgtggtttgggttttattccatccagcgcgttaaaaatcaaagagtctttttctgaatttgatgctgagcagcgttttgaattacctgatagtgcagcacaggaacataagcagtgtctttgtggagaggtattaagaggagtaaaaaagccaactgattgcaaattgtttgctaaggcttgcctgccagaaaatcctttaggatcctgtatggtttcatcagaaggagcttgcgctgctgtttatgcttatggacgggtgaatgctttatga

SEQ ID NO: 92353 - protein, 368 aa, Legionella pneumophila str. Lens
MKYIEEFRNGVYAQAIVNEIIATADPQRHYQFMEFCGGHTHAIHRYGIPSLLPNNVEMIHGPGCPVCVLPVARIDKAIALASMPQVILCSYADMLRVPGTGQRSLLTAKAGGADVRMIYSADDALKIAQENPDKDVVFFAIGFETTTPPTAFVIKQAKKLNITNFSVFCNHVLTPIAMDSLLQANEVALDGFVGPAHVSIVIGSYPYEHVCKKYQKPIVISGFEPLDVLHSILMLIQQLNEGRCEVEIQYTRAVNRTGNLLSQHIMAEILEIRDRFEWRGLGFIPSSALKIKESFSEFDAEQRFELPDSAAQEHKQCLCGEVLRGVKKPTDCKLFAKACLPENPLGSCMVSSEGACAAVYAYGRVNAL

SEQ ID NO: 92354 - DNA, 1092 bp, Campylobacter jejuni RM1221
  CDS (1)..(1092): transl_table=11
atgaatttcatcgatgaatttagagataaagaaagcattttagctttaaaaaaacttatagaacaagaacttaaaaatcctatcaatatcatggaaatttgcggtgggcatacgcatagtattatgaaatatgccctgccttctattttgccaaaggaaattaactttatccatgggccaggatgtcctgtttgtgttatgccaagagttcgcattgatacagctattaagctagcctccatgaaagatacgattttttgtaccttaggggatcttttaagggtgcctggaagtgaaatttctttactggatttaagagctaaaggggctgatgttagagcactttattctccgcttgaagttttggaaatcgctaagcaaaatttaaacaaaaatatcatcttttttgctataggttttgaaaccactacgcctatgagtgctttacttcttcaaaaggttatagaagaaaaaataaataatgtcttttttcatatcaatcatatcacggttccagcacctgtggaagcgatcatgaatgatgaaaatgtaaaaatcaatgcttttttaggcccttctcatgtgagtgtgataacaggttatggtatttatgagcctttagcagcaaagtttaaaacccctatagcggtgagtggttttgagccagttgatattttagaaagtgtgttaaatatcataaaacaaagcaatgaaggcacttttaaagtgtataatcaatacaaaagagccgtaagcaaagaaggcaatgttaaagcacaaaatttagtaaaaaaatactttagggtgtgtgattttgaatttcgtggcttaggacttattaaaaatggaggcttggagttaaaagaagaatttagcgcttacgatgcgagtaaaaaatttgattgtacggtgcaaagtaaaaatgaaagcaaagcctgtatttgtgggcaaattttaagaggtttggccaagccttatgattgtaaagtttttggcaaggcttgtacgccaagaagtcctataggaagttgtatggtttctggcgagggtgcttgtgcggcgtattataaatactcaaaggtgaatgcatga

SEQ ID NO: 92355 - protein, 363 aa, Campylobacter jejuni RM1221
MNFIDEFRDKESILALKKLIEQELKNPINIMEICGGHTHSIMKYALPSILPKEINFIHGPGCPVCVMPRVRIDTAIKLASMKDTIFCTLGDLLRVPGSEISLLDLRAKGADVRALYSPLEVLEIAKQNLNKNIIFFAIGFETTTPMSALLLQKVIEEKINNVFFHINHITVPAPVEAIMNDENVKINAFLGPSHVSVITGYGIYEPLAAKFKTPIAVSGFEPVDILESVLNIIKQSNEGTFKVYNQYKRAVSKEGNVKAQNLVKKYFRVCDFEFRGLGLIKNGGLELKEEFSAYDASKKFDCTVQSKNESKACICGQILRGLAKPYDCKVFGKACTPRSPIGSCMVSGEGACAAYYKYSKVNA

SEQ ID NO: 92356 - DNA, 1095 bp, Dehalococcoides ethenogenes 195
  CDS (1)..(1095): transl_table=11
gtgaatttcatagaggaattccgcagcagccagtcaggacgcaccctgctggaatatataaacaaacgttccaccaagcctgcccgctttatggagttttgcggcgggcataccgtagccattttccgctacggcatccgccagctgctgccgccccatattgaaatgctgtcagggccgggctgccctgtttgtgtaacctctaccgccgacctggacaaagtcatagccctgtccaggctgccaggggttataatctgctcattcggagacctgctaagggttccctccagccgccaaagcctgctggaagtgcgggcggaaggggcggacgtacgtattgtctactctaccatggacgcactggagatagcccgccagaaccccttgaaaaaggttatctttgtgggtataggttttgaaaccaccgcccccaccattgccgcttcggtaatacaggctcgtaatcaggggcttgctaattattatgtaatgtcaattcacaaaataacccctcccgttatgcgggcgatactggatgcaggtgaaacccgcctttcgggcataatctgccccggccatgtttcttctattaccggcagcaatgcctgggaatttattccagaggaataccatctggcttgtgccgtgtcaggctttgaaagcctggacatactctactgtgttaagtctctggtagaccaggtggaagacgcaactccccgtctggacgtcagctattcacgggcagtcaaacctgaaggcaatactgccgcccttaagattatggatgaagtatttgatatctgcccggccaactggcgggggataggtattttaccccaaagcggcctctgcctgcggcctgaatttgccgcttttgatgccgaaaaaaactttgagataaaactttccgagcccagccgcgaaacacccggctgtctgtgcggtgaaattatcaaaggcacccggacacctctggaatgcaagcttttttcaaaggtctgcaccccggaaaacccggtcgggccgtgcatggtctcttccgagggcacctgcgccgcctattaccactacggaggcaaacttggataa

SEQ ID NO: 92357 - protein, 364 aa, Dehalococcoides ethenogenes 195
MNFIEEFRSSQSGRTLLEYINKRSTKPARFMEFCGGHTVAIFRYGIRQLLPPHIEMLSGPGCPVCVTSTADLDKVIALSRLPGVIICSFGDLLRVPSSRQSLLEVRAEGADVRIVYSTMDALEIARQNPLKKVIFVGIGFETTAPTIAASVIQARNQGLANYYVMSIHKITPPVMRAILDAGETRLSGIICPGHVSSITGSNAWEFIPEEYHLACAVSGFESLDILYCVKSLVDQVEDATPRLDVSYSRAVKPEGNTAALKIMDEVFDICPANWRGIGILPQSGLCLRPEFAAFDAEKNFEIKLSEPSRETPGCLCGEIIKGTRTPLECKLFSKVCTPENPVGPCMVSSEGTCAAYYHYGGKLG

SEQ ID NO: 92358 - DNA, 1119 bp, Thermococcus kodakaraensis KOD1
  CDS (1)..(1119): transl_table=11
atggaggagccctttgaggcctaccgctcgcgtgaggtggccatgaaactcgttgaaaagatcagagaggaagcgaagaccctcgacggtgaaatcaggataatgcacgtctgcggaacccatgaggacacggtaacgaggcacggaatccgctcgcttcttccggagaacgttaaggtcgtcagcgggccgggctgtccggtctgcataacaccggttgaggacatcgtggcgatgcagctcatcatgaggaaagcccgggaagagggagaagagataatcctgacgaccttcggcgacatgtacaagatcccgacgccgatggggagcttcgccgacttaaagagtgagggctttgatgtcagaatcgtctatggtatctttgacacctacagaatcgccaaggagaacccggacaaaaccgtcgtccacttctcgccgggctttgagacgacaaccgctccagcggccggaatgctcaacgtcgccgcccaagaggagcttgagaacttcaagatatactccgtccacaggctaaccccgccagccgttgaggtgctcctcaagcagggcacggtctttcagggcctcatagcccctggtcacgtctccacgataatcggagtgaagggctgggagtacctgacagaaaagtatggtatccctcaggtcgtcgcgggcttcgagccgaacgacgtcctcatggcgattcttatgctcatcaggatgtacaaggaaggcgaggcgaggataatcaacgagtacgagcgggctgtcaagtacgaaggcaacgtggtcgcccagaagatgatagacaagttcttcgaggtcgtcgatgccaagtggcgtgccctcggcgttttcccgaagagcggcctcgagctgaggaaggagtggaaggatttcgagataaggagcttctacaaagtagaggttcccaagaacctgcccgacctcgaaaagggctgccgctgcggcgccgtgctgaggggactggctttacctactgactgccccctcttcggaaagacctgcacgccgagacacccggtcgggccgtgcatggtgtcctacgaaggaacatgccagatattctacaagtacggcgtgctgttctga

SEQ ID NO: 92359 - protein, 372 aa, Thermococcus kodakaraensis KOD1
MEEPFEAYRSREVAMKLVEKIREEAKTLDGEIRIMHVCGTHEDTVTRHGIRSLLPENVKVVSGPGCPVCITPVEDIVAMQLIMRKAREEGEEIILTTFGDMYKIPTPMGSFADLKSEGFDVRIVYGIFDTYRIAKENPDKTVVHFSPGFETTTAPAAGMLNVAAQEELENFKIYSVHRLTPPAVEVLLKQGTVFQGLIAPGHVSTIIGVKGWEYLTEKYGIPQVVAGFEPNDVLMAILMLIRMYKEGEARIINEYERAVKYEGNVVAQKMIDKFFEVVDAKWRALGVFPKSGLELRKEWKDFEIRSFYKVEVPKNLPDLEKGCRCGAVLRGLALPTDCPLFGKTCTPRHPVGPCMVSYEGTCQIFYKYGVLF

SEQ ID NO: 92360 - DNA, 1137 bp, Magnetospirillum magnetotacticum MS-1
  CDS (1)..(1137)
ttgaaatacatcgacgagttcagggacggcgaactggcgcaaagcattgcgcgcgccatcaaggccgaggctgatcccgcctccacctaccacatcatggaattttgcggcggccatacccatgccatcagccgttatggcctggaagacctgctgcccgccaatgtgcgcatgatccacgggccgggctgtccggtctgcgtgctgcccatcggccgcatcgacgccgccatctggctggcgcgtcagccgggcgtgatcctgtgcacctatggcgacatgctgcgcgtgccgggctccaagcgcctgtcgctgctcaaggccaaggccgagggcgccgatgtgcgcatggtgtactcgaccatggacgccatcaagctggcccaatccaatcctgaccgacaggttgtgttcttcgccattggcttcgagaccaccacgccgcccaccgccgtggccatcaaacaggcccaggcgctggagctgaagaatttcagcgtattctgcaaccatgtgctgacgccgtccgccatcacccagattctcgattcccccgaggtgcgcgaactgggcacggtgaagctggacgccttcatcggcccggcccatgtgtccaccatcatcggctcgcgcccctacgaatatttcgccgaggaataccaacgcccggtggtcatcgccggtttcgagcccctcgacgtcatgcaggcggtgcgcatgctggtgcgccagatcaacgagggccgcttcgaggtggaaaacgaattcgcccgcgccgtgaccagggacggcaacgagaaggccaaatccctggtggccgacatgttcgaactgcgccgggtcttcgaatggcgggggctgggcatggtgccctattcggctctgcgcctcaaagaaccctatgccgcctgggatgccgagcgccgctgggacgtgccccaggacaatcccggcgacaacaaggcctgcgaatgcggcgccatcctgaggggagtgaaaaagcccatcgactgcaagctgttcggcacaatctgcacgcccgaaaatcccatggggtcctgcatggtctcggccgagggcgcctgcgccgcccactggacctatggacggttccgggatctggagaagagtgaatga

SEQ ID NO: 92361 - protein, 378 aa, Magnetospirillum magnetotacticum MS-1
MKYIDEFRDGELAQSIARAIKAEADPASTYHIMEFCGGHTHAISRYGLEDLLPANVRMIHGPGCPVCVLPIGRIDAAIWLARQPGVILCTYGDMLRVPGSKRLSLLKAKAEGADVRMVYSTMDAIKLAQSNPDRQVVFFAIGFETTTPPTAVAIKQAQALELKNFSVFCNHVLTPSAITQILDSPEVRELGTVKLDAFIGPAHVSTIIGSRPYEYFAEEYQRPVVIAGFEPLDVMQAVRMLVRQINEGRFEVENEFARAVTRDGNEKAKSLVADMFELRRVFEWRGLGMVPYSALRLKEPYAAWDAERRWDVPQDNPGDNKACECGAILRGVKKPIDCKLFGTICTPENPMGSCMVSAEGACAAHWTYGRFRDLEKSE

SEQ ID NO: 92362 - DNA, 1239 bp, Nostoc punctiforme PCC 73102
  CDS (1)..(1239)
atgcggttcgttaaaaaaaattccctaccacaaagcgaaattaactattctccagtccctatgaaatatgttgacgaattccgcgaaccggaaaaagcagaagccttatgccgcgaaatcaccaaattaagccaccagctagaaaaacccatcaaaatcatggaagtatgcggcggacatacccattccatatttaaatacggtatcgaagaaatattaccccaaaccatcgaactaattcatggtcctggttgtccagtatgcgttatgccaaaagggagattagatgatgcgatcgcaatctctcaaaatcataacgtcatttttgccacctttggcgacgcaatgcgagttcccggttccaaaacgagtttactccaagccagggcacaaggtgcagacatccgtatggtgtactctcctttagacagcctgcaaattgccaaagatcaccccgacagagaagtagtcttcttcgcattaggctttgaaaccacagcccccagcaccgccttcactattgtgcaagcagcagccgaagaaattcataactttagtatgtttagcaatcacgtcctcgtgattcccgcgctcaaagcactattagataatcccgacttgcaactcgatggatttgttgggcctggtcatgtcagcatggtaattggcagtgacccatatcaatttatttcccaacaatataataagccaatagtcgtctcaggatttgaacccttagatattctccaatcaatttggatgctattgcaacagatagtagaaaatcgttgcgaagttgaaaatcaatataaccgaattgtccaaaaatctgggaacacagtagccctacaagctataaataaagttttcgcagtgcgagatagctttgattggcgcggcttaggtgacatcccctattcaggattaaaaattaaacctgaatatgcccaatttgatgccgaacttaaatttaccattccgaatctcaaagtagccgaccataaagcttgtaaatgtggagaaattctcaaaggagtcttaaagccttgggagtgcaaagtattcggtacagcttgcacaccagaaacaccaatcggcacttgcatggtatcttctgaaggcgcttgtgcagcctattacaaatatggacgactctccaccattgccaaaagaacaatcacccaaaaaccaaaaataactcaagaacctctccccgcctgcggtttttctttagattaa

SEQ ID NO: 92363 - protein, 412 aa, Nostoc punctiforme PCC 73102
MRFVKKNSLPQSEINYSPVPMKYVDEFREPEKAEALCREITKLSHQLEKPIKIMEVCGGHTHSIFKYGIEEILPQTIELIHGPGCPVCVMPKGRLDDAIAISQNHNVIFATFGDAMRVPGSKTSLLQARAQGADIRMVYSPLDSLQIAKDHPDREVVFFALGFETTAPSTAFTIVQAAAEEIHNFSMFSNHVLVIPALKALLDNPDLQLDGFVGPGHVSMVIGSDPYQFISQQYNKPIVVSGFEPLDILQSIWMLLQQIVENRCEVENQYNRIVQKSGNTVALQAINKVFAVRDSFDWRGLGDIPYSGLKIKPEYAQFDAELKFTIPNLKVADHKACKCGEILKGVLKPWECKVFGTACTPETPIGTCMVSSEGACAAYYKYGRLSTIAKRTITQKPKITQEPLPACGFSLD

SEQ ID NO: 92364 - DNA, 1092 bp, Desulfovibrio desulfuricans G20
  CDS (1)..(1092)
atgaacttttccaatgcgttcaaagatcctgtgctgtgccgcgggctgctggaccggcttcgtgccgagacagacgccccgctgcgtttcatggaagtgtgcggcacacataccgtggccatattccagagcggtctgcgcccgctgctgccggaacaggtcgtccatgtgtccggccccgggtgtccggtctgtgtgacccacgaaagcgagatagccgcctatctggaactggcggaacgcgacaaggtgatcatcgccacgttcggcgaccttatgcgtgttcccggccccggtggcaaaacacttaaaagcgcacaggccgccggtgcccgcatcgaagtggtctattcacccgtggacgcactgtcacttgccgctgcccacccgcagtccacggtggtttttctgggcatcggttttgaaaccaccacccccgccgtggccgccaccatcaaaaccgcagaccggcaggggctgaagaattttcaggtactttcctttcacaaactggtgccccccgctctgggcgcgctgctttccgaccctgactgtgcagtggatgcttttctgctgccgggacatgtttccaccattctgggcacggccccgtacaactttgtggccgaacagtttcacacccccggcgtggtggccggttttgaccctgccgacattctgcaggcgctgctgctgatggtgcagatgcgccgccgaggcgaatacgccatcaccaaccagtacagccgcgcggtaagcgacaacggcaaccccaaggcgcgcagcatcatgtacgaggtattccgtcctgcagacgcgctgtggcgcggcatcggcaccatacccgacagcgggctggtgttcaccgacgcctacagacaattcgacgccatggaacagcaggaactgaccctgcgggacgtgcccaacacacccggatgcagatgcggcgacgtgctcaagggcaaaatgcagcccgacaactgtccgctgtttgccaaggcctgcacacccgcccgccccgtgggaccgtgcatggtttccaccgaaggaagctgcgccgcctatttcaaatacaatatcgggagctga

SEQ ID NO: 92365 - protein, 363 aa, Desulfovibrio desulfuricans G20
MNFSNAFKDPVLCRGLLDRLRAETDAPLRFMEVCGTHTVAIFQSGLRPLLPEQVVHVSGPGCPVCVTHESEIAAYLELAERDKVIIATFGDLMRVPGPGGKTLKSAQAAGARIEVVYSPVDALSLAAAHPQSTVVFLGIGFETTTPAVAATIKTADRQGLKNFQVLSFHKLVPPALGALLSDPDCAVDAFLLPGHVSTILGTAPYNFVAEQFHTPGVVAGFDPADILQALLLMVQMRRRGEYAITNQYSRAVSDNGNPKARSIMYEVFRPADALWRGIGTIPDSGLVFTDAYRQFDAMEQQELTLRDVPNTPGCRCGDVLKGKMQPDNCPLFAKACTPARPVGPCMVSTEGSCAAYFKYNIGS

SEQ ID NO: 92366 - DNA, 1116 bp, Actinobacillus pleuropneumoniae serovar 1 str. 4074
  CDS (1)..(1116)
atgcaatttgtcgatgaatttagagatcccgttctggctcgtaaattaattacgcatttacagcaattaatgcaaaagttgccgcaattcagtaaaaaacgaccgctttatttgatggaagtatgcggcggtcatacccatacgatttttaaattcggtttagatcgtattttgccggaaagtatcgaatttattcacggtcctggttgtccggtatgcgtattaccgatggggcgaattgacgtatgtattgaaatcgctcgtcgccccgaggtcattttttgtaccttcggtgatgcgatgagagtaaaaggcaaactaggctctttattggatgctaaaggacagggtgccgatattcgtatcgtctattctcccttggatgcactcaatattgcccgacaaaatccgaacaaaaaagtggttttcttttctctcggatttgaaacgacaatgccaagtacggcgataacattacagcaagccaaaaagcaacaggtaaataacttctttattgtttgccaaaacattacgattattcctacattacgagaattattacgacaagagcaagtattaatcgacggctttatcgcaccgggtcacgtcagtatgattatcggcaccgctccctatcaaccgcttgccgagcaatatcataaaccgtttgtggttaccggctttgagcctttagatttattacaagcgattgtgatgctagtcgaacaattcgtcgagaatcgttgtgaagttgaaaatcaatacaagcggattgttcaatccaacggtaatctaatcgcacagcaggcaatgcaagaagtctttcaattgaaaaaaagtagcgaatggcgaggattaggcgaaattgcggaatcaggggttgagcttaccgagcagtatgcgcaattcgatgccgagaaatattttaatacgcaggtacatgccgttgcggatgatcctctcgctcgctgcggagatgtcttaacaggaaaatgtaaaccgagtgattgtcctttatttgggcaaaaatgtaacccgaatagtgcctatggtgcattaatggtttcttctgagggggcttgttcggcttactatcaatatcggagagaaatgtaa

SEQ ID NO: 92367 - protein, 371 aa, Actinobacillus pleuropneumoniae serovar 1 str. 4074
MQFVDEFRDPVLARKLITHLQQLMQKLPQFSKKRPLYLMEVCGGHTHTIFKFGLDRILPESIEFIHGPGCPVCVLPMGRIDVCIEIARRPEVIFCTFGDAMRVKGKLGSLLDAKGQGADIRIVYSPLDALNIARQNPNKKVVFFSLGFETTMPSTAITLQQAKKQQVNNFFIVCQNITIIPTLRELLRQEQVLIDGFIAPGHVSMIIGTAPYQPLAEQYHKPFVVTGFEPLDLLQAIVMLVEQFVENRCEVENQYKRIVQSNGNLIAQQAMQEVFQLKKSSEWRGLGEIAESGVELTEQYAQFDAEKYFNTQVHAVADDPLARCGDVLTGKCKPSDCPLFGQKCNPNSAYGALMVSSEGACSAYYQYRREM

SEQ ID NO: 92368 - DNA, 1152 bp, Anabaena variabilis ATCC 29413
  CDS (1)..(1152)
atgaaatacgtcgatgaatttcgggaaccagaaaaagctgaagccttacgtcgtgagatagaaaaactcagccagcaattagataaacatatcaagattatggaagtatgcggcgggcatactcactctatttttaaatacggtattgaagaaattttaccagccaacatagaactgattcacgggcctggttgtccagtctgtgttatgcctaaggggagattggatgatgcgatcgctattgctcaaaatcctaacgtcattttagcaacctttggcgacaccatgcgcgtccccggttccaaaaccagcttgctgcaagccaaagccacaggcgcagatatccgcatggtttactctcccctagatagcctgcaaattgcgagaaatcaccctgataaagaaattgtattcttcgctttaggctttgaaaccacagcccccagcaccgcttttaccatcctccaagctgcttcagaaaatattactaactttagtatgttttctaatcacgtcctcgtcattcccgccctgcaagctttattaaataaccctgatttgcagctagatggctttattggccccggtcatgtgagtatggtaattggtactgaaccttatgaatttattgcccaaaaatatcataaaccaattgttgtttccggctttgaaccattagatattctccaatcaatttggatgttgttacagcaactaagagaaaatcgctgtgcagtagaaaatcaatataatagattagtccaaaaacaagggaatcaaatagcactagaagctatgcacaaagtgtttgcagtccgggaaacatttgcatggcgtggcttagacgaaattccggattctgggttaaaaattcgcccagaatatgcccaatttgatgctgaattaaaatttaccactcctaacttgaaagttgccgaccataaagcctgtcagtgtggcgaaattcttcaaggagtcctcaaaccttggcagtgtaaggtatttggtacagcctgcacaccagaatcaccaataggtacctgcatggtgtcctcagaaggagcttgtgccgcatactataaatatggcagattttcgacaacgttacaaaaacaagcagccgaaaagccaaaagtgactatctcgtcataa

SEQ ID NO: 92369 - protein, 383 aa, Anabaena variabilis ATCC 29413
MKYVDEFREPEKAEALRREIEKLSQQLDKHIKIMEVCGGHTHSIFKYGIEEILPANIELIHGPGCPVCVMPKGRLDDAIAIAQNPNVILATFGDTMRVPGSKTSLLQAKATGADIRMVYSPLDSLQIARNHPDKEIVFFALGFETTAPSTAFTILQAASENITNFSMFSNHVLVIPALQALLNNPDLQLDGFIGPGHVSMVIGTEPYEFIAQKYHKPIVVSGFEPLDILQSIWMLLQQLRENRCAVENQYNRLVQKQGNQIALEAMHKVFAVRETFAWRGLDEIPDSGLKIRPEYAQFDAELKFTTPNLKVADHKACQCGEILQGVLKPWQCKVFGTACTPESPIGTCMVSSEGACAAYYKYGRFSTTLQKQAAEKPKVTISS

SEQ ID NO: 92370 - DNA, 1104 bp, Synechococcus elongatus PCC 7942
  CDS (1)..(1104)
atgcgctacgtccaggagtttcggcaggcggcagccgtgcaagcgtgggtagaagcgatcgcgcaacgggtaacgcgaccttggacgctgatggaagtttgcggcggccagacccacagcatcgttcgctatggcctcgatactttgctgcccgagggggtgacgctgctgcatggccccggttgtccggtctgtgtgacgcccggctcggtgattgatcaggcaatcgcgatcgcccaagatccgcaagtcataatctgtagcttcggcgatatggtacgggttcccggcgatcgccagcagagtttacagcaagcccgtgccgctggtgctcaggtgcagattgtctatagtccactggatgctgttgcgatcgcagctaaaaaccccgatcgccaagtggtttttctcgcggtcggctttgaaacaacagctcccgcaactgctctcgcgatcgcccaagcccagcaacaacagctcaccaacttttcggtgttgctgtctcatgtccgcgtggctccggcgatgacacagttactcgctgatccagattgccggattcaaggctttctggcggcgggtcatgtttgtacagtcgctggtttagcggaatatccggcgatcgctaatcgctatcatgtcccgatcgcgattactggctttgaaccagtcgatattttgcagggcatttacgcctgtctggatcaactagaatccggccgctctgaagtcgtgaattgctacggtcgcgctgttcaagaagctggaaatttagccgctcagcagtgggtagaacgggtgtttgcgatcgccgatcaagactggcgcagcctgggcacaattcccgagggagggctggaattccagcctgaatttaagtcgtttgatgcccattgtcgttttgcaatcactggcgcgatcgcgctcacatcagtcaatgactgcatcagcggtttggttcttcaaggccagaaacaaccctgtgactgtccggcttttggtcgcacttgtactccagaaaaacctctaggtgcgccaatggtttccagcgagggagcttgcgctgcatactatcgctatcgccgcactcaagtcatgaattga

SEQ ID NO: 92371 - protein, 367 aa, Synechococcus elongatus PCC 7942
MRYVQEFRQAAAVQAWVEAIAQRVTRPWTLMEVCGGQTHSIVRYGLDTLLPEGVTLLHGPGCPVCVTPGSVIDQAIAIAQDPQVIICSFGDMVRVPGDRQQSLQQARAAGAQVQIVYSPLDAVAIAAKNPDRQVVFLAVGFETTAPATALAIAQAQQQQLTNFSVLLSHVRVAPAMTQLLADPDCRIQGFLAAGHVCTVAGLAEYPAIANRYHVPIAITGFEPVDILQGIYACLDQLESGRSEVVNCYGRAVQEAGNLAAQQWVERVFAIADQDWRSLGTIPEGGLEFQPEFKSFDAHCRFAITGAIALTSVNDCISGLVLQGQKQPCDCPAFGRTCTPEKPLGAPMVSSEGACAAYYRYRRTQVMN

SEQ ID NO: 92372 - DNA, 1116 bp, Crocosphaera watsonii WH 8501
  CDS (1)..(1116)
atgaaatttgttgatgaatatcgtaatgctgatctagctcaaaagtatgtccaagagatcacacaaacaattactagaccttggacaatcatggaaatttgtggaggacaaacccattctattgttaaatatgggatagatcgcctattacctcctgagattaccctgattcacggtcctggatgtcctgtttgtgttacccccattgaattaatagattgtgctttaaaaattgctagtttacctaatgttattttttgttcttttggggatatgttgcgagtccctggaagcgaaaaagatttattaactatcaaagcttctggtggggatgttcgtattgtttactcacctctagatagtttaaaaattgctcaagaaaatcctgataaagaggttgttttttttgctgttggctttgaaacaaccaccccagcaacagctatggcagtttatcaggctgatcaacaaggaattgaaaacctctctttattagtttctcatgtcttagttcccccagctatgtcagcccttttatcatcgcctaattgtgtggtgcaaggatttttagcagcaggtcatgtctgtaccgttatgggctacgaagcttataaacctatcgctcaaaaatataaagtacatatcgtcataacagggtttgaacctatcgacgttttgcaaggaatttatcattgtattcaacaattagaaaccggaaaatatgactgtgaaaatcaatatattcgctccgtaaaatctcagggtaactttttagcacaacaactcattcaagaaatctttgaagtggttccccgtcgttggcgaggtattggagaaatacgggagagtggcttaggtttacgcccagaatactccctctatgatgccttaaaacgctttgaaagccccttatcctctttaaccccatccacagccccacaagtctgtattagcggtgaaatcatgcaagggtacaaaaaacctaacgattgtcctgctttcggaacccaatgtacaccagaaaaccctctaggtgcgcccatggtatcttcagaaggagcttgtgctgcttattaccgctatcgaaaccatcggcaactggtggggcaatattaa

SEQ ID NO: 92373 - protein, 371 aa, Crocosphaera watsonii WH 8501
MKFVDEYRNADLAQKYVQEITQTITRPWTIMEICGGQTHSIVKYGIDRLLPPEITLIHGPGCPVCVTPIELIDCALKIASLPNVIFCSFGDMLRVPGSEKDLLTIKASGGDVRIVYSPLDSLKIAQENPDKEVVFFAVGFETTTPATAMAVYQADQQGIENLSLLVSHVLVPPAMSALLSSPNCVVQGFLAAGHVCTVMGYEAYKPIAQKYKVHIVITGFEPIDVLQGIYHCIQQLETGKYDCENQYIRSVKSQGNFLAQQLIQEIFEVVPRRWRGIGEIRESGLGLRPEYSLYDALKRFESPLSSLTPSTAPQVCISGEIMQGYKKPNDCPAFGTQCTPENPLGAPMVSSEGACAAYYRYRNHRQLVGQY

SEQ ID NO: 92374 - DNA, 1125 bp, Dechloromonas aromatica RCB
  CDS (1)..(1125)
atgaagtacatcgacgagttccgcgacggcgacgtcgcgcagacgctggctgccgccattcgcgccgaggctgacccggcgcgcagctaccatttcatggagttctgcggcggccacacccacgccatttctcgttacggcgtgtccgacctgttgccggccaacgtcaagatgattcacggtccaggctgcccggtctgcgtgctgccgatcggtcgcgtcgatcaggcgatccgcctggcgctcgaacagggcgtcacgctgtgcacctacggcgactgcctgcgcgtgccggcctccgatggtctatcgctgatgaaagccaaggccaagggcggcgacatccgcatggtttattcgagcgccgatgccgtgaccttggcgcaaaagaatccggacaagcaggtcgttttcttcgccatcggtttcgaaacgacgacgccgccgacggcggtggcgatcaagcacgctgccgcgctgggcctgaagaatttctcggtgctctgctgccatgtgctgacgccatcggccatttccagcatcctcgaatcgccggaggttcgccagtggggcaccgtgccgctcgacggcttcattggtccagcccatgtatcgaccatcatcggcagtcggccctacgagttcttcgccgaggaataccgcaagccggtggtcattgccggcttcgaaccgctcgacgtgatgcaggcgatcaagatgctgatccgccaggtcaacgaagggcgcgccgaggtcgagaacgaattcgcccgcgccgtcagccgcgacggcaacctcaaggcgcaacaactggtcgccgaagtcttcgagatgcgcaagcatttcgaatggcgcggcctgaacatcctgccttactcggcgctgcgcattcgcagccagttcgccgaatttgatgccgaaaagcgttttccgctcggttatgcatcggtgcccgatcacaaggcctgcgaatgcggggccatcctgcgcggcgtcaagcggccgcaggactgcaagattttcggcaccgtctgtacgccggaaaacccggtcggttcctgcatggtcagctccgaaggcgcctgtgccgctcactacacttatggacgctacaaggatgtctga

SEQ ID NO: 92375 - protein, 374 aa, Dechloromonas aromatica RCB
MKYIDEFRDGDVAQTLAAAIRAEADPARSYHFMEFCGGHTHAISRYGVSDLLPANVKMIHGPGCPVCVLPIGRVDQAIRLALEQGVTLCTYGDCLRVPASDGLSLMKAKAKGGDIRMVYSSADAVTLAQKNPDKQVVFFAIGFETTTPPTAVAIKHAAALGLKNFSVLCCHVLTPSAISSILESPEVRQWGTVPLDGFIGPAHVSTIIGSRPYEFFAEEYRKPVVIAGFEPLDVMQAIKMLIRQVNEGRAEVENEFARAVSRDGNLKAQQLVAEVFEMRKHFEWRGLNILPYSALRIRSQFAEFDAEKRFPLGYASVPDHKACECGAILRGVKRPQDCKIFGTVCTPENPVGSCMVSSEGACAAHYTYGRYKDV

SEQ ID NO: 92376 - DNA, 1137 bp, Burkholderia cepacia R1808
  CDS (1)..(1137)
atgaagtacatcgacgaattccgcgaccgcgcgctcgccgaacgcatttccgcgcgcattcaggcggaggcgcagcccggcacgcgctatcacttcatggaattctgcggcggtcacacgcatgcgatttcccgctacggcgtgaccgacctgctgcccgacaacgtgcggatgatccacggccccggctgccccgtctgcgtgctgccggtcggacgcatcgatctcgcggtgcagctcgcgctggagcgcggcgtgatcgtctgcacctatggcgacacgatgcgcgtgccggcctccggcgggatgtcgctgatgcgcgcgaaggcgcacggcgccgacatccggatggtttattcgccgctcgacgcgctgaagatcgcgcgcctgaatcccgatcgcgaggtcgtgttcttcgcgatcggcttcgagaccaccacgccgcccaccgcgctgatcgtgcgcgacgcggccgctgccggcgtcgacaatttcagcgtgctgtgctgccacgtgctgacgcccgccgcgatcacgcatctgctcgcggcgccggccgtggcggccgacgccgtgccgctcgacggcttcatcggccccgcgcacgtcagcatcgtgatcggctcggcgccctacgagggcttcgcgcgcgactatcggaagccggtcgtgatcgcgggcttcgagccgctcgacgtgatgcaggcgatcctgatgctgatccgccaggtcaacgacggccgcgccgaggtcgagaacgaattttcgcgggcggtcacgcgtgccggcaacgccgccgcgcaggcgctgatggacgacgtgttcgaggctcgcgagagcttcgagtggcgcggcctgggcgaggtgccggccagcgccctgcggatccgcgcgaaatacgcgcgccacgacgccgaagcgcgttacgggctggtctaccggcccgtcgccgaccaccgcaaatgcgagtgcggcgcgatcctgcgcggcctcaagcagccgcgcgactgctcgctgttcggcaccgtgtgcacgcccgagaatccgatgggttcgtgcatggtgtcgagcgagggcgcgtgcgccgcgcattactcgtatggccgtttcaaggacattccgctggtacccgcatga

SEQ ID NO: 92377 - protein, 378 aa, Burkholderia cepacia R1808
MKYIDEFRDRALAERISARIQAEAQPGTRYHFMEFCGGHTHAISRYGVTDLLPDNVRMIHGPGCPVCVLPVGRIDLAVQLALERGVIVCTYGDTMRVPASGGMSLMRAKAHGADIRMVYSPLDALKIARLNPDREVVFFAIGFETTTPPTALIVRDAAAAGVDNFSVLCCHVLTPAAITHLLAAPAVAADAVPLDGFIGPAHVSIVIGSAPYEGFARDYRKPVVIAGFEPLDVMQAILMLIRQVNDGRAEVENEFSRAVTRAGNAAAQALMDDVFEARESFEWRGLGEVPASALRIRAKYARHDAEARYGLVYRPVADHRKCECGAILRGLKQPRDCSLFGTVCTPENPMGSCMVSSEGACAAHYSYGRFKDIPLVPA

SEQ ID NO: 92378 - DNA, 1143 bp, Rubrivivax gelatinosus PM1
  CDS (1)..(1143)
atgaagtacatcgacgagtttcgcgacggcggcgtcgcccagaagatcgccgagcggctgcgccaggaggttcgtccgaaccgcagctacagcttcatggagttctgcggcggccacacccacgccatctcgcgttatggcgtcagcgagctgctgccggccaatgtgcgcatggtgcacggtccaggctgcccggtctgcgtgctgccgatcggccgcatcgacctggcgatcaagctcgcactcgagcgtggagccatcgtctgtacctacggcgacaccatgcgcgtgccggcgtccgacggcctgtcgctggttcgtgccaaggcgcgcggtggcgacatccgcatggtgtactcggcggccgatgcgctccagatcgcgcgccagaacccgcagcgcgaggtggtgttcttcgcgatcggcttcgagacgaccacgccgcccacggccctggcgatccgcgacgcccacaaggaggggctggcgaatttcagcgtgctgtgctgccatgtgctcacgccgtcggcgatcacgcacatcctcgagtcgcccgaagtacggcagttcggcacggtgccgatcgatggcttcgtggggccggcacacgtcagcatcgtgatcggttccggaccctacgagcacttcgcacaggagtaccgcaagccggtggtcatcgccggcttcgagccgctcgacgtgatgcaggcggtgctgatgctcgtgcgccaggtgaacgaagggcgcgccgaggtcgagaacgagttcacccgtgcggtcaaccgcgacggcaacctgaatgcgcaggcgctggtgtccgacatcttcgagctgcggccgagtttcgagtggcgtggcctcggtgaagtgccgtacagcgcgctcaagatccgccccggcttcgccgccttcgatgccgagcggcgcttccagctcggctaccagccggtggccgacaacaaggcctgcgaatgcggcgccatcctgcgcggtgtgaagaagccgaccgactgcaagatcttcggcacggtgtgcacgccggagaatccggtggggtcctgcatggtgtccagcgagggcgcctgcgcggcgcactactcctacgggcggttcaaggacatcgcgatcgtggcggcagcatga

SEQ ID NO: 92379 - protein, 380 aa, Rubrivivax gelatinosus PM1
MKYIDEFRDGGVAQKIAERLRQEVRPNRSYSFMEFCGGHTHAISRYGVSELLPANVRMVHGPGCPVCVLPIGRIDLAIKLALERGAIVCTYGDTMRVPASDGLSLVRAKARGGDIRMVYSAADALQIARQNPQREVVFFAIGFETTTPPTALAIRDAHKEGLANFSVLCCHVLTPSAITHILESPEVRQFGTVPIDGFVGPAHVSIVIGSGPYEHFAQEYRKPVVIAGFEPLDVMQAVLMLVRQVNEGRAEVENEFTRAVNRDGNLNAQALVSDIFELRPSFEWRGLGEVPYSALKIRPGFAAFDAERRFQLGYQPVADNKACECGAILRGVKKPTDCKIFGTVCTPENPVGSCMVSSEGACAAHYSYGRFKDIAIVAAA

SEQ ID NO: 92380 - DNA, 1161 bp, Rhodospirillum rubrum
  CDS (1)..(1161)
atgacgacacccgaggacggcgcggcttttcaggaccccgagcgggtgcgcgccctggccacggccatcgcccaggcggtgaggccgggcaaacgctatcgcttcatggaattctgcggcggccatacccacgccatcggccgctatgggctggccgggctgctgcccgaagccgtcaccctgatccatgggccgggctgcccggtctgcgtgctgcccgccggccgcatcgacgccgccctggctttggccgcccggcccgaggtgatcttgtgcagctatggcgatctgttccgcgtgcccggttcggcgcggcgcagcatgatctcggcccgggccgagggcgccgatatccgcatggtcacctcgccgttgcaagcggtgaccatcgccagggacaatccccaacgcgccgtggtgttcttcgccatcggctttgaaaccaccgccccggcctcggcggcggcgatcaaggcctccctggccgccggtctgaccaacttccatgaactggtctgccatgtgctgacgccgccggcgatggccgccatcctggccgaggaggccaccgccgcgaccgatgtccggccgcgtctggatgggctgatcggccccggccatgtggctttgatcaccggcatggcgcccttcgaccgcttcgcccaaagcaacggccggccgatcgccgtggccggttttgagcccaccgatctgctgcaagccgtgctcgccctggtgactttgaccaacgagggggcggcgcgcgccgtcaaccgctatacccgggcggtgaccgaggccggcaacaccaccgcccaggccctgcttaacgaggttttcgaggtcaaggccagcgcggaatggcgcgggcttggcatggtcgccgacagcgccctggccttgcgtccggcctatgcccgcttcgacgccgagaaacgctttccgtgcgatctgccgcccccccaggtcaatcgcgcctgccgctgccccgatatcctgcgcggcctgatcgcccccgaggactgcgcgctgtttggccgaagctgcacgcctagcgatccggtcggtgcctgcatggtttcgtccgagggcgcctgcgccgcggcttacgcctatggcggtcgccgcgccgccacgcctttacggagaccccagccatga

SEQ ID NO: 92381 - protein, 386 aa, Rhodospirillum rubrum
MTTPEDGAAFQDPERVRALATAIAQAVRPGKRYRFMEFCGGHTHAIGRYGLAGLLPEAVTLIHGPGCPVCVLPAGRIDAALALAARPEVILCSYGDLFRVPGSARRSMISARAEGADIRMVTSPLQAVTIARDNPQRAVVFFAIGFETTAPASAAAIKASLAAGLTNFHELVCHVLTPPAMAAILAEEATAATDVRPRLDGLIGPGHVALITGMAPFDRFAQSNGRPIAVAGFEPTDLLQAVLALVTLTNEGAARAVNRYTRAVTEAGNTTAQALLNEVFEVKASAEWRGLGMVADSALALRPAYARFDAEKRFPCDLPPPQVNRACRCPDILRGLIAPEDCALFGRSCTPSDPVGACMVSSEGACAAAYAYGGRRAATPLRRPQP

SEQ ID NO: 92382 - DNA, 1143 bp, Ralstonia metallidurans CH34
  CDS (1)..(1143)
atgaaatacgtggacgaattccgggacggcgagctggcccgtaccctggcggcgaagatcgcccgcgacgccgactccgggcgcagctacagtttcatggagttctgcggcggccacacccacgccatctcccgctacggtgtcagcgatctgttgcccgccaacgtgcgcatgatccacggccccggctgcccggtgtgcgtgctgcccatcggccgcatcgatctcgccatcaagctcgcgttggagcgtggtgtgatcctctgctcctatggcgacacgctgcgcatccccgcctccgagagcctgtcgctgctcaaggccaaggcccgcggtgcggacatccgcatggtctactcggcggccgacgcgctggccatcgcccagcagaatccccagcgcgaagtggtgtttttcgccatcggcttcgagaccaccacgccgcccaccgcgctggtgatcaagcaggccgaggcggcccgcgtcaccaacttcagtgtgctgtgcaaccacgtgctgacgccttcggccatcatcaccatcctcgagtcgccggaggtgcgcaagctgggtaccgtgccgctggacggcttcgtcggccccgcccatgtcagcaccgtgatcggcagtcggccctacgaattcttcgccgaggagtaccgcaagccggtggtgatcgccggcttcgagccgctggacgtgatgcaggccatcctcatgctggtgacgcaggtcaacgagggcagagccgaggtggagaatgaattcactcgcgccgtcacccgagacggcaaccagaaggcccaggccttggtgtcggaagtcttcgagctgcgctgctccttcgaatggcgcggcctgggcgaggtgccctacagcgccctgcgcatccgcgccagctaccgcctgttcgacgccgaggcccgcttcggcctcgcctaccggccggtgcccgacaacaaggcctgcgaatgcggcgccatcctgcgcggcgtgaagaagcccaccgactgcaagctcttcgccaccgcgtgcacgccggagaatccgatgggctcctgcatggtgtcgagcgaaggggcgtgcgcggcgcattacagctacgggcggttcaaggacatcgaagtggtggtggcagcttga

SEQ ID NO: 92383 - protein, 380 aa, Ralstonia metallidurans CH34
MKYVDEFRDGELARTLAAKIARDADSGRSYSFMEFCGGHTHAISRYGVSDLLPANVRMIHGPGCPVCVLPIGRIDLAIKLALERGVILCSYGDTLRIPASESLSLLKAKARGADIRMVYSAADALAIAQQNPQREVVFFAIGFETTTPPTALVIKQAEAARVTNFSVLCNHVLTPSAIITILESPEVRKLGTVPLDGFVGPAHVSTVIGSRPYEFFAEEYRKPVVIAGFEPLDVMQAILMLVTQVNEGRAEVENEFTRAVTRDGNQKAQALVSEVFELRCSFEWRGLGEVPYSALRIRASYRLFDAEARFGLAYRPVPDNKACECGAILRGVKKPTDCKLFATACTPENPMGSCMVSSEGACAAHYSYGRFKDIEVVVAA

SEQ ID NO: 92384 - DNA, 1191 bp, Burkholderia fungorum LB400
  CDS (1)..(1191)
atgaaatacgtcgacgaattccgcgatccggacagagcccgtgcgctgacgcacgagattcgccggctagtcgagcggatcgcacgcacacgcggtggcctggagcgaccgttgcagatcatggaggtttgcggcggtcatacgcattcgatctttcggtacgggattcaccagatgctgccgccggaggtcgagttcgttcatggtcccggctgccccgtctgcgtgctgccgatgggacgcgtcgacgactgtgtggcgctcgccaggcggcccgaagtgatcttcacgacgttcggcgacgcaatgcgagtaccgggctccagcacgagcttgctgaaggccaaggccgatggcgctgacgtgcggatggtctattctcccgtcgacgcgctggcgattgcacgtgcgaatccgcatcgcgaagtgatcttcttcgggctcggctttgaaaccacgatgccgggcacggcaatgacggtgctgcaggcgcacgccgggcgcgtcgaaaacttttcgcttttctgcaaccacatcactatcgttccgacgatcaaggcgattctcgactcaccggacctgcgcctcgacggatttctcggcccggggcacgtcagcatggtgatcggaacccgtccgtatcgcttcattgcggaacagtaccggaggccgattaccgtcgccggattcgagccgctcgatgtgctgcattcggtcttcatggtcttgcgccagatcgcagaaggccgcagcgaggtggaaaaccagtatgcccgtatcgtgcccgagaatggcaatgcacaggcgctgtcggcgatcgggcaggtgttcgagccgcgcgagttttttgaatggcgcgggcttggatcgattgagcattcgggtgtgcggattcgcgatgcgtttgccgcgttcgatgcggagcgcaagtttcctgtagccaacctgcagttggccgatccgcaggcgtgtcagtgcggcgaggtccttaaaggcgtcatcaagccgcctcaatgcaaggtgtttggcactgcgtgcacgccggacaggccgcttggcgccttgatggtatcgagcgaaggtgcgtgcgcggcgcactatcgctacgcacgcatcgatacatcggcgctgaccgcggcagctgctgtttgtcctggacccgctccggcggcgctgcgagtgcaagcatga

SEQ ID NO: 92385 - protein, 396 aa, Burkholderia fungorum LB400
MKYVDEFRDPDRARALTHEIRRLVERIARTRGGLERPLQIMEVCGGHTHSIFRYGIHQMLPPEVEFVHGPGCPVCVLPMGRVDDCVALARRPEVIFTTFGDAMRVPGSSTSLLKAKADGADVRMVYSPVDALAIARANPHREVIFFGLGFETTMPGTAMTVLQAHAGRVENFSLFCNHITIVPTIKAILDSPDLRLDGFLGPGHVSMVIGTRPYRFIAEQYRRPITVAGFEPLDVLHSVFMVLRQIAEGRSEVENQYARIVPENGNAQALSAIGQVFEPREFFEWRGLGSIEHSGVRIRDAFAAFDAERKFPVANLQLADPQACQCGEVLKGVIKPPQCKVFGTACTPDRPLGALMVSSEGACAAHYRYARIDTSALTAAAAVCPGPAPAALRVQA

SEQ ID NO: 92386 - DNA, 1101 bp, Magnetococcus sp. MC-1
  CDS (1)..(1101)
atggaccaagcaagcatggaacagaaactactggcccttacccgtttgcaggtaagtgagcctattaaggtgatgaatttgtgtggaggatttgcccggttttgggccgagagcgattggcatcaatcccttagccgagtggtgcatatcatgccagggccgggctgtccggtatgtgtctgtcccgaagctgaaattcgcgcggccatgcatttggcggtgcgtgaggatgtgatcttggcggcgtttggtgacatgctgtcggtacccatctcctatggggcggcgggctatgccaccttggatggtgcgcggcaagatggcgcggatgtggttgctgtggccaatcctcatgaggcggtcgagctggccttacgtcaccccacccgtgaagtggtcttttttgccagtggttttgagacggtctcggcaccactggcggcgcagtttctggcgggtgtgccggataatttctcgattttaaatgcgctgcgtttaagttggccggtggtggataccatgttgtcgcagcatgagcggcgcccttttaaagccattattgccccgggtcacgtggcggccattgtcggttcggagtgttggcgttttgcggtgacccagtatggcattcccgtttccattagtggcttttctgaccgtagctttttggcttcactggatacggtggtgcgccaagttgtgtcgggtaaaccccaattggacattcaagaaccctatcgtattaacccccgtggcaacctctatgcgctcacctgtgttaataatgtgtttgatgtgcagagtgtgcattggcggggtattggtcgggtgccagactcgggctacgccctacgtgaagcttggcaccatcgagatgcccgcaaacgttttcacgccctggcaacctttcagcctgagatgggcgatatgcccaacgactgtctttgtgcctctattgttatgggtaagcagagcccccatgactgcttgcgttatgcccatgattgccagccggataatcccgtgggtccctgtatggcctcggtggatggggcttgccgcatcatgtgggaacgccaacatagtgagctattggattag

SEQ ID NO: 92387 - protein, 366 aa, Magnetococcus sp. MC-1
MDQASMEQKLLALTRLQVSEPIKVMNLCGGFARFWAESDWHQSLSRVVHIMPGPGCPVCVCPEAEIRAAMHLAVREDVILAAFGDMLSVPISYGAAGYATLDGARQDGADVVAVANPHEAVELALRHPTREVVFFASGFETVSAPLAAQFLAGVPDNFSILNALRLSWPVVDTMLSQHERRPFKAIIAPGHVAAIVGSECWRFAVTQYGIPVSISGFSDRSFLASLDTVVRQVVSGKPQLDIQEPYRINPRGNLYALTCVNNVFDVQSVHWRGIGRVPDSGYALREAWHHRDARKRFHALATFQPEMGDMPNDCLCASIVMGKQSPHDCLRYAHDCQPDNPVGPCMASVDGACRIMWERQHSELLD

SEQ ID NO: 92388 - DNA, 1083 bp, Magnetococcus sp. MC-1
  CDS (1)..(1083)
atgatgcaggccaaggtgtggttggaaaagctgcaacagctgccgcgcccggcggggcgggtggcgattatgaacgtctgtggggggcatgagcgctccatcaccatggccggtttgcggggggtgttgccggactatgtacggttggtgccggggccgggttgcccggtctgtatctgtcccgagggggatatccatgcggctatccggctggggttggaggatggtgcgctggtgtgcgcttttggggacatgctgcgggtgcccatcaaccgggggcgggccgaggtgcgctctttggaacaggcgcacgccagcggtgcggacattcgcccggtggcctcgcccatggaggcggtcgccttggcccagcagaacccccagcggcaggtggtgtttttcgcggcggggtttgagaccaccatggccccggtggcggccatgcttgcccagcagccgccggataacttgacggtgtggttggccgggcgactaacctggcctgcggtgtcgctgttgttggagagtggtacgccgggctttgatgccttggtggcaccgggccatgtggccaccgtgatggggccggaggagtgggattttgtttggcaacaccacggcatagccacagcggttgcgggttttttgcccgattcgctgttggcggccttctattcggtgctgcgtcaggtgagcagcggtcagcccatgctggacaactgctatgccgaggtggttcgggccgggggtaaccccttcgcaaaacagattttgcagcaggtgtttgaggtggtggatgccccatggcgcggggtgggcaccattcccgcctcgggttatgccataagtgaggcgtatggcgggtgggatgcccggcgccgttttccccatcaatgccaggatgaaggggatgagcaaatgccccccggctgtgattgtgcccgtgtggtgatgggcaaactggagccggtggcgtgccgtctttatcagaccgcttgcacgccccgtacaccggtggggccctgtatggtctccgacgaaggggcgtgccgcatttggtggagcggtggtgtcagaaagtag

SEQ ID NO: 92389 - protein, 360 aa, Magnetococcus sp. MC-1
MMQAKVWLEKLQQLPRPAGRVAIMNVCGGHERSITMAGLRGVLPDYVRLVPGPGCPVCICPEGDIHAAIRLGLEDGALVCAFGDMLRVPINRGRAEVRSLEQAHASGADIRPVASPMEAVALAQQNPQRQVVFFAAGFETTMAPVAAMLAQQPPDNLTVWLAGRLTWPAVSLLLESGTPGFDALVAPGHVATVMGPEEWDFVWQHHGIATAVAGFLPDSLLAAFYSVLRQVSSGQPMLDNCYAEVVRAGGNPFAKQILQQVFEVVDAPWRGVGTIPASGYAISEAYGGWDARRRFPHQCQDEGDEQMPPGCDCARVVMGKLEPVACRLYQTACTPRTPVGPCMVSDEGACRIWWSGGVRK

SEQ ID NO: 92390 - DNA, 1119 bp, Methanosarcina barkeri str. fusaro
  CDS (1)..(1119)
atggaaaacgggaattcaccttcaaagccagcgattcctgaaattgaaaaaaagcttctggaaagaatcagagactttgataaaccgcttcgcataatgcatgtctgcggaactcacgagcggactatagcaaaatatgggttaaggagtatccttccgaaaaatatcgaggtaataagcggccccggatgccccgtttgtgtgactcctgaagaagatattaatattgcaattgcccttgcgaaaagtggggcaacggttgtcacttttggagacatgatgcgggttccgggttcggctgaaagcttactggatgcaaagtctgaaggggcaaatgtaaagatggtctatagcattgacgatgcaattgcccttgcagaaaaaaagccagaacttgaggtagtcttttttggaataggctttgagaccacggttcctgcaaatgcggctgctcttttaagaaagacccccgaaaacttcagcctccttacctcgcagaagcaaacccctcctgcagtcgaattccttgccagggacgcagacgttgatgcttttatagctcctgggcacgtggcaaccataataggcacaaaaccttttgagtctcttgcagaaaaaggctttcctattgccgtaagtgggtttgaaccaggagatattctccttggaataaacctgttacaactgcaggcagaagaaggaatctcaagggtagataacggctacccgagagctgtaaaacctgaagggaaccagattgcccttaaaataatgaatgaagtatttgaaacctcagattctgaatggcgaggcatagggaaaatagaaaattcggggcttgtgctcaggaaagagtttgaagaaaaggacgctgcaaaaaagcatgaggatctgtatgcttctgcccttgaagatgtccgaaagaaaacaggaggaaaagacaaaaagcgttgtatctgcgcagctatccttacaggaaaagcaaagccttcccagtgtccaaacttcggtaaagaatgtaccccgaaaaaccctgcaggcccctgtatggtaagccaggaaggtatgtgttataactggttcaggtactcaagagaaggaggcaacagagttgcatga

SEQ ID NO: 92391 - protein, 372 aa, Methanosarcina barkeri str. fusaro
MENGNSPSKPAIPEIEKKLLERIRDFDKPLRIMHVCGTHERTIAKYGLRSILPKNIEVISGPGCPVCVTPEEDINIAIALAKSGATVVTFGDMMRVPGSAESLLDAKSEGANVKMVYSIDDAIALAEKKPELEVVFFGIGFETTVPANAAALLRKTPENFSLLTSQKQTPPAVEFLARDADVDAFIAPGHVATIIGTKPFESLAEKGFPIAVSGFEPGDILLGINLLQLQAEEGISRVDNGYPRAVKPEGNQIALKIMNEVFETSDSEWRGIGKIENSGLVLRKEFEEKDAAKKHEDLYASALEDVRKKTGGKDKKRCICAAILTGKAKPSQCPNFGKECTPKNPAGPCMVSQEGMCYNWFRYSREGGNRVA

SEQ ID NO: 92392 - DNA, 1092 bp, Geobacter metallireducens GS-15
  CDS (1)..(1092)
atgaaataccaggacgaattccgcgaccgccacgtggtgctgggccttgccgcccggatcagggagcacgtggccgggcgtacggagcccatgaccttcatggaggtctgcggcactcataccatgtcgatctatcagtacgggctccgcaccctcctccctccccaggtgcggctcatctccggacccggctgcccggtctgcgtcacccccaatgagtacctggaccgggccgtggccctctgccggctccccgacgttatcgtcgccaccttcggcgacatggtccgggtccccggctccacgtcgtccctccaggaggagcgcgcccggggggccgacatccggatcgtctactcccccttggacgccgttgccattgctgccaggaatccggagaagcgggtggtctttctcggcgtcggcttcgagaccacggccccggccattggcgggagcatcctggcggcgaagaagcaggggctcgccaactacttcgtgctggcagcccacaagaccatgcccaagcccatgggggtcctctccgccgacccggagctgaagatcgacggctacatctgccccgcccacgtgagcaccatcaccgggccggagatctaccgcttcctggccgaggagtttcatatcccctgcgtcatcaccggtttcgagcctgcggacgtcatgcagggggtcgagatgctcgtccgccaggtggtggcgggggagagccgggtggagacccagtacagcagggtggtacggcctgaggggaaccgcaaggcccaggaggtgatccgggaggtcttcaccccctgcgatgccccctggcgcggcatcggggtcatcccggggagcggcctgcggatcgccgacgcctatgccgtgtttgacgccgagaaggcgattcccgtggcggtggaggagacccgggaacacgcgggatgtctctgcggcgagatcctcaaggggaaagcggccccaaccgactgtcccctctttggcggcgcctgcacccccgagtcccccgtgggggcctgcatggtctcctccgaggggacctgcgcggcggcgtacaagtatgggcagtga

SEQ ID NO: 92393 - protein, 363 aa, Geobacter metallireducens GS-15
MKYQDEFRDRHVVLGLAARIREHVAGRTEPMTFMEVCGTHTMSIYQYGLRTLLPPQVRLISGPGCPVCVTPNEYLDRAVALCRLPDVIVATFGDMVRVPGSTSSLQEERARGADIRIVYSPLDAVAIAARNPEKRVVFLGVGFETTAPAIGGSILAAKKQGLANYFVLAAHKTMPKPMGVLSADPELKIDGYICPAHVSTITGPEIYRFLAEEFHIPCVITGFEPADVMQGVEMLVRQVVAGESRVETQYSRVVRPEGNRKAQEVIREVFTPCDAPWRGIGVIPGSGLRIADAYAVFDAEKAIPVAVEETREHAGCLCGEILKGKAAPTDCPLFGGACTPESPVGACMVSSEGTCAAAYKYGQ

SEQ ID NO: 92394 - DNA, 1050 bp, Clostridium thermocellum ATCC 27405
  CDS (1)..(1050)
atgaagacgcttgaagctataaaaaaggagcttggagaatacgagggcaaaaacattaaaataatggaagtctgcggcacccacacttccagcatttttaagaacgggatccgaagccttatctcccctcgtatacagcttatttcgggaccgggctgccctgtatgcgtgacggcctcatcctacattgacaggcttgtagaatattctctaaaggacaaccattgtgttttgactttcggtgacatgatgaaggtaaagggacacaaactttctcttaccgaggcaaaagcaacggggggaaatgtaaaaatcctctattctcccctcagtgcggtaaaaattgcaatcaaaagccctgagacccaatttatttttgccgcagtggggtttgagaccacagcccctatttatgcgctgatgattgaagaaataattaagaataatataaaaaacctgaaactgatgacttcgattaagaccattatacctgcgatttcatatatttgcgaaaatgaaaaaaatatagacgcttttctctgccccggtcatgtcagtgttatcatcggctcctcggtttataccgatatggcgttaaaataccgcaagccttttgtgataggcggtttcgagggtgggcatattatagcggcaatttatgaaataatccgccagatttcaaacaatgaatacagtatgaaaaacatgtatcaaagtgctgtaagccctgagggaaatcaaaaggcgaaatctttgattgacaaatattttgaagctgcagacgactattggcggggaatcggaataataaaaaactcggggctaaggctaagaacggaatacagggattttgatgccgggagcacaatttttgaagatgctgacgctgcaccttcgggctgtaaatgtgctgatgtaatactgggaagaataacccctgcacaatgccctctgttcggcaaggcctgcactccgttaaatgccgtcggagcatgcatggtttcttcagagggcgcctgcggaatctggtacagaaattgtgaggtgtag

SEQ ID NO: 92395 - protein, 349 aa, Clostridium thermocellum ATCC 27405
MKTLEAIKKELGEYEGKNIKIMEVCGTHTSSIFKNGIRSLISPRIQLISGPGCPVCVTASSYIDRLVEYSLKDNHCVLTFGDMMKVKGHKLSLTEAKATGGNVKILYSPLSAVKIAIKSPETQFIFAAVGFETTAPIYALMIEEIIKNNIKNLKLMTSIKTIIPAISYICENEKNIDAFLCPGHVSVIIGSSVYTDMALKYRKPFVIGGFEGGHIIAAIYEIIRQISNNEYSMKNMYQSAVSPEGNQKAKSLIDKYFEAADDYWRGIGIIKNSGLRLRTEYRDFDAGSTIFEDADAAPSGCKCADVILGRITPAQCPLFGKACTPLNAVGACMVSSEGACGIWYRNCEV

SEQ ID NO: 92396 - DNA, 1317 bp, Trichodesmium erythraeum IMS101
  CDS (1)..(1317)
ttgagtgcagccttaaatttagcaatggagttcaccccggggacctggataacactcacactgccagcaatagggaacagaaaatttgtcaaaaatccaataattattagattttataagattgttggagatttttgggaacgtaaacctaacatattattacatttatttctgataactgatatgaagtacgttaaagaatttcgcgaccccgacaaagcacaaggtttagtaagagaaattgctcaactcagccaaaagttaggatacaccacggaacacccactaaaaataatggaagtttgtgggggtcacactcactctatttttaaatatggcattcaagaagctttacctaataatattgaactaatacatggccctggctgtccagtttgcattatgcccagaggtagattagatgatgcgatcgctctggcagaaaaacccaatgtcatttttacaactttcggtgatgggatgcgagtaccgggttctcaaaaaagtttgttacaggcaaaagctcagggtgcagatattagaatggtttattcgcccctggatagtttgaagatagctaaagaaaacccagataaagagataattttctttggtttaggttttgaaactactgcccccagtgcagctttaactattttgcaggcagaagcagaaggcgtcaaaaatttcagtatatttagtaaccatgttttggttgtaccggctctagaggcattacttagcaacccagatttagaattacaaggttttgttgggcctggtcatgtgagtatggttattggtactcaagtatatcacataatttcggaaaaataccaaaaacctgtggttgtatcaggttttgaacctttggatattttgcagtctatttggatgttactacagcaaatattagaaggtcgttgtgaagttgaaaatcaatatagtcgcatagtaaaagaagagggtaatagggtagcacttgaagccatgaaacgagtatttgaagtgcgagatacgtttgagtggcgtggtttgggagaaattcccgagtccggattaaaaattactgatgcttattcctgttttgatgctgaggctaagttttgtctgcctaacaaaaaagttgctgatgctaaagcttgccaatgtggggaaattctcaaaggtgtactgaaaccttgggagtgtaaagtctttggtactgcttgtactcctgaaaacccgatcggcacttgcatggtttcctctgaaggtgcttgtgctgcctattataaatatggtcggttgtttaagaaggaaaaagttaaggtttaa

SEQ ID NO: 92397 - protein, 438 aa, Trichodesmium erythraeum IMS101
MSAALNLAMEFTPGTWITLTLPAIGNRKFVKNPIIIRFYKIVGDFWERKPNILLHLFLITDMKYVKEFRDPDKAQGLVREIAQLSQKLGYTTEHPLKIMEVCGGHTHSIFKYGIQEALPNNIELIHGPGCPVCIMPRGRLDDAIALAEKPNVIFTTFGDGMRVPGSQKSLLQAKAQGADIRMVYSPLDSLKIAKENPDKEIIFFGLGFETTAPSAALTILQAEAEGVKNFSIFSNHVLVVPALEALLSNPDLELQGFVGPGHVSMVIGTQVYHIISEKYQKPVVVSGFEPLDILQSIWMLLQQILEGRCEVENQYSRIVKEEGNRVALEAMKRVFEVRDTFEWRGLGEIPESGLKITDAYSCFDAEAKFCLPNKKVADAKACQCGEILKGVLKPWECKVFGTACTPENPIGTCMVSSEGACAAYYKYGRLFKKEKVKV

SEQ ID NO: 92398 - DNA, 1086 bp, Moorella thermoacetica ATCC 39073
  CDS (1)..(1086)
atgggccgggttgccgccctggcagatgaggttgcggaacgccttgggcggccggcagtttttatagaagtatgcggtacacacacagtggctatttcccggctgggattgcggagcttgctggcaggtcgcgtagaattgcgaagcggccccgggtgtcctgtttgtgtaactgatcaccaggaaatcgatatgatggtcgatctggcccgcctgcccggggttacgctgggaaccttcggggatatgttacgcgttcccggcagccggtcttccctggagagggaacgcgccggcggtgccgacgtgcgcattttttactcgcccctggacgcagtggcctttgctgaagccaacccggaaagagaggtcgtgtttttagggattggttttgaaacgactgccccggcagtcgctgcaagccttgcgagggcccgggctaaaggggtgaaaaactttagtctattttcggcccataaactcatccccccggcccttcgcgccgttctcagtgaccccgaattaaaactggacgggcttatcttgccgggtcatgttagcgccgttactggcaggcgggcgtttgactttatcgttaaagagtatggcctgccgtcagtaatcagcggctttgaccccatggatattctgattgcccttcacgagcttttgcttcaattgctccggggcgaggcccgggttgccaacaagtacacgcgggtagtgcgggaagaaggtaacctggatgctcgcaagcgcattgcggagtgtttcgaggaggtcgatgtcccctggcgcggccttggagttattcctgaaagcggactttcactacgggaaacttttcgggattttgatgcccgatttaaactaaatatagaaccggccccgccaacacctctttacccgccaggttgtgcctgtaaagaaattttacggggaaaacttttacccccggaatgccggctatttagtaatgtatgtacacctgtccatcctgtaggcccctgtatggtttccagtgaaggggcctgcgcggcttactatcgatttgaacgtttttctccagttggaggtggcatttag

SEQ ID NO: 92399 - protein, 361 aa, Moorella thermoacetica ATCC 39073
MGRVAALADEVAERLGRPAVFIEVCGTHTVAISRLGLRSLLAGRVELRSGPGCPVCVTDHQEIDMMVDLARLPGVTLGTFGDMLRVPGSRSSLERERAGGADVRIFYSPLDAVAFAEANPEREVVFLGIGFETTAPAVAASLARARAKGVKNFSLFSAHKLIPPALRAVLSDPELKLDGLILPGHVSAVTGRRAFDFIVKEYGLPSVISGFDPMDILIALHELLLQLLRGEARVANKYTRVVREEGNLDARKRIAECFEEVDVPWRGLGVIPESGLSLRETFRDFDARFKLNIEPAPPTPLYPPGCACKEILRGKLLPPECRLFSNVCTPVHPVGPCMVSSEGACAAYYRFERFSPVGGGI

SEQ ID NO: 92400 - DNA, 1098 bp, Thiobacillus denitrificans ATCC 25259
  CDS (1)..(1098)
atggacgaagcacggatctggctcgagaaagtccacgcgctcgcgttcgaccgcaaggtcaagatcatgaacgtatgcggcgggcacgagcgctcgatcacccatgccggactgcgcggcgcgctgccggactggctcgagctcgtgcccggacccggctgcccggtctgcgtgtgccccgaagaagacgtctaccaggcgatccagctcgcgctgcaggacagggtcattctcgtcgcctacggcgacatgctgcgggtaccggtcaacgtcaagaaaggcgaaattcgatcactggccgaggcgcaggccgcgggggcggacgtgcggccgatcgcgagcccgctcgacgcccgcaggatcgcagccgaaaacccgacgcggcccgtggtgttcttcgccgcgggcttcgaaacgacgaccgcgccgaccgccgccatgctggccgaaggcgttcccgacaatctgagcattctgctgtccgggcgcctgacctggcccgcggtcgcgatgctgctcgactcgggcagccccggcttcgacgcgctgatcgcccccggccacgtgtcgaccgtgatggggcccgaggaatggaacttcgtcgtccaacgccacgagatccccgccgcggtcgccgggttcggcacggcctcgctgctcgcctccttctattcggtgctgcgccagctcgagagcggtgaacgctttctcgacaactgctaccgcgaagtcgcgcacccggacgggaatccaacggcgcgtcgaatgatggcccgcgcgttcgacgtggtcgacgcgaactggcgcggcatcggcgtgatcgctcgctcgggatacgcactcaaaccgggcctcgcgcagcacgacgcacgcgtcctgttcgacgaccacaccgatccggcgcgctggcgcgccggcgaaatgccgcccggatgcgactgcgcgcaagtcgttctcggcaagatctatcccaaccagtgccgcatctacggcaaggcctgcacgccgcgcaagccggtgggaccgtgcatggtctcggacgaaggcgcctgccgcatctggtgggccggtggcgtgcgcgtcgcggccgatgcctga

SEQ ID NO: 92401 - protein, 365 aa, Thiobacillus denitrificans ATCC 25259
MDEARIWLEKVHALAFDRKVKIMNVCGGHERSITHAGLRGALPDWLELVPGPGCPVCVCPEEDVYQAIQLALQDRVILVAYGDMLRVPVNVKKGEIRSLAEAQAAGADVRPIASPLDARRIAAENPTRPVVFFAAGFETTTAPTAAMLAEGVPDNLSILLSGRLTWPAVAMLLDSGSPGFDALIAPGHVSTVMGPEEWNFVVQRHEIPAAVAGFGTASLLASFYSVLRQLESGERFLDNCYREVAHPDGNPTARRMMARAFDVVDANWRGIGVIARSGYALKPGLAQHDARVLFDDHTDPARWRAGEMPPGCDCAQVVLGKIYPNQCRIYGKACTPRKPVGPCMVSDEGACRIWWAGGVRVAADA

SEQ ID NO: 92402 - DNA, 1062 bp, Desulfitobacterium hafniense DCB-2
  CDS (1)..(1062)
atggcggcgggctatctaaaagaaattcgggaattagcggcagccccctatacggttatggaggtatgtggaactcatactgtggctattgccaagaatgccttgcgggatttgctgccggctcagattcgcttggtctccggtccggggtgccctgtatgtgttacagacagcagcgatattgatcagtttctctatctggctgctcagcctcatgtcattaccgcaacctttggcgatatgattcgggtgcccggctcgcaaaagagtctgcagatgctgcgtggggaaggggcggatatccgcattgtttactccacactggacgccttggacctggcccggaagaaccctgacaaagaagtggtctttctcggcgtgggctttgagaccaccgttcccacggtgtgtgtaagcattgaacaggcccaaaaggaagatatcaggaattacagtattttatccatgcataagcttgtgcctcctgtgctgcgcgccttagcagaggatccggagacggaagtggatgggtttctggatcccggtcatgcctgcgctattattggcagcgaagccttggcctttatggctgaggattacgccatgcccggagtggttactggttttgaagctctggatatcctggaggggttggtcatgctgctccggcaaagagaccaaggccgtgcggagatagaaatacaatatgataagatcgtgaaaccggaaggcaatcgggtagctcaggctctcatccataagatctttgaaccggttgatgcagcatttcggggactcggtatcattcctctgggagggttgggggtccgtaaggaatatgaggattgggatgctgcgaaaaaattcgcgctcccggagtttgagaccgtagaaatccccggctgccgctgtgggaacgttctaaaggggcagattactccacctgagtgtccattatttgcccgtaagtgtacccccttgtctcctgtgggaccttgcatggtttcctcagaagggtcttgtgcagcttattaccgatatgcgcaaaggagtgggatataa

SEQ ID NO: 92403 - protein, 353 aa, Desulfitobacterium hafniense DCB-2
MAAGYLKEIRELAAAPYTVMEVCGTHTVAIAKNALRDLLPAQIRLVSGPGCPVCVTDSSDIDQFLYLAAQPHVITATFGDMIRVPGSQKSLQMLRGEGADIRIVYSTLDALDLARKNPDKEVVFLGVGFETTVPTVCVSIEQAQKEDIRNYSILSMHKLVPPVLRALAEDPETEVDGFLDPGHACAIIGSEALAFMAEDYAMPGVVTGFEALDILEGLVMLLRQRDQGRAEIEIQYDKIVKPEGNRVAQALIHKIFEPVDAAFRGLGIIPLGGLGVRKEYEDWDAAKKFALPEFETVEIPGCRCGNVLKGQITPPECPLFARKCTPLSPVGPCMVSSEGSCAAYYRYAQRSGI

SEQ ID NO: 92404 - DNA, 1092 bp, Campylobacter lari RM2100
  CDS (1)..(1092): transl_table=11
atggatttaattaatgattttagagataaagaaagaattttagccctaaaagaacttattgcttctaaaattactaagtctattaatatcatggaaatttgtggtggacatacgcatagtattatgaaatttggcttgcctgatttattaccaaaagaaattaattttgttcatggcccaggctgtcctgtgtgtgttatgccaagagagcgtattgatgtagctttaaaacttgcaagtataccaaatactatcttttgtgtattaggcgatatgcttaaagtgccaggaagctatgaaagcttaattgatcttagagctaaaggtgctgatattagagcgctttatacacctttggatgtgatagatatagctttaaaaaatcctgaaaaaaatataatcttttttgccataggttttgagactacaacccctatgagcggggtgattatagaaaaaagtatagccttaaatttaaaaaatttattttttcatatcaatcatgtattagttccacctgcggtagaagctatcatgcaagatgaaaatgtaaaaattgatgcctttttagggccttctcatgttagtgtcatcacaggatcaaacatttatgaacctattgctaaaaaatataaaacccctatagcagtgagtggttttgaaccggttgatataatgcttagcgtgttaaatatagtagagcaaatgaatgcaaatacttttgaagtttataatgaatatcacagagtagttagtaaagaaggaaatttaaaagccaaagctttagtggaaaaatactttaaaccttgtgattttgaatttagaggtcttggagtgattgtaaatggcgggctttgtttaaaagatgaatttgctcacttagatgctagcaaggtgtttgattgtaaagtacaaagtaaagatgaaagtaaggcttgcatttgtggtcaaattttaagaggcttagctaagccttatgattgtaaggtgtttgcaaaagcttgcactccaaaaaatcccataggtagctgtatggtttctagtgaaggagcttgtgcggcttattataaatactatcaagataaggcataa

SEQ ID NO: 92405 - protein, 363 aa, Campylobacter lari RM2100
MDLINDFRDKERILALKELIASKITKSINIMEICGGHTHSIMKFGLPDLLPKEINFVHGPGCPVCVMPRERIDVALKLASIPNTIFCVLGDMLKVPGSYESLIDLRAKGADIRALYTPLDVIDIALKNPEKNIIFFAIGFETTTPMSGVIIEKSIALNLKNLFFHINHVLVPPAVEAIMQDENVKIDAFLGPSHVSVITGSNIYEPIAKKYKTPIAVSGFEPVDIMLSVLNIVEQMNANTFEVYNEYHRVVSKEGNLKAKALVEKYFKPCDFEFRGLGVIVNGGLCLKDEFAHLDASKVFDCKVQSKDESKACICGQILRGLAKPYDCKVFAKACTPKNPIGSCMVSSEGACAAYYKYYQDKA

SEQ ID NO: 92406 - DNA, 1122 bp, Azorhizobium caulinodans
  CDS (1)..(1122): transl_table=11
atgcgtttcgtcgatgaattccgcgatccggccctcgccgccgcgctgatccgggaaatcgggaccatctgcgccaccctcgggcgcgcgaaggatgatcccgtcaccgtcatggaggtgtgtggcgggcacacccacgccatcttccgctatgggctcgaaggcctgttgcccgacctgatcgaattcgtgcacggccccggctgcccggtctgcgttctgcccatgggccgcgtggacgattgcgtcgccatcgccgagcggcccgaagtgatcttcgccaccttcggcgatgccatgcgggttcccggctcccgcaagagcctgcttcaggccaaggcggacggcgccgacgtgcgcatggtctattcgcccctcgacgcactggaactcgcccgccgcaatcccgaccgggaggtggtgttcttcggcctcggcttcgagaccaccatgccctctaccgcgctcaccgtgcagcgggcggcgcgcgagcgcatcaccaacttctccctcttctgcaatcacatcaccatcattccgacgctgcgggcgctgctggagcagccggacttcggcatcgatggcttcatcggacccggccatgtctccatggtcatcggcacggcgccctaccgcttcatcgccgaggaattccgcaagccgctggtggtggcgggcttcgaacccatcgatctcctgcaatccctgctgatgattctgcgccagatggcggcgggcgaggcgcggatcgagaaccagtacgcccgcgtcgtgccggagcgcggcaacccctccgccttgcgtgcggtggaggaggtgtatgagcctcgccccacattcgaatggcggggccttggctccatcgagcgctcgggtgtgcgcctgcgcgagccctatgccgccttcgatgccgagcggcgcttcgccgtgccggacgtgaaggtggccgatcccgcggcctgccgctgcggcgaggtgctgaccggcgccgtgaaaccgtgggcctgtccggtgttcggcaccacctgcacgccggagatgccgctcggcgcccttatggtgtcatccgagggcgcttgcgcggcctattaccaatatggcggcctgcggggggcagcatga

SEQ ID NO: 92407 - protein, 373 aa, Azorhizobium caulinodans
MRFVDEFRDPALAAALIREIGTICATLGRAKDDPVTVMEVCGGHTHAIFRYGLEGLLPDLIEFVHGPGCPVCVLPMGRVDDCVAIAERPEVIFATFGDAMRVPGSRKSLLQAKADGADVRMVYSPLDALELARRNPDREVVFFGLGFETTMPSTALTVQRAARERITNFSLFCNHITIIPTLRALLEQPDFGIDGFIGPGHVSMVIGTAPYRFIAEEFRKPLVVAGFEPIDLLQSLLMILRQMAAGEARIENQYARVVPERGNPSALRAVEEVYEPRPTFEWRGLGSIERSGVRLREPYAAFDAERRFAVPDVKVADPAACRCGEVLTGAVKPWACPVFGTTCTPEMPLGALMVSSEGACAAYYQYGGLRGAA

SEQ ID NO: 92408 - DNA, 1146 bp, Thiocapsa roseopersicina
  CDS (1)..(1146): transl_table=11
gtgaaatacatcgacgagttccgcgataaggggctcgcccgccggctcgccgagacgatcgccgccgaggcgcacccggggcgcgactatcgcttgatggagttctgcggcggccatacccacgccatctttcgctacggcgtgcagcacctgatgccgccgaacctgagtttcatccatggtcccggctgtccggtgtgcgtgctgccgatggcccggatcgaccatgcgattgcgctcgccacacagcacgatgtcacgctctgcacctacggcgatctcatgcgcgtgccggcgagcgagcgcaagagcctgctcaaggcgaaggccgatggagcagatatccgcatgatctactcgacccaagacgtgctgcggatcgcccgcgagaaccccgatcgccaggtcgtcttcttcgccatcggcttcgagacgaccacgccgccgaccgccgtggccgtgaagacggcgcgcgccgaggggctgaccaacttctcagtcttctgcaaccatgtgctgaccccgtcggcgctgcagacgatcctgagcaccgccggccccgacggggtccagctcgacggcatcctcggtccatcccatgtgagtacgctcatcggcagccgtccctaccgtttcgtggccgagcaattcggcgtgcccgtcgtgatcgccggtttcgagcccctggacgtgatgcagtccgccttgatgctcgtcagacagctcaacgacgggcgttgcgaggtcgagaaccagtacacgcgcgcggtaagcgaggaaggcaaccgcaaggcgcaggccctgatcgacgaggtctttcggatccgccccgagttcgaatggcgcgggctcggcttcctgccgaacagcgccttggcgctggacgacgcctacgcggacctggatgccgaggagcgctttccggtcgagttcgccccggccaaagagatcaagggctgcgagtgcccggccatcctgcgcggcgtaaagacaccgaccgactgcaagctcttcggcaacccctgcacgcccgacaaccccatgggttcctgcatggtgtcctcggagggtgcttgtgcggcctattggagctacgggcggttcagagccgccagcctccagccaaaggttgaaagccgaagctga

SEQ ID NO: 92409 - protein, 381 aa, Thiocapsa roseopersicina
MKYIDEFRDKGLARRLAETIAAEAHPGRDYRLMEFCGGHTHAIFRYGVQHLMPPNLSFIHGPGCPVCVLPMARIDHAIALATQHDVTLCTYGDLMRVPASERKSLLKAKADGADIRMIYSTQDVLRIARENPDRQVVFFAIGFETTTPPTAVAVKTARAEGLTNFSVFCNHVLTPSALQTILSTAGPDGVQLDGILGPSHVSTLIGSRPYRFVAEQFGVPVVIAGFEPLDVMQSALMLVRQLNDGRCEVENQYTRAVSEEGNRKAQALIDEVFRIRPEFEWRGLGFLPNSALALDDAYADLDAEERFPVEFAPAKEIKGCECPAILRGVKTPTDCKLFGNPCTPDNPMGSCMVSSEGACAAYWSYGRFRAASLQPKVESRS

SEQ ID NO: 92410 - DNA, 1086 bp, Synechococcus sp
  CDS (1)..(1086): transl_table=11
atgaaatttgtagatgaatttcgcgatcccgcagcggttcagaaatatgtgcaggcgatcgccgcccttgtgacccgtccatggacaatcatggagatctgcggcggacaaacccacagcatcgttaaatacggcatcgatcaactgctgcccccagaaatcaccttgattcatggccccggttgtccggtctgtgtcacccctgctgaacttattgatcaggcgatcgccctggctcagttgcccgatgtggtgttgtgttcctttggtgatatgttgcgcgtgccggggacaaggctcgatttactctcggtgaaggcgcagggggcggccgtaaaaatggtttattctcccctcgatgccctgaaaatggcccaggaaaatcccgacaaacaggtgattttttttgcggtgggctttgaaacgaccgcaccgaccacggcgatggcagtctaccaagccgccaagttaggactaaccaatttttccctcttggtcgcccatgtgtcagtgccgccagcgatagaagcgattttgtccgctccggatcgaaccattcagggttttttgctcgcgggccatgtctgcacggtgatggggtatcaggaatatgaggcgatcgccaaaaattaccaaatccccctgatcgtgacagggtttgaacccttggatattgtgcaggggatttatctctgcgtgaaacagttggaggaagggcgatcgcatatcgaaaatcaataccgtcgcgtcgtccaagccgcagggaatgccacggcacagcaattagtgaccgaaatttttgaaattgtgccccgtacttggcgcgggattggtgaaatttcccagagtggtctcggtttgcgcgaaaaatatgccgtctttgatgcctctcgcaaatttaagctagatttgacgcatttccagccccaagcatcttcttcttgtatcagtggcgaaattctgcgcggtcgaaaaaaacccaagcaatgtcccgcctttggcacaacctgcaccccagaacgtccccttggtgcgccgatggtttcctccgagggagcctgtgctgcctattaccgttacggctaa

SEQ ID NO: 92411 - protein, 361 aa, Synechococcus sp
MKFVDEFRDPAAVQKYVQAIAALVTRPWTIMEICGGQTHSIVKYGIDQLLPPEITLIHGPGCPVCVTPAELIDQAIALAQLPDVVLCSFGDMLRVPGTRLDLLSVKAQGAAVKMVYSPLDALKMAQENPDKQVIFFAVGFETTAPTTAMAVYQAAKLGLTNFSLLVAHVSVPPAIEAILSAPDRTIQGFLLAGHVCTVMGYQEYEAIAKNYQIPLIVTGFEPLDIVQGIYLCVKQLEEGRSHIENQYRRVVQAAGNATAQQLVTEIFEIVPRTWRGIGEISQSGLGLREKYAVFDASRKFKLDLTHFQPQASSSCISGEILRGRKKPKQCPAFGTTCTPERPLGAPMVSSEGACAAYYRYG

SEQ ID NO: 92412 - DNA, 1185 bp, Acidianus ambivalens
  CDS (1)..(1185): transl_table=11
atggatttacctaaacagattgatgcattatttagagagaatagcgaacttgcaaaatctattacagaacaaattcataaattagctccgatagtatccaaagaaattggcagagaaaaaattaagataatgaatttttgtgggtcacatgaatgggtgacgactcattatgggttaagagctctcatgccggaaacagtagagttaataccgggacctgggtgcccagtttgtgttactccgtccagtgacattgagaacgtaataaaattggccatggagggttacacagtttatacttttgggatgtttcaagttactacggtgaaacattataagaaagatgaggtagggagtttagcggctgccagagctttaggggctgatgtaagaatagtttacagttttgttgacgcaatagaagacgctaaaaagtctggaaaaccatcagtattttttggtataggattcgaaactactactcctagctatgcagtattgtttgagaaagaaaaggttcctaaaaacttactcttttattcttcgttaaaacttacagcaccagcggctgaattcgctgttaggttacacaagagcaaaggtctagtacctgtttctggagttattggtcccggtcacgtttctagcataattggggctattagctgggactttttccctagggaatataaaataccagcagtagttactggcttcgaaccgatagatgtcttagccggagttctaaaaatactccaagacttgcattcgggagatataacctacacgaacttggaatacaaaagagtagtaaagtaccaaggaaacgtgtatgcacaagttgaaataaataaggtcttcaagctggttgatgcaatatggaggggtataggttccataccgaagagcggtttggatttaagagaggagtattccatgtataatgcaagggaacaattaggaataaaagaaaagccttgggattacgatttgcctcctggatgcagatgtaatgaggtaaccttaggtattgcctaccctacagactgtcctatgtttatgaaagcttgtactcctgcaaggccctggggaccgtgcatggtgtccatggaaggagcatgtgccgtttgggccagattcggctctacggaaaggattactaaaattgtttcggaggtgaaataa

SEQ ID NO: 92413 - protein, 394 aa, Acidianus ambivalens
MDLPKQIDALFRENSELAKSITEQIHKLAPIVSKEIGREKIKIMNFCGSHEWVTTHYGLRALMPETVELIPGPGCPVCVTPSSDIENVIKLAMEGYTVYTFGMFQVTTVKHYKKDEVGSLAAARALGADVRIVYSFVDAIEDAKKSGKPSVFFGIGFETTTPSYAVLFEKEKVPKNLLFYSSLKLTAPAAEFAVRLHKSKGLVPVSGVIGPGHVSSIIGAISWDFFPREYKIPAVVTGFEPIDVLAGVLKILQDLHSGDITYTNLEYKRVVKYQGNVYAQVEINKVFKLVDAIWRGIGSIPKSGLDLREEYSMYNAREQLGIKEKPWDYDLPPGCRCNEVTLGIAYPTDCPMFMKACTPARPWGPCMVSMEGACAVWARFGSTERITKIVSEVK

SEQ ID NO: 92414 - DNA, 1140 bp, Rhodobacter sphaeroides
  CDS (1)..(1140): transl_table=11
atgaaattcgcgtccgagttccgcgatcccgccctcgcgcggagccttctggcggccatcgccgcgcgcgccgacgagatgggcgccacccgcgcccgcccgctgcacatcatggagatctgcggcggccacacccacgcgatcttccgctacgggctcgaccggctggtgcatgaggggatcgaattcatccacggccccggctgcccggtctgcgtcctgccgatgggccgggtcgacgaatgcatcgccatcgccgagcggcccgaggtgatcttcaccaccttcggcgatgcgatgcgcgtgccgggggcgccgggctcgctcttgcaggccaaggcacgcggcgcggacatccgcatggtctattcgccgctcgacgcgctcgagatcgcgcggcgcaatcccgcgcgcgaggttgtcttcttcggcctcggcttcgagacgacgacgccctcgaccgccctctcgatccagcaggcggcgcgggaggagctcttcaacttcagcgtcttctgcaaccacatcaccgtccccgaaccgatccgggcgctgctcgacgatcccgacatgcggctcgacggcttcatcgggcccggccatgtctcgatggtgatcggcatccatgcctacgatttcgtggcgcgcgactattccaagcccctcgtcgtggcgggcttcgagccaaccgatctcctccagtcggtgctgatggtgctggaccagatcgccgagggccgctcggagatcgagaaccagtatgcccgcgtggtgcccgagcacggcaatccggtcagcctcgccgccatcgccgacgtctacgagcgcaggccgagcttcgaatggcggggcctcggcgagatcgacgcctcgggcctgcgtatccgcgagacctatgccgccttcgatgccgaacggaagttcggtatcggctacggcgctcctgccgcgccccggcaggagcccgagggatgtgcctgcggcgcggtgatgaccggccggatcaagccccccgcctgcccgcagttcggccgcggctgcacgcccgagatgccgctcggcgcgctgatggtgagttcggaaggcgcctgcgcggcctactggcaatatgccggcgcacgcgggctggctgcggaatag

SEQ ID NO: 92415 - protein, 379 aa, Rhodobacter sphaeroides
MKFASEFRDPALARSLLAAIAARADEMGATRARPLHIMEICGGHTHAIFRYGLDRLVHEGIEFIHGPGCPVCVLPMGRVDECIAIAERPEVIFTTFGDAMRVPGAPGSLLQAKARGADIRMVYSPLDALEIARRNPAREVVFFGLGFETTTPSTALSIQQAAREELFNFSVFCNHITVPEPIRALLDDPDMRLDGFIGPGHVSMVIGIHAYDFVARDYSKPLVVAGFEPTDLLQSVLMVLDQIAEGRSEIENQYARVVPEHGNPVSLAAIADVYERRPSFEWRGLGEIDASGLRIRETYAAFDAERKFGIGYGAPAAPRQEPEGCACGAVMTGRIKPPACPQFGRGCTPEMPLGALMVSSEGACAAYWQYAGARGLAAE

SEQ ID NO: 92416 - DNA, 1110 bp, Thermococcus litoralis
  CDS (1)..(1110): transl_table=11
atggaactttcgatttttcaagatagagagttagctcagaagatactccaagggataaaacgagaggcggagagaataggtagggaagtaaagctgatgcacgtttgtggtactcatgaagacaccgtgacgagaagcgggataaggtctcttcttcccgaaaacgttaaagttatgagcggtcctggatgtcctgtctgcataacccccgcagaagacattgcggcaatgatggagataatgcgcaaagcaaaagaagagggagaggagataatcctcacgacctttggggacatgtataagatccccacagcagtgggaagctttgccgatctgaaaagtgaggggtttgatgttagagttgtttattcgatttacgattcctataagatagcactcaaagagaaggacaagctagtagttcatttttctccggggtttgaaaccacaactgctcccgctgcgggcatactgaaggaggttatagagaaaggaatagaaaacttcaaaatatattcagttcaccgcttaactcctcccgccgttgaggcgttgattaaacaagggacggtttttgatgggcttatagaccctggacacgtttcgacaataatcggcgtgaaaggatgggagtacataacaaaagaatatggagttccccaggtagttgcgggatttgagccggttgattttctcatgggaatattcatgctcttgagaatgataagaaagggagaggcaaaaatagaaaaccagtacacaagggttgtgaaatacgagggcaacgttgaggctcagagaacgatagaggctctctttgatgtcgttgacgcaaagtggagagctttgggtgtaataccaaaaagtgggttggagctcaaaaaagagtataaggattatgaagtaagaacattttacagggtaaagcctccagagctgcccgatctggagaagggatgcatatgtggggctgtgcttagaggactggcgctgccaacacagtgccccctctttggaaagaagtgtactccaagaaacccggttgggccgtgcatggtttcctatgagggaacgtgccagatattctacaaatatggggcgctcttttga

SEQ ID NO: 92417 - protein, 369 aa, Thermococcus litoralis
MELSIFQDRELAQKILQGIKREAERIGREVKLMHVCGTHEDTVTRSGIRSLLPENVKVMSGPGCPVCITPAEDIAAMMEIMRKAKEEGEEIILTTFGDMYKIPTAVGSFADLKSEGFDVRVVYSIYDSYKIALKEKDKLVVHFSPGFETTTAPAAGILKEVIEKGIENFKIYSVHRLTPPAVEALIKQGTVFDGLIDPGHVSTIIGVKGWEYITKEYGVPQVVAGFEPVDFLMGIFMLLRMIRKGEAKIENQYTRVVKYEGNVEAQRTIEALFDVVDAKWRALGVIPKSGLELKKEYKDYEVRTFYRVKPPELPDLEKGCICGAVLRGLALPTQCPLFGKKCTPRNPVGPCMVSYEGTCQIFYKYGALF

SEQ ID NO: 92418 - DNA, 1140 bp, Azotobacter chroococcum mcd 1
  CDS (1)..(1140): transl_table=11
atgaagtacgtcgacgaattccgcgacggcgccaccgcgcgccagctcgctgcgcgcatcgccgccgaggccgatcccgcgcgccagtaccggctgatggagttctgcggcgggcacacccacgcgatctttcgctatggcatccccgacctgctgccggccagcgtgcggctgatccacggcccgggctgcccggtctgcgtgatgccgatcggccggctggacatggccatcgaactggcgcgccgcccggaagtgatcctctgcacctacggcgacatgctgcgcgtgcccgcgtccggccgggtcagcctgctcaaggcgcgcgccgaaagcgccgcggtgcgcatgctctactcgccggccgaggcgctgaagctggcgcaggacaacccgagtaaagaggtggtgttcttcgccatcggcttcgagaccaccaccccgcccaccgcgctggtgatcgagcaggcgcagaggctcggcctgaagaatttctcggtgttctgcaaccacgtgctgaccccggcggcgatgcacgcgatcctcgccaccccggaggcgcgtgccggcacgctgcagctggacggcttcatcggcccggcccacgtcagcacggtgatcggcagcgcgccctacgcgcccttcccgcagcaatacggcacgccgctggtgatcgccggcttcgagccgctggacctgctgcaggcgctcttgatgctggtgcgccagctcaacgaggggcgcgccgaggtggaaaaccagttcacccgcgcggtgactgccgaaggcaaccgcaaggcgaaggcgctgaccgagcgggtcttcgaggtgcgcgagagcttcgagtggcgcggcctgggtgccgtgccgcacagcgccctgcagatccgcgaggccttcgccgagttcaacgccgagcggcgcttcgccctcgagccacgcaccggcctggagaacaaggcctgcgaatgcccggcgatcctccgtggggcgaagagcccgcgcgactgcaagctgttcggcaacccctgcaccccggacaacccgctcggctcgtgcatggtttcctccgagggcgcctgcgccgcctggtatgcctacggccgccagcgccaggctgccgtggaggtggcccgatga

SEQ ID NO: 92419 - protein, 379 aa, Azotobacter chroococcum mcd 1
MKYVDEFRDGATARQLAARIAAEADPARQYRLMEFCGGHTHAIFRYGIPDLLPASVRLIHGPGCPVCVMPIGRLDMAIELARRPEVILCTYGDMLRVPASGRVSLLKARAESAAVRMLYSPAEALKLAQDNPSKEVVFFAIGFETTTPPTALVIEQAQRLGLKNFSVFCNHVLTPAAMHAILATPEARAGTLQLDGFIGPAHVSTVIGSAPYAPFPQQYGTPLVIAGFEPLDLLQALLMLVRQLNEGRAEVENQFTRAVTAEGNRKAKALTERVFEVRESFEWRGLGAVPHSALQIREAFAEFNAERRFALEPRTGLENKACECPAILRGAKSPRDCKLFGNPCTPDNPLGSCMVSSEGACAAWYAYGRQRQAAVEVAR

SEQ ID NO: 92420 - DNA, 1143 bp, Bradyrhizobium japonicum
  CDS (1)..(1143): transl_table=11
atgaaatatgccgatgagtttcgcgacaaggagatcgcgctcgggctcgcgaaagcgatccgcgcggaagccgatccgcgaaagccctatcgcttcatggaattctgcggcggccatacccacgcgatctcgcgttacggcctcgaggacatgctgccgaagaacgtgcggatgatccacgggcccggctgtccggtctgtgtgctgccggccgggcgcatcgacatggcgatccggctcgccgagcggccagacatcatcctgtgcgtctatggcgacctgatgcgcgtcccgggctcgcagggcgcatcgctcctgaaggcgaaggcccgtggtgccgacatccgcatggtctattccacgatcgacgcgatccggatcgccgaggacaatcccgggcgcgaggtggtgttcttcgccatcggcttcgagaccacgacgccgccgaccgcggtcatgatccgattggccgggaagaagcaactcgaaaacttcagcgtgttctgcaaccacgtgctgacgccgccggcgatgcagaacatcctggagagcccggacatccgcaacatcggccgcgtcgagatcgacggttttgtcggacccgcccacgtctcgaccatcatcggtactgcgccttacgagttcttcgccgaggagttcggcaagccggtggtgatcgcgggcttcgagccgctcgacatgatgcaggcgatcctgatgctggtgcggcaggtcaacgagcacaggcatgaggtcgagaaccagtacagccgcgccgtgagccgcgacggcaatctgcgcgccaaggaagaagtgtccgacatcttcgagctgcgcgatcagttcgagtggcgcgggctcgggcaggtgccttatagcgggttgaagctgaagcgcgcttacgcgaaatacgacgcggaggtccgcttcgacatgaacgagctgcgcgtcgacgacaatccggcctgcgaatgcggcgcgatcctgcgcggtgtgaagaagccggtggattgcaagctgttcggcaccgtctgcacgccggagacgccgatgggatcctgcatggtctcctccgaaggcgcctgcgccgcgcactggacctatggccgcttccgcgatcatcagcagaggcgggcgtcatga

SEQ ID NO: 92421 - protein, 380 aa, Bradyrhizobium japonicum
MKYADEFRDKEIALGLAKAIRAEADPRKPYRFMEFCGGHTHAISRYGLEDMLPKNVRMIHGPGCPVCVLPAGRIDMAIRLAERPDIILCVYGDLMRVPGSQGASLLKAKARGADIRMVYSTIDAIRIAEDNPGREVVFFAIGFETTTPPTAVMIRLAGKKQLENFSVFCNHVLTPPAMQNILESPDIRNIGRVEIDGFVGPAHVSTIIGTAPYEFFAEEFGKPVVIAGFEPLDMMQAILMLVRQVNEHRHEVENQYSRAVSRDGNLRAKEEVSDIFELRDQFEWRGLGQVPYSGLKLKRAYAKYDAEVRFDMNELRVDDNPACECGAILRGVKKPVDCKLFGTVCTPETPMGSCMVSSEGACAAHWTYGRFRDHQQRRAS

SEQ ID NO: 92422 - DNA, 1140 bp, Alcaligenes eutrophus
  CDS (1)..(1140): transl_table=11
atgaaatacatcgaagaatttcgcgacggcgagctggcgcaacgcattgcggcgcacgttcgcgctgaggcgcggccggggcaacgctacaacttcatggagttctgcggcggacacacgcatgccatttcgcgttacggcgtgaccgaactgctgcccgagaacgtgcggatgattcacgggccgggctgcccagtgtgcgtgctgccgatcggccgcattgacctagcgctgcatctggcgctggagcgcgacgccatcgtctgcacttacggcgacacgatgcgggtgccggcctcggggggcatgtcgttgattcgggccaaggcgcacggggccgacatccgcatggtctactcggccgctgatgcgctgaaaattgcgcagcggcatccacagcgcgaggtggtgttccttgccattggcttcgagactacaacgcctccaactgcgctgattattcgcgaggcgaaggcgcgccaggtggataacttcagtgtgttgtgttgccacgtgcttacgccgtcggccattacccacatcctggagtcgcccgaggtgcgcgactatggcactgtgcccatcgacggattcgttgggccggctcatgtgagtatcgtgatcggtacccggccctatgagcatttttcacgcgagtacggtaagccggtggtgatcgcaggcttcgagccgctcgatgtgatgcaagccattctgatgttggtacgacaagtcaacagcggacgcgcagaggtggaaaatgagttcgtgcgcgctgtcacccgcgatggcaacgagagcgcgcaggccatggtgtcggaagtgttcgagctgcggccgtctttcgagtggcgaggactcggcgaggtgccatatagcgccttgcgcatccgcgcgcagtttgcgcgtttcgacgctgagcaacgcttcgatctgcgctaccggccggtgcctgacaataaggcttgcgaatgcggcgcgatcttgcgtggcgtcaagaagccaaccgactgcaagctgttcgctaccgtctgcaccccggagaatccgatggggtcgtgcatggtatccagcgaaggtgcctgcgccgcgcactattcgtatgggcggttcaaggatatccccttggtggcagcatga

SEQ ID NO: 92423 - protein, 379 aa, Alcaligenes eutrophus
MKYIEEFRDGELAQRIAAHVRAEARPGQRYNFMEFCGGHTHAISRYGVTELLPENVRMIHGPGCPVCVLPIGRIDLALHLALERDAIVCTYGDTMRVPASGGMSLIRAKAHGADIRMVYSAADALKIAQRHPQREVVFLAIGFETTTPPTALIIREAKARQVDNFSVLCCHVLTPSAITHILESPEVRDYGTVPIDGFVGPAHVSIVIGTRPYEHFSREYGKPVVIAGFEPLDVMQAILMLVRQVNSGRAEVENEFVRAVTRDGNESAQAMVSEVFELRPSFEWRGLGEVPYSALRIRAQFARFDAEQRFDLRYRPVPDNKACECGAILRGVKKPTDCKLFATVCTPENPMGSCMVSSEGACAAHYSYGRFKDIPLVAA

SEQ ID NO: 92424 - DNA, 1140 bp, Azotobacter vinelandii
  CDS (1)..(1140): transl_table=11
atgaagtacgtcgacgaattccgcgacggcgccaccgcgcgccagctcgccgcgcgcatcgccgccgaggccgatccgaagcgccagtaccggctgatggagttctgcggcgggcacacccacgcgatcttccgctacggcatccccgacctgctgccggccaacgtgcggctgatccacggccccggctgcccggtctgcgtgatgccgatcggccgcctggacatggccatcgaactggcgcgccgccccggcgtgatcctctgcacctacggcgacatgttgcgcgtgcccgcctccgggcgcgtcagtctgctcaaggcgcgcgccgaaggcgccgcagtgcgcatgctctactcgccgatcgaggcgctgaagctggcccaggacaacccggacagggacgtggtgttcttcgccatcggcttcgagaccaccacgccgcccaccgcgctggtgatcgaacaggcgcagaggctcggcttgaagaacttctcggtgttctgcaaccacgtgctgaccccggcggcgatgcacgccatcctcgccaccccggaggcgcgcgccggcacgctgcaactggacggcttcatcggcccggcccacgtcagcacggtgatcggcagcgacgcctacgcgcccttcccgcgtcagtacggcacgccgctggtgatcgccggcttcgaaccgctggacctgttgcaggcgctgctgatgctggtgcgccagctcaacgaggggcgtgccgaggtggaaaaccagttcacccgcgcggtcaccgcaggcggcaatctcaaggcgaaggcgctgaccgggcggatcttcgagctgcgcgagagtttcgagtggcgcggcctgggcgcgctgccgaacagcgccctgcggatccgcgaggccttcgccgaattcgacgccgagcggcgcttcgctctcgaagcgcgcagcggcctggagaacaaggcctgcgaatgcccggcgatcctccgcggggcgaagagcccgcgcgactgcaagctgttcggcaacccctgcagcccggacaatccgctcggctcgtgcatggtttcctccgagggcgcctgcgccgcctggtacgcctacggccgccagcgccaggccgtcgtggcggtggcccgatga

SEQ ID NO: 92425 - protein, 379 aa, Azotobacter vinelandii
MKYVDEFRDGATARQLAARIAAEADPKRQYRLMEFCGGHTHAIFRYGIPDLLPANVRLIHGPGCPVCVMPIGRLDMAIELARRPGVILCTYGDMLRVPASGRVSLLKARAEGAAVRMLYSPIEALKLAQDNPDRDVVFFAIGFETTTPPTALVIEQAQRLGLKNFSVFCNHVLTPAAMHAILATPEARAGTLQLDGFIGPAHVSTVIGSDAYAPFPRQYGTPLVIAGFEPLDLLQALLMLVRQLNEGRAEVENQFTRAVTAGGNLKAKALTGRIFELRESFEWRGLGALPNSALRIREAFAEFDAERRFALEARSGLENKACECPAILRGAKSPRDCKLFGNPCSPDNPLGSCMVSSEGACAAWYAYGRQRQAVVAVAR

SEQ ID NO: 92426 - DNA, 1158 bp, Rhizobium leguminosarum
  CDS (1)..(1158): transl_table=11
atgaaatatatcgacgaatatcgcgacggcagcctcgccaaggacgttgcccggcaaatcaccgcgctcgccgaccccgcgcgctcctatcacttcatggaattctgcggtggccacacgcatgccatctcccgctacggccttgaggacctgctgcccgccaatgtgcggatgatccacgggccgggatgtcccgtctgtgtcctgccgatcggccgcattgatgctgcgatcgcgcttgccatgcggccggaaatcacgctctgcacctatggcgacctgatgcgagtaccgggctccaacggttcgagcttgttgaaggccaaggcggccggtgcggacatccgcatggtctattcgacgctcgatgcgttgcggatcgccgatgccgaacccgaccgcgaggtcgtattcttcgcgatcggcttcgagacgacgacaccgacgaccgcgctcgcgctcaaggcggcaatcgccagggggctcggcaatttctcgatcttctgcaatcacgttctgacgcccgcgccgatccagaacatcctcgaaagcccggatgtccgaaagctcggcacgatcaagatcgatggatttatcggtcccgcccatgtctcgacggtgatcggcaccgagccttatgagttcttcgccgaggagttccgcaagccggtggtggtggcgggtttcgaaccgctcgacgttatccaggcgatcctgatgctggtgcggcaggtcaacgatggccgccatgaggtggaaaaccagtatatccgcgcggtcaccgccctcggcaacgagaaggcccaggcggaggtcgcaaatttcttcgaactccgggagagcttcgaatggcgggggctcggcgaagtgccctatggcgcgctgcggctcaggccacaatatgcggcctatgatgccgaaaaacgcttctcgatggtcacgcccgccgcgaaggacaatccggcctgcgaatgcggcgcgatcctgcgcggcgtcaagaagccggccgactgcaagctgttcggtacggtctgcacgccggacacacccatgggttcctgcatggtctcgccggaaggcgcctgcgcggcgcactgggcctatggccgcttccgcgaaaaggtgcggcaggttgatgcgcggagagcggtcgcatga

SEQ ID NO: 92427 - protein, 385 aa, Rhizobium leguminosarum
MKYIDEYRDGSLAKDVARQITALADPARSYHFMEFCGGHTHAISRYGLEDLLPANVRMIHGPGCPVCVLPIGRIDAAIALAMRPEITLCTYGDLMRVPGSNGSSLLKAKAAGADIRMVYSTLDALRIADAEPDREVVFFAIGFETTTPTTALALKAAIARGLGNFSIFCNHVLTPAPIQNILESPDVRKLGTIKIDGFIGPAHVSTVIGTEPYEFFAEEFRKPVVVAGFEPLDVIQAILMLVRQVNDGRHEVENQYIRAVTALGNEKAQAEVANFFELRESFEWRGLGEVPYGALRLRPQYAAYDAEKRFSMVTPAAKDNPACECGAILRGVKKPADCKLFGTVCTPDTPMGSCMVSPEGACAAHWAYGRFREKVRQVDARRAVA

SEQ ID NO: 92428 - DNA, 1134 bp, Rhodobacter capsulatus
  CDS (1)..(1134)
atgaaattcgcctcggaattccgtgaccccgcgctggcgaaggggcttttggcggagatcgcgcggctggccgaccagatcggcgcgacggcggaaaagcccgtccatatcatggagatctgcggcgggcacacgcattcgatctttcgctacgggctcgacaagctcattcatccgggcatcgaattcatccacgggccgggctgtccggtctgcgtgctgccgcgcgcgcgggtcgatgaatgcatcgagatcgccgggcggcccgaggtgatcttttgcacctttggcgatgcgatgcgggttccgggctcgaagctgagcctgatgcaggcgaaggcggcgggggccgatatccgcatggtctattcgcccttggatgcgctggaactggcgcggcgcaaccccgggcgcgaggtggtgttctttggtctgggcttcgagacgacgacgccctcgactgccttggcgatccagcaggccgcgcgcgaggggctggcgaatttcagcgtcttttgcaaccacatcaccgtgcccgagccgatcagggcgctgctggatgacccctacatgcggctcgacggcttcatcgggccgggccatgtctcgatggtgatcggcattcatccctatgatttcattgccgaggattacggcaagccgctggtcgtcgcggggttcgaacccacggatctcttgcaatcggtgctgatggtgctgcgccagatatcccaaggccgcgcggcgatcgagaaccaatatgcccgcgtcgtgcccgagcatggcaaccgggtgtcgctggcggcgattgctgacgtctatgagcggcggccctcgttcgaatggcgggggcttggcgagatcgacgcctcggggctgcgcattcgggcggcctatcgcgcccatgatgccgaggagaaattcggcgtgggctatgcgggccagcgcgccgcggtcgaggaggccgagggctgcgcctgcggcgcggtgatgaccgggcggatgaaacccgtcgcctgtgcgcaattcggcaagggctgcacgcccgaaatgccgctgggcgcgctgatggtgagttcggagggggcctgtgcggcctattggcaatatggcggggcgcgggcggcggaatga

SEQ ID NO: 92429 - protein, 377 aa, Rhodobacter capsulatus
MKFASEFRDPALAKGLLAEIARLADQIGATAEKPVHIMEICGGHTHSIFRYGLDKLIHPGIEFIHGPGCPVCVLPRARVDECIEIAGRPEVIFCTFGDAMRVPGSKLSLMQAKAAGADIRMVYSPLDALELARRNPGREVVFFGLGFETTTPSTALAIQQAAREGLANFSVFCNHITVPEPIRALLDDPYMRLDGFIGPGHVSMVIGIHPYDFIAEDYGKPLVVAGFEPTDLLQSVLMVLRQISQGRAAIENQYARVVPEHGNRVSLAAIADVYERRPSFEWRGLGEIDASGLRIRAAYRAHDAEEKFGVGYAGQRAAVEEAEGCACGAVMTGRMKPVACAQFGKGCTPEMPLGALMVSSEGACAAYWQYGGARAAE

SEQ ID NO: 92430 - DNA, 1077 bp, Methanococcus jannaschii
  CDS (1)..(1077): transl_table=11
atgattaatatcaatgatagagccttaataaaaaaagccatagataagataaacaaacttgctgagaagatagataaattaaagattatgcacgtctgtggaagtcatgagcacacaatctgtaagtatgggattagggatgttctgccagagaatataaccgttgttccagggccgggttgtccagtttgtgtaacaactcaaaaagagatagatacagccatatatttagctgacaatggatatgtaataaccactcttggagatatgtatagagtgccgggaagtgaaaaatctttgatggaaaagcaatctgagggttgtgatgttagaattgtctatagtataagtgaagcagtaaagatggctaagaaggagagagataagaagtttgtttttgtggcaataggttttgaaaccactgctccaactactggggctgaactaataagtttaaaaaataaagatgttaataacttctttatcctaaattgccacaggcagactcctccagttatggagttcttgttaaatgagggagtttatttagatgcatttatatgcccaggacatgtttcaacaatcaccggattaaagccttattatgggttgtgtgaaaaatacaaagctccaatggttgttgctggctttgagccaatagatgtgttaatggctataataatgattttaaagcaagtcatcagtggagaggcaaaggttgaaaatgaatatattagagcagttaagccagaaggtaatgttttagctcaaaaaataataaatgaagtttttgaaagcatagatgttccttggagaggtttcccagttgttaaaaatggtggttttggattgagggagaagtataagaaatttgacatctatgagcatgaggatattccagagattaaagagaaaattcctaaaggttgtatatgtgataagattttgagaggagagaaactgccaactgactgcccattgtttggaacggtttgcactccattaaatccagttggtagttgtatggtttcagatgagggaacgtgtaggatattttataagtataggaggatttaa

SEQ ID NO: 92431 - protein, 358 aa, Methanococcus jannaschii
MININDRALIKKAIDKINKLAEKIDKLKIMHVCGSHEHTICKYGIRDVLPENITVVPGPGCPVCVTTQKEIDTAIYLADNGYVITTLGDMYRVPGSEKSLMEKQSEGCDVRIVYSISEAVKMAKKERDKKFVFVAIGFETTAPTTGAELISLKNKDVNNFFILNCHRQTPPVMEFLLNEGVYLDAFICPGHVSTITGLKPYYGLCEKYKAPMVVAGFEPIDVLMAIIMILKQVISGEAKVENEYIRAVKPEGNVLAQKIINEVFESIDVPWRGFPVVKNGGFGLREKYKKFDIYEHEDIPEIKEKIPKGCICDKILRGEKLPTDCPLFGTVCTPLNPVGSCMVSDEGTCRIFYKYRRI

SEQ ID NO: 92432 - DNA, 25 bp, Primer
atgcgttttgttgatgaatatcgcg

SEQ ID NO: 92433 - DNA, 24 bp, Primer
ttacgcttcactctcctgctgacg

SEQ ID NO: 92434 - protein, 358 aa, consensus
  MISC_FEATURE (1)..(358): consensus for the disclosure of xaa see table XV
MXXCGXHXXXIXXXGXXXXLPXXXXXXXGPGCPVCVXPXXXXXXXXXXAXXXXXXXXXXXXXXXGDXXRVPXXXXXXXXXXSLXXXXXXGXDXRXXYSXXXXXXXAXXXPXXXVVFXXXGFETTXPXXAXXXXXXXXXXXXNXXXXXXHXXXXXXXXXXXXXXXXXXXXXXXXXXXXXXPXHVXXXXGXXXXXXXXXXXXXPXXXXGFEPXDXXXXXXXXXXQXXXXXXXXXXNXYXRXVXXXGNXXAXXXXXXXFXXXXXXXWRGXGXXXXSXXXXXXXXXXXDAXXXXXXXXXXXXXXXXXXXXXXXXXXCXCXXXLXGXXXPXXCXXFXXXCTPXXPXGXXMVSXEGXCXXXXXY

SEQ ID NO: 92435 - protein, 48 aa, consensus
  MISC_FEATURE (1)..(48): consensus for the disclosure of xaa see table XV
XXXCGXXXXXXXXXXXXXXXXXXXXXXXGPGCPVCXXXXXXXXXXXXX

SEQ ID NO: 92436 - protein, 60 aa, consensus
  MISC_FEATURE (1)..(60): consensus for the disclosure of xaa see table XV
XXXXXXXXXXXXXXXXXXXXXXXAXXXXXXXXXXXXXGFEXXXXXXXXXXXXXXXXXXXX

SEQ ID NO: 92437 - protein, 110 aa, consensus
  MISC_FEATURE (1)..(110): consensus for the disclosure of xaa see table XV
XXXXXXXXXXXXGXXXXXXXXXXXXXXXXXXGFXXXXXXXXXXXXXXXXXXXXXXXXXXXXXXXXXXXGXXXXXXXXXXXXXXXXXXXXRXXXXXXXXXXXXXXXXXXXX

SEQ ID NO: 92438 - protein, 46 aa, consensus
  MISC_FEATURE (1)..(46): consensus for the disclosure of xaa see table XV
XXXXXXXXGXXXPXXCXXXXXXCXPXXXXGXXMXSXXGXCXXXXXX

SEQ ID NO: 92439 - DNA, 864 bp, Escherichia coli; identical to SEQ ID NO: 46787
  CDS (1)..(864)

SEQ ID NO: 92440 - protein, 287 aa, Escherichia coli; identical to SEQ ID NO: 46788

SEQ ID NO: 92441 - DNA, 891 bp, Mesorhizobium loti MAFF303099; identical to SEQ ID NO: 46789
  CDS (1)..(891): transl_table=11

SEQ ID NO: 92442 - protein, 296 aa, Mesorhizobium loti MAFF303099; identical to SEQ ID NO: 46790

SEQ ID NO: 92443 - DNA, 867 bp, Borrelia burgdorferi B31; identical to SEQ ID NO: 46791
  CDS (1)..(867): transl_table=11

SEQ ID NO: 92444 - protein, 288 aa, Borrelia burgdorferi B31; identical to SEQ ID NO: 46792

SEQ ID NO: 92445 - DNA, 879 bp, Thermotoga maritima MSB8; identical to SEQ ID NO: 46793
  CDS (1)..(879): transl_table=11

SEQ ID NO: 92446 - protein, 292 aa, Thermotoga maritima MSB8; identical to SEQ ID NO: 46794

SEQ ID NO: 92447 - DNA, 885 bp, Bacillus halodurans C-125; identical to SEQ ID NO: 46795
  CDS (1)..(885): transl_table=11

SEQ ID NO: 92448 - protein, 294 aa, Bacillus halodurans C-125; identical to SEQ ID NO: 46796

SEQ ID NO: 92449 - DNA, 864 bp, Pasteurella multocida subsp. multocida str. Pm70; identical to SEQ ID NO: 46797
  CDS (1)..(864): transl_table=11

SEQ ID NO: 92450 - protein, 287 aa, Pasteurella multocida subsp. multocida str. Pm70; identical to SEQ ID NO: 46798

SEQ ID NO: 92451 - DNA, 864 bp, Pseudomonas aeruginosa PAO1; identical to SEQ ID NO: 46799
  CDS (1)..(864): transl_table=11

SEQ ID NO: 92452 - protein, 287 aa, Pseudomonas aeruginosa PAO1; identical to SEQ ID NO: 46800

SEQ ID NO: 92453 - DNA, 885 bp, Neisseria meningitidis Z2491; identical to SEQ ID NO: 46801
  CDS (1)..(885): transl_table=11

SEQ ID NO: 92454 - protein, 294 aa, Neisseria meningitidis Z2491; identical to SEQ ID NO: 46802

SEQ ID NO: 92455 - DNA, 879 bp, Clostridium acetobutylicum ATCC 824; identical to SEQ ID NO: 46803
  CDS (1)..(879): transl_table=11

SEQ ID NO: 92456 - protein, 292 aa, Clostridium acetobutylicum ATCC 824; identical to SEQ ID NO: 46804

SEQ ID NO: 92457 - DNA, 888 bp, Sinorhizobium meliloti 1021; identical to SEQ ID NO: 46805
  CDS (1)..(888): transl_table=11

SEQ ID NO: 92458 - protein, 295 aa, Sinorhizobium meliloti 1021; identical to SEQ ID NO: 46806

SEQ ID NO: 92459 - DNA, 876 bp, Bacillus subtilis subsp. subtilis str. 168; identical to SEQ ID NO: 46807
  CDS (1)..(876): transl_table=11

SEQ ID NO: 92460 - protein, 291 aa, Bacillus subtilis subsp. subtilis str. 168; identical to SEQ ID NO: 46808

SEQ ID NO: 92461 - DNA, 882 bp, Caulobacter crescentus CB15; identical to SEQ ID NO: 46809
  CDS (1)..(882): transl_table=11

SEQ ID NO: 92462 - protein, 293 aa, Caulobacter crescentus CB15; identical to SEQ ID NO: 46810

SEQ ID NO: 92463 - DNA, 864 bp, Salmonella typhimurium LT2; identical to SEQ ID NO: 46811
  CDS (1)..(864): transl_table=11

SEQ ID NO: 92464 - protein, 287 aa, Salmonella typhimurium LT2; identical to SEQ ID NO: 46812

SEQ ID NO: 92465 - DNA, 876 bp, Listeria innocua Clip11262; identical to SEQ ID NO: 46813
  CDS (1)..(876): transl_table=11

SEQ ID NO: 92466 - protein, 291 aa, Listeria innocua Clip11262; identical to SEQ ID NO: 46814

SEQ ID NO: 92467 - DNA, 888 bp, Agrobacterium tumefaciens str. C58; identical to SEQ ID NO: 46815
  CDS (1)..(888): transl_table=11

SEQ ID NO: 92468 - protein, 295 aa, Agrobacterium tumefaciens str. C58; identical to SEQ ID NO: 46816

SEQ ID NO: 92469 - DNA, 945 bp, Brucella melitensis 16M; identical to SEQ ID NO: 46817
  CDS (1)..(945): transl_table=11

SEQ ID NO: 92470 - protein, 314 aa, Brucella melitensis 16M; identical to SEQ ID NO: 46818

SEQ ID NO: 92471 - DNA, 885 bp, Clostridium perfringens str. 13; identical to SEQ ID NO: 46819
  CDS (1)..(885): transl_table=11

SEQ ID NO: 92472 - protein, 294 aa, Clostridium perfringens str. 13; identical to SEQ ID NO: 46820

SEQ ID NO: 92473 - DNA, 879 bp, Fusobacterium nucleatum subsp. nucleatum ATCC 25586; identical to SEQ ID NO: 46821
  CDS (1)..(879): transl_table=11

SEQ ID NO: 92474 - protein, 292 aa, Fusobacterium nucleatum subsp. nucleatum ATCC 25586; identical to SEQ ID NO: 46822

SEQ ID NO: 92475 - DNA, 873 bp, Thermoanaerobacter tengcongensis MB4; identical to SEQ ID NO: 46823
  CDS (1)..(873): transl_table=11

SEQ ID NO: 92476 - protein, 290 aa, Thermoanaerobacter tengcongensis MB4; identical to SEQ ID NO: 46824

SEQ ID NO: 92477 - DNA, 888 bp, Chlorobium tepidum TLS; identical to SEQ ID NO: 46825
  CDS (1)..(888): transl_table=11

SEQ ID NO: 92478 - protein, 295 aa, Chlorobium tepidum TLS; identical to SEQ ID NO: 46826

SEQ ID NO: 92479 - DNA, 864 bp, Yersinia pestis KIM; identical to SEQ ID NO: 46827
  CDS (1)..(864): transl_table=11

SEQ ID NO: 92480 - protein, 287 aa, Yersinia pestis KIM; identical to SEQ ID NO: 46828

SEQ ID NO: 92481 - DNA, 900 bp, Brucella suis 1330; identical to SEQ ID NO: 46829
  CDS (1)..(900): transl_table=11

SEQ ID NO: 92482 - protein, 299 aa, Brucella suis 1330; identical to SEQ ID NO: 46830

SEQ ID NO: 92483 - DNA, 864 bp, Shewanella oneidensis MR-1; identical to SEQ ID NO: 46831
  CDS (1)..(864): transl_table=11

SEQ ID NO: 92484 - protein, 287 aa, Shewanella oneidensis MR-1; identical to SEQ ID NO: 46832

SEQ ID NO: 92485 - DNA, 951 bp, Pseudomonas putida KT2440; identical to SEQ ID NO: 46833
  CDS (1)..(951): transl_table=11

SEQ ID NO: 92486 - protein, 316 aa, Pseudomonas putida KT2440; identical to SEQ ID NO: 46834

SEQ ID NO: 92487 - DNA, 888 bp, Bradyrhizobium japonicum USDA 110; identical to SEQ ID NO: 46835
  CDS (1)..(888)

SEQ ID NO: 92488 - protein, 295 aa, Bradyrhizobium japonicum USDA 110; identical to SEQ ID NO: 46836

SEQ ID NO: 92489 - DNA, 864 bp, Xylella fastidiosa Temecula1; identical to SEQ ID NO: 46837
  CDS (1)..(864): transl_table=11

SEQ ID NO: 92490 - protein, 287 aa, Xylella fastidiosa Temecula1; identical to SEQ ID NO: 46838

SEQ ID NO: 92491 - DNA, 888 bp, Clostridium tetani E88; identical to SEQ ID NO: 46839
  CDS (1)..(888): transl_table=11

SEQ ID NO: 92492 - protein, 295 aa, Clostridium tetani E88; identical to SEQ ID NO: 46840

SEQ ID NO: 92493 - DNA, 867 bp, Vibrio parahaemolyticus RIMD 2210633; identical to SEQ ID NO: 46841
  CDS (1)..(867): transl_table=11

SEQ ID NO: 92494 - protein, 288 aa, Vibrio parahaemolyticus RIMD 2210633; identical to SEQ ID NO: 46842

SEQ ID NO: 92495 - DNA, 867 bp, Bacteroides thetaiotaomicron VPI-5482; identical to SEQ ID NO: 46843
  CDS (1)..(867): transl_table=11

SEQ ID NO: 92496 - protein, 288 aa, Bacteroides thetaiotaomicron VPI-5482; identical to SEQ ID NO: 46844

SEQ ID NO: 92497 - DNA, 885 bp, Enterococcus faecalis V583; identical to SEQ ID NO: 46845
  CDS (1)..(885): transl_table=11

SEQ ID NO: 92498 - protein, 294 aa, Enterococcus faecalis V583; identical to SEQ ID NO: 46846

SEQ ID NO: 92499 - DNA, 864 bp, Coxiella burnetii RSA 493; identical to SEQ ID NO: 46847
  CDS (1)..(864): transl_table=11

SEQ ID NO: 92500 - protein, 287 aa, Coxiella burnetii RSA 493; identical to SEQ ID NO: 46848

SEQ ID NO: 92501 - DNA, 876 bp, Bacillus cereus ATCC 14579; identical to SEQ ID NO: 46849
  CDS (1)..(876): transl_table=11

SEQ ID NO: 92502 - protein, 291 aa, Bacillus cereus ATCC 14579; identical to SEQ ID NO: 46850

SEQ ID NO: 92503 - DNA, 867 bp, Nitrosomonas europaea ATCC 19718; identical to SEQ ID NO: 46851
  CDS (1)..(867): transl_table=11

SEQ ID NO: 92504 - protein, 288 aa, Nitrosomonas europaea ATCC 19718; identical to SEQ ID NO: 46852

SEQ ID NO: 92505 - DNA, 1029 bp, Rhodopirellula baltica SH 1; identical to SEQ ID NO: 46853
  CDS (1)..(1029): transl_table=11

SEQ ID NO: 92506 - protein, 342 aa, Rhodopirellula baltica SH 1; identical to SEQ ID NO: 46854

SEQ ID NO: 92507 - DNA, 864 bp, Wigglesworthia glossinidia endosymbiont of Glossina brevipalpis; identical to SEQ ID NO: 46855
  CDS (1)..(864): transl_table=11

SEQ ID NO: 92508 - protein, 287 aa, Wigglesworthia glossinidia endosymbiont of Glossina brevipalpis; identical to SEQ ID NO: 46856

SEQ ID NO: 92509 - DNA, 873 bp, Candidatus Blochmannia floridanus; identical to SEQ ID NO: 46857
  CDS (1)..(873): transl_table=11

SEQ ID NO: 92510 - protein, 290 aa, Candidatus Blochmannia floridanus; identical to SEQ ID NO: 46858

SEQ ID NO: 92511 - DNA, 927 bp, Bordetella bronchiseptica RB50; identical to SEQ ID NO: 46859
  CDS (1)..(927): transl_table=11

SEQ ID NO: 92512 - protein, 308 aa, Bordetella bronchiseptica RB50; identical to SEQ ID NO: 46860

SEQ ID NO: 92513 - DNA, 867 bp, Chromobacterium violaceum ATCC 12472; identical to SEQ ID NO: 46861
  CDS (1)..(867): transl_table=11

SEQ ID NO: 92514 - protein, 288 aa, Chromobacterium violaceum ATCC 12472; identical to SEQ ID NO: 46862

SEQ ID NO: 92515 - DNA, 891 bp, Porphyromonas gingivalis W83; identical to SEQ ID NO: 46863
  CDS (1)..(891): transl_table=11

SEQ ID NO: 92516 - protein, 296 aa, Porphyromonas gingivalis W83; identical to SEQ ID NO: 46864

SEQ ID NO: 92517 - DNA, 864 bp, Photorhabdus luminescens subsp. laumondii TTO1; identical to SEQ ID NO: 46865
  CDS (1)..(864): transl_table=11

SEQ ID NO: 92518 - protein, 287 aa, Photorhabdus luminescens subsp. laumondii TTO1; identical to SEQ ID NO: 46866

SEQ ID NO: 92519 - DNA, 888 bp, Rhodopseudomonas palustris CGA009; identical to SEQ ID NO: 46867
  CDS (1)..(888): transl_table=11

SEQ ID NO: 92520 - protein, 295 aa, Rhodopseudomonas palustris CGA009; identical to SEQ ID NO: 46868

SEQ ID NO: 92521 - DNA, 879 bp, Bdellovibrio bacteriovorus HD100; identical to SEQ ID NO: 46869
  CDS (1)..(879): transl_table=11

SEQ ID NO: 92522 - protein, 292 aa, Bdellovibrio bacteriovorus HD100; identical to SEQ ID NO: 46870

SEQ ID NO: 92523 - DNA, 867 bp, Treponema denticola ATCC 35405; identical to SEQ ID NO: 46871
  CDS (1)..(867): transl_table=11

SEQ ID NO: 92524 - protein, 288 aa, Treponema denticola ATCC 35405; identical to SEQ ID NO: 46872

SEQ ID NO: 92525 - DNA, 885 bp, Parachlamydia sp. UWE25; identical to SEQ ID NO: 46873
  CDS (1)..(885): transl_table=11

SEQ ID NO: 92526 - protein, 294 aa, Parachlamydia sp. UWE25; identical to SEQ ID NO: 46874

SEQ ID NO: 92527 - DNA, 882 bp, Desulfovibrio vulgaris subsp. vulgaris str. Hildenborough; identical to SEQ ID NO: 46875
  CDS (1)..(882): transl_table=11

SEQ ID NO: 92528 - protein, 293 aa, Desulfovibrio vulgaris subsp. vulgaris str. Hildenborough; identical to SEQ ID NO: 46876

SEQ ID NO: 92529 - DNA, 864 bp, Erwinia carotovora subsp. atroseptica SCRI1043; identical to SEQ ID NO: 46877
  CDS (1)..(864)

SEQ ID NO: 92530 - protein, 287 aa, Erwinia carotovora subsp. atroseptica SCRI1043; identical to SEQ ID NO: 46878

SEQ ID NO: 92531 - DNA, 894 bp, Desulfotalea psychrophila LSv54; identical to SEQ ID NO: 46879
  CDS (1)..(894): transl_table=11

SEQ ID NO: 92532 - protein, 297 aa, Desulfotalea psychrophila LSv54; identical to SEQ ID NO: 46880

SEQ ID NO: 92533 - DNA, 870 bp, Borrelia garinii PBi; identical to SEQ ID NO: 46881
  CDS (1)..(870): transl_table=11

SEQ ID NO: 92534 - protein, 289 aa, Borrelia garinii PBi; identical to SEQ ID NO: 46882

SEQ ID NO: 92535 - DNA, 879 bp, Symbiobacterium thermophilum IAM 14863; identical to SEQ ID NO: 46883
  CDS (1)..(879): transl_table=11

SEQ ID NO: 92536 - protein, 292 aa, Symbiobacterium thermophilum IAM 14863; identical to SEQ ID NO: 46884

SEQ ID NO: 92537 - DNA, 864 bp, Mannheimia succiniciproducens MBEL55E; identical to SEQ ID NO: 46885
  CDS (1)..(864): transl_table=11

SEQ ID NO: 92538 - protein, 287 aa, Mannheimia succiniciproducens MBEL55E; identical to SEQ ID NO: 46886

SEQ ID NO: 92539 - DNA, 876 bp, Bacillus licheniformis ATCC 14580; identical to SEQ ID NO: 46887
  CDS (1)..(876): transl_table=11

SEQ ID NO: 92540 - protein, 291 aa, Bacillus licheniformis ATCC 14580; identical to SEQ ID NO: 46888

SEQ ID NO: 92541 - DNA, 870 bp, Methylococcus capsulatus str. Bath; identical to SEQ ID NO: 46889
  CDS (1)..(870): transl_table=11

SEQ ID NO: 92542 - protein, 289 aa, Methylococcus capsulatus str. Bath; identical to SEQ ID NO: 46890

SEQ ID NO: 92543 - DNA, 867 bp, Legionella pneumophila str. Paris; identical to SEQ ID NO: 46891
  CDS (1)..(867): transl_table=11

SEQ ID NO: 92544 - protein, 288 aa, Legionella pneumophila str. Paris; identical to SEQ ID NO: 46892

SEQ ID NO: 92545 - DNA, 864 bp, Photobacterium profundum SS9; identical to SEQ ID NO: 46893
  CDS (1)..(864): transl_table=11

SEQ ID NO: 92546 - protein, 287 aa, Photobacterium profundum SS9; identical to SEQ ID NO: 46894

SEQ ID NO: 92547 - DNA, 876 bp, Geobacillus kaustophilus HTA426; identical to SEQ ID NO: 46895
  CDS (1)..(876): transl_table=11

SEQ ID NO: 92548 - protein, 291 aa, Geobacillus kaustophilus HTA426; identical to SEQ ID NO: 46896

SEQ ID NO: 92549 - DNA, 864 bp, Idiomarina loihiensis L2TR; identical to SEQ ID NO: 46897
  CDS (1)..(864): transl_table=11

SEQ ID NO: 92550 - protein, 287 aa, Idiomarina loihiensis L2TR; identical to SEQ ID NO: 46898

SEQ ID NO: 92551 - DNA, 867 bp, Azoarcus sp. EbN1; identical to SEQ ID NO: 46899
  CDS (1)..(867): transl_table=11

SEQ ID NO: 92552 - protein, 288 aa, Azoarcus sp. EbN1; identical to SEQ ID NO: 46900

SEQ ID NO: 92553 - DNA, 891 bp, Silicibacter pomeroyi DSS-3; identical to SEQ ID NO: 46901
  CDS (1)..(891): transl_table=11

SEQ ID NO: 92554 - protein, 296 aa, Silicibacter pomeroyi DSS-3; identical to SEQ ID NO: 46902

SEQ ID NO: 92555 - DNA, 891 bp, Rhodobacter sphaeroides 2.4.1; identical to SEQ ID NO: 46903
  CDS (1)..(891)

SEQ ID NO: 92556 - protein, 296 aa, Rhodobacter sphaeroides 2.4.1; identical to SEQ ID NO: 46904

SEQ ID NO: 92557 - DNA, 870 bp, Desulfitobacterium hafniense DCB-2; identical to SEQ ID NO: 46905
  CDS (1)..(870)

SEQ ID NO: 92558 - protein, 289 aa, Desulfitobacterium hafniense DCB-2; identical to SEQ ID NO: 46906

SEQ ID NO: 92559 - DNA, 864 bp, Actinobacillus pleuropneumoniae serovar 1 str. 4074; identical to SEQ ID NO: 46907
  CDS (1)..(864)

SEQ ID NO: 92560 - protein, 287 aa, Actinobacillus pleuropneumoniae serovar 1 str. 4074; identical to SEQ ID NO: 46908

SEQ ID NO: 92561 - DNA, 855 bp, Dechloromonas aromatica RCB; identical to SEQ ID NO: 46909
  CDS (1)..(855)

SEQ ID NO: 92562 - protein, 284 aa, Dechloromonas aromatica RCB; identical to SEQ ID NO: 46910

SEQ ID NO: 92563 - DNA, 867 bp, Methylobacillus flagellatus KT; identical to SEQ ID NO: 46911
  CDS (1)..(867)

SEQ ID NO: 92564 - protein, 288 aa, Methylobacillus flagellatus KT; identical to SEQ ID NO: 46912

SEQ ID NO: 92565 - DNA, 900 bp, Magnetospirillum magnetotacticum MS-1; identical to SEQ ID NO: 46913
  CDS (1)..(900)

SEQ ID NO: 92566 - protein, 299 aa, Magnetospirillum magnetotacticum MS-1; identical to SEQ ID NO: 46914

SEQ ID NO: 92567 - DNA, 822 bp, Rubrivivax gelatinosus PM1; identical to SEQ ID NO: 46915
  CDS (1)..(822)

SEQ ID NO: 92568 - protein, 273 aa, Rubrivivax gelatinosus PM1; identical to SEQ ID NO: 46916

SEQ ID NO: 92569 - DNA, 888 bp, Rhodospirillum rubrum; identical to SEQ ID NO: 46917
  CDS (1)..(888)

SEQ ID NO: 92570 - protein, 295 aa, Rhodospirillum rubrum; identical to SEQ ID NO: 46918

SEQ ID NO: 92571 - DNA, 936 bp, Ralstonia metallidurans CH34; identical to SEQ ID NO: 46919
  CDS (1)..(936)

SEQ ID NO: 92572 - protein, 311 aa, Ralstonia metallidurans CH34; identical to SEQ ID NO: 46920

SEQ ID NO: 92573 - DNA, 924 bp, Burkholderia fungorum LB400; identical to SEQ ID NO: 46921
  CDS (1)..(924)

SEQ ID NO: 92574 - protein, 307 aa, Burkholderia fungorum LB400; identical to SEQ ID NO: 46922

SEQ ID NO: 92575 - DNA, 882 bp, Enterococcus faecium; identical to SEQ ID NO: 46923
  CDS (1)..(882)

SEQ ID NO: 92576 - protein, 293 aa, Enterococcus faecium; identical to SEQ ID NO: 46924

SEQ ID NO: 92577 - DNA, 888 bp, Magnetococcus sp. MC-1; identical to SEQ ID NO: 46925
  CDS (1)..(888)

SEQ ID NO: 92578 - protein, 295 aa, Magnetococcus sp. MC-1; identical to SEQ ID NO: 46926

SEQ ID NO: 92579 - DNA, 879 bp, Geobacter metallireducens GS-15; identical to SEQ ID NO: 46927
  CDS (1)..(879)

SEQ ID NO: 92580 - protein, 292 aa, Geobacter metallireducens GS-15; identical to SEQ ID NO: 46928

SEQ ID NO: 92581 - DNA, 870 bp, Cytophaga hutchinsonii; identical to SEQ ID NO: 46929
  CDS (1)..(870)

SEQ ID NO: 92582 - protein, 289 aa, Cytophaga hutchinsonii; identical to SEQ ID NO: 46930

SEQ ID NO: 92583 - DNA, 885 bp, Clostridium thermocellum ATCC 27405; identical to SEQ ID NO: 46931
  CDS (1)..(885)

SEQ ID NO: 92584 - protein, 294 aa, Clostridium thermocellum ATCC 27405; identical to SEQ ID NO: 46932

SEQ ID NO: 92585 - DNA, 855 bp, Microbulbifer degradans 2-40; identical to SEQ ID NO: 46933
  CDS (1)..(855)

SEQ ID NO: 92586 - protein, 284 aa, Microbulbifer degradans 2-40; identical to SEQ ID NO: 46934

SEQ ID NO: 92587 - DNA, 879 bp, Moorella thermoacetica ATCC 39073; identical to SEQ ID NO: 46935
  CDS (1)..(879)

SEQ ID NO: 92588 - protein, 292 aa, Moorella thermoacetica ATCC 39073; identical to SEQ ID NO: 46936

SEQ ID NO: 92589 - DNA, 867 bp, Thiobacillus denitrificans ATCC 25259; identical to SEQ ID NO: 46937
  CDS (1)..(867)

SEQ ID NO: 92590 - protein, 288 aa, Thiobacillus denitrificans ATCC 25259; identical to SEQ ID NO: 46938

SEQ ID NO: 92591 - DNA, 882 bp, Silicibacter sp. TM1040; identical to SEQ ID NO: 46939
  CDS (1)..(882)

SEQ ID NO: 92592 - protein, 293 aa, Silicibacter sp. TM1040; identical to SEQ ID NO: 46940

SEQ ID NO: 92593 - DNA, 873 bp, Azotobacter vinelandii; identical to SEQ ID NO: 46941
  CDS (1)..(873)

SEQ ID NO: 92594 - protein, 290 aa, Azotobacter vinelandii; identical to SEQ ID NO: 46942

SEQ ID NO: 92595 - DNA, 903 bp, Polaromonas sp. JS666; identical to SEQ ID NO: 46943
  CDS (1)..(903)

SEQ ID NO: 92596 - protein, 300 aa, Polaromonas sp. JS666; identical to SEQ ID NO: 46944

SEQ ID NO: 92597 - DNA, 864 bp, Haemophilus influenzae; identical to SEQ ID NO: 46945
  CDS (1)..(864): transl_table=11

SEQ ID NO: 92598 - protein, 287 aa, Haemophilus influenzae; identical to SEQ ID NO: 46946

SEQ ID NO: 92599 - DNA, 22 bp, Primer
atgatccgcagtatgaccgcct

SEQ ID NO: 92600 - DNA, 24 bp, Primer
ttattcgatgttctgaatctgctc

SEQ ID NO: 92601 - protein, 338 aa, consensus; identical to SEQ ID NO: 46949
  MISC_FEATURE (1)..(338): consensus for the disclosure of xaa see table XV

SEQ ID NO: 92602 - protein, 73 aa, consensus; identical to SEQ ID NO: 46950
  MISC_FEATURE (1)..(73): consensus for the disclosure of xaa see table XV

SEQ ID NO: 92603 - protein, 101 aa, consensus; identical to SEQ ID NO: 46951
  MISC_FEATURE (1)..(101): consensus for the disclosure of xaa see table XV

SEQ ID NO: 92604 - DNA, 1575 bp, Escherichia coli K12; identical to SEQ ID NO: 62948
  CDS (244)..(1575)

SEQ ID NO: 92605 - protein, 443 aa, Escherichia coli K12; identical to SEQ ID NO: 62949

SEQ ID NO: 92606 - DNA, 1326 bp, Yersinia pestis; identical to SEQ ID NO: 62950
  CDS (1)..(1326)

SEQ ID NO: 92607 - protein, 441 aa, Yersinia pestis; identical to SEQ ID NO: 62951

SEQ ID NO: 92608 - DNA, 1332 bp, Salmonella enterica subsp. enterica serovar Typhi; identical to SEQ ID NO: 62952
  CDS (1)..(1332)

SEQ ID NO: 92609 - protein, 443 aa, Salmonella enterica subsp. enterica serovar Typhi; identical to SEQ ID NO: 62953

SEQ ID NO: 92610 - DNA, 1311 bp, Neisseria meningitidis; identical to SEQ ID NO: 62954
  CDS (1)..(1311)

SEQ ID NO: 92611 - protein, 436 aa, Neisseria meningitidis; identical to SEQ ID NO: 62955

SEQ ID NO: 92612 - DNA, 1863 bp, Arabidopsis thaliana (mouse-ear cress); identical to SEQ ID NO: 62956
  CDS (1)..(1863)

SEQ ID NO: 92613 - protein, 620 aa, Arabidopsis thaliana (mouse-ear cress); identical to SEQ ID NO: 62957

SEQ ID NO: 92614 - DNA, 1371 bp, Vibrio cholerae; identical to SEQ ID NO: 62958
  CDS (1)..(1371)

SEQ ID NO: 92615 - protein, 456 aa, Vibrio cholerae; identical to SEQ ID NO: 62959

SEQ ID NO: 92616 - DNA, 1299 bp, Pseudomonas aeruginosa; identical to SEQ ID NO: 62960
  CDS (1)..(1299)

SEQ ID NO: 92617 - protein, 432 aa, Pseudomonas aeruginosa; identical to SEQ ID NO: 62961

SEQ ID NO: 92618 - DNA, 1259 bp, Pseudomonas aeruginosa; identical to SEQ ID NO: 62962
  CDS (45)..(1238)

SEQ ID NO: 92619 - protein, 397 aa, Pseudomonas aeruginosa; identical to SEQ ID NO: 62963

SEQ ID NO: 92620 - DNA, 1716 bp, Arabidopsis thaliana (mouse-ear cress); identical to SEQ ID NO: 62964
  CDS (1)..(1716)

SEQ ID NO: 92621 - protein, 571 aa, Arabidopsis thaliana (mouse-ear cress); identical to SEQ ID NO: 62965

SEQ ID NO: 92622 - DNA, 1326 bp, Erwinia carotovora; identical to SEQ ID NO: 62966
  CDS (1)..(1326)

SEQ ID NO: 92623 - protein, 441 aa, Erwinia carotovora; identical to SEQ ID NO: 62967

SEQ ID NO: 92624 - DNA, 1356 bp, Acinetobacter sp; identical to SEQ ID NO: 62968
  CDS (1)..(1356)

SEQ ID NO: 92625 - protein, 451 aa, Acinetobacter sp; identical to SEQ ID NO: 62969

SEQ ID NO: 92626 - DNA, 1326 bp, Photobacterium profundum; identical to SEQ ID NO: 62970
  CDS (1)..(1326)

SEQ ID NO: 92627 - protein, 441 aa, Photobacterium profundum; identical to SEQ ID NO: 62971

SEQ ID NO: 92628 - DNA, 1872 bp, Oryza sativa; identical to SEQ ID NO: 62972
  CDS (1)..(1731)

SEQ ID NO: 92629 - protein, 576 aa, Oryza sativa; identical to SEQ ID NO: 62973

SEQ ID NO: 92630 - DNA, 1308 bp, Chromobacterium violaceum; identical to SEQ ID NO: 62974
  CDS (1)..(1308)

SEQ ID NO: 92631 - protein, 435 aa, Chromobacterium violaceum; identical to SEQ ID NO: 62975

SEQ ID NO: 92632 - DNA, 1404 bp, Bordetella parapertussis; identical to SEQ ID NO: 62976
  CDS (1)..(1404)

SEQ ID NO: 92633 - protein, 467 aa, Bordetella parapertussis; identical to SEQ ID NO: 62977

SEQ ID NO: 92634 - DNA, 1335 bp, Nitrosomonas europaea; identical to SEQ ID NO: 62978
  CDS (1)..(1335)

SEQ ID NO: 92635 - protein, 444 aa, Nitrosomonas europaea; identical to SEQ ID NO: 62979

SEQ ID NO: 92636 - DNA, 2075 bp, Arabidopsis thaliana; identical to SEQ ID NO: 62980
  CDS (120)..(1949)

SEQ ID NO: 92637 - protein, 609 aa, Arabidopsis thaliana; identical to SEQ ID NO: 62981

SEQ ID NO: 92638 - DNA, 1728 bp, Oryza sativa; identical to SEQ ID NO: 62982
  CDS (1)..(1728)

SEQ ID NO: 92639 - protein, 575 aa, Oryza sativa; identical to SEQ ID NO: 62983

SEQ ID NO: 92640 - DNA, 1329 bp, Buchnera aphidicola; identical to SEQ ID NO: 62984
  CDS (1)..(1329)

SEQ ID NO: 92641 - protein, 442 aa, Buchnera aphidicola; identical to SEQ ID NO: 62985

SEQ ID NO: 92642 - DNA, 1314 bp, Haemophilus ducreyi; identical to SEQ ID NO: 62986
  CDS (1)..(1314)

SEQ ID NO: 92643 - protein, 437 aa, Haemophilus ducreyi; identical to SEQ ID NO: 62987

SEQ ID NO: 92644 - DNA, 1323 bp, Pasteurella multocida; identical to SEQ ID NO: 62988
  CDS (1)..(1323)

SEQ ID NO: 92645 - protein, 440 aa, Pasteurella multocida; identical to SEQ ID NO: 62989

SEQ ID NO: 92646 - DNA, 1347 bp, Photorhabdus luminescens; identical to SEQ ID NO: 62990
  CDS (1)..(1347)

SEQ ID NO: 92647 - protein, 448 aa, Photorhabdus luminescens; identical to SEQ ID NO: 62991

SEQ ID NO: 92648 - DNA, 1299 bp, Pseudomonas putida; identical to SEQ ID NO: 62992
  CDS (1)..(1299)

SEQ ID NO: 92649 - protein, 432 aa, Pseudomonas putida; identical to SEQ ID NO: 62993

SEQ ID NO: 92650 - DNA, 1299 bp, Pseudomonas syringae; identical to SEQ ID NO: 62994
  CDS (1)..(1299)

SEQ ID NO: 92651 - protein, 432 aa, Pseudomonas syringae; identical to SEQ ID NO: 62995

SEQ ID NO: 92652 - DNA, 1356 bp, Ralstonia solanacearum; identical to SEQ ID NO: 62996
  CDS (1)..(1356)

SEQ ID NO: 92653 - protein, 451 aa, Ralstonia solanacearum; identical to SEQ ID NO: 62997

SEQ ID NO: 92654 - DNA, 1338 bp, Shewanella oneidensis; identical to SEQ ID NO: 62998
  CDS (1)..(1338)

SEQ ID NO: 92655 - protein, 445 aa, Shewanella oneidensis; identical to SEQ ID NO: 62999

SEQ ID NO: 92656 - DNA, 1338 bp, Vibrio parahaemolyticus; identical to SEQ ID NO: 63000
  CDS (1)..(1338)

SEQ ID NO: 92657 - protein, 445 aa, Vibrio parahaemolyticus; identical to SEQ ID NO: 63001

SEQ ID NO: 92658 - DNA, 25 bp, Primer
atggtaaaggaacgtaaaaccgagt

SEQ ID NO: 92659 - DNA, 24 bp, Primer
ttaccctaaatccgccatcaacac

SEQ ID NO: 92660 - protein, 528 aa, consensus; identical to SEQ ID NO: 63004
  MISC_FEATURE (1)..(528): consensus for the disclosure of xaa see table XV

SEQ ID NO: 92661 - protein, 108 aa, consensus; identical to SEQ ID NO: 63005
  MISC_FEATURE (1)..(108): consensus for the disclosure of xaa see table XV

SEQ ID NO: 92662 - protein, 79 aa, consensus; identical to SEQ ID NO: 63006
  MISC_FEATURE (1)..(79): consensus for the disclosure of xaa see table XV

SEQ ID NO: 92663 - protein, 103 aa, consensus; identical to SEQ ID NO: 63007
  MISC_FEATURE (1)..(103): consensus for the disclosure of xaa see table XV

SEQ ID NO: 92664 - protein, 76 aa, consensus; identical to SEQ ID NO: 63008
  MISC_FEATURE (1)..(76): consensus for the disclosure of xaa see table XV

SEQ ID NO: 92665 - DNA, 378 bp, Escherichia coli; identical to SEQ ID NO: 44321
  CDS (1)..(378)

SEQ ID NO: 92666 - protein, 125 aa, Escherichia coli; identical to SEQ ID NO: 44322

SEQ ID NO: 92667 - DNA, 474 bp, Gluconobacter oxydans 621H; identical to SEQ ID NO: 44323
  CDS (1)..(474)

SEQ ID NO: 92668 - protein, 157 aa, Gluconobacter oxydans 621H; identical to SEQ ID NO: 44324

SEQ ID NO: 92669 - DNA, 405 bp, Wolbachia endosymbiont strain TRS of Brugia malayi; identical to SEQ ID NO: 44325
  CDS (1)..(405)

SEQ ID NO: 92670 - protein, 134 aa, Wolbachia endosymbiont strain TRS of Brugia malayi; identical to SEQ ID NO: 44326

SEQ ID NO: 92671 - DNA, 384 bp, Xanthomonas oryzae pv. oryzae KACC10331; identical to SEQ ID NO: 44327
  CDS (1)..(384)

SEQ ID NO: 92672 - protein, 127 aa, Xanthomonas oryzae pv. oryzae KACC10331; identical to SEQ ID NO: 44328

SEQ ID NO: 92673 - DNA, 465 bp, Caulobacter crescentus CB15; identical to SEQ ID NO: 44329
  CDS (1)..(465): transl_table=11

SEQ ID NO: 92674 - protein, 154 aa, Caulobacter crescentus CB15; identical to SEQ ID NO: 44330

SEQ ID NO: 92675 - DNA, 402 bp, Agrobacterium tumefaciens str. C58; identical to SEQ ID NO: 44331
  CDS (1)..(402): transl_table=11

SEQ ID NO: 92676 - protein, 133 aa, Agrobacterium tumefaciens str. C58; identical to SEQ ID NO: 44332

SEQ ID NO: 92677 - DNA, 426 bp, Brucella melitensis 16M; identical to SEQ ID NO: 44333
  CDS (1)..(426): transl_table=11

SEQ ID NO: 92678 - protein, 141 aa, Brucella melitensis 16M; identical to SEQ ID NO: 44334

SEQ ID NO: 92679 - DNA, 405 bp, Bradyrhizobium japonicum USDA 110; identical to SEQ ID NO: 44335
  CDS (1)..(405)

SEQ ID NO: 92680 - protein, 134 aa, Bradyrhizobium japonicum USDA 110; identical to SEQ ID NO: 44336

SEQ ID NO: 92681 - DNA, 375 bp, Bordetella bronchiseptica RB50; identical to SEQ ID NO: 44337
  CDS (1)..(375): transl_table=11

SEQ ID NO: 92682 - protein, 124 aa, Bordetella bronchiseptica RB50; identical to SEQ ID NO: 44338

SEQ ID NO: 92683 - DNA, 378 bp, Erwinia carotovora subsp. atroseptica SCRI1043; identical to SEQ ID NO: 44339
  CDS (1)..(378)

SEQ ID NO: 92684 - protein, 125 aa, Erwinia carotovora subsp. atroseptica SCRI1043; identical to SEQ ID NO: 44340

SEQ ID NO: 92685 - DNA, 378 bp, Yersinia pseudotuberculosis IP 32953; identical to SEQ ID NO: 44341
  CDS (1)..(378): transl_table=11

SEQ ID NO: 92686 - protein, 125 aa, Yersinia pseudotuberculosis IP 32953; identical to SEQ ID NO: 44342

SEQ ID NO: 92687 - DNA, 381 bp, Methylococcus capsulatus str. Bath; identical to SEQ ID NO: 44343
  CDS (1)..(381): transl_table=11

SEQ ID NO: 92688 - protein, 126 aa, Methylococcus capsulatus str. Bath; identical to SEQ ID NO: 44344

SEQ ID NO: 92689 - DNA, 453 bp, Anaplasma marginale str. St. Maries; identical to SEQ ID NO: 44345
  CDS (1)..(453): transl_table=11

SEQ ID NO: 92690 - protein, 150 aa, Anaplasma marginale str. St. Maries; identical to SEQ ID NO: 44346

SEQ ID NO: 92691 - DNA, 375 bp, Idiomarina loihiensis L2TR; identical to SEQ ID NO: 44347
  CDS (1)..(375): transl_table=11

SEQ ID NO: 92692 - protein, 124 aa, Idiomarina loihiensis L2TR; identical to SEQ ID NO: 44348

SEQ ID NO: 92693 - DNA, 384 bp, Azoarcus sp. EbN1; identical to SEQ ID NO: 44349
  CDS (1)..(384): transl_table=11

SEQ ID NO: 92694 - protein, 127 aa, Azoarcus sp. EbN1; identical to SEQ ID NO: 44350

SEQ ID NO: 92695 - DNA, 405 bp, Ehrlichia ruminantium str. Welgevonden; identical to SEQ ID NO: 44351
  CDS (1)..(405): transl_table=11

SEQ ID NO: 92696 - protein, 134 aa, Ehrlichia ruminantium str. Welgevonden; identical to SEQ ID NO: 44352

SEQ ID NO: 92697 - DNA, 384 bp, Xylella fastidiosa Ann-1; identical to SEQ ID NO: 44353
  CDS (1)..(384)

SEQ ID NO: 92698 - protein, 127 aa, Xylella fastidiosa Ann-1; identical to SEQ ID NO: 44354

SEQ ID NO: 92699 - DNA, 393 bp, Magnetospirillum magnetotacticum MS-1; identical to SEQ ID NO: 44355
  CDS (1)..(393)

SEQ ID NO: 92700 - protein, 130 aa, Magnetospirillum magnetotacticum MS-1; identical to SEQ ID NO: 44356

SEQ ID NO: 92701 - DNA, 393 bp, Magnetospirillum magnetotacticum MS-1; identical to SEQ ID NO: 44357
  CDS (1)..(393)

SEQ ID NO: 92702 - protein, 130 aa, Magnetospirillum magnetotacticum MS-1; identical to SEQ ID NO: 44358

SEQ ID NO: 92703 - DNA, 381 bp, Azotobacter vinelandii; identical to SEQ ID NO: 44359
  CDS (1)..(381)

SEQ ID NO: 92704 - protein, 126 aa, Azotobacter vinelandii; identical to SEQ ID NO: 44360

SEQ ID NO: 92705 - DNA, 384 bp, Desulfitobacterium hafniense DCB-2; identical to SEQ ID NO: 44361
  CDS (1)..(384)

SEQ ID NO: 92706 - protein, 127 aa, Desulfitobacterium hafniense DCB-2; identical to SEQ ID NO: 44362

SEQ ID NO: 92707 - DNA, 384 bp, Methylobacillus flagellatus KT; identical to SEQ ID NO: 44363
  CDS (1)..(384)

SEQ ID NO: 92708 - protein, 127 aa, Methylobacillus flagellatus KT; identical to SEQ ID NO: 44364

SEQ ID NO: 92709 - DNA, 393 bp, Mesorhizobium sp. BNC1; identical to SEQ ID NO: 44365
  CDS (1)..(393)

SEQ ID NO: 92710 - protein, 130 aa, Mesorhizobium sp. BNC1; identical to SEQ ID NO: 44366

SEQ ID NO: 92711 - DNA, 384 bp, Ehrlichia canis str. Jake; identical to SEQ ID NO: 44367
  CDS (1)..(384)

SEQ ID NO: 92712 - protein, 127 aa, Ehrlichia canis str. Jake; identical to SEQ ID NO: 44368

SEQ ID NO: 92713 - DNA, 375 bp, Rubrivivax gelatinosus PM1; identical to SEQ ID NO: 44369
  CDS (1)..(375)

SEQ ID NO: 92714 - protein, 124 aa, Rubrivivax gelatinosus PM1; identical to SEQ ID NO: 44370

SEQ ID NO: 92715 - DNA, 381 bp, Pseudomonas fluorescens PfO-1; identical to SEQ ID NO: 44371
  CDS (1)..(381)

SEQ ID NO: 92716 - protein, 126 aa, Pseudomonas fluorescens PfO-1; identical to SEQ ID NO: 44372

SEQ ID NO: 92717 - DNA, 408 bp, Rhodospirillum rubrum; identical to SEQ ID NO: 44373
  CDS (1)..(408)

SEQ ID NO: 92718 - protein, 135 aa, Rhodospirillum rubrum; identical to SEQ ID NO: 44374

SEQ ID NO: 92719 - DNA, 375 bp, Ralstonia metallidurans CH34; identical to SEQ ID NO: 44375
  CDS (1)..(375)

SEQ ID NO: 92720 - protein, 124 aa, Ralstonia metallidurans CH34; identical to SEQ ID NO: 44376

SEQ ID NO: 92721 - DNA, 375 bp, Burkholderia fungorum LB400; identical to SEQ ID NO: 44377
  CDS (1)..(375)

SEQ ID NO: 92722 - protein, 124 aa, Burkholderia fungorum LB400; identical to SEQ ID NO: 44378

SEQ ID NO: 92723 - DNA, 381 bp, Magnetococcus sp. MC-1; identical to SEQ ID NO: 44379
  CDS (1)..(381)

SEQ ID NO: 92724 - protein, 126 aa, Magnetococcus sp. MC-1; identical to SEQ ID NO: 44380

SEQ ID NO: 92725 - DNA, 399 bp, Novosphingobium aromaticivorans DSM 12444; identical to SEQ ID NO: 44381
  CDS (1)..(399)

SEQ ID NO: 92726 - protein, 132 aa, Novosphingobium aromaticivorans DSM 12444; identical to SEQ ID NO: 44382

SEQ ID NO: 92727 - DNA, 387 bp, Cytophaga hutchinsonii; identical to SEQ ID NO: 44383
  CDS (1)..(387)

SEQ ID NO: 92728 - protein, 128 aa, Cytophaga hutchinsonii; identical to SEQ ID NO: 44384

SEQ ID NO: 92729 - DNA, 372 bp, Microbulbifer degradans 2-40; identical to SEQ ID NO: 44385
  CDS (1)..(372)

SEQ ID NO: 92730 - protein, 123 aa, Microbulbifer degradans 2-40; identical to SEQ ID NO: 44386

SEQ ID NO: 92731 - DNA, 384 bp, Thiobacillus denitrificans ATCC 25259; identical to SEQ ID NO: 44387
  CDS (1)..(384)

SEQ ID NO: 92732 - protein, 127 aa, Thiobacillus denitrificans ATCC 25259; identical to SEQ ID NO: 44388

SEQ ID NO: 92733 - DNA, 384 bp, Dechloromonas aromatica RCB; identical to SEQ ID NO: 44389
  CDS (1)..(384)

SEQ ID NO: 92734 - protein, 127 aa, Dechloromonas aromatica RCB; identical to SEQ ID NO: 44390

SEQ ID NO: 92735 - DNA, 414 bp, Chloroflexus aurantiacus; identical to SEQ ID NO: 44391
  CDS (1)..(414)

SEQ ID NO: 92736 - protein, 137 aa, Chloroflexus aurantiacus; identical to SEQ ID NO: 44392

SEQ ID NO: 92737 - DNA, 396 bp, Polaromonas sp. JS666; identical to SEQ ID NO: 44393
  CDS (1)..(396)

SEQ ID NO: 92738 - protein, 131 aa, Polaromonas sp. JS666; identical to SEQ ID NO: 44394

SEQ ID NO: 92739 - DNA, 903 bp, Oryza sativa; identical to SEQ ID NO: 44395
  CDS (1)..(903)

SEQ ID NO: 92740 - protein, 300 aa, Oryza sativa; identical to SEQ ID NO: 44396

SEQ ID NO: 92741 - DNA, 384 bp, Bdellovibrio bacteriovorus; identical to SEQ ID NO: 44397
  CDS (1)..(384)

SEQ ID NO: 92742 - protein, 127 aa, Bdellovibrio bacteriovorus; identical to SEQ ID NO: 44398

SEQ ID NO: 92743 - DNA, 393 bp, Brucella suis; identical to SEQ ID NO: 44399
  CDS (1)..(393)

SEQ ID NO: 92744 - protein, 130 aa, Brucella suis; identical to SEQ ID NO: 44400

SEQ ID NO: 92745 - DNA, 381 bp, Chromobacterium violaceum; identical to SEQ ID NO: 44401
  CDS (1)..(381): transl_table=11

SEQ ID NO: 92746 - protein, 126 aa, Chromobacterium violaceum; identical to SEQ ID NO: 44402

SEQ ID NO: 92747 - DNA, 387 bp, Deinococcus radiodurans; identical to SEQ ID NO: 44403
  CDS (1)..(387): transl_table=11

SEQ ID NO: 92748 - protein, 128 aa, Deinococcus radiodurans; identical to SEQ ID NO: 44404

SEQ ID NO: 92749 - DNA, 384 bp, Nitrosomonas europaea; identical to SEQ ID NO: 44405
  CDS (1)..(384): transl_table=11

SEQ ID NO: 92750 - protein, 127 aa, Nitrosomonas europaea; identical to SEQ ID NO: 44406

SEQ ID NO: 92751 - DNA, 378 bp, Photorhabdus luminescens; identical to SEQ ID NO: 44407
  CDS (1)..(378): transl_table=11

SEQ ID NO: 92752 - protein, 125 aa, Photorhabdus luminescens; identical to SEQ ID NO: 44408

SEQ ID NO: 92753 - DNA, 384 bp, Photobacterium profundum; identical to SEQ ID NO: 44409
  CDS (1)..(384): transl_table=11

SEQ ID NO: 92754 - protein, 127 aa, Photobacterium profundum; identical to SEQ ID NO: 44410

SEQ ID NO: 92755 - DNA, 381 bp, Pseudomonas aeruginosa; identical to SEQ ID NO: 44411
  CDS (1)..(381): transl_table=11

SEQ ID NO: 92756 - protein, 126 aa, Pseudomonas aeruginosa; identical to SEQ ID NO: 44412

SEQ ID NO: 92757 - DNA, 375 bp, Ralstonia solanacearum; identical to SEQ ID NO: 44413
  CDS (1)..(375): transl_table=11

SEQ ID NO: 92758 - protein, 124 aa, Ralstonia solanacearum; identical to SEQ ID NO: 44414

SEQ ID NO: 92759 - DNA, 393 bp, Rhizobium etli; identical to SEQ ID NO: 44415
  CDS (1)..(393)

SEQ ID NO: 92760 - protein, 130 aa, Rhizobium etli; identical to SEQ ID NO: 44416

SEQ ID NO: 92761 - DNA, 393 bp, Rhizobium loti; identical to SEQ ID NO: 44417
  CDS (1)..(393)

SEQ ID NO: 92762 - protein, 130 aa, Rhizobium loti; identical to SEQ ID NO: 44418

SEQ ID NO: 92763 - DNA, 393 bp, Rhodopseudomonas palustris; identical to SEQ ID NO: 44419
  CDS (1)..(393): transl_table=11

SEQ ID NO: 92764 - protein, 130 aa, Rhodopseudomonas palustris; identical to SEQ ID NO: 44420

SEQ ID NO: 92765 - DNA, 378 bp, Salmonella typhi; identical to SEQ ID NO: 44421
  CDS (1)..(378): transl_table=11

SEQ ID NO: 92766 - protein, 125 aa, Salmonella typhi; identical to SEQ ID NO: 44422

SEQ ID NO: 92767 - DNA, 378 bp, Salmonella typhimurium; identical to SEQ ID NO: 44423
  CDS (1)..(378): transl_table=11

SEQ ID NO: 92768 - protein, 125 aa, Salmonella typhimurium; identical to SEQ ID NO: 44424

SEQ ID NO: 92769 - DNA, 381 bp, Shewanella oneidensis; identical to SEQ ID NO: 44425
  CDS (1)..(381): transl_table=11

SEQ ID NO: 92770 - protein, 126 aa, Shewanella oneidensis; identical to SEQ ID NO: 44426

SEQ ID NO: 92771 - DNA, 381 bp, Vibrio cholerae; identical to SEQ ID NO: 44427
  CDS (1)..(381): transl_table=11

SEQ ID NO: 92772 - protein, 126 aa, Vibrio cholerae; identical to SEQ ID NO: 44428

SEQ ID NO: 92773 - DNA, 381 bp, Vibrio parahaemolyticus; identical to SEQ ID NO: 44429
  CDS (1)..(381)

SEQ ID NO: 92774 - protein, 126 aa, Vibrio parahaemolyticus; identical to SEQ ID NO: 44430

SEQ ID NO: 92775 - DNA, 402 bp, Wolbachia pipientis wMel; identical to SEQ ID NO: 44431
  CDS (1)..(402): transl_table=11

SEQ ID NO: 92776 - protein, 133 aa, Wolbachia pipientis wMel; identical to SEQ ID NO: 44432

SEQ ID NO: 92777 - DNA, 384 bp, Xanthomonas campestris; identical to SEQ ID NO: 44433
  CDS (1)..(384): transl_table=11

SEQ ID NO: 92778 - protein, 127 aa, Xanthomonas campestris; identical to SEQ ID NO: 44434

SEQ ID NO: 92779 - DNA, 384 bp, Xylella fastidiosa; identical to SEQ ID NO: 44435
  CDS (1)..(384): transl_table=11

SEQ ID NO: 92780 - protein, 127 aa, Xylella fastidiosa; identical to SEQ ID NO: 44436

SEQ ID NO: 92781 - DNA, 23 bp, Primer
atgatcaattcgccccgagtgtg

SEQ ID NO: 92782 - DNA, 24 bp, Primer
ttaatgaatgagtgtgggaacggc

SEQ ID NO: 92783 - protein, 78 aa, consensus; identical to SEQ ID NO: 44439
  MISC_FEATURE (1)..(78): consensus for the disclosure of xaa see table XV

SEQ ID NO: 92784 - protein, 112 aa, consensus; identical to SEQ ID NO: 44440
  MISC_FEATURE (1)..(112): consensus for the disclosure of xaa see table XV

SEQ ID NO: 92785 - protein, 114 aa, consensus; identical to SEQ ID NO: 44441
  MISC_FEATURE (1)..(114): consensus for the disclosure of xaa see table XV

SEQ ID NO: 92786 - DNA, 2391 bp, Escherichia coli; identical to SEQ ID NO: 49727
  CDS (1)..(2391)

SEQ ID NO: 92787 - protein, 796 aa, Escherichia coli; identical to SEQ ID NO: 49728

SEQ ID NO: 92788 - DNA, 2427 bp, Gluconobacter oxydans 621H; identical to SEQ ID NO: 49729
  CDS (1)..(2427)

SEQ ID NO: 92789 - protein, 808 aa, Gluconobacter oxydans 621H; identical to SEQ ID NO: 49730

SEQ ID NO: 92790 - DNA, 2172 bp, Gluconobacter oxydans 621H; identical to SEQ ID NO: 49731
  CDS (1)..(2172)

SEQ ID NO: 92791 - protein, 723 aa, Gluconobacter oxydans 621H; identical to SEQ ID NO: 49732

SEQ ID NO: 92792 - DNA, 2232 bp, Gluconobacter oxydans 621H; identical to SEQ ID NO: 49733
  CDS (1)..(2232)

SEQ ID NO: 92793 - protein, 743 aa, Gluconobacter oxydans 621H; identical to SEQ ID NO: 49734

SEQ ID NO: 92794 - DNA, 2274 bp, Gluconobacter oxydans 621H; identical to SEQ ID NO: 49735
  CDS (1)..(2274)

SEQ ID NO: 92795 - protein, 757 aa, Gluconobacter oxydans 621H; identical to SEQ ID NO: 49736

SEQ ID NO: 92796 - DNA, 2367 bp, Gluconobacter oxydans 621H; identical to SEQ ID NO: 49737
  CDS (1)..(2367)

SEQ ID NO: 92797 - protein, 788 aa, Gluconobacter oxydans 621H; identical to SEQ ID NO: 49738

SEQ ID NO: 92798 - DNA, 2358 bp, Mesorhizobium loti MAFF303099; identical to SEQ ID NO: 49739
  CDS (1)..(2358): transl_table=11

SEQ ID NO: 92799 - protein, 785 aa, Mesorhizobium loti MAFF303099; identical to SEQ ID NO: 49740

SEQ ID NO: 92800 - DNA, 2412 bp, Pseudomonas aeruginosa PAO1; identical to SEQ ID NO: 49741
  CDS (1)..(2412): transl_table=11

SEQ ID NO: 92801 - protein, 803 aa, Pseudomonas aeruginosa PAO1; identical to SEQ ID NO: 49742

SEQ ID NO: 92802 - DNA, 2334 bp, Sinorhizobium meliloti 1021; identical to SEQ ID NO: 49743
  CDS (1)..(2334): transl_table=11

SEQ ID NO: 92803 - protein, 777 aa, Sinorhizobium meliloti 1021; identical to SEQ ID NO: 49744

SEQ ID NO: 92804 - DNA, 2391 bp, Salmonella typhimurium LT2; identical to SEQ ID NO: 49745
  CDS (1)..(2391): transl_table=11

SEQ ID NO: 92805 - protein, 796 aa, Salmonella typhimurium LT2; identical to SEQ ID NO: 49746

SEQ ID NO: 92806 - DNA, 2337 bp, Agrobacterium tumefaciens str. C58; identical to SEQ ID NO: 49747
  CDS (1)..(2337): transl_table=11

SEQ ID NO: 92807 - protein, 778 aa, Agrobacterium tumefaciens str. C58; identical to SEQ ID NO: 49748

SEQ ID NO: 92808 - DNA, 2472 bp, Xanthomonas campestris pv. campestris str. ATCC 33913; identical to SEQ ID NO: 49749
  CDS (1)..(2472): transl_table=11

SEQ ID NO: 92809 - protein, 823 aa, Xanthomonas campestris pv. campestris str. ATCC 33913; identical to SEQ ID NO: 49750

SEQ ID NO: 92810 - DNA, 1740 bp, Xanthomonas campestris pv. campestris str. ATCC 33913; identical to SEQ ID NO: 49751
  CDS (1)..(1740): transl_table=11

SEQ ID NO: 92811 - protein, 579 aa, Xanthomonas campestris pv. campestris str. ATCC 33913; identical to SEQ ID NO: 49752

SEQ ID NO: 92812 - DNA, 1986 bp, Xanthomonas axonopodis pv. citri str. 306; identical to SEQ ID NO: 49753
  CDS (1)..(1986): transl_table=11

SEQ ID NO: 92813 - protein, 661 aa, Xanthomonas axonopodis pv. citri str. 306; identical to SEQ ID NO: 49754

SEQ ID NO: 92814 - DNA, 2478 bp, Xanthomonas axonopodis pv. citri str. 306; identical to SEQ ID NO: 49755
  CDS (1)..(2478): transl_table=11

SEQ ID NO: 92815 - protein, 825 aa, Xanthomonas axonopodis pv. citri str. 306; identical to SEQ ID NO: 49756

SEQ ID NO: 92816 - DNA, 2331 bp, Shigella flexneri 2a str. 301; identical to SEQ ID NO: 49757
  CDS (1)..(2331): transl_table=11

SEQ ID NO: 92817 - protein, 776 aa, Shigella flexneri 2a str. 301; identical to SEQ ID NO: 49758

SEQ ID NO: 92818 - DNA, 1788 bp, Pseudomonas putida KT2440; identical to SEQ ID NO: 49759
  CDS (1)..(1788): transl_table=11

SEQ ID NO: 92819 - protein, 595 aa, Pseudomonas putida KT2440; identical to SEQ ID NO: 49760

SEQ ID NO: 92820 - DNA, 1749 bp, Bradyrhizobium japonicum USDA 110; identical to SEQ ID NO: 49761
  CDS (1)..(1749)

SEQ ID NO: 92821 - protein, 582 aa, Bradyrhizobium japonicum USDA 110; identical to SEQ ID NO: 49762

SEQ ID NO: 92822 - DNA, 1665 bp, Bradyrhizobium japonicum USDA 110; identical to SEQ ID NO: 49763
  CDS (1)..(1665)

SEQ ID NO: 92823 - protein, 554 aa, Bradyrhizobium japonicum USDA 110; identical to SEQ ID NO: 49764

SEQ ID NO: 92824 - DNA, 1728 bp, Bradyrhizobium japonicum USDA 110; identical to SEQ ID NO: 49765
  CDS (1)..(1728)

SEQ ID NO: 92825 - protein, 575 aa, Bradyrhizobium japonicum USDA 110; identical to SEQ ID NO: 49766

SEQ ID NO: 92826 - DNA, 2175 bp, Rhodopseudomonas palustris CGA009; identical to SEQ ID NO: 49767
  CDS (1)..(2175): transl_table=11

SEQ ID NO: 92827 - protein, 724 aa, Rhodopseudomonas palustris CGA009; identical to SEQ ID NO: 49768

SEQ ID NO: 92828 - DNA, 2397 bp, Acinetobacter sp. ADP1; identical to SEQ ID NO: 49769
  CDS (1)..(2397): transl_table=11

SEQ ID NO: 92829 - protein, 798 aa, Acinetobacter sp. ADP1; identical to SEQ ID NO: 49770

SEQ ID NO: 92830 - DNA, 2406 bp, Acinetobacter sp. ADP1; identical to SEQ ID NO: 49771
  CDS (1)..(2406): transl_table=11

SEQ ID NO: 92831 - protein, 801 aa, Acinetobacter sp. ADP1; identical to SEQ ID NO: 49772

SEQ ID NO: 92832 - DNA, 1806 bp, Methylococcus capsulatus str. Bath; identical to SEQ ID NO: 49773
  CDS (1)..(1806): transl_table=11

SEQ ID NO: 92833 - protein, 601 aa, Methylococcus capsulatus str. Bath; identical to SEQ ID NO: 49774

SEQ ID NO: 92834 - DNA, 2331 bp, Idiomarina loihiensis L2TR; identical to SEQ ID NO: 49775
  CDS (1)..(2331): transl_table=11

SEQ ID NO: 92835 - protein, 776 aa, Idiomarina loihiensis L2TR; identical to SEQ ID NO: 49776

SEQ ID NO: 92836 - DNA, 1821 bp, Silicibacter pomeroyi DSS-3; identical to SEQ ID NO: 49777
  CDS (1)..(1821): transl_table=11

SEQ ID NO: 92837 - protein, 606 aa, Silicibacter pomeroyi DSS-3; identical to SEQ ID NO: 49778

SEQ ID NO: 92838 - DNA, 2346 bp, Rhodobacter sphaeroides 2.4.1; identical to SEQ ID NO: 49779
  CDS (1)..(2346)

SEQ ID NO: 92839 - protein, 781 aa, Rhodobacter sphaeroides 2.4.1; identical to SEQ ID NO: 49780

SEQ ID NO: 92840 - DNA, 1803 bp, Rhodobacter sphaeroides 2.4.1; identical to SEQ ID NO: 49781
  CDS (1)..(1803)

SEQ ID NO: 92841 - protein, 600 aa, Rhodobacter sphaeroides 2.4.1; identical to SEQ ID NO: 49782

SEQ ID NO: 92842 - DNA, 1704 bp, Magnetospirillum magnetotacticum MS-1; identical to SEQ ID NO: 49783
  CDS (1)..(1704)

SEQ ID NO: 92843 - protein, 567 aa, Magnetospirillum magnetotacticum MS-1; identical to SEQ ID NO: 49784

SEQ ID NO: 92844 - DNA, 2406 bp, Azotobacter vinelandii; identical to SEQ ID NO: 49785
  CDS (1)..(2406)

SEQ ID NO: 92845 - protein, 801 aa, Azotobacter vinelandii; identical to SEQ ID NO: 49786

SEQ ID NO: 92846 - DNA, 2376 bp, Pseudomonas syringae pv. syringae B728a; identical to SEQ ID NO: 49787
  CDS (1)..(2376)

SEQ ID NO: 92847 - protein, 791 aa, Pseudomonas syringae pv. syringae B728a; identical to SEQ ID NO: 49788

SEQ ID NO: 92848 - DNA, 2535 bp, Psychrobacter sp. 273-4; identical to SEQ ID NO: 49789
  CDS (1)..(2535)

SEQ ID NO: 92849 - protein, 844 aa, Psychrobacter sp. 273-4; identical to SEQ ID NO: 49790

SEQ ID NO: 92850 - DNA, 1782 bp, Dechloromonas aromatica RCB; identical to SEQ ID NO: 49791
  CDS (1)..(1782)

SEQ ID NO: 92851 - protein, 593 aa, Dechloromonas aromatica RCB; identical to SEQ ID NO: 49792

SEQ ID NO: 92852 - DNA, 1725 bp, Ralstonia eutropha JMP134; identical to SEQ ID NO: 49793
  CDS (1)..(1725)

SEQ ID NO: 92853 - protein, 574 aa, Ralstonia eutropha JMP134; identical to SEQ ID NO: 49794

SEQ ID NO: 92854 - DNA, 1857 bp, Methylobacillus flagellatus KT; identical to SEQ ID NO: 49795
  CDS (1)..(1857)

SEQ ID NO: 92855 - protein, 618 aa, Methylobacillus flagellatus KT; identical to SEQ ID NO: 49796

SEQ ID NO: 92856 - DNA, 1800 bp, Methylobacillus flagellatus KT; identical to SEQ ID NO: 49797
  CDS (1)..(1800)

SEQ ID NO: 92857 - protein, 599 aa, Methylobacillus flagellatus KT; identical to SEQ ID NO: 49798

SEQ ID NO: 92858 - DNA, 1725 bp, Mesorhizobium sp. BNC1; identical to SEQ ID NO: 49799
  CDS (1)..(1725)

SEQ ID NO: 92859 - protein, 574 aa, Mesorhizobium sp. BNC1; identical to SEQ ID NO: 49800

SEQ ID NO: 92860 - DNA, 1827 bp, Mesorhizobium sp. BNC1; identical to SEQ ID NO: 49801
  CDS (1)..(1827)

SEQ ID NO: 92861 - protein, 608 aa, Mesorhizobium sp. BNC1; identical to SEQ ID NO: 49802

SEQ ID NO: 92862 - DNA, 2559 bp, Mesorhizobium sp. BNC1; identical to SEQ ID NO: 49803
  CDS (1)..(2559)

SEQ ID NO: 92863 - protein, 852 aa, Mesorhizobium sp. BNC1; identical to SEQ ID NO: 49804

SEQ ID NO: 92864 - DNA, 2157 bp, Ralstonia eutropha JMP134; identical to SEQ ID NO: 49805
  CDS (1)..(2157)

SEQ ID NO: 92865 - protein, 718 aa, Ralstonia eutropha JMP134; identical to SEQ ID NO: 49806

SEQ ID NO: 92866 - DNA, 1728 bp, Burkholderia cepacia R1808; identical to SEQ ID NO: 49807
  CDS (1)..(1728)

SEQ ID NO: 92867 - protein, 575 aa, Burkholderia cepacia R1808; identical to SEQ ID NO: 49808

SEQ ID NO: 92868 - DNA, 2136 bp, Rubrivivax gelatinosus PM1; identical to SEQ ID NO: 49809
  CDS (1)..(2136)

SEQ ID NO: 92869 - protein, 711 aa, Rubrivivax gelatinosus PM1; identical to SEQ ID NO: 49810

SEQ ID NO: 92870 - DNA, 1668 bp, Rubrivivax gelatinosus PM1; identical to SEQ ID NO: 49811
  CDS (1)..(1668)

SEQ ID NO: 92871 - protein, 555 aa, Rubrivivax gelatinosus PM1; identical to SEQ ID NO: 49812

SEQ ID NO: 92872 - DNA, 1689 bp, Rubrivivax gelatinosus PM1; identical to SEQ ID NO: 49813
  CDS (1)..(1689)

SEQ ID NO: 92873 - protein, 562 aa, Rubrivivax gelatinosus PM1; identical to SEQ ID NO: 49814

SEQ ID NO: 92874 - DNA, 1956 bp, Rubrivivax gelatinosus PM1; identical to SEQ ID NO: 49815
  CDS (1)..(1956)

SEQ ID NO: 92875 - protein, 651 aa, Rubrivivax gelatinosus PM1; identical to SEQ ID NO: 49816

SEQ ID NO: 92876 - DNA, 1686 bp, Rubrivivax gelatinosus PM1; identical to SEQ ID NO: 49817
  CDS (1)..(1686)

SEQ ID NO: 92877 - protein, 561 aa, Rubrivivax gelatinosus PM1; identical to SEQ ID NO: 49818

SEQ ID NO: 92878 - DNA, 1857 bp, Rubrivivax gelatinosus PM1; identical to SEQ ID NO: 49819
  CDS (1)..(1857)

SEQ ID NO: 92879 - protein, 618 aa, Rubrivivax gelatinosus PM1; identical to SEQ ID NO: 49820

SEQ ID NO: 92880 - DNA, 2412 bp, Pseudomonas fluorescens PfO-1; identical to SEQ ID NO: 49821
  CDS (1)..(2412)

SEQ ID NO: 92881 - protein, 803 aa, Pseudomonas fluorescens PfO-1; identical to SEQ ID NO: 49822

SEQ ID NO: 92882 - DNA, 1674 bp, Burkholderia fungorum LB400; identical to SEQ ID NO: 49823
  CDS (1)..(1674)

SEQ ID NO: 92883 - protein, 557 aa, Burkholderia fungorum LB400; identical to SEQ ID NO: 49824

SEQ ID NO: 92884 - DNA, 1818 bp, Burkholderia fungorum LB400; identical to SEQ ID NO: 49825
  CDS (1)..(1818)

SEQ ID NO: 92885 - protein, 605 aa, Burkholderia fungorum LB400; identical to SEQ ID NO: 49826

SEQ ID NO: 92886 - DNA, 2430 bp, Burkholderia fungorum LB400; identical to SEQ ID NO: 49827
  CDS (1)..(2430)

SEQ ID NO: 92887 - protein, 809 aa, Burkholderia fungorum LB400; identical to SEQ ID NO: 49828

SEQ ID NO: 92888 - DNA, 2094 bp, Novosphingobium aromaticivorans DSM 12444; identical to SEQ ID NO: 49829
  CDS (1)..(2094)

SEQ ID NO: 92889 - protein, 697 aa, Novosphingobium aromaticivorans DSM 12444; identical to SEQ ID NO: 49830

SEQ ID NO: 92890 - DNA, 2184 bp, Novosphingobium aromaticivorans DSM 12444; identical to SEQ ID NO: 49831
  CDS (1)..(2184)

SEQ ID NO: 92891 - protein, 727 aa, Novosphingobium aromaticivorans DSM 12444; identical to SEQ ID NO: 49832

SEQ ID NO: 92892 - DNA, 2049 bp, Polaromonas sp. JS666; identical to SEQ ID NO: 49833
  CDS (1)..(2049)

SEQ ID NO: 92893 - protein, 682 aa, Polaromonas sp. JS666; identical to SEQ ID NO: 49834

SEQ ID NO: 92894 - DNA, 1902 bp, Hyphomicrobium methylovorum; identical to SEQ ID NO: 49835
  CDS (1)..(1902): transl_table=11

SEQ ID NO: 92895 - protein, 633 aa, Hyphomicrobium methylovorum; identical to SEQ ID NO: 49836

SEQ ID NO: 92896 - DNA, 1806 bp, Methylobacterium extorquens; identical to SEQ ID NO: 49837
  CDS (1)..(1806): transl_table=11

SEQ ID NO: 92897 - protein, 601 aa, Methylobacterium extorquens; identical to SEQ ID NO: 49838

SEQ ID NO: 92898 - DNA, 2361 bp, Pantoea citrea; identical to SEQ ID NO: 49839
  CDS (1)..(2361): transl_table=11

SEQ ID NO: 92899 - protein, 786 aa, Pantoea citrea; identical to SEQ ID NO: 49840

SEQ ID NO: 92900 - DNA, 2229 bp, Acetobacter pasteurianus; identical to SEQ ID NO: 49841
  CDS (1)..(2229): transl_table=11

SEQ ID NO: 92901 - protein, 742 aa, Acetobacter pasteurianus; identical to SEQ ID NO: 49842

SEQ ID NO: 92902 - DNA, 1674 bp, uncultured bacterium 582; identical to SEQ ID NO: 49843
  CDS (1)..(1674): transl_table=11

SEQ ID NO: 92903 - protein, 557 aa, uncultured bacterium 582; identical to SEQ ID NO: 49844

SEQ ID NO: 92904 - DNA, 2253 bp, uncultured bacterium 581; identical to SEQ ID NO: 49845
  CDS (1)..(2253): transl_table=11

SEQ ID NO: 92905 - protein, 750 aa, uncultured bacterium 581; identical to SEQ ID NO: 49846

SEQ ID NO: 92906 - DNA, 2391 bp, Enterobacter asburiae; identical to SEQ ID NO: 49847
  CDS (1)..(2391): transl_table=11

SEQ ID NO: 92907 - protein, 796 aa, Enterobacter asburiae; identical to SEQ ID NO: 49848

SEQ ID NO: 92908 - DNA, 1767 bp, Rhizobium sp; identical to SEQ ID NO: 49849
  CDS (1)..(1767): transl_table=11

SEQ ID NO: 92909 - protein, 588 aa, Rhizobium sp; identical to SEQ ID NO: 49850

SEQ ID NO: 92910 - DNA, 2073 bp, Pseudomonas putida; identical to SEQ ID NO: 49851
  CDS (1)..(2073): transl_table=11

SEQ ID NO: 92911 - protein, 690 aa, Pseudomonas putida; identical to SEQ ID NO: 49852

SEQ ID NO: 92912 - DNA, 2223 bp, Gluconobacter oxydans; identical to SEQ ID NO: 49853
  CDS (1)..(2223): transl_table=11

SEQ ID NO: 92913 - protein, 740 aa, Gluconobacter oxydans; identical to SEQ ID NO: 49854

SEQ ID NO: 92914 - DNA, 2229 bp, Acetobacter pasteurianus; identical to SEQ ID NO: 49855
  CDS (1)..(2229): transl_table=11

SEQ ID NO: 92915 - protein, 742 aa, Acetobacter pasteurianus; identical to SEQ ID NO: 49856

SEQ ID NO: 92916 - DNA, 1800 bp, Methylobacillus sp; identical to SEQ ID NO: 49857
  CDS (1)..(1800): transl_table=11

SEQ ID NO: 92917 - protein, 599 aa, Methylobacillus sp; identical to SEQ ID NO: 49858

SEQ ID NO: 92918 - DNA, 2253 bp, uncultured proteobacterium; identical to SEQ ID NO: 49859
  CDS (1)..(2253): transl_table=11

SEQ ID NO: 92919 - protein, 750 aa, uncultured proteobacterium; identical to SEQ ID NO: 49860

SEQ ID NO: 92920 - DNA, 1896 bp, Pseudomonas putida; identical to SEQ ID NO: 49861
  CDS (1)..(1896): y means t/u or c

SEQ ID NO: 92921 - protein, 631 aa, Pseudomonas putida; identical to SEQ ID NO: 49862
  misc_feature (427)..(427): Xaa can be Ser or Pro

SEQ ID NO: 92922 - DNA, 2088 bp, Pseudomonas sp; identical to SEQ ID NO: 49863
  CDS (1)..(2088): transl_table=11

SEQ ID NO: 92923 - protein, 695 aa, Pseudomonas sp; identical to SEQ ID NO: 49864

SEQ ID NO: 92924 - DNA, 1872 bp, Pseudomonas butanovora; identical to SEQ ID NO: 49865
  CDS (1)..(1872): transl_table=11

SEQ ID NO: 92925 - protein, 623 aa, Pseudomonas butanovora; identical to SEQ ID NO: 49866

SEQ ID NO: 92926 - DNA, 1890 bp, Methylobacterium nodulans; identical to SEQ ID NO: 49867
  CDS (1)..(1890): transl_table=11

SEQ ID NO: 92927 - protein, 629 aa, Methylobacterium nodulans; identical to SEQ ID NO: 49868

SEQ ID NO: 92928 - DNA, 1806 bp, Rhizobium meliloti; identical to SEQ ID NO: 49869
  CDS (1)..(1806): transl_table=11

SEQ ID NO: 92929 - protein, 601 aa, Rhizobium meliloti; identical to SEQ ID NO: 49870

SEQ ID NO: 92930 - DNA, 2088 bp, Pseudomonas stutzeri; identical to SEQ ID NO: 49871
  CDS (1)..(2088): transl_table=11

SEQ ID NO: 92931 - protein, 695 aa, Pseudomonas stutzeri; identical to SEQ ID NO: 49872

SEQ ID NO: 92932 - DNA, 2097 bp, Alcaligenes eutrophus; identical to SEQ ID NO: 49873
  CDS (1)..(2097): transl_table=11

SEQ ID NO: 92933 - protein, 698 aa, Alcaligenes eutrophus; identical to SEQ ID NO: 49874

SEQ ID NO: 92934 - DNA, 1800 bp, Methylovorus sp; identical to SEQ ID NO: 49875
  CDS (1)..(1800): transl_table=11

SEQ ID NO: 92935 - protein, 599 aa, Methylovorus sp; identical to SEQ ID NO: 49876

SEQ ID NO: 92936 - DNA, 2373 bp, Pantoea citrea; identical to SEQ ID NO: 49877
  CDS (1)..(2373): transl_table=11

SEQ ID NO: 92937 - protein, 790 aa, Pantoea citrea; identical to SEQ ID NO: 49878

SEQ ID NO: 92938 - DNA, 2229 bp, Acetobacter aceti; identical to SEQ ID NO: 49879
  CDS (1)..(2229): transl_table=11

SEQ ID NO: 92939 - protein, 742 aa, Acetobacter aceti; identical to SEQ ID NO: 49880

SEQ ID NO: 92940 - DNA, 2220 bp, Acetobacter europaeus; identical to SEQ ID NO: 49881
  CDS (1)..(2220): transl_table=11

SEQ ID NO: 92941 - protein, 739 aa, Acetobacter europaeus; identical to SEQ ID NO: 49882

SEQ ID NO: 92942 - DNA, 2217 bp, Acetobacter polyoxogenes; identical to SEQ ID NO: 49883
  CDS (1)..(2217): transl_table=11

SEQ ID NO: 92943 - protein, 738 aa, Acetobacter polyoxogenes; identical to SEQ ID NO: 49884

SEQ ID NO: 92944 - DNA, 2274 bp, Gluconobacter oxydans; identical to SEQ ID NO: 49885
  CDS (1)..(2274): transl_table=11

SEQ ID NO: 92945 - protein, 757 aa, Gluconobacter oxydans; identical to SEQ ID NO: 49886

SEQ ID NO: 92946 - DNA, 2406 bp, Acinetobacter calcoaceticus; identical to SEQ ID NO: 49887
  CDS (1)..(2406): transl_table=11

SEQ ID NO: 92947 - protein, 801 aa, Acinetobacter calcoaceticus; identical to SEQ ID NO: 49888

SEQ ID NO: 92948 - DNA, 1881 bp, Methylobacterium extorquens; identical to SEQ ID NO: 49889
  CDS (1)..(1881): transl_table=11

SEQ ID NO: 92949 - protein, 626 aa, Methylobacterium extorquens; identical to SEQ ID NO: 49890

SEQ ID NO: 92950 - DNA, 1722 bp, Methylophilus methylotrophus; identical to SEQ ID NO: 49891
  CDS (1)..(1722): transl_table=11

SEQ ID NO: 92951 - protein, 573 aa, Methylophilus methylotrophus; identical to SEQ ID NO: 49892

SEQ ID NO: 92952 - DNA, 1881 bp, Methylobacterium organophilum XX; identical to SEQ ID NO: 49893
  CDS (1)..(1881): transl_table=11

SEQ ID NO: 92953 - protein, 626 aa, Methylobacterium organophilum XX; identical to SEQ ID NO: 49894

SEQ ID NO: 92954 - DNA, 1896 bp, Paracoccus denitrificans; identical to SEQ ID NO: 49895
  CDS (1)..(1896): transl_table=11

SEQ ID NO: 92955 - protein, 631 aa, Paracoccus denitrificans; identical to SEQ ID NO: 49896

SEQ ID NO: 92956 - DNA, 2127 bp, Comamonas testosteroni; identical to SEQ ID NO: 49897
  CDS (1)..(2127): transl_table=11

SEQ ID NO: 92957 - protein, 708 aa, Comamonas testosteroni; identical to SEQ ID NO: 49898

SEQ ID NO: 92958 - DNA, 2373 bp, Xanthomonas campestris; identical to SEQ ID NO: 49899
  CDS (1)..(2373): transl_table=11

SEQ ID NO: 92959 - protein, 790 aa, Xanthomonas campestris; identical to SEQ ID NO: 49900

SEQ ID NO: 92960 - DNA, 1803 bp, Paracoccus denitrificans; identical to SEQ ID NO: 49901
  CDS (1)..(1803): transl_table=11

SEQ ID NO: 92961 - protein, 600 aa, Paracoccus denitrificans; identical to SEQ ID NO: 49902

SEQ ID NO: 92962 - DNA, 24 bp, Primer
atggcaattaacaatacaggctcg

SEQ ID NO: 92963 - DNA, 23 bp, Primer
ttacttcacatcatccggcagcg

SEQ ID NO: 92964 - protein, 793 aa, consensus; identical to SEQ ID NO: 49905
  MISC_FEATURE (1)..(793): consensus for the disclosure of xaa see table XV

SEQ ID NO: 92965 - protein, 81 aa, consensus; identical to SEQ ID NO: 49906
  MISC_FEATURE (1)..(81): consensus for the disclosure of xaa see table XV

SEQ ID NO: 92966 - protein, 95 aa, consensus; identical to SEQ ID NO: 49907
  MISC_FEATURE (1)..(95): consensus for the disclosure of xaa see table XV

SEQ ID NO: 92967 - protein, 119 aa, consensus; identical to SEQ ID NO: 49908
  MISC_FEATURE (1)..(119): consensus for the disclosure of xaa see table XV

SEQ ID NO: 92968 - protein, 63 aa, consensus; identical to SEQ ID NO: 49909
  MISC_FEATURE (1)..(63): consensus for the disclosure of xaa see table XV

SEQ ID NO: 92969 - DNA, 2535 bp, Escherichia coli; identical to SEQ ID NO: 49910
  CDS (1)..(2535)

SEQ ID NO: 92970 - protein, 844 aa, Escherichia coli; identical to SEQ ID NO: 49911

SEQ ID NO: 92971 - DNA, 2331 bp, Lactobacillus acidophilus NCFM; identical to SEQ ID NO: 49912
  CDS (1)..(2331)

SEQ ID NO: 92972 - protein, 776 aa, Lactobacillus acidophilus NCFM; identical to SEQ ID NO: 49913

SEQ ID NO: 92973 - DNA, 2058 bp, Lactobacillus acidophilus NCFM; identical to SEQ ID NO: 49914
  CDS (1)..(2058)

SEQ ID NO: 92974 - protein, 685 aa, Lactobacillus acidophilus NCFM; identical to SEQ ID NO: 49915

SEQ ID NO: 92975 - DNA, 2445 bp, Xanthomonas oryzae pv. oryzae KACC10331; identical to SEQ ID NO: 49916
  CDS (1)..(2445)

SEQ ID NO: 92976 - protein, 814 aa, Xanthomonas oryzae pv. oryzae KACC10331; identical to SEQ ID NO: 49917

SEQ ID NO: 92977 - DNA, 2373 bp, Vibrio fischeri ES114; identical to SEQ ID NO: 49918
  CDS (1)..(2373)

SEQ ID NO: 92978 - protein, 790 aa, Vibrio fischeri ES114; identical to SEQ ID NO: 49919

SEQ ID NO: 92979 - DNA, 2397 bp, Neisseria gonorrhoeae FA 1090; identical to SEQ ID NO: 49920
  CDS (1)..(2397)

SEQ ID NO: 92980 - protein, 798 aa, Neisseria gonorrhoeae FA 1090; identical to SEQ ID NO: 49921

SEQ ID NO: 92981 - DNA, 2457 bp, Mesorhizobium loti MAFF303099; identical to SEQ ID NO: 49922
  CDS (1)..(2457): transl_table=11

SEQ ID NO: 92982 - protein, 818 aa, Mesorhizobium loti MAFF303099; identical to SEQ ID NO: 49923

SEQ ID NO: 92983 - DNA, 2268 bp, Mesorhizobium loti MAFF303099; identical to SEQ ID NO: 49924
  CDS (1)..(2268): transl_table=11

SEQ ID NO: 92984 - protein, 755 aa, Mesorhizobium loti MAFF303099; identical to SEQ ID NO: 49925

SEQ ID NO: 92985 - DNA, 2154 bp, Mesorhizobium loti MAFF303099; identical to SEQ ID NO: 49926
  CDS (1)..(2154): transl_table=11

SEQ ID NO: 92986 - protein, 717 aa, Mesorhizobium loti MAFF303099; identical to SEQ ID NO: 49927

SEQ ID NO: 92987 - DNA, 1983 bp, Helicobacter pylori J99; identical to SEQ ID NO: 49928
  CDS (1)..(1983): transl_table=11

SEQ ID NO: 92988 - protein, 660 aa, Helicobacter pylori J99; identical to SEQ ID NO: 49929

SEQ ID NO: 92989 - DNA, 1932 bp, Thermotoga maritima MSB8; identical to SEQ ID NO: 49930
  CDS (1)..(1932): transl_table=11

SEQ ID NO: 92990 - protein, 643 aa, Thermotoga maritima MSB8; identical to SEQ ID NO: 49931

SEQ ID NO: 92991 - DNA, 2508 bp, Vibrio cholerae O1 biovar eltor str. N16961; identical to SEQ ID NO: 49932
  CDS (1)..(2508): transl_table=11

SEQ ID NO: 92992 - protein, 835 aa, Vibrio cholerae O1 biovar eltor str. N16961; identical to SEQ ID NO: 49933

SEQ ID NO: 92993 - DNA, 2160 bp, Bacillus halodurans C-125; identical to SEQ ID NO: 49934
  CDS (1)..(2160): transl_table=11

SEQ ID NO: 92994 - protein, 719 aa, Bacillus halodurans C-125; identical to SEQ ID NO: 49935

SEQ ID NO: 92995 - DNA, 2661 bp, Bacillus halodurans C-125; identical to SEQ ID NO: 49936
  CDS (1)..(2661): transl_table=11

SEQ ID NO: 92996 - protein, 886 aa, Bacillus halodurans C-125; identical to SEQ ID NO: 49937

SEQ ID NO: 92997 - DNA, 2064 bp, Bacillus halodurans C-125; identical to SEQ ID NO: 49938
  CDS (1)..(2064): transl_table=11

SEQ ID NO: 92998 - protein, 687 aa, Bacillus halodurans C-125; identical to SEQ ID NO: 49939

SEQ ID NO: 92999 - DNA, 2328 bp, Pasteurella multocida subsp. multocida str. Pm70; identical to SEQ ID NO: 49940
  CDS (1)..(2328): transl_table=11

SEQ ID NO: 93000 - protein, 775 aa, Pasteurella multocida subsp. multocida str. Pm70; identical to SEQ ID NO: 49941

SEQ ID NO: 93001 - DNA, 2562 bp, Pasteurella multocida subsp. multocida str. Pm70; identical to SEQ ID NO: 49942
  CDS (1)..(2562): transl_table=11

SEQ ID NO: 93002 - protein, 853 aa, Pasteurella multocida subsp. multocida str. Pm70; identical to SEQ ID NO: 49943

SEQ ID NO: 93003 - DNA, 1995 bp, Lactococcus lactis subsp. lactis Il1403; identical to SEQ ID NO: 49944
  CDS (1)..(1995): transl_table=11

SEQ ID NO: 93004 - protein, 664 aa, Lactococcus lactis subsp. lactis Il1403; identical to SEQ ID NO: 49945

SEQ ID NO: 93005 - DNA, 2232 bp, Lactococcus lactis subsp. lactis Il1403; identical to SEQ ID NO: 49946
  CDS (1)..(2232): transl_table=11

SEQ ID NO: 93006 - protein, 743 aa, Lactococcus lactis subsp. lactis Il1403; identical to SEQ ID NO: 49947

SEQ ID NO: 93007 - DNA, 3030 bp, Deinococcus radiodurans R1; identical to SEQ ID NO: 49948
  CDS (1)..(3030): transl_table=11

SEQ ID NO: 93008 - protein, 1009 aa, Deinococcus radiodurans R1; identical to SEQ ID NO: 49949

SEQ ID NO: 93009 - DNA, 2430 bp, Clostridium acetobutylicum ATCC 824; identical to SEQ ID NO: 49950
  CDS (1)..(2430): transl_table=11

SEQ ID NO: 93010 - protein, 809 aa, Clostridium acetobutylicum ATCC 824; identical to SEQ ID NO: 49951

SEQ ID NO: 93011 - DNA, 2304 bp, Sinorhizobium meliloti 1021; identical to SEQ ID NO: 49952
  CDS (1)..(2304): transl_table=11

SEQ ID NO: 93012 - protein, 767 aa, Sinorhizobium meliloti 1021; identical to SEQ ID NO: 49953

SEQ ID NO: 93013 - DNA, 2235 bp, Sinorhizobium meliloti 1021; identical to SEQ ID NO: 49954
  CDS (1)..(2235): transl_table=11

SEQ ID NO: 93014 - protein, 744 aa, Sinorhizobium meliloti 1021; identical to SEQ ID NO: 49955

SEQ ID NO: 93015 - DNA, 1944 bp, Bacillus subtilis subsp. subtilis str. 168; identical to SEQ ID NO: 49956
  CDS (1)..(1944): transl_table=11

SEQ ID NO: 93016 - protein, 647 aa, Bacillus subtilis subsp. subtilis str. 168; identical to SEQ ID NO: 49957

SEQ ID NO: 93017 - DNA, 1962 bp, Caulobacter crescentus CB15; identical to SEQ ID NO: 49958
  CDS (1)..(1962): transl_table=11

SEQ ID NO: 93018 - protein, 653 aa, Caulobacter crescentus CB15; identical to SEQ ID NO: 49959

SEQ ID NO: 93019 - DNA, 2385 bp, Caulobacter crescentus CB15; identical to SEQ ID NO: 49960
  CDS (1)..(2385): transl_table=11

SEQ ID NO: 93020 - protein, 794 aa, Caulobacter crescentus CB15; identical to SEQ ID NO: 49961

SEQ ID NO: 93021 - DNA, 2202 bp, Caulobacter crescentus CB15; identical to SEQ ID NO: 49962
  CDS (1)..(2202): transl_table=11

SEQ ID NO: 93022 - protein, 733 aa, Caulobacter crescentus CB15; identical to SEQ ID NO: 49963

SEQ ID NO: 93023 - DNA, 2187 bp, Sinorhizobium meliloti 1021; identical to SEQ ID NO: 49964
  CDS (1)..(2187)

SEQ ID NO: 93024 - protein, 728 aa, Sinorhizobium meliloti 1021; identical to SEQ ID NO: 49965

SEQ ID NO: 93025 - DNA, 2595 bp, Haemophilus influenzae Rd KW20; identical to SEQ ID NO: 49966
  CDS (1)..(2595): transl_table=11

SEQ ID NO: 93026 - protein, 864 aa, Haemophilus influenzae Rd KW20; identical to SEQ ID NO: 49967

SEQ ID NO: 93027 - DNA, 2250 bp, Synechocystis sp. PCC 6803; identical to SEQ ID NO: 49968
  CDS (1)..(2250): transl_table=11

SEQ ID NO: 93028 - protein, 749 aa, Synechocystis sp. PCC 6803; identical to SEQ ID NO: 49969

SEQ ID NO: 93029 - DNA, 1953 bp, Synechocystis sp. PCC 6803; identical to SEQ ID NO: 49970
  CDS (1)..(1953): transl_table=11

SEQ ID NO: 93030 - protein, 650 aa, Synechocystis sp. PCC 6803; identical to SEQ ID NO: 49971

SEQ ID NO: 93031 - DNA, 2658 bp, Synechocystis sp. PCC 6803; identical to SEQ ID NO: 49972
  CDS (1)..(2658): transl_table=11

SEQ ID NO: 93032 - protein, 885 aa, Synechocystis sp. PCC 6803; identical to SEQ ID NO: 49973

SEQ ID NO: 93033 - DNA, 2484 bp, Listeria monocytogenes EGD-e; identical to SEQ ID NO: 49974
  CDS (1)..(2484): transl_table=11

SEQ ID NO: 93034 - protein, 827 aa, Listeria monocytogenes EGD-e; identical to SEQ ID NO: 49975

SEQ ID NO: 93035 - DNA, 2481 bp, Listeria innocua Clip11262; identical to SEQ ID NO: 49976
  CDS (1)..(2481): transl_table=11

SEQ ID NO: 93036 - protein, 826 aa, Listeria innocua Clip11262; identical to SEQ ID NO: 49977

SEQ ID NO: 93037 - DNA, 2271 bp, Nostoc sp. PCC 7120; identical to SEQ ID NO: 49978
  CDS (1)..(2271): transl_table=11

SEQ ID NO: 93038 - protein, 756 aa, Nostoc sp. PCC 7120; identical to SEQ ID NO: 49979

SEQ ID NO: 93039 - DNA, 1932 bp, Nostoc sp. PCC 7120; identical to SEQ ID NO: 49980
  CDS (1)..(1932): transl_table=11

SEQ ID NO: 93040 - protein, 643 aa, Nostoc sp. PCC 7120; identical to SEQ ID NO: 49981

SEQ ID NO: 93041 - DNA, 2295 bp, Agrobacterium tumefaciens str. C58; identical to SEQ ID NO: 49982
  CDS (1)..(2295): transl_table=11

SEQ ID NO: 93042 - protein, 764 aa, Agrobacterium tumefaciens str. C58; identical to SEQ ID NO: 49983

SEQ ID NO: 93043 - DNA, 2274 bp, Agrobacterium tumefaciens str. C58; identical to SEQ ID NO: 49984
  CDS (1)..(2274): transl_table=11

SEQ ID NO: 93044 - protein, 757 aa, Agrobacterium tumefaciens str. C58; identical to SEQ ID NO: 49985

SEQ ID NO: 93045 - DNA, 2448 bp, Agrobacterium tumefaciens str. C58; identical to SEQ ID NO: 49986
  CDS (1)..(2448): transl_table=11

SEQ ID NO: 93046 - protein, 815 aa, Agrobacterium tumefaciens str. C58; identical to SEQ ID NO: 49987

SEQ ID NO: 93047 - DNA, 2460 bp, Brucella melitensis 16M; identical to SEQ ID NO: 49988
  CDS (1)..(2460): transl_table=11

SEQ ID NO: 93048 - protein, 819 aa, Brucella melitensis 16M; identical to SEQ ID NO: 49989

SEQ ID NO: 93049 - DNA, 2193 bp, Brucella melitensis 16M; identical to SEQ ID NO: 49990
  CDS (1)..(2193): transl_table=11

SEQ ID NO: 93050 - protein, 730 aa, Brucella melitensis 16M; identical to SEQ ID NO: 49991

SEQ ID NO: 93051 - DNA, 2040 bp, Clostridium perfringens str. 13; identical to SEQ ID NO: 49992
  CDS (1)..(2040): transl_table=11

SEQ ID NO: 93052 - protein, 679 aa, Clostridium perfringens str. 13; identical to SEQ ID NO: 49993

SEQ ID NO: 93053 - DNA, 2163 bp, Corynebacterium glutamicum ATCC 13032; identical to SEQ ID NO: 49994
  CDS (1)..(2163): transl_table=11

SEQ ID NO: 93054 - protein, 720 aa, Corynebacterium glutamicum ATCC 13032; identical to SEQ ID NO: 49995

SEQ ID NO: 93055 - DNA, 2196 bp, Fusobacterium nucleatum subsp. nucleatum ATCC 25586; identical to SEQ ID NO: 49996
  CDS (1)..(2196): transl_table=11

SEQ ID NO: 93056 - protein, 731 aa, Fusobacterium nucleatum subsp. nucleatum ATCC 25586; identical to SEQ ID NO: 49997

SEQ ID NO: 93057 - DNA, 2532 bp, Thermoanaerobacter tengcongensis MB4; identical to SEQ ID NO: 49998
  CDS (1)..(2532): transl_table=11

SEQ ID NO: 93058 - protein, 843 aa, Thermoanaerobacter tengcongensis MB4; identical to SEQ ID NO: 49999

SEQ ID NO: 93059 - DNA, 2388 bp, Streptomyces coelicolor A3(2); identical to SEQ ID NO: 50000
  CDS (1)..(2388)

SEQ ID NO: 93060 - protein, 795 aa, Streptomyces coelicolor A3(2); identical to SEQ ID NO: 50001

SEQ ID NO: 93061 - DNA, 2151 bp, Streptomyces coelicolor A3(2); identical to SEQ ID NO: 50002
  CDS (1)..(2151)

SEQ ID NO: 93062 - protein, 716 aa, Streptomyces coelicolor A3(2); identical to SEQ ID NO: 50003

SEQ ID NO: 93063 - DNA, 2463 bp, Bacillus anthracis str. A2012; identical to SEQ ID NO: 50004
  CDS (1)..(2463): transl_table=11

SEQ ID NO: 93064 - protein, 820 aa, Bacillus anthracis str. A2012; identical to SEQ ID NO: 50005

SEQ ID NO: 93065 - DNA, 1932 bp, Thermosynechococcus elongatus BP-1; identical to SEQ ID NO: 50006
  CDS (1)..(1932): transl_table=11

SEQ ID NO: 93066 - protein, 643 aa, Thermosynechococcus elongatus BP-1; identical to SEQ ID NO: 50007

SEQ ID NO: 93067 - DNA, 2235 bp, Thermosynechococcus elongatus BP-1; identical to SEQ ID NO: 50008
  CDS (1)..(2235): transl_table=11

SEQ ID NO: 93068 - protein, 744 aa, Thermosynechococcus elongatus BP-1; identical to SEQ ID NO: 50009

SEQ ID NO: 93069 - DNA, 2322 bp, Streptococcus agalactiae 2603V/R; identical to SEQ ID NO: 50010
  CDS (1)..(2322): transl_table=11

SEQ ID NO: 93070 - protein, 773 aa, Streptococcus agalactiae 2603V/R; identical to SEQ ID NO: 50011

SEQ ID NO: 93071 - DNA, 2172 bp, Oceanobacillus iheyensis HTE831; identical to SEQ ID NO: 50012
  CDS (1)..(2172): transl_table=11

SEQ ID NO: 93072 - protein, 723 aa, Oceanobacillus iheyensis HTE831; identical to SEQ ID NO: 50013

SEQ ID NO: 93073 - DNA, 2778 bp, Oceanobacillus iheyensis HTE831; identical to SEQ ID NO: 50014
  CDS (1)..(2778): transl_table=11

SEQ ID NO: 93074 - protein, 925 aa, Oceanobacillus iheyensis HTE831; identical to SEQ ID NO: 50015

SEQ ID NO: 93075 - DNA, 2028 bp, Oceanobacillus iheyensis HTE831; identical to SEQ ID NO: 50016
  CDS (1)..(2028): transl_table=11

SEQ ID NO: 93076 - protein, 675 aa, Oceanobacillus iheyensis HTE831; identical to SEQ ID NO: 50017

SEQ ID NO: 93077 - DNA, 2157 bp, Brucella suis 1330; identical to SEQ ID NO: 50018
  CDS (1)..(2157): transl_table=11

SEQ ID NO: 93078 - protein, 718 aa, Brucella suis 1330; identical to SEQ ID NO: 50019

SEQ ID NO: 93079 - DNA, 2307 bp, Shewanella oneidensis MR-1; identical to SEQ ID NO: 50020
  CDS (1)..(2307): transl_table=11

SEQ ID NO: 93080 - protein, 768 aa, Shewanella oneidensis MR-1; identical to SEQ ID NO: 50021

SEQ ID NO: 93081 - DNA, 2199 bp, Corynebacterium efficiens YS-314; identical to SEQ ID NO: 50022
  CDS (1)..(2199): transl_table=11

SEQ ID NO: 93082 - protein, 732 aa, Corynebacterium efficiens YS-314; identical to SEQ ID NO: 50023

SEQ ID NO: 93083 - DNA, 2409 bp, Vibrio vulnificus CMCP6; identical to SEQ ID NO: 50024
  CDS (1)..(2409): transl_table=11

SEQ ID NO: 93084 - protein, 802 aa, Vibrio vulnificus CMCP6; identical to SEQ ID NO: 50025

SEQ ID NO: 93085 - DNA, 2232 bp, Staphylococcus epidermidis ATCC 12228; identical to SEQ ID NO: 50026
  CDS (1)..(2232): transl_table=11

SEQ ID NO: 93086 - protein, 743 aa, Staphylococcus epidermidis ATCC 12228; identical to SEQ ID NO: 50027

SEQ ID NO: 93087 - DNA, 2214 bp, Bradyrhizobium japonicum USDA 110; identical to SEQ ID NO: 50028
  CDS (1)..(2214)

SEQ ID NO: 93088 - protein, 737 aa, Bradyrhizobium japonicum USDA 110; identical to SEQ ID NO: 50029

SEQ ID NO: 93089 - DNA, 2286 bp, Bradyrhizobium japonicum USDA 110; identical to SEQ ID NO: 50030
  CDS (1)..(2286)

SEQ ID NO: 93090 - protein, 761 aa, Bradyrhizobium japonicum USDA 110; identical to SEQ ID NO: 50031

SEQ ID NO: 93091 - DNA, 2379 bp, Xylella fastidiosa Temecula1; identical to SEQ ID NO: 50032
  CDS (1)..(2379): transl_table=11

SEQ ID NO: 93092 - protein, 792 aa, Xylella fastidiosa Temecula1; identical to SEQ ID NO: 50033

SEQ ID NO: 93093 - DNA, 2322 bp, Pseudomonas syringae pv. tomato str. DC3000; identical to SEQ ID NO: 50034
  CDS (1)..(2322): transl_table=11

SEQ ID NO: 93094 - protein, 773 aa, Pseudomonas syringae pv. tomato str. DC3000; identical to SEQ ID NO: 50035

SEQ ID NO: 93095 - DNA, 2571 bp, Vibrio parahaemolyticus RIMD 2210633; identical to SEQ ID NO: 50036
  CDS (1)..(2571): transl_table=11

SEQ ID NO: 93096 - protein, 856 aa, Vibrio parahaemolyticus RIMD 2210633; identical to SEQ ID NO: 50037

SEQ ID NO: 93097 - DNA, 2523 bp, Salmonella enterica subsp. enterica serovar Typhi Ty2; identical to SEQ ID NO: 50038
  CDS (1)..(2523): transl_table=11

SEQ ID NO: 93098 - protein, 840 aa, Salmonella enterica subsp. enterica serovar Typhi Ty2; identical to SEQ ID NO: 50039

SEQ ID NO: 93099 - DNA, 2187 bp, Enterococcus faecalis V583; identical to SEQ ID NO: 50040
  CDS (1)..(2187): transl_table=11

SEQ ID NO: 93100 - protein, 728 aa, Enterococcus faecalis V583; identical to SEQ ID NO: 50041

SEQ ID NO: 93101 - DNA, 2337 bp, Enterococcus faecalis V583; identical to SEQ ID NO: 50042
  CDS (1)..(2337): transl_table=11

SEQ ID NO: 93102 - protein, 778 aa, Enterococcus faecalis V583; identical to SEQ ID NO: 50043

SEQ ID NO: 93103 - DNA, 2382 bp, Coxiella burnetii RSA 493; identical to SEQ ID NO: 50044
  CDS (1)..(2382): transl_table=11

SEQ ID NO: 93104 - protein, 793 aa, Coxiella burnetii RSA 493; identical to SEQ ID NO: 50045

SEQ ID NO: 93105 - DNA, 2334 bp, Streptomyces avermitilis MA-4680; identical to SEQ ID NO: 50046
  CDS (1)..(2334)

SEQ ID NO: 93106 - protein, 777 aa, Streptomyces avermitilis MA-4680; identical to SEQ ID NO: 50047

SEQ ID NO: 93107 - DNA, 2226 bp, Streptomyces avermitilis MA-4680; identical to SEQ ID NO: 50048
  CDS (1)..(2226)

SEQ ID NO: 93108 - protein, 741 aa, Streptomyces avermitilis MA-4680; identical to SEQ ID NO: 50049

SEQ ID NO: 93109 - DNA, 2043 bp, Bacillus cereus ATCC 14579; identical to SEQ ID NO: 50050
  CDS (1)..(2043): transl_table=11

SEQ ID NO: 93110 - protein, 680 aa, Bacillus cereus ATCC 14579; identical to SEQ ID NO: 50051

SEQ ID NO: 93111 - DNA, 2493 bp, Bacillus cereus ATCC 14579; identical to SEQ ID NO: 50052
  CDS (1)..(2493): transl_table=11

SEQ ID NO: 93112 - protein, 830 aa, Bacillus cereus ATCC 14579; identical to SEQ ID NO: 50053

SEQ ID NO: 93113 - DNA, 2052 bp, Bacillus cereus ATCC 14579; identical to SEQ ID NO: 50054
  CDS (1)..(2052): transl_table=11

SEQ ID NO: 93114 - protein, 683 aa, Bacillus cereus ATCC 14579; identical to SEQ ID NO: 50055

SEQ ID NO: 93115 - DNA, 2010 bp, Helicobacter hepaticus ATCC 51449; identical to SEQ ID NO: 50056
  CDS (1)..(2010): transl_table=11

SEQ ID NO: 93116 - protein, 669 aa, Helicobacter hepaticus ATCC 51449; identical to SEQ ID NO: 50057

SEQ ID NO: 93117 - DNA, 1818 bp, Prochlorococcus marinus subsp. marinus str. CCMP1375; identical to SEQ ID NO: 50058
  CDS (1)..(1818): transl_table=11

SEQ ID NO: 93118 - protein, 605 aa, Prochlorococcus marinus subsp. marinus str. CCMP1375; identical to SEQ ID NO: 50059

SEQ ID NO: 93119 - DNA, 2343 bp, Candidatus Blochmannia floridanus; identical to SEQ ID NO: 50060
  CDS (1)..(2343): transl_table=11

SEQ ID NO: 93120 - protein, 780 aa, Candidatus Blochmannia floridanus; identical to SEQ ID NO: 50061

SEQ ID NO: 93121 - DNA, 1764 bp, Prochlorococcus marinus subsp. pastoris str. CCMP1986; identical to SEQ ID NO: 50062
  CDS (1)..(1764): transl_table=11

SEQ ID NO: 93122 - protein, 587 aa, Prochlorococcus marinus subsp. pastoris str. CCMP1986; identical to SEQ ID NO: 50063

SEQ ID NO: 93123 - DNA, 1977 bp, Prochlorococcus marinus str. MIT 9313; identical to SEQ ID NO: 50064
  CDS (1)..(1977): transl_table=11

SEQ ID NO: 93124 - protein, 658 aa, Prochlorococcus marinus str. MIT 9313; identical to SEQ ID NO: 50065

SEQ ID NO: 93125 - DNA, 2100 bp, Synechococcus sp. WH 8102; identical to SEQ ID NO: 50066
  CDS (1)..(2100): transl_table=11

SEQ ID NO: 93126 - protein, 699 aa, Synechococcus sp. WH 8102; identical to SEQ ID NO: 50067

SEQ ID NO: 93127 - DNA, 2364 bp, Chromobacterium violaceum ATCC 12472; identical to SEQ ID NO: 50068
  CDS (1)..(2364): transl_table=11

SEQ ID NO: 93128 - protein, 787 aa, Chromobacterium violaceum ATCC 12472; identical to SEQ ID NO: 50069

SEQ ID NO: 93129 - DNA, 1920 bp, Wolinella succinogenes DSM 1740; identical to SEQ ID NO: 50070
  CDS (1)..(1920): transl_table=11

SEQ ID NO: 93130 - protein, 639 aa, Wolinella succinogenes DSM 1740; identical to SEQ ID NO: 50071

SEQ ID NO: 93131 - DNA, 2121 bp, Gloeobacter violaceus PCC 7421; identical to SEQ ID NO: 50072
  CDS (1)..(2121): transl_table=11

SEQ ID NO: 93132 - protein, 706 aa, Gloeobacter violaceus PCC 7421; identical to SEQ ID NO: 50073

SEQ ID NO: 93133 - DNA, 2193 bp, Gloeobacter violaceus PCC 7421; identical to SEQ ID NO: 50074
  CDS (1)..(2193): transl_table=11

SEQ ID NO: 93134 - protein, 730 aa, Gloeobacter violaceus PCC 7421; identical to SEQ ID NO: 50075

SEQ ID NO: 93135 - DNA, 2457 bp, Photorhabdus luminescens subsp. laumondii TTO1; identical to SEQ ID NO: 50076
  CDS (1)..(2457): transl_table=11

SEQ ID NO: 93136 - protein, 818 aa, Photorhabdus luminescens subsp. laumondii TTO1; identical to SEQ ID NO: 50077

SEQ ID NO: 93137 - DNA, 2181 bp, Corynebacterium diphtheriae NCTC 13129; identical to SEQ ID NO: 50078
  CDS (1)..(2181): transl_table=11

SEQ ID NO: 93138 - protein, 726 aa, Corynebacterium diphtheriae NCTC 13129; identical to SEQ ID NO: 50079

SEQ ID NO: 93139 - DNA, 1947 bp, Rhodopseudomonas palustris CGA009; identical to SEQ ID NO: 50080
  CDS (1)..(1947): transl_table=11

SEQ ID NO: 93140 - protein, 648 aa, Rhodopseudomonas palustris CGA009; identical to SEQ ID NO: 50081

SEQ ID NO: 93141 - DNA, 2274 bp, Rhodopseudomonas palustris CGA009; identical to SEQ ID NO: 50082
  CDS (1)..(2274): transl_table=11

SEQ ID NO: 93142 - protein, 757 aa, Rhodopseudomonas palustris CGA009; identical to SEQ ID NO: 50083

SEQ ID NO: 93143 - DNA, 2499 bp, Rhodopseudomonas palustris CGA009; identical to SEQ ID NO: 50084
  CDS (1)..(2499): transl_table=11

SEQ ID NO: 93144 - protein, 832 aa, Rhodopseudomonas palustris CGA009; identical to SEQ ID NO: 50085

SEQ ID NO: 93145 - DNA, 1989 bp, Geobacter sulfurreducens PCA; identical to SEQ ID NO: 50086
  CDS (1)..(1989): transl_table=11

SEQ ID NO: 93146 - protein, 662 aa, Geobacter sulfurreducens PCA; identical to SEQ ID NO: 50087

SEQ ID NO: 93147 - DNA, 2391 bp, Geobacter sulfurreducens PCA; identical to SEQ ID NO: 50088
  CDS (1)..(2391): transl_table=11

SEQ ID NO: 93148 - protein, 796 aa, Geobacter sulfurreducens PCA; identical to SEQ ID NO: 50089

SEQ ID NO: 93149 - DNA, 2388 bp, Lactobacillus johnsonii NCC 533; identical to SEQ ID NO: 50090
  CDS (1)..(2388): transl_table=11

SEQ ID NO: 93150 - protein, 795 aa, Lactobacillus johnsonii NCC 533; identical to SEQ ID NO: 50091

SEQ ID NO: 93151 - DNA, 2058 bp, Lactobacillus johnsonii NCC 533; identical to SEQ ID NO: 50092
  CDS (1)..(2058): transl_table=11

SEQ ID NO: 93152 - protein, 685 aa, Lactobacillus johnsonii NCC 533; identical to SEQ ID NO: 50093

SEQ ID NO: 93153 - DNA, 2697 bp, Bdellovibrio bacteriovorus HD100; identical to SEQ ID NO: 50094
  CDS (1)..(2697): transl_table=11

SEQ ID NO: 93154 - protein, 898 aa, Bdellovibrio bacteriovorus HD100; identical to SEQ ID NO: 50095

SEQ ID NO: 93155 - DNA, 2373 bp, Bdellovibrio bacteriovorus HD100; identical to SEQ ID NO: 50096
  CDS (1)..(2373): transl_table=11

SEQ ID NO: 93156 - protein, 790 aa, Bdellovibrio bacteriovorus HD100; identical to SEQ ID NO: 50097

SEQ ID NO: 93157 - DNA, 2514 bp, Bacillus cereus ATCC 10987; identical to SEQ ID NO: 50098
  CDS (1)..(2514): transl_table=11

SEQ ID NO: 93158 - protein, 837 aa, Bacillus cereus ATCC 10987; identical to SEQ ID NO: 50099

SEQ ID NO: 93159 - DNA, 2496 bp, Yersinia pestis biovar Medievalis str. 91001; identical to SEQ ID NO: 50100
  CDS (1)..(2496): transl_table=11

SEQ ID NO: 93160 - protein, 831 aa, Yersinia pestis biovar Medievalis str. 91001; identical to SEQ ID NO: 50101

SEQ ID NO: 93161 - DNA, 2757 bp, Leptospira interrogans serovar Copenhageni str. Fiocruz L1-130; identical to SEQ ID NO: 50102
  CDS (1)..(2757): transl_table=11

SEQ ID NO: 93162 - protein, 918 aa, Leptospira interrogans serovar Copenhageni str. Fiocruz L1-130; identical to SEQ ID NO: 50103

SEQ ID NO: 93163 - DNA, 2088 bp, Thermus thermophilus HB27; identical to SEQ ID NO: 50104
  CDS (1)..(2088): transl_table=11

SEQ ID NO: 93164 - protein, 695 aa, Thermus thermophilus HB27; identical to SEQ ID NO: 50105

SEQ ID NO: 93165 - DNA, 2151 bp, Bartonella quintana str. Toulouse; identical to SEQ ID NO: 50106
  CDS (1)..(2151): transl_table=11

SEQ ID NO: 93166 - protein, 716 aa, Bartonella quintana str. Toulouse; identical to SEQ ID NO: 50107

SEQ ID NO: 93167 - DNA, 2463 bp, Bartonella quintana str. Toulouse; identical to SEQ ID NO: 50108
  CDS (1)..(2463): transl_table=11

SEQ ID NO: 93168 - protein, 820 aa, Bartonella quintana str. Toulouse; identical to SEQ ID NO: 50109

SEQ ID NO: 93169 - DNA, 2151 bp, Bartonella henselae str. Houston-1; identical to SEQ ID NO: 50110
  CDS (1)..(2151): transl_table=11

SEQ ID NO: 93170 - protein, 716 aa, Bartonella henselae str. Houston-1; identical to SEQ ID NO: 50111

SEQ ID NO: 93171 - DNA, 2463 bp, Bartonella henselae str. Houston-1; identical to SEQ ID NO: 50112
  CDS (1)..(2463): transl_table=11

SEQ ID NO: 93172 - protein, 820 aa, Bartonella henselae str. Houston-1; identical to SEQ ID NO: 50113

SEQ ID NO: 93173 - DNA, 2043 bp, Bacillus thuringiensis serovar konkukian str. 97-27; identical to SEQ ID NO: 50114
  CDS (1)..(2043): transl_table=11

SEQ ID NO: 93174 - protein, 680 aa, Bacillus thuringiensis serovar konkukian str. 97-27; identical to SEQ ID NO: 50115

SEQ ID NO: 93175 - DNA, 2505 bp, Bacillus thuringiensis serovar konkukian str. 97-27; identical to SEQ ID NO: 50116
  CDS (1)..(2505): transl_table=11

SEQ ID NO: 93176 - protein, 834 aa, Bacillus thuringiensis serovar konkukian str. 97-27; identical to SEQ ID NO: 50117

SEQ ID NO: 93177 - DNA, 2052 bp, Bacillus thuringiensis serovar konkukian str. 97-27; identical to SEQ ID NO: 50118
  CDS (1)..(2052): transl_table=11

SEQ ID NO: 93178 - protein, 683 aa, Bacillus thuringiensis serovar konkukian str. 97-27; identical to SEQ ID NO: 50119

SEQ ID NO: 93179 - DNA, 2559 bp, Acinetobacter sp. ADP1; identical to SEQ ID NO: 50120
  CDS (1)..(2559): transl_table=11

SEQ ID NO: 93180 - protein, 852 aa, Acinetobacter sp. ADP1; identical to SEQ ID NO: 50121

SEQ ID NO: 93181 - DNA, 2478 bp, Erwinia carotovora subsp. atroseptica SCRI1043; identical to SEQ ID NO: 50122
  CDS (1)..(2478)

SEQ ID NO: 93182 - protein, 825 aa, Erwinia carotovora subsp. atroseptica SCRI1043; identical to SEQ ID NO: 50123

SEQ ID NO: 93183 - DNA, 2346 bp, Propionibacterium acnes KPA171202; identical to SEQ ID NO: 50124
  CDS (1)..(2346): transl_table=11

SEQ ID NO: 93184 - protein, 781 aa, Propionibacterium acnes KPA171202; identical to SEQ ID NO: 50125

SEQ ID NO: 93185 - DNA, 2166 bp, Streptococcus pyogenes MGAS10394; identical to SEQ ID NO: 50126
  CDS (1)..(2166): transl_table=11

SEQ ID NO: 93186 - protein, 721 aa, Streptococcus pyogenes MGAS10394; identical to SEQ ID NO: 50127

SEQ ID NO: 93187 - DNA, 2487 bp, Desulfotalea psychrophila LSv54; identical to SEQ ID NO: 50128
  CDS (1)..(2487): transl_table=11

SEQ ID NO: 93188 - protein, 828 aa, Desulfotalea psychrophila LSv54; identical to SEQ ID NO: 50129

SEQ ID NO: 93189 - DNA, 2400 bp, Symbiobacterium thermophilum IAM 14863; identical to SEQ ID NO: 50130
  CDS (1)..(2400): transl_table=11

SEQ ID NO: 93190 - protein, 799 aa, Symbiobacterium thermophilum IAM 14863; identical to SEQ ID NO: 50131

SEQ ID NO: 93191 - DNA, 2574 bp, Symbiobacterium thermophilum IAM 14863; identical to SEQ ID NO: 50132
  CDS (1)..(2574): transl_table=11

SEQ ID NO: 93192 - protein, 857 aa, Symbiobacterium thermophilum IAM 14863; identical to SEQ ID NO: 50133

SEQ ID NO: 93193 - DNA, 2043 bp, Bacillus cereus ZK; identical to SEQ ID NO: 50134
  CDS (1)..(2043): transl_table=11

SEQ ID NO: 93194 - protein, 680 aa, Bacillus cereus ZK; identical to SEQ ID NO: 50135

SEQ ID NO: 93195 - DNA, 2508 bp, Bacillus cereus ZK; identical to SEQ ID NO: 50136
  CDS (1)..(2508): transl_table=11

SEQ ID NO: 93196 - protein, 835 aa, Bacillus cereus ZK; identical to SEQ ID NO: 50137

SEQ ID NO: 93197 - DNA, 2340 bp, Mannheimia succiniciproducens MBEL55E; identical to SEQ ID NO: 50138
  CDS (1)..(2340): transl_table=11

SEQ ID NO: 93198 - protein, 779 aa, Mannheimia succiniciproducens MBEL55E; identical to SEQ ID NO: 50139

SEQ ID NO: 93199 - DNA, 2622 bp, Mannheimia succiniciproducens MBEL55E; identical to SEQ ID NO: 50140
  CDS (1)..(2622): transl_table=11

SEQ ID NO: 93200 - protein, 873 aa, Mannheimia succiniciproducens MBEL55E; identical to SEQ ID NO: 50141

SEQ ID NO: 93201 - DNA, 2076 bp, Bacillus licheniformis ATCC 14580; identical to SEQ ID NO: 50142
  CDS (1)..(2076): transl_table=11

SEQ ID NO: 93202 - protein, 691 aa, Bacillus licheniformis ATCC 14580; identical to SEQ ID NO: 50143

SEQ ID NO: 93203 - DNA, 2385 bp, Legionella pneumophila subsp. pneumophila str. Philadelphia 1; identical to SEQ ID NO: 50144
  CDS (1)..(2385): transl_table=11

SEQ ID NO: 93204 - protein, 794 aa, Legionella pneumophila subsp. pneumophila str. Philadelphia 1; identical to SEQ ID NO: 50145

SEQ ID NO: 93205 - DNA, 2319 bp, Legionella pneumophila subsp. pneumophila str. Philadelphia 1; identical to SEQ ID NO: 50146
  CDS (1)..(2319): transl_table=11

SEQ ID NO: 93206 - protein, 772 aa, Legionella pneumophila subsp. pneumophila str. Philadelphia 1; identical to SEQ ID NO: 50147

SEQ ID NO: 93207 - DNA, 2559 bp, Burkholderia pseudomallei K96243; identical to SEQ ID NO: 50148
  CDS (1)..(2559): transl_table=11

SEQ ID NO: 93208 - protein, 852 aa, Burkholderia pseudomallei K96243; identical to SEQ ID NO: 50149

SEQ ID NO: 93209 - DNA, 2163 bp, Burkholderia pseudomallei K96243; identical to SEQ ID NO: 50150
  CDS (1)..(2163): transl_table=11

SEQ ID NO: 93210 - protein, 720 aa, Burkholderia pseudomallei K96243; identical to SEQ ID NO: 50151

SEQ ID NO: 93211 - DNA, 2493 bp, Methylococcus capsulatus str. Bath; identical to SEQ ID NO: 50152
  CDS (1)..(2493): transl_table=11

SEQ ID NO: 93212 - protein, 830 aa, Methylococcus capsulatus str. Bath; identical to SEQ ID NO: 50153

SEQ ID NO: 93213 - DNA, 2280 bp, Methylococcus capsulatus str. Bath; identical to SEQ ID NO: 50154
  CDS (1)..(2280): transl_table=11

SEQ ID NO: 93214 - protein, 759 aa, Methylococcus capsulatus str. Bath; identical to SEQ ID NO: 50155

SEQ ID NO: 93215 - DNA, 2370 bp, Nocardia farcinica IFM 10152; identical to SEQ ID NO: 50156
  CDS (1)..(2370): transl_table=11

SEQ ID NO: 93216 - protein, 789 aa, Nocardia farcinica IFM 10152; identical to SEQ ID NO: 50157

SEQ ID NO: 93217 - DNA, 2439 bp, Nocardia farcinica IFM 10152; identical to SEQ ID NO: 50158
  CDS (1)..(2439): transl_table=11

SEQ ID NO: 93218 - protein, 812 aa, Nocardia farcinica IFM 10152; identical to SEQ ID NO: 50159

SEQ ID NO: 93219 - DNA, 2385 bp, Legionella pneumophila str. Paris; identical to SEQ ID NO: 50160
  CDS (1)..(2385): transl_table=11

SEQ ID NO: 93220 - protein, 794 aa, Legionella pneumophila str. Paris; identical to SEQ ID NO: 50161

SEQ ID NO: 93221 - DNA, 2424 bp, Photobacterium profundum SS9; identical to SEQ ID NO: 50162
  CDS (1)..(2424): transl_table=11

SEQ ID NO: 93222 - protein, 807 aa, Photobacterium profundum SS9; identical to SEQ ID NO: 50163

SEQ ID NO: 93223 - DNA, 2391 bp, Photobacterium profundum SS9; identical to SEQ ID NO: 50164
  CDS (1)..(2391): transl_table=11

SEQ ID NO: 93224 - protein, 796 aa, Photobacterium profundum SS9; identical to SEQ ID NO: 50165

SEQ ID NO: 93225 - DNA, 2331 bp, Streptococcus thermophilus LMG 18311; identical to SEQ ID NO: 50166
  CDS (1)..(2331): transl_table=11

SEQ ID NO: 93226 - protein, 776 aa, Streptococcus thermophilus LMG 18311; identical to SEQ ID NO: 50167

SEQ ID NO: 93227 - DNA, 2328 bp, Streptococcus thermophilus CNRZ1066; identical to SEQ ID NO: 50168
  CDS (1)..(2328): transl_table=11

SEQ ID NO: 93228 - protein, 775 aa, Streptococcus thermophilus CNRZ1066; identical to SEQ ID NO: 50169

SEQ ID NO: 93229 - DNA, 2088 bp, Thermus thermophilus HB8; identical to SEQ ID NO: 50170
  CDS (1)..(2088): transl_table=11

SEQ ID NO: 93230 - protein, 695 aa, Thermus thermophilus HB8; identical to SEQ ID NO: 50171

SEQ ID NO: 93231 - DNA, 2046 bp, Geobacillus kaustophilus HTA426; identical to SEQ ID NO: 50172
  CDS (1)..(2046): transl_table=11

SEQ ID NO: 93232 - protein, 681 aa, Geobacillus kaustophilus HTA426; identical to SEQ ID NO: 50173

SEQ ID NO: 93233 - DNA, 2691 bp, Geobacillus kaustophilus HTA426; identical to SEQ ID NO: 50174
  CDS (1)..(2691): transl_table=11

SEQ ID NO: 93234 - protein, 896 aa, Geobacillus kaustophilus HTA426; identical to SEQ ID NO: 50175

SEQ ID NO: 93235 - DNA, 2577 bp, Salmonella enterica subsp. enterica serovar Paratypi A str. ATCC; identical to SEQ ID NO: 50176
  CDS (1)..(2577): transl_table=11

SEQ ID NO: 93236 - protein, 858 aa, Salmonella enterica subsp. enterica serovar Paratypi A str. ATCC; identical to SEQ ID NO: 50177

SEQ ID NO: 93237 - DNA, 2268 bp, Idiomarina loihiensis L2TR; identical to SEQ ID NO: 50178
  CDS (1)..(2268): transl_table=11

SEQ ID NO: 93238 - protein, 755 aa, Idiomarina loihiensis L2TR; identical to SEQ ID NO: 50179

SEQ ID NO: 93239 - DNA, 2373 bp, Azoarcus sp. EbN1; identical to SEQ ID NO: 50180
  CDS (1)..(2373): transl_table=11

SEQ ID NO: 93240 - protein, 790 aa, Azoarcus sp. EbN1; identical to SEQ ID NO: 50181

SEQ ID NO: 93241 - DNA, 2109 bp, Zymomonas mobilis subsp. mobilis ZM4; identical to SEQ ID NO: 50182
  CDS (1)..(2109): transl_table=11

SEQ ID NO: 93242 - protein, 702 aa, Zymomonas mobilis subsp. mobilis ZM4; identical to SEQ ID NO: 50183

SEQ ID NO: 93243 - DNA, 2367 bp, Silicibacter pomeroyi DSS-3; identical to SEQ ID NO: 50184
  CDS (1)..(2367): transl_table=11

SEQ ID NO: 93244 - protein, 788 aa, Silicibacter pomeroyi DSS-3; identical to SEQ ID NO: 50185

SEQ ID NO: 93245 - DNA, 2034 bp, Synechococcus elongatus PCC 6301; identical to SEQ ID NO: 50186
  CDS (1)..(2034): transl_table=11

SEQ ID NO: 93246 - protein, 677 aa, Synechococcus elongatus PCC 6301; identical to SEQ ID NO: 50187

SEQ ID NO: 93247 - DNA, 1878 bp, Synechococcus elongatus PCC 6301; identical to SEQ ID NO: 50188
  CDS (1)..(1878): transl_table=11

SEQ ID NO: 93248 - protein, 625 aa, Synechococcus elongatus PCC 6301; identical to SEQ ID NO: 50189

SEQ ID NO: 93249 - DNA, 1845 bp, Bacillus clausii KSM-K16; identical to SEQ ID NO: 50190
  CDS (1)..(1845): transl_table=11

SEQ ID NO: 93250 - protein, 614 aa, Bacillus clausii KSM-K16; identical to SEQ ID NO: 50191

SEQ ID NO: 93251 - DNA, 2148 bp, Bacillus clausii KSM-K16; identical to SEQ ID NO: 50192
  CDS (1)..(2148): transl_table=11

SEQ ID NO: 93252 - protein, 715 aa, Bacillus clausii KSM-K16; identical to SEQ ID NO: 50193

SEQ ID NO: 93253 - DNA, 2808 bp, Bacillus clausii KSM-K16; identical to SEQ ID NO: 50194
  CDS (1)..(2808): transl_table=11

SEQ ID NO: 93254 - protein, 935 aa, Bacillus clausii KSM-K16; identical to SEQ ID NO: 50195

SEQ ID NO: 93255 - DNA, 2322 bp, Bacillus clausii KSM-K16; identical to SEQ ID NO: 50196
  CDS (1)..(2322): transl_table=11

SEQ ID NO: 93256 - protein, 773 aa, Bacillus clausii KSM-K16; identical to SEQ ID NO: 50197

SEQ ID NO: 93257 - DNA, 1932 bp, Campylobacter jejuni RM1221; identical to SEQ ID NO: 50198
  CDS (1)..(1932): transl_table=11

SEQ ID NO: 93258 - protein, 643 aa, Campylobacter jejuni RM1221; identical to SEQ ID NO: 50199

SEQ ID NO: 93259 - DNA, 2025 bp, Rhodobacter sphaeroides 2.4.1; identical to SEQ ID NO: 50200
  CDS (1)..(2025)

SEQ ID NO: 93260 - protein, 674 aa, Rhodobacter sphaeroides 2.4.1; identical to SEQ ID NO: 50201

SEQ ID NO: 93261 - DNA, 1902 bp, Rhodobacter sphaeroides 2.4.1; identical to SEQ ID NO: 50202
  CDS (1)..(1902)

SEQ ID NO: 93262 - protein, 633 aa, Rhodobacter sphaeroides 2.4.1; identical to SEQ ID NO: 50203

SEQ ID NO: 93263 - DNA, 2427 bp, Xylella fastidiosa Dixon; identical to SEQ ID NO: 50204
  CDS (1)..(2427)

SEQ ID NO: 93264 - protein, 808 aa, Xylella fastidiosa Dixon; identical to SEQ ID NO: 50205

SEQ ID NO: 93265 - DNA, 1947 bp, Lactobacillus gasseri; identical to SEQ ID NO: 50206
  CDS (1)..(1947)

SEQ ID NO: 93266 - protein, 648 aa, Lactobacillus gasseri; identical to SEQ ID NO: 50207

SEQ ID NO: 93267 - DNA, 2193 bp, Leuconostoc mesenteroides subsp. mesenteroides ATCC 8293; identical to SEQ ID NO: 50208
  CDS (1)..(2193)

SEQ ID NO: 93268 - protein, 730 aa, Leuconostoc mesenteroides subsp. mesenteroides ATCC 8293; identical to SEQ ID NO: 50209

SEQ ID NO: 93269 - DNA, 2244 bp, Azotobacter vinelandii; identical to SEQ ID NO: 50210
  CDS (1)..(2244)

SEQ ID NO: 93270 - protein, 747 aa, Azotobacter vinelandii; identical to SEQ ID NO: 50211

SEQ ID NO: 93271 - DNA, 1974 bp, Nostoc punctiforme PCC 73102; identical to SEQ ID NO: 50212
  CDS (1)..(1974)

SEQ ID NO: 93272 - protein, 657 aa, Nostoc punctiforme PCC 73102; identical to SEQ ID NO: 50213

SEQ ID NO: 93273 - DNA, 1926 bp, Nostoc punctiforme PCC 73102; identical to SEQ ID NO: 50214
  CDS (1)..(1926)

SEQ ID NO: 93274 - protein, 641 aa, Nostoc punctiforme PCC 73102; identical to SEQ ID NO: 50215

SEQ ID NO: 93275 - DNA, 2268 bp, Nostoc punctiforme PCC 73102; identical to SEQ ID NO: 50216
  CDS (1)..(2268)

SEQ ID NO: 93276 - protein, 755 aa, Nostoc punctiforme PCC 73102; identical to SEQ ID NO: 50217

SEQ ID NO: 93277 - DNA, 1926 bp, Nostoc punctiforme PCC 73102; identical to SEQ ID NO: 50218
  CDS (1)..(1926)

SEQ ID NO: 93278 - protein, 641 aa, Nostoc punctiforme PCC 73102; identical to SEQ ID NO: 50219

SEQ ID NO: 93279 - DNA, 1932 bp, Nostoc punctiforme PCC 73102; identical to SEQ ID NO: 50220
  CDS (1)..(1932)

SEQ ID NO: 93280 - protein, 643 aa, Nostoc punctiforme PCC 73102; identical to SEQ ID NO: 50221

SEQ ID NO: 93281 - DNA, 2424 bp, Nostoc punctiforme PCC 73102; identical to SEQ ID NO: 50222
  CDS (1)..(2424)

SEQ ID NO: 93282 - protein, 807 aa, Nostoc punctiforme PCC 73102; identical to SEQ ID NO: 50223

SEQ ID NO: 93283 - DNA, 2361 bp, Nostoc punctiforme PCC 73102; identical to SEQ ID NO: 50224
  CDS (1)..(2361)

SEQ ID NO: 93284 - protein, 786 aa, Nostoc punctiforme PCC 73102; identical to SEQ ID NO: 50225

SEQ ID NO: 93285 - DNA, 2325 bp, Haemophilus somnus 2336; identical to SEQ ID NO: 50226
  CDS (1)..(2325)

SEQ ID NO: 93286 - protein, 774 aa, Haemophilus somnus 2336; identical to SEQ ID NO: 50227

SEQ ID NO: 93287 - DNA, 2541 bp, Haemophilus somnus 2336; identical to SEQ ID NO: 50228
  CDS (1)..(2541)

SEQ ID NO: 93288 - protein, 846 aa, Haemophilus somnus 2336; identical to SEQ ID NO: 50229

SEQ ID NO: 93289 - DNA, 2403 bp, Actinobacillus pleuropneumoniae serovar 1 str. 4074; identical to SEQ ID NO: 50230
  CDS (1)..(2403)

SEQ ID NO: 93290 - protein, 800 aa, Actinobacillus pleuropneumoniae serovar 1 str. 4074; identical to SEQ ID NO: 50231

SEQ ID NO: 93291 - DNA, 2325 bp, Pseudomonas aeruginosa UCBPP-PA14; identical to SEQ ID NO: 50232
  CDS (1)..(2325)

SEQ ID NO: 93292 - protein, 774 aa, Pseudomonas aeruginosa UCBPP-PA14; identical to SEQ ID NO: 50233

SEQ ID NO: 93293 - DNA, 2259 bp, Fusobacterium nucleatum subsp. vincentii ATCC 49256; identical to SEQ ID NO: 50234
  CDS (1)..(2259): transl_table=11

SEQ ID NO: 93294 - protein, 752 aa, Fusobacterium nucleatum subsp. vincentii ATCC 49256; identical to SEQ ID NO: 50235

SEQ ID NO: 93295 - DNA, 2484 bp, Psychrobacter sp. 273-4; identical to SEQ ID NO: 50236
  CDS (1)..(2484)

SEQ ID NO: 93296 - protein, 827 aa, Psychrobacter sp. 273-4; identical to SEQ ID NO: 50237

SEQ ID NO: 93297 - DNA, 2595 bp, Haemophilus influenzae R2846; identical to SEQ ID NO: 50238
  CDS (1)..(2595)

SEQ ID NO: 93298 - protein, 864 aa, Haemophilus influenzae R2846; identical to SEQ ID NO: 50239

SEQ ID NO: 93299 - DNA, 2259 bp, Anabaena variabilis ATCC 29413; identical to SEQ ID NO: 50240
  CDS (1)..(2259)

SEQ ID NO: 93300 - protein, 752 aa, Anabaena variabilis ATCC 29413; identical to SEQ ID NO: 50241

SEQ ID NO: 93301 - DNA, 2271 bp, Anabaena variabilis ATCC 29413; identical to SEQ ID NO: 50242
  CDS (1)..(2271)

SEQ ID NO: 93302 - protein, 756 aa, Anabaena variabilis ATCC 29413; identical to SEQ ID NO: 50243

SEQ ID NO: 93303 - DNA, 2139 bp, Synechococcus elongatus PCC 7942; identical to SEQ ID NO: 50244
  CDS (1)..(2139)

SEQ ID NO: 93304 - protein, 712 aa, Synechococcus elongatus PCC 7942; identical to SEQ ID NO: 50245

SEQ ID NO: 93305 - DNA, 2223 bp, Synechococcus elongatus PCC 7942; identical to SEQ ID NO: 50246
  CDS (1)..(2223)

SEQ ID NO: 93306 - protein, 740 aa, Synechococcus elongatus PCC 7942; identical to SEQ ID NO: 50247

SEQ ID NO: 93307 - DNA, 2376 bp, Ralstonia eutropha JMP134; identical to SEQ ID NO: 50248
  CDS (1)..(2376)

SEQ ID NO: 93308 - protein, 791 aa, Ralstonia eutropha JMP134; identical to SEQ ID NO: 50249

SEQ ID NO: 93309 - DNA, 2376 bp, Methylobacillus flagellatus KT; identical to SEQ ID NO: 50250
  CDS (1)..(2376)

SEQ ID NO: 93310 - protein, 791 aa, Methylobacillus flagellatus KT; identical to SEQ ID NO: 50251

SEQ ID NO: 93311 - DNA, 2223 bp, Crocosphaera watsonii WH 8501; identical to SEQ ID NO: 50252
  CDS (1)..(2223)

SEQ ID NO: 93312 - protein, 740 aa, Crocosphaera watsonii WH 8501; identical to SEQ ID NO: 50253

SEQ ID NO: 93313 - DNA, 1842 bp, Crocosphaera watsonii WH 8501; identical to SEQ ID NO: 50254
  CDS (1)..(1842)

SEQ ID NO: 93314 - protein, 613 aa, Crocosphaera watsonii WH 8501; identical to SEQ ID NO: 50255

SEQ ID NO: 93315 - DNA, 2694 bp, Exiguobacterium sp. 255-15; identical to SEQ ID NO: 50256
  CDS (1)..(2694)

SEQ ID NO: 93316 - protein, 897 aa, Exiguobacterium sp. 255-15; identical to SEQ ID NO: 50257

SEQ ID NO: 93317 - DNA, 1707 bp, Exiguobacterium sp. 255-15; identical to SEQ ID NO: 50258
  CDS (1)..(1707)

SEQ ID NO: 93318 - protein, 568 aa, Exiguobacterium sp. 255-15; identical to SEQ ID NO: 50259

SEQ ID NO: 93319 - DNA, 2037 bp, Rubrobacter xylanophilus DSM 9941; identical to SEQ ID NO: 50260
  CDS (1)..(2037)

SEQ ID NO: 93320 - protein, 678 aa, Rubrobacter xylanophilus DSM 9941; identical to SEQ ID NO: 50261

SEQ ID NO: 93321 - DNA, 1959 bp, Rubrobacter xylanophilus DSM 9941; identical to SEQ ID NO: 50262
  CDS (1)..(1959)

SEQ ID NO: 93322 - protein, 652 aa, Rubrobacter xylanophilus DSM 9941; identical to SEQ ID NO: 50263

SEQ ID NO: 93323 - DNA, 2145 bp, Mesorhizobium sp. BNC1; identical to SEQ ID NO: 50264
  CDS (1)..(2145)

SEQ ID NO: 93324 - protein, 714 aa, Mesorhizobium sp. BNC1; identical to SEQ ID NO: 50265

SEQ ID NO: 93325 - DNA, 2457 bp, Mesorhizobium sp. BNC1; identical to SEQ ID NO: 50266
  CDS (1)..(2457)

SEQ ID NO: 93326 - protein, 818 aa, Mesorhizobium sp. BNC1; identical to SEQ ID NO: 50267

SEQ ID NO: 93327 - DNA, 2040 bp, Mesorhizobium sp. BNC1; identical to SEQ ID NO: 50268
  CDS (1)..(2040)

SEQ ID NO: 93328 - protein, 679 aa, Mesorhizobium sp. BNC1; identical to SEQ ID NO: 50269

SEQ ID NO: 93329 - DNA, 2172 bp, Mesorhizobium sp. BNC1; identical to SEQ ID NO: 50270
  CDS (1)..(2172)

SEQ ID NO: 93330 - protein, 723 aa, Mesorhizobium sp. BNC1; identical to SEQ ID NO: 50271

SEQ ID NO: 93331 - DNA, 2064 bp, Burkholderia cepacia R18194; identical to SEQ ID NO: 50272
  CDS (1)..(2064)

SEQ ID NO: 93332 - protein, 687 aa, Burkholderia cepacia R18194; identical to SEQ ID NO: 50273

SEQ ID NO: 93333 - DNA, 2388 bp, Burkholderia cepacia R1808; identical to SEQ ID NO: 50274
  CDS (1)..(2388)

SEQ ID NO: 93334 - protein, 795 aa, Burkholderia cepacia R1808; identical to SEQ ID NO: 50275

SEQ ID NO: 93335 - DNA, 2145 bp, Listeria monocytogenes str. 4b H7858; identical to SEQ ID NO: 50276
  CDS (1)..(2145): transl_table=11

SEQ ID NO: 93336 - protein, 714 aa, Listeria monocytogenes str. 4b H7858; identical to SEQ ID NO: 50277

SEQ ID NO: 93337 - DNA, 2511 bp, Bacillus cereus G9241; identical to SEQ ID NO: 50278
  CDS (1)..(2511): transl_table=11

SEQ ID NO: 93338 - protein, 836 aa, Bacillus cereus G9241; identical to SEQ ID NO: 50279

SEQ ID NO: 93339 - DNA, 2706 bp, Bacillus cereus G9241; identical to SEQ ID NO: 50280
  CDS (1)..(2706): transl_table=11

SEQ ID NO: 93340 - protein, 901 aa, Bacillus cereus G9241; identical to SEQ ID NO: 50281

SEQ ID NO: 93341 - DNA, 2496 bp, Rhodospirillum rubrum; identical to SEQ ID NO: 50282
  CDS (1)..(2496)

SEQ ID NO: 93342 - protein, 831 aa, Rhodospirillum rubrum; identical to SEQ ID NO: 50283

SEQ ID NO: 93343 - DNA, 1929 bp, Rhodospirillum rubrum; identical to SEQ ID NO: 50284
  CDS (1)..(1929)

SEQ ID NO: 93344 - protein, 642 aa, Rhodospirillum rubrum; identical to SEQ ID NO: 50285

SEQ ID NO: 93345 - DNA, 2160 bp, Rhodospirillum rubrum; identical to SEQ ID NO: 50286
  CDS (1)..(2160)

SEQ ID NO: 93346 - protein, 719 aa, Rhodospirillum rubrum; identical to SEQ ID NO: 50287

SEQ ID NO: 93347 - DNA, 2319 bp, Ralstonia metallidurans CH34; identical to SEQ ID NO: 50288
  CDS (1)..(2319)

SEQ ID NO: 93348 - protein, 772 aa, Ralstonia metallidurans CH34; identical to SEQ ID NO: 50289

SEQ ID NO: 93349 - DNA, 2223 bp, Ralstonia metallidurans CH34; identical to SEQ ID NO: 50290
  CDS (1)..(2223)

SEQ ID NO: 93350 - protein, 740 aa, Ralstonia metallidurans CH34; identical to SEQ ID NO: 50291

SEQ ID NO: 93351 - DNA, 2064 bp, Ralstonia metallidurans CH34; identical to SEQ ID NO: 50292
  CDS (1)..(2064)

SEQ ID NO: 93352 - protein, 687 aa, Ralstonia metallidurans CH34; identical to SEQ ID NO: 50293

SEQ ID NO: 93353 - DNA, 2400 bp, Burkholderia fungorum LB400; identical to SEQ ID NO: 50294
  CDS (1)..(2400)

SEQ ID NO: 93354 - protein, 799 aa, Burkholderia fungorum LB400; identical to SEQ ID NO: 50295

SEQ ID NO: 93355 - DNA, 2376 bp, Burkholderia fungorum LB400; identical to SEQ ID NO: 50296
  CDS (1)..(2376)

SEQ ID NO: 93356 - protein, 791 aa, Burkholderia fungorum LB400; identical to SEQ ID NO: 50297

SEQ ID NO: 93357 - DNA, 2172 bp, Enterococcus faecium; identical to SEQ ID NO: 50298
  CDS (1)..(2172)

SEQ ID NO: 93358 - protein, 723 aa, Enterococcus faecium; identical to SEQ ID NO: 50299

SEQ ID NO: 93359 - DNA, 3390 bp, Thermobifida fusca; identical to SEQ ID NO: 50300
  CDS (1)..(3390)

SEQ ID NO: 93360 - protein, 1129 aa, Thermobifida fusca; identical to SEQ ID NO: 50301

SEQ ID NO: 93361 - DNA, 2193 bp, Thermobifida fusca; identical to SEQ ID NO: 50302
  CDS (1)..(2193)

SEQ ID NO: 93362 - protein, 730 aa, Thermobifida fusca; identical to SEQ ID NO: 50303

SEQ ID NO: 93363 - DNA, 2406 bp, Thermobifida fusca; identical to SEQ ID NO: 50304
  CDS (1)..(2406)

SEQ ID NO: 93364 - protein, 801 aa, Thermobifida fusca; identical to SEQ ID NO: 50305

SEQ ID NO: 93365 - DNA, 2055 bp, Novosphingobium aromaticivorans DSM 12444; identical to SEQ ID NO: 50306
  CDS (1)..(2055)

SEQ ID NO: 93366 - protein, 684 aa, Novosphingobium aromaticivorans DSM 12444; identical to SEQ ID NO: 50307

SEQ ID NO: 93367 - DNA, 2475 bp, Clostridium thermocellum ATCC 27405; identical to SEQ ID NO: 50308
  CDS (1)..(2475)

SEQ ID NO: 93368 - protein, 824 aa, Clostridium thermocellum ATCC 27405; identical to SEQ ID NO: 50309

SEQ ID NO: 93369 - DNA, 2238 bp, Microbulbifer degradans 2-40; identical to SEQ ID NO: 50310
  CDS (1)..(2238)

SEQ ID NO: 93370 - protein, 745 aa, Microbulbifer degradans 2-40; identical to SEQ ID NO: 50311

SEQ ID NO: 93371 - DNA, 1986 bp, Oenococcus oeni PSU-1; identical to SEQ ID NO: 50312
  CDS (1)..(1986)

SEQ ID NO: 93372 - protein, 661 aa, Oenococcus oeni PSU-1; identical to SEQ ID NO: 50313

SEQ ID NO: 93373 - DNA, 2640 bp, Oenococcus oeni PSU-1; identical to SEQ ID NO: 50314
  CDS (1)..(2640)

SEQ ID NO: 93374 - protein, 879 aa, Oenococcus oeni PSU-1; identical to SEQ ID NO: 50315

SEQ ID NO: 93375 - DNA, 2154 bp, Pediococcus pentosaceus ATCC 25745; identical to SEQ ID NO: 50316
  CDS (1)..(2154)

SEQ ID NO: 93376 - protein, 717 aa, Pediococcus pentosaceus ATCC 25745; identical to SEQ ID NO: 50317

SEQ ID NO: 93377 - DNA, 2310 bp, Pediococcus pentosaceus ATCC 25745; identical to SEQ ID NO: 50318
  CDS (1)..(2310)

SEQ ID NO: 93378 - protein, 769 aa, Pediococcus pentosaceus ATCC 25745; identical to SEQ ID NO: 50319

SEQ ID NO: 93379 - DNA, 2067 bp, Trichodesmium erythraeum IMS101; identical to SEQ ID NO: 50320
  CDS (1)..(2067)

SEQ ID NO: 93380 - protein, 688 aa, Trichodesmium erythraeum IMS101; identical to SEQ ID NO: 50321

SEQ ID NO: 93381 - DNA, 2289 bp, Trichodesmium erythraeum IMS101; identical to SEQ ID NO: 50322
  CDS (1)..(2289)

SEQ ID NO: 93382 - protein, 762 aa, Trichodesmium erythraeum IMS101; identical to SEQ ID NO: 50323

SEQ ID NO: 93383 - DNA, 1965 bp, Trichodesmium erythraeum IMS101; identical to SEQ ID NO: 50324
  CDS (1)..(1965)

SEQ ID NO: 93384 - protein, 654 aa, Trichodesmium erythraeum IMS101; identical to SEQ ID NO: 50325

SEQ ID NO: 93385 - DNA, 2664 bp, Moorella thermoacetica ATCC 39073; identical to SEQ ID NO: 50326
  CDS (1)..(2664)

SEQ ID NO: 93386 - protein, 887 aa, Moorella thermoacetica ATCC 39073; identical to SEQ ID NO: 50327

SEQ ID NO: 93387 - DNA, 2175 bp, Streptococcus suis 89/1591; identical to SEQ ID NO: 50328
  CDS (1)..(2175)

SEQ ID NO: 93388 - protein, 724 aa, Streptococcus suis 89/1591; identical to SEQ ID NO: 50329

SEQ ID NO: 93389 - DNA, 2208 bp, Silicibacter sp. TM1040; identical to SEQ ID NO: 50330
  CDS (1)..(2208)

SEQ ID NO: 93390 - protein, 735 aa, Silicibacter sp. TM1040; identical to SEQ ID NO: 50331

SEQ ID NO: 93391 - DNA, 2286 bp, Rubrobacter xylanophilus DSM 9941; identical to SEQ ID NO: 50332
  CDS (1)..(2286)

SEQ ID NO: 93392 - protein, 761 aa, Rubrobacter xylanophilus DSM 9941; identical to SEQ ID NO: 50333

SEQ ID NO: 93393 - DNA, 2946 bp, Chloroflexus aurantiacus; identical to SEQ ID NO: 50334
  CDS (1)..(2946)

SEQ ID NO: 93394 - protein, 981 aa, Chloroflexus aurantiacus; identical to SEQ ID NO: 50335

SEQ ID NO: 93395 - DNA, 2028 bp, Polaromonas sp. JS666; identical to SEQ ID NO: 50336
  CDS (1)..(2028)

SEQ ID NO: 93396 - protein, 675 aa, Polaromonas sp. JS666; identical to SEQ ID NO: 50337

SEQ ID NO: 93397 - DNA, 2271 bp, Streptococcus pyogenes M49 591; identical to SEQ ID NO: 50338
  CDS (1)..(2271)

SEQ ID NO: 93398 - protein, 756 aa, Streptococcus pyogenes M49 591; identical to SEQ ID NO: 50339

SEQ ID NO: 93399 - DNA, 1935 bp, Campylobacter lari RM2100; identical to SEQ ID NO: 50340
  CDS (1)..(1935): transl_table=11

SEQ ID NO: 93400 - protein, 644 aa, Campylobacter lari RM2100; identical to SEQ ID NO: 50341

SEQ ID NO: 93401 - DNA, 2541 bp, Citrobacter freundii; identical to SEQ ID NO: 50342
  CDS (1)..(2541): transl_table=11

SEQ ID NO: 93402 - protein, 846 aa, Citrobacter freundii; identical to SEQ ID NO: 50343

SEQ ID NO: 93403 - DNA, 2184 bp, Staphylococcus aureus; identical to SEQ ID NO: 50344
  CDS (1)..(2184): transl_table=11

SEQ ID NO: 93404 - protein, 727 aa, Staphylococcus aureus; identical to SEQ ID NO: 50345

SEQ ID NO: 93405 - DNA, 2292 bp, uncultured bacterium 311; identical to SEQ ID NO: 50346
  CDS (1)..(2292): transl_table=11

SEQ ID NO: 93406 - protein, 763 aa, uncultured bacterium 311; identical to SEQ ID NO: 50347

SEQ ID NO: 93407 - DNA, 2196 bp, Streptococcus pneumoniae; identical to SEQ ID NO: 50348
  CDS (1)..(2196): transl_table=11

SEQ ID NO: 93408 - protein, 731 aa, Streptococcus pneumoniae; identical to SEQ ID NO: 50349

SEQ ID NO: 93409 - DNA, 2196 bp, Streptococcus pneumoniae; identical to SEQ ID NO: 50350
  CDS (1)..(2196): transl_table=11

SEQ ID NO: 93410 - protein, 731 aa, Streptococcus pneumoniae; identical to SEQ ID NO: 50351

SEQ ID NO: 93411 - DNA, 2160 bp, Streptococcus pneumoniae; identical to SEQ ID NO: 50352
  CDS (1)..(2160): transl_table=11

SEQ ID NO: 93412 - protein, 719 aa, Streptococcus pneumoniae; identical to SEQ ID NO: 50353

SEQ ID NO: 93413 - DNA, 2160 bp, Streptococcus pneumoniae; identical to SEQ ID NO: 50354
  CDS (1)..(2160): transl_table=11

SEQ ID NO: 93414 - protein, 719 aa, Streptococcus pneumoniae; identical to SEQ ID NO: 50355

SEQ ID NO: 93415 - DNA, 2112 bp, Streptococcus pneumoniae; identical to SEQ ID NO: 50356
  CDS (1)..(2112): transl_table=11

SEQ ID NO: 93416 - protein, 703 aa, Streptococcus pneumoniae; identical to SEQ ID NO: 50357

SEQ ID NO: 93417 - DNA, 2223 bp, Streptococcus gordonii; identical to SEQ ID NO: 50358
  CDS (1)..(2223): transl_table=11

SEQ ID NO: 93418 - protein, 740 aa, Streptococcus gordonii; identical to SEQ ID NO: 50359

SEQ ID NO: 93419 - DNA, 1980 bp, Helicobacter pylori; identical to SEQ ID NO: 50360
  CDS (1)..(1980): transl_table=11

SEQ ID NO: 93420 - protein, 659 aa, Helicobacter pylori; identical to SEQ ID NO: 50361

SEQ ID NO: 93421 - DNA, 2184 bp, Staphylococcus aureus; identical to SEQ ID NO: 50362
  CDS (1)..(2184): transl_table=11

SEQ ID NO: 93422 - protein, 727 aa, Staphylococcus aureus; identical to SEQ ID NO: 50363

SEQ ID NO: 93423 - DNA, 1983 bp, Helicobacter pylori; identical to SEQ ID NO: 50364
  CDS (1)..(1983): transl_table=11

SEQ ID NO: 93424 - protein, 660 aa, Helicobacter pylori; identical to SEQ ID NO: 50365

SEQ ID NO: 93425 - DNA, 1980 bp, Helicobacter pylori; identical to SEQ ID NO: 50366
  CDS (1)..(1980): transl_table=11

SEQ ID NO: 93426 - protein, 659 aa, Helicobacter pylori; identical to SEQ ID NO: 50367

SEQ ID NO: 93427 - DNA, 2382 bp, Enterococcus hirae; identical to SEQ ID NO: 50368
  CDS (1)..(2382): transl_table=11

SEQ ID NO: 93428 - protein, 793 aa, Enterococcus hirae; identical to SEQ ID NO: 50369

SEQ ID NO: 93429 - DNA, 2148 bp, Mycobacterium smegmatis; identical to SEQ ID NO: 50370
  CDS (1)..(2148): transl_table=11

SEQ ID NO: 93430 - protein, 715 aa, Mycobacterium smegmatis; identical to SEQ ID NO: 50371

SEQ ID NO: 93431 - DNA, 2160 bp, Streptococcus pneumoniae; identical to SEQ ID NO: 50372
  CDS (1)..(2160): transl_table=11

SEQ ID NO: 93432 - protein, 719 aa, Streptococcus pneumoniae; identical to SEQ ID NO: 50373

SEQ ID NO: 93433 - DNA, 2160 bp, Streptococcus pneumoniae; identical to SEQ ID NO: 50374
  CDS (1)..(2160): transl_table=11

SEQ ID NO: 93434 - protein, 719 aa, Streptococcus pneumoniae; identical to SEQ ID NO: 50375

SEQ ID NO: 93435 - DNA, 2160 bp, Streptococcus pneumoniae; identical to SEQ ID NO: 50376
  CDS (1)..(2160): transl_table=11

SEQ ID NO: 93436 - protein, 719 aa, Streptococcus pneumoniae; identical to SEQ ID NO: 50377

SEQ ID NO: 93437 - DNA, 2160 bp, Streptococcus pneumoniae; identical to SEQ ID NO: 50378
  CDS (1)..(2160): transl_table=11

SEQ ID NO: 93438 - protein, 719 aa, Streptococcus pneumoniae; identical to SEQ ID NO: 50379

SEQ ID NO: 93439 - DNA, 2181 bp, Aquifex aeolicus; identical to SEQ ID NO: 50380
  CDS (1)..(2181): transl_table=11

SEQ ID NO: 93440 - protein, 726 aa, Aquifex aeolicus; identical to SEQ ID NO: 50381

SEQ ID NO: 93441 - DNA, 2745 bp, Bacillus subtilis; identical to SEQ ID NO: 50382
  CDS (1)..(2745): transl_table=11

SEQ ID NO: 93442 - protein, 914 aa, Bacillus subtilis; identical to SEQ ID NO: 50383

SEQ ID NO: 93443 - DNA, 2553 bp, Escherichia coli; identical to SEQ ID NO: 50384
  CDS (1)..(2553): transl_table=11

SEQ ID NO: 93444 - protein, 850 aa, Escherichia coli; identical to SEQ ID NO: 50385

SEQ ID NO: 93445 - DNA, 2397 bp, Neisseria flavescens; identical to SEQ ID NO: 50386
  CDS (1)..(2397): transl_table=11

SEQ ID NO: 93446 - protein, 798 aa, Neisseria flavescens; identical to SEQ ID NO: 50387

SEQ ID NO: 93447 - DNA, 2397 bp, Neisseria lactamica; identical to SEQ ID NO: 50388
  CDS (1)..(2397): transl_table=11

SEQ ID NO: 93448 - protein, 798 aa, Neisseria lactamica; identical to SEQ ID NO: 50389

SEQ ID NO: 93449 - DNA, 2283 bp, Buchnera aphidicola; identical to SEQ ID NO: 50390
  CDS (1)..(2283)

SEQ ID NO: 93450 - protein, 760 aa, Buchnera aphidicola; identical to SEQ ID NO: 50391

SEQ ID NO: 93451 - DNA, 2346 bp, Haemophilus influenzae; identical to SEQ ID NO: 50392
  CDS (1)..(2346): transl_table=11

SEQ ID NO: 93452 - protein, 781 aa, Haemophilus influenzae; identical to SEQ ID NO: 50393

SEQ ID NO: 93453 - DNA, 2334 bp, Vibrio cholerae; identical to SEQ ID NO: 50394
  CDS (1)..(2334): transl_table=11

SEQ ID NO: 93454 - protein, 777 aa, Vibrio cholerae; identical to SEQ ID NO: 50395

SEQ ID NO: 93455 - DNA, 19 bp, Primer
atggccgggaatgaccgcg

SEQ ID NO: 93456 - DNA, 28 bp, Primer
ttaattactaccaaacatatccttgatc

SEQ ID NO: 93457 - protein, 968 aa, consensus; identical to SEQ ID NO: 50398
  MISC_FEATURE (1)..(968): consensus for the disclosure of xaa see table XV

SEQ ID NO: 93458 - protein, 164 aa, consensus; identical to SEQ ID NO: 50399
  MISC_FEATURE (1)..(164): consensus for the disclosure of xaa see table XV

SEQ ID NO: 93459 - protein, 44 aa, consensus; identical to SEQ ID NO: 50400
  MISC_FEATURE (1)..(44): consensus for the disclosure of xaa see table XV

SEQ ID NO: 93460 - protein, 104 aa, consensus; identical to SEQ ID NO: 50401
  MISC_FEATURE (1)..(104): consensus for the disclosure of xaa see table XV

SEQ ID NO: 93461 - protein, 71 aa, consensus; identical to SEQ ID NO: 50402
  MISC_FEATURE (1)..(71): consensus for the disclosure of xaa see table XV

SEQ ID NO: 93462 - DNA, 969 bp, Escherichia coli K12; identical to SEQ ID NO: 36938
  CDS (1)..(969)

SEQ ID NO: 93463 - protein, 322 aa, Escherichia coli K12; identical to SEQ ID NO: 36939

SEQ ID NO: 93464 - DNA, 1119 bp, Thermococcus kodakaraensis; identical to SEQ ID NO: 36940
  CDS (1)..(1119)

SEQ ID NO: 93465 - protein, 372 aa, Thermococcus kodakaraensis; identical to SEQ ID NO: 36941

SEQ ID NO: 93466 - DNA, 1101 bp, Mesorhizobium loti MAFF303099; identical to SEQ ID NO: 36942
  CDS (1)..(1101): transl_table=11

SEQ ID NO: 93467 - protein, 366 aa, Mesorhizobium loti MAFF303099; identical to SEQ ID NO: 36943

SEQ ID NO: 93468 - DNA, 1074 bp, Mesorhizobium loti MAFF303099; identical to SEQ ID NO: 36944
  CDS (1)..(1074): transl_table=11

SEQ ID NO: 93469 - protein, 357 aa, Mesorhizobium loti MAFF303099; identical to SEQ ID NO: 36945

SEQ ID NO: 93470 - DNA, 1113 bp, Mesorhizobium loti MAFF303099; identical to SEQ ID NO: 36946
  CDS (1)..(1113): transl_table=11

SEQ ID NO: 93471 - protein, 370 aa, Mesorhizobium loti MAFF303099; identical to SEQ ID NO: 36947

SEQ ID NO: 93472 - DNA, 1182 bp, Mesorhizobium loti MAFF303099; identical to SEQ ID NO: 36948
  CDS (1)..(1182): transl_table=11

SEQ ID NO: 93473 - protein, 393 aa, Mesorhizobium loti MAFF303099; identical to SEQ ID NO: 36949

SEQ ID NO: 93474 - DNA, 1080 bp, Mesorhizobium loti MAFF303099; identical to SEQ ID NO: 36950
  CDS (1)..(1080): transl_table=11

SEQ ID NO: 93475 - protein, 359 aa, Mesorhizobium loti MAFF303099; identical to SEQ ID NO: 36951

SEQ ID NO: 93476 - DNA, 1098 bp, Mesorhizobium loti MAFF303099; identical to SEQ ID NO: 36952
  CDS (1)..(1098): transl_table=11

SEQ ID NO: 93477 - protein, 365 aa, Mesorhizobium loti MAFF303099; identical to SEQ ID NO: 36953

SEQ ID NO: 93478 - DNA, 1056 bp, Mesorhizobium loti MAFF303099; identical to SEQ ID NO: 36954
  CDS (1)..(1056): transl_table=11

SEQ ID NO: 93479 - protein, 351 aa, Mesorhizobium loti MAFF303099; identical to SEQ ID NO: 36955

SEQ ID NO: 93480 - DNA, 1053 bp, Thermoplasma volcanium GSS1; identical to SEQ ID NO: 36956
  CDS (1)..(1053): transl_table=11

SEQ ID NO: 93481 - protein, 350 aa, Thermoplasma volcanium GSS1; identical to SEQ ID NO: 36957

SEQ ID NO: 93482 - DNA, 1095 bp, Pyrococcus abyssi GE5; identical to SEQ ID NO: 36958
  CDS (1)..(1095): transl_table=11

SEQ ID NO: 93483 - protein, 364 aa, Pyrococcus abyssi GE5; identical to SEQ ID NO: 36959

SEQ ID NO: 93484 - DNA, 1122 bp, Pyrococcus horikoshii OT3; identical to SEQ ID NO: 36960
  CDS (1)..(1122): transl_table=11

SEQ ID NO: 93485 - protein, 373 aa, Pyrococcus horikoshii OT3; identical to SEQ ID NO: 36961

SEQ ID NO: 93486 - DNA, 1128 bp, Pyrococcus horikoshii OT3; identical to SEQ ID NO: 36962
  CDS (1)..(1128): transl_table=11

SEQ ID NO: 93487 - protein, 375 aa, Pyrococcus horikoshii OT3; identical to SEQ ID NO: 36963

SEQ ID NO: 93488 - DNA, 1089 bp, Pyrococcus horikoshii OT3; identical to SEQ ID NO: 36964
  CDS (1)..(1089): transl_table=11

SEQ ID NO: 93489 - protein, 362 aa, Pyrococcus horikoshii OT3; identical to SEQ ID NO: 36965

SEQ ID NO: 93490 - DNA, 1146 bp, Aeropyrum pernix K1; identical to SEQ ID NO: 36966
  CDS (1)..(1146): transl_table=11

SEQ ID NO: 93491 - protein, 381 aa, Aeropyrum pernix K1; identical to SEQ ID NO: 36967

SEQ ID NO: 93492 - DNA, 1164 bp, Treponema pallidum subsp. pallidum str. Nichols; identical to SEQ ID NO: 36968
  CDS (1)..(1164): transl_table=11

SEQ ID NO: 93493 - protein, 387 aa, Treponema pallidum subsp. pallidum str. Nichols; identical to SEQ ID NO: 36969

SEQ ID NO: 93494 - DNA, 1080 bp, Thermotoga maritima MSB8; identical to SEQ ID NO: 36970
  CDS (1)..(1080): transl_table=11

SEQ ID NO: 93495 - protein, 359 aa, Thermotoga maritima MSB8; identical to SEQ ID NO: 36971

SEQ ID NO: 93496 - DNA, 1068 bp, Thermotoga maritima MSB8; identical to SEQ ID NO: 36972
  CDS (1)..(1068): transl_table=11

SEQ ID NO: 93497 - protein, 355 aa, Thermotoga maritima MSB8; identical to SEQ ID NO: 36973

SEQ ID NO: 93498 - DNA, 1110 bp, Thermotoga maritima MSB8; identical to SEQ ID NO: 36974
  CDS (1)..(1110): transl_table=11

SEQ ID NO: 93499 - protein, 369 aa, Thermotoga maritima MSB8; identical to SEQ ID NO: 36975

SEQ ID NO: 93500 - DNA, 1137 bp, Bacillus halodurans C-125; identical to SEQ ID NO: 36976
  CDS (1)..(1137): transl_table=11

SEQ ID NO: 93501 - protein, 378 aa, Bacillus halodurans C-125; identical to SEQ ID NO: 36977

SEQ ID NO: 93502 - DNA, 1107 bp, Pasteurella multocida subsp. multocida str. Pm70; identical to SEQ ID NO: 36978
  CDS (1)..(1107): transl_table=11

SEQ ID NO: 93503 - protein, 368 aa, Pasteurella multocida subsp. multocida str. Pm70; identical to SEQ ID NO: 36979

SEQ ID NO: 93504 - DNA, 1113 bp, Pseudomonas aeruginosa PAO1; identical to SEQ ID NO: 36980
  CDS (1)..(1113): transl_table=11

SEQ ID NO: 93505 - protein, 370 aa, Pseudomonas aeruginosa PAO1; identical to SEQ ID NO: 36981

SEQ ID NO: 93506 - DNA, 1161 bp, Pseudomonas aeruginosa PAO1; identical to SEQ ID NO: 36982
  CDS (1)..(1161): transl_table=11

SEQ ID NO: 93507 - protein, 386 aa, Pseudomonas aeruginosa PAO1; identical to SEQ ID NO: 36983

SEQ ID NO: 93508 - DNA, 1137 bp, Lactococcus lactis subsp. lactis Il1403; identical to SEQ ID NO: 36984
  CDS (1)..(1137): transl_table=11

SEQ ID NO: 93509 - protein, 378 aa, Lactococcus lactis subsp. lactis Il1403; identical to SEQ ID NO: 36985

SEQ ID NO: 93510 - DNA, 1368 bp, Deinococcus radiodurans R1; identical to SEQ ID NO: 36986
  CDS (1)..(1368): transl_table=11

SEQ ID NO: 93511 - protein, 455 aa, Deinococcus radiodurans R1; identical to SEQ ID NO: 36987

SEQ ID NO: 93512 - DNA, 1095 bp, Xylella fastidiosa 9a5c; identical to SEQ ID NO: 36988
  CDS (1)..(1095): transl_table=11

SEQ ID NO: 93513 - protein, 364 aa, Xylella fastidiosa 9a5c; identical to SEQ ID NO: 36989

SEQ ID NO: 93514 - DNA, 1179 bp, Mycobacterium leprae TN; identical to SEQ ID NO: 36990
  CDS (1)..(1179): transl_table=11

SEQ ID NO: 93515 - protein, 392 aa, Mycobacterium leprae TN; identical to SEQ ID NO: 36991

SEQ ID NO: 93516 - DNA, 1071 bp, Mycobacterium leprae TN; identical to SEQ ID NO: 36992
  CDS (1)..(1071): transl_table=11

SEQ ID NO: 93517 - protein, 356 aa, Mycobacterium leprae TN; identical to SEQ ID NO: 36993

SEQ ID NO: 93518 - DNA, 1179 bp, Mycoplasma pulmonis UAB CTIP; identical to SEQ ID NO: 36994
  CDS (1)..(1179): transl_table=4

SEQ ID NO: 93519 - protein, 392 aa, Mycoplasma pulmonis UAB CTIP; identical to SEQ ID NO: 36995

SEQ ID NO: 93520 - DNA, 1182 bp, Mycobacterium tuberculosis CDC1551; identical to SEQ ID NO: 36996
  CDS (1)..(1182): transl_table=11

SEQ ID NO: 93521 - protein, 393 aa, Mycobacterium tuberculosis CDC1551; identical to SEQ ID NO: 36997

SEQ ID NO: 93522 - DNA, 1074 bp, Mycobacterium tuberculosis CDC1551; identical to SEQ ID NO: 36998
  CDS (1)..(1074): transl_table=11

SEQ ID NO: 93523 - protein, 357 aa, Mycobacterium tuberculosis CDC1551; identical to SEQ ID NO: 36999

SEQ ID NO: 93524 - DNA, 1083 bp, Mycobacterium tuberculosis CDC1551; identical to SEQ ID NO: 37000
  CDS (1)..(1083): transl_table=11

SEQ ID NO: 93525 - protein, 360 aa, Mycobacterium tuberculosis CDC1551; identical to SEQ ID NO: 37001

SEQ ID NO: 93526 - DNA, 1107 bp, Sulfolobus solfataricus P2; identical to SEQ ID NO: 37002
  CDS (1)..(1107): transl_table=11

SEQ ID NO: 93527 - protein, 368 aa, Sulfolobus solfataricus P2; identical to SEQ ID NO: 37003

SEQ ID NO: 93528 - DNA, 1110 bp, Clostridium acetobutylicum ATCC 824; identical to SEQ ID NO: 37004
  CDS (1)..(1110): transl_table=11

SEQ ID NO: 93529 - protein, 369 aa, Clostridium acetobutylicum ATCC 824; identical to SEQ ID NO: 37005

SEQ ID NO: 93530 - DNA, 1107 bp, Agrobacterium tumefaciens str. C58; identical to SEQ ID NO: 37006
  CDS (1)..(1107): transl_table=11

SEQ ID NO: 93531 - protein, 368 aa, Agrobacterium tumefaciens str. C58; identical to SEQ ID NO: 37007

SEQ ID NO: 93532 - DNA, 1242 bp, Agrobacterium tumefaciens str. C58; identical to SEQ ID NO: 37008
  CDS (1)..(1242): transl_table=11

SEQ ID NO: 93533 - protein, 413 aa, Agrobacterium tumefaciens str. C58; identical to SEQ ID NO: 37009

SEQ ID NO: 93534 - DNA, 1131 bp, Streptococcus pneumoniae R6; identical to SEQ ID NO: 37010
  CDS (1)..(1131): transl_table=11

SEQ ID NO: 93535 - protein, 376 aa, Streptococcus pneumoniae R6; identical to SEQ ID NO: 37011

SEQ ID NO: 93536 - DNA, 1104 bp, Sulfolobus tokodaii str. 7; identical to SEQ ID NO: 37012
  CDS (1)..(1104): transl_table=11

SEQ ID NO: 93537 - protein, 367 aa, Sulfolobus tokodaii str. 7; identical to SEQ ID NO: 37013

SEQ ID NO: 93538 - DNA, 1086 bp, Sinorhizobium meliloti 1021; identical to SEQ ID NO: 37014
  CDS (1)..(1086): transl_table=11

SEQ ID NO: 93539 - protein, 361 aa, Sinorhizobium meliloti 1021; identical to SEQ ID NO: 37015

SEQ ID NO: 93540 - DNA, 1002 bp, Sinorhizobium meliloti 1021; identical to SEQ ID NO: 37016
  CDS (1)..(1002): transl_table=11

SEQ ID NO: 93541 - protein, 333 aa, Sinorhizobium meliloti 1021; identical to SEQ ID NO: 37017

SEQ ID NO: 93542 - DNA, 1068 bp, Sinorhizobium meliloti 1021; identical to SEQ ID NO: 37018
  CDS (1)..(1068): transl_table=11

SEQ ID NO: 93543 - protein, 355 aa, Sinorhizobium meliloti 1021; identical to SEQ ID NO: 37019

SEQ ID NO: 93544 - DNA, 1104 bp, Bacillus subtilis subsp. subtilis str. 168; identical to SEQ ID NO: 37020
  CDS (1)..(1104): transl_table=11

SEQ ID NO: 93545 - protein, 367 aa, Bacillus subtilis subsp. subtilis str. 168; identical to SEQ ID NO: 37021

SEQ ID NO: 93546 - DNA, 1116 bp, Thermoplasma acidophilum DSM 1728; identical to SEQ ID NO: 37022
  CDS (1)..(1116): transl_table=11

SEQ ID NO: 93547 - protein, 371 aa, Thermoplasma acidophilum DSM 1728; identical to SEQ ID NO: 37023

SEQ ID NO: 93548 - DNA, 1119 bp, Thermoplasma acidophilum DSM 1728; identical to SEQ ID NO: 37024
  CDS (1)..(1119): transl_table=11

SEQ ID NO: 93549 - protein, 372 aa, Thermoplasma acidophilum DSM 1728; identical to SEQ ID NO: 37025

SEQ ID NO: 93550 - DNA, 1140 bp, Halobacterium salinarum NRC-1; identical to SEQ ID NO: 37026
  CDS (1)..(1140): transl_table=11

SEQ ID NO: 93551 - protein, 379 aa, Halobacterium salinarum NRC-1; identical to SEQ ID NO: 37027

SEQ ID NO: 93552 - DNA, 1074 bp, Yersinia pestis CO92; identical to SEQ ID NO: 37028
  CDS (1)..(1074)

SEQ ID NO: 93553 - protein, 357 aa, Yersinia pestis CO92; identical to SEQ ID NO: 37029

SEQ ID NO: 93554 - DNA, 1110 bp, Escherichia coli K12; identical to SEQ ID NO: 37030
  CDS (1)..(1110): transl_table=11

SEQ ID NO: 93555 - protein, 369 aa, Escherichia coli K12; identical to SEQ ID NO: 37031

SEQ ID NO: 93556 - DNA, 1098 bp, Sinorhizobium meliloti 1021; identical to SEQ ID NO: 37032
  CDS (1)..(1098): transl_table=11

SEQ ID NO: 93557 - protein, 365 aa, Sinorhizobium meliloti 1021; identical to SEQ ID NO: 37033

SEQ ID NO: 93558 - DNA, 1089 bp, Sinorhizobium meliloti 1021; identical to SEQ ID NO: 37034
  CDS (1)..(1089): transl_table=11

SEQ ID NO: 93559 - protein, 362 aa, Sinorhizobium meliloti 1021; identical to SEQ ID NO: 37035

SEQ ID NO: 93560 - DNA, 1068 bp, Sinorhizobium meliloti 1021; identical to SEQ ID NO: 37036
  CDS (1)..(1068): transl_table=11

SEQ ID NO: 93561 - protein, 355 aa, Sinorhizobium meliloti 1021; identical to SEQ ID NO: 37037

SEQ ID NO: 93562 - DNA, 1092 bp, Synechocystis sp. PCC 6803; identical to SEQ ID NO: 37038
  CDS (1)..(1092): transl_table=11

SEQ ID NO: 93563 - protein, 363 aa, Synechocystis sp. PCC 6803; identical to SEQ ID NO: 37039

SEQ ID NO: 93564 - DNA, 1071 bp, Salmonella typhimurium LT2; identical to SEQ ID NO: 37040
  CDS (1)..(1071): transl_table=11

SEQ ID NO: 93565 - protein, 356 aa, Salmonella typhimurium LT2; identical to SEQ ID NO: 37041

SEQ ID NO: 93566 - DNA, 1101 bp, Listeria innocua Clip11262; identical to SEQ ID NO: 37042
  CDS (1)..(1101): transl_table=11

SEQ ID NO: 93567 - protein, 366 aa, Listeria innocua Clip11262; identical to SEQ ID NO: 37043

SEQ ID NO: 93568 - DNA, 1101 bp, Nostoc sp. PCC 7120; identical to SEQ ID NO: 37044
  CDS (1)..(1101): transl_table=11

SEQ ID NO: 93569 - protein, 366 aa, Nostoc sp. PCC 7120; identical to SEQ ID NO: 37045

SEQ ID NO: 93570 - DNA, 1098 bp, Ralstonia solanacearum GMI1000; identical to SEQ ID NO: 37046
  CDS (1)..(1098): transl_table=11

SEQ ID NO: 93571 - protein, 365 aa, Ralstonia solanacearum GMI1000; identical to SEQ ID NO: 37047

SEQ ID NO: 93572 - DNA, 1101 bp, Agrobacterium tumefaciens str. C58; identical to SEQ ID NO: 37048
  CDS (1)..(1101): transl_table=11

SEQ ID NO: 93573 - protein, 366 aa, Agrobacterium tumefaciens str. C58; identical to SEQ ID NO: 37049

SEQ ID NO: 93574 - DNA, 1089 bp, Agrobacterium tumefaciens str. C58; identical to SEQ ID NO: 37050
  CDS (1)..(1089): transl_table=11

SEQ ID NO: 93575 - protein, 362 aa, Agrobacterium tumefaciens str. C58; identical to SEQ ID NO: 37051

SEQ ID NO: 93576 - DNA, 1059 bp, Agrobacterium tumefaciens str. C58; identical to SEQ ID NO: 37052
  CDS (1)..(1059): transl_table=11

SEQ ID NO: 93577 - protein, 352 aa, Agrobacterium tumefaciens str. C58; identical to SEQ ID NO: 37053

SEQ ID NO: 93578 - DNA, 1113 bp, Agrobacterium tumefaciens str. C58; identical to SEQ ID NO: 37054
  CDS (1)..(1113): transl_table=11

SEQ ID NO: 93579 - protein, 370 aa, Agrobacterium tumefaciens str. C58; identical to SEQ ID NO: 37055

SEQ ID NO: 93580 - DNA, 1116 bp, Agrobacterium tumefaciens str. C58; identical to SEQ ID NO: 37056
  CDS (1)..(1116): transl_table=11

SEQ ID NO: 93581 - protein, 371 aa, Agrobacterium tumefaciens str. C58; identical to SEQ ID NO: 37057

SEQ ID NO: 93582 - DNA, 1122 bp, Agrobacterium tumefaciens str. C58; identical to SEQ ID NO: 37058
  CDS (1)..(1122): transl_table=11

SEQ ID NO: 93583 - protein, 373 aa, Agrobacterium tumefaciens str. C58; identical to SEQ ID NO: 37059

SEQ ID NO: 93584 - DNA, 1074 bp, Agrobacterium tumefaciens str. C58; identical to SEQ ID NO: 37060
  CDS (1)..(1074): transl_table=11

SEQ ID NO: 93585 - protein, 357 aa, Agrobacterium tumefaciens str. C58; identical to SEQ ID NO: 37061

SEQ ID NO: 93586 - DNA, 1074 bp, Agrobacterium tumefaciens str. C58; identical to SEQ ID NO: 37062
  CDS (1)..(1074): transl_table=11

SEQ ID NO: 93587 - protein, 357 aa, Agrobacterium tumefaciens str. C58; identical to SEQ ID NO: 37063

SEQ ID NO: 93588 - DNA, 1086 bp, Agrobacterium tumefaciens str. C58; identical to SEQ ID NO: 37064
  CDS (1)..(1086): transl_table=11

SEQ ID NO: 93589 - protein, 361 aa, Agrobacterium tumefaciens str. C58; identical to SEQ ID NO: 37065

SEQ ID NO: 93590 - DNA, 999 bp, Agrobacterium tumefaciens str. C58; identical to SEQ ID NO: 37066
  CDS (1)..(999): transl_table=11

SEQ ID NO: 93591 - protein, 332 aa, Agrobacterium tumefaciens str. C58; identical to SEQ ID NO: 37067

SEQ ID NO: 93592 - DNA, 1077 bp, Agrobacterium tumefaciens str. C58; identical to SEQ ID NO: 37068
  CDS (1)..(1077): transl_table=11

SEQ ID NO: 93593 - protein, 358 aa, Agrobacterium tumefaciens str. C58; identical to SEQ ID NO: 37069

SEQ ID NO: 93594 - DNA, 1062 bp, Agrobacterium tumefaciens str. C58; identical to SEQ ID NO: 37070
  CDS (1)..(1062): transl_table=11

SEQ ID NO: 93595 - protein, 353 aa, Agrobacterium tumefaciens str. C58; identical to SEQ ID NO: 37071

SEQ ID NO: 93596 - DNA, 1074 bp, Agrobacterium tumefaciens str. C58; identical to SEQ ID NO: 37072
  CDS (1)..(1074): transl_table=11

SEQ ID NO: 93597 - protein, 357 aa, Agrobacterium tumefaciens str. C58; identical to SEQ ID NO: 37073

SEQ ID NO: 93598 - DNA, 1098 bp, Agrobacterium tumefaciens str. C58; identical to SEQ ID NO: 37074
  CDS (1)..(1098): transl_table=11

SEQ ID NO: 93599 - protein, 365 aa, Agrobacterium tumefaciens str. C58; identical to SEQ ID NO: 37075

SEQ ID NO: 93600 - DNA, 1080 bp, Agrobacterium tumefaciens str. C58; identical to SEQ ID NO: 37076
  CDS (1)..(1080): transl_table=11

SEQ ID NO: 93601 - protein, 359 aa, Agrobacterium tumefaciens str. C58; identical to SEQ ID NO: 37077

SEQ ID NO: 93602 - DNA, 1044 bp, Agrobacterium tumefaciens str. C58; identical to SEQ ID NO: 37078
  CDS (1)..(1044): transl_table=11

SEQ ID NO: 93603 - protein, 347 aa, Agrobacterium tumefaciens str. C58; identical to SEQ ID NO: 37079

SEQ ID NO: 93604 - DNA, 999 bp, Agrobacterium tumefaciens str. C58; identical to SEQ ID NO: 37080
  CDS (1)..(999): transl_table=11

SEQ ID NO: 93605 - protein, 332 aa, Agrobacterium tumefaciens str. C58; identical to SEQ ID NO: 37081

SEQ ID NO: 93606 - DNA, 1041 bp, Agrobacterium tumefaciens str. C58; identical to SEQ ID NO: 37082
  CDS (1)..(1041): transl_table=11

SEQ ID NO: 93607 - protein, 346 aa, Agrobacterium tumefaciens str. C58; identical to SEQ ID NO: 37083

SEQ ID NO: 93608 - DNA, 1116 bp, Agrobacterium tumefaciens str. C58; identical to SEQ ID NO: 37084
  CDS (1)..(1116): transl_table=11

SEQ ID NO: 93609 - protein, 371 aa, Agrobacterium tumefaciens str. C58; identical to SEQ ID NO: 37085

SEQ ID NO: 93610 - DNA, 1092 bp, Brucella melitensis 16M; identical to SEQ ID NO: 37086
  CDS (1)..(1092): transl_table=11

SEQ ID NO: 93611 - protein, 363 aa, Brucella melitensis 16M; identical to SEQ ID NO: 37087

SEQ ID NO: 93612 - DNA, 1056 bp, Brucella melitensis 16M; identical to SEQ ID NO: 37088
  CDS (1)..(1056): transl_table=11

SEQ ID NO: 93613 - protein, 351 aa, Brucella melitensis 16M; identical to SEQ ID NO: 37089

SEQ ID NO: 93614 - DNA, 1074 bp, Pyrobaculum aerophilum str. IM2; identical to SEQ ID NO: 37090
  CDS (1)..(1074): transl_table=11

SEQ ID NO: 93615 - protein, 357 aa, Pyrobaculum aerophilum str. IM2; identical to SEQ ID NO: 37091

SEQ ID NO: 93616 - DNA, 1110 bp, Clostridium perfringens str. 13; identical to SEQ ID NO: 37092
  CDS (1)..(1110): transl_table=11

SEQ ID NO: 93617 - protein, 369 aa, Clostridium perfringens str. 13; identical to SEQ ID NO: 37093

SEQ ID NO: 93618 - DNA, 1119 bp, Pyrococcus furiosus DSM 3638; identical to SEQ ID NO: 37094
  CDS (1)..(1119): transl_table=11

SEQ ID NO: 93619 - protein, 372 aa, Pyrococcus furiosus DSM 3638; identical to SEQ ID NO: 37095

SEQ ID NO: 93620 - DNA, 1113 bp, Pyrococcus furiosus DSM 3638; identical to SEQ ID NO: 37096
  CDS (1)..(1113): transl_table=11

SEQ ID NO: 93621 - protein, 370 aa, Pyrococcus furiosus DSM 3638; identical to SEQ ID NO: 37097

SEQ ID NO: 93622 - DNA, 1122 bp, Pyrococcus furiosus DSM 3638; identical to SEQ ID NO: 37098
  CDS (1)..(1122): transl_table=11

SEQ ID NO: 93623 - protein, 373 aa, Pyrococcus furiosus DSM 3638; identical to SEQ ID NO: 37099

SEQ ID NO: 93624 - DNA, 999 bp, Corynebacterium glutamicum ATCC 13032; identical to SEQ ID NO: 37100
  CDS (1)..(999): transl_table=11

SEQ ID NO: 93625 - protein, 332 aa, Corynebacterium glutamicum ATCC 13032; identical to SEQ ID NO: 37101

SEQ ID NO: 93626 - DNA, 1227 bp, Corynebacterium glutamicum ATCC 13032; identical to SEQ ID NO: 37102
  CDS (1)..(1227): transl_table=11

SEQ ID NO: 93627 - protein, 408 aa, Corynebacterium glutamicum ATCC 13032; identical to SEQ ID NO: 37103

SEQ ID NO: 93628 - DNA, 1131 bp, Corynebacterium glutamicum ATCC 13032; identical to SEQ ID NO: 37104
  CDS (1)..(1131): transl_table=11

SEQ ID NO: 93629 - protein, 376 aa, Corynebacterium glutamicum ATCC 13032; identical to SEQ ID NO: 37105

SEQ ID NO: 93630 - DNA, 1071 bp, Fusobacterium nucleatum subsp. nucleatum ATCC 25586; identical to SEQ ID NO: 37106
  CDS (1)..(1071): transl_table=11

SEQ ID NO: 93631 - protein, 356 aa, Fusobacterium nucleatum subsp. nucleatum ATCC 25586; identical to SEQ ID NO: 37107

SEQ ID NO: 93632 - DNA, 1164 bp, Thermoanaerobacter tengcongensis MB4; identical to SEQ ID NO: 37108
  CDS (1)..(1164): transl_table=11

SEQ ID NO: 93633 - protein, 387 aa, Thermoanaerobacter tengcongensis MB4; identical to SEQ ID NO: 37109

SEQ ID NO: 93634 - DNA, 1095 bp, Xanthomonas campestris pv. campestris str. ATCC 33913; identical to SEQ ID NO: 37110
  CDS (1)..(1095): transl_table=11

SEQ ID NO: 93635 - protein, 364 aa, Xanthomonas campestris pv. campestris str. ATCC 33913; identical to SEQ ID NO: 37111

SEQ ID NO: 93636 - DNA, 1098 bp, Staphylococcus aureus subsp. aureus MW2; identical to SEQ ID NO: 37112
  CDS (1)..(1098): transl_table=11

SEQ ID NO: 93637 - protein, 365 aa, Staphylococcus aureus subsp. aureus MW2; identical to SEQ ID NO: 37113

SEQ ID NO: 93638 - DNA, 1095 bp, Yersinia pestis KIM; identical to SEQ ID NO: 37114
  CDS (1)..(1095): transl_table=11

SEQ ID NO: 93639 - protein, 364 aa, Yersinia pestis KIM; identical to SEQ ID NO: 37115

SEQ ID NO: 93640 - DNA, 1074 bp, Thermosynechococcus elongatus BP-1; identical to SEQ ID NO: 37116
  CDS (1)..(1074): transl_table=11

SEQ ID NO: 93641 - protein, 357 aa, Thermosynechococcus elongatus BP-1; identical to SEQ ID NO: 37117

SEQ ID NO: 93642 - DNA, 1098 bp, Oceanobacillus iheyensis HTE831; identical to SEQ ID NO: 37118
  CDS (1)..(1098): transl_table=11

SEQ ID NO: 93643 - protein, 365 aa, Oceanobacillus iheyensis HTE831; identical to SEQ ID NO: 37119

SEQ ID NO: 93644 - DNA, 1128 bp, Bifidobacterium longum NCC2705; identical to SEQ ID NO: 37120
  CDS (1)..(1128): transl_table=11

SEQ ID NO: 93645 - protein, 375 aa, Bifidobacterium longum NCC2705; identical to SEQ ID NO: 37121

SEQ ID NO: 93646 - DNA, 1005 bp, Corynebacterium efficiens YS-314; identical to SEQ ID NO: 37122
  CDS (1)..(1005): transl_table=11

SEQ ID NO: 93647 - protein, 334 aa, Corynebacterium efficiens YS-314; identical to SEQ ID NO: 37123

SEQ ID NO: 93648 - DNA, 1182 bp, Corynebacterium efficiens YS-314; identical to SEQ ID NO: 37124
  CDS (1)..(1182): transl_table=11

SEQ ID NO: 93649 - protein, 393 aa, Corynebacterium efficiens YS-314; identical to SEQ ID NO: 37125

SEQ ID NO: 93650 - DNA, 1209 bp, Corynebacterium efficiens YS-314; identical to SEQ ID NO: 37126
  CDS (1)..(1209): transl_table=11

SEQ ID NO: 93651 - protein, 402 aa, Corynebacterium efficiens YS-314; identical to SEQ ID NO: 37127

SEQ ID NO: 93652 - DNA, 1155 bp, Pseudomonas putida KT2440; identical to SEQ ID NO: 37128
  CDS (1)..(1155): transl_table=11

SEQ ID NO: 93653 - protein, 384 aa, Pseudomonas putida KT2440; identical to SEQ ID NO: 37129

SEQ ID NO: 93654 - DNA, 1086 bp, Bradyrhizobium japonicum USDA 110; identical to SEQ ID NO: 37130
  CDS (1)..(1086)

SEQ ID NO: 93655 - protein, 361 aa, Bradyrhizobium japonicum USDA 110; identical to SEQ ID NO: 37131

SEQ ID NO: 93656 - DNA, 1101 bp, Bradyrhizobium japonicum USDA 110; identical to SEQ ID NO: 37132
  CDS (1)..(1101)

SEQ ID NO: 93657 - protein, 366 aa, Bradyrhizobium japonicum USDA 110; identical to SEQ ID NO: 37133

SEQ ID NO: 93658 - DNA, 1116 bp, Bradyrhizobium japonicum USDA 110; identical to SEQ ID NO: 37134
  CDS (1)..(1116)

SEQ ID NO: 93659 - protein, 371 aa, Bradyrhizobium japonicum USDA 110; identical to SEQ ID NO: 37135

SEQ ID NO: 93660 - DNA, 1137 bp, Lactobacillus plantarum WCFS1; identical to SEQ ID NO: 37136
  CDS (1)..(1137): transl_table=11

SEQ ID NO: 93661 - protein, 378 aa, Lactobacillus plantarum WCFS1; identical to SEQ ID NO: 37137

SEQ ID NO: 93662 - DNA, 1146 bp, Pseudomonas syringae pv. tomato str. DC3000; identical to SEQ ID NO: 37138
  CDS (1)..(1146): transl_table=11

SEQ ID NO: 93663 - protein, 381 aa, Pseudomonas syringae pv. tomato str. DC3000; identical to SEQ ID NO: 37139

SEQ ID NO: 93664 - DNA, 1137 bp, Streptomyces avermitilis MA-4680; identical to SEQ ID NO: 37140
  CDS (1)..(1137)

SEQ ID NO: 93665 - protein, 378 aa, Streptomyces avermitilis MA-4680; identical to SEQ ID NO: 37141

SEQ ID NO: 93666 - DNA, 1098 bp, Bacillus cereus ATCC 14579; identical to SEQ ID NO: 37142
  CDS (1)..(1098): transl_table=11

SEQ ID NO: 93667 - protein, 365 aa, Bacillus cereus ATCC 14579; identical to SEQ ID NO: 37143

SEQ ID NO: 93668 - DNA, 1089 bp, Bordetella pertussis Tohama I; identical to SEQ ID NO: 37144
  CDS (1)..(1089): transl_table=11

SEQ ID NO: 93669 - protein, 362 aa, Bordetella pertussis Tohama I; identical to SEQ ID NO: 37145

SEQ ID NO: 93670 - DNA, 1248 bp, Prochlorococcus marinus str. MIT 9313; identical to SEQ ID NO: 37146
  CDS (1)..(1248): transl_table=11

SEQ ID NO: 93671 - protein, 415 aa, Prochlorococcus marinus str. MIT 9313; identical to SEQ ID NO: 37147

SEQ ID NO: 93672 - DNA, 1119 bp, Chromobacterium violaceum ATCC 12472; identical to SEQ ID NO: 37148
  CDS (1)..(1119): transl_table=11

SEQ ID NO: 93673 - protein, 372 aa, Chromobacterium violaceum ATCC 12472; identical to SEQ ID NO: 37149

SEQ ID NO: 93674 - DNA, 1113 bp, Chromobacterium violaceum ATCC 12472; identical to SEQ ID NO: 37150
  CDS (1)..(1113): transl_table=11

SEQ ID NO: 93675 - protein, 370 aa, Chromobacterium violaceum ATCC 12472; identical to SEQ ID NO: 37151

SEQ ID NO: 93676 - DNA, 1089 bp, Gloeobacter violaceus PCC 7421; identical to SEQ ID NO: 37152
  CDS (1)..(1089): transl_table=11

SEQ ID NO: 93677 - protein, 362 aa, Gloeobacter violaceus PCC 7421; identical to SEQ ID NO: 37153

SEQ ID NO: 93678 - DNA, 1098 bp, Vibrio vulnificus YJ016; identical to SEQ ID NO: 37154
  CDS (1)..(1098): transl_table=11

SEQ ID NO: 93679 - protein, 365 aa, Vibrio vulnificus YJ016; identical to SEQ ID NO: 37155

SEQ ID NO: 93680 - DNA, 1137 bp, Corynebacterium diphtheriae NCTC 13129; identical to SEQ ID NO: 37156
  CDS (1)..(1137): transl_table=11

SEQ ID NO: 93681 - protein, 378 aa, Corynebacterium diphtheriae NCTC 13129; identical to SEQ ID NO: 37157

SEQ ID NO: 93682 - DNA, 1092 bp, Rhodopseudomonas palustris CGA009; identical to SEQ ID NO: 37158
  CDS (1)..(1092): transl_table=11

SEQ ID NO: 93683 - protein, 363 aa, Rhodopseudomonas palustris CGA009; identical to SEQ ID NO: 37159

SEQ ID NO: 93684 - DNA, 1065 bp, Rhodopseudomonas palustris CGA009; identical to SEQ ID NO: 37160
  CDS (1)..(1065): transl_table=11

SEQ ID NO: 93685 - protein, 354 aa, Rhodopseudomonas palustris CGA009; identical to SEQ ID NO: 37161

SEQ ID NO: 93686 - DNA, 1071 bp, Mycobacterium avium subsp. paratuberculosis str. k10; identical to SEQ ID NO: 37162
  CDS (1)..(1071): transl_table=11

SEQ ID NO: 93687 - protein, 356 aa, Mycobacterium avium subsp. paratuberculosis str. k10; identical to SEQ ID NO: 37163

SEQ ID NO: 93688 - DNA, 1179 bp, Mycobacterium avium subsp. paratuberculosis str. k10; identical to SEQ ID NO: 37164
  CDS (1)..(1179): transl_table=11

SEQ ID NO: 93689 - protein, 392 aa, Mycobacterium avium subsp. paratuberculosis str. k10; identical to SEQ ID NO: 37165

SEQ ID NO: 93690 - DNA, 1104 bp, Lactobacillus johnsonii NCC 533; identical to SEQ ID NO: 37166
  CDS (1)..(1104): transl_table=11

SEQ ID NO: 93691 - protein, 367 aa, Lactobacillus johnsonii NCC 533; identical to SEQ ID NO: 37167

SEQ ID NO: 93692 - DNA, 1044 bp, Bdellovibrio bacteriovorus HD100; identical to SEQ ID NO: 37168
  CDS (1)..(1044): transl_table=11

SEQ ID NO: 93693 - protein, 347 aa, Bdellovibrio bacteriovorus HD100; identical to SEQ ID NO: 37169

SEQ ID NO: 93694 - DNA, 1131 bp, Bacillus cereus ATCC 10987; identical to SEQ ID NO: 37170
  CDS (1)..(1131): transl_table=11

SEQ ID NO: 93695 - protein, 376 aa, Bacillus cereus ATCC 10987; identical to SEQ ID NO: 37171

SEQ ID NO: 93696 - DNA, 1131 bp, Thermus thermophilus HB27; identical to SEQ ID NO: 37172
  CDS (1)..(1131): transl_table=11

SEQ ID NO: 93697 - protein, 376 aa, Thermus thermophilus HB27; identical to SEQ ID NO: 37173

SEQ ID NO: 93698 - DNA, 1047 bp, Thermus thermophilus HB27; identical to SEQ ID NO: 37174
  CDS (1)..(1047): transl_table=11

SEQ ID NO: 93699 - protein, 348 aa, Thermus thermophilus HB27; identical to SEQ ID NO: 37175

SEQ ID NO: 93700 - DNA, 1089 bp, Mycoplasma mobile 163K; identical to SEQ ID NO: 37176
  CDS (1)..(1089): transl_table=4

SEQ ID NO: 93701 - protein, 362 aa, Mycoplasma mobile 163K; identical to SEQ ID NO: 37177

SEQ ID NO: 93702 - DNA, 1074 bp, Picrophilus torridus DSM 9790; identical to SEQ ID NO: 37178
  CDS (1)..(1074): transl_table=11

SEQ ID NO: 93703 - protein, 357 aa, Picrophilus torridus DSM 9790; identical to SEQ ID NO: 37179

SEQ ID NO: 93704 - DNA, 1047 bp, Bartonella henselae str. Houston-1; identical to SEQ ID NO: 37180
  CDS (1)..(1047): transl_table=11

SEQ ID NO: 93705 - protein, 348 aa, Bartonella henselae str. Houston-1; identical to SEQ ID NO: 37181

SEQ ID NO: 93706 - DNA, 1131 bp, Bacillus thuringiensis serovar konkukian str. 97-27; identical to SEQ ID NO: 37182
  CDS (1)..(1131): transl_table=11

SEQ ID NO: 93707 - protein, 376 aa, Bacillus thuringiensis serovar konkukian str. 97-27; identical to SEQ ID NO: 37183

SEQ ID NO: 93708 - DNA, 1089 bp, Erwinia carotovora subsp. atroseptica SCRI1043; identical to SEQ ID NO: 37184
  CDS (1)..(1089)

SEQ ID NO: 93709 - protein, 362 aa, Erwinia carotovora subsp. atroseptica SCRI1043; identical to SEQ ID NO: 37185

SEQ ID NO: 93710 - DNA, 1086 bp, Erwinia carotovora subsp. atroseptica SCRI1043; identical to SEQ ID NO: 37186
  CDS (1)..(1086)

SEQ ID NO: 93711 - protein, 361 aa, Erwinia carotovora subsp. atroseptica SCRI1043; identical to SEQ ID NO: 37187

SEQ ID NO: 93712 - DNA, 1128 bp, Erwinia carotovora subsp. atroseptica SCRI1043; identical to SEQ ID NO: 37188
  CDS (1)..(1128)

SEQ ID NO: 93713 - protein, 375 aa, Erwinia carotovora subsp. atroseptica SCRI1043; identical to SEQ ID NO: 37189

SEQ ID NO: 93714 - DNA, 1083 bp, Erwinia carotovora subsp. atroseptica SCRI1043; identical to SEQ ID NO: 37190
  CDS (1)..(1083)

SEQ ID NO: 93715 - protein, 360 aa, Erwinia carotovora subsp. atroseptica SCRI1043; identical to SEQ ID NO: 37191

SEQ ID NO: 93716 - DNA, 1092 bp, Erwinia carotovora subsp. atroseptica SCRI1043; identical to SEQ ID NO: 37192
  CDS (1)..(1092)

SEQ ID NO: 93717 - protein, 363 aa, Erwinia carotovora subsp. atroseptica SCRI1043; identical to SEQ ID NO: 37193

SEQ ID NO: 93718 - DNA, 1074 bp, Erwinia carotovora subsp. atroseptica SCRI1043; identical to SEQ ID NO: 37194
  CDS (1)..(1074)

SEQ ID NO: 93719 - protein, 357 aa, Erwinia carotovora subsp. atroseptica SCRI1043; identical to SEQ ID NO: 37195

SEQ ID NO: 93720 - DNA, 1320 bp, Propionibacterium acnes KPA171202; identical to SEQ ID NO: 37196
  CDS (1)..(1320): transl_table=11

SEQ ID NO: 93721 - protein, 439 aa, Propionibacterium acnes KPA171202; identical to SEQ ID NO: 37197

SEQ ID NO: 93722 - DNA, 1095 bp, Leifsonia xyli subsp. xyli str. CTCB07; identical to SEQ ID NO: 37198
  CDS (1)..(1095): transl_table=11

SEQ ID NO: 93723 - protein, 364 aa, Leifsonia xyli subsp. xyli str. CTCB07; identical to SEQ ID NO: 37199

SEQ ID NO: 93724 - DNA, 1095 bp, Symbiobacterium thermophilum IAM 14863; identical to SEQ ID NO: 37200
  CDS (1)..(1095): transl_table=11

SEQ ID NO: 93725 - protein, 364 aa, Symbiobacterium thermophilum IAM 14863; identical to SEQ ID NO: 37201

SEQ ID NO: 93726 - DNA, 1119 bp, Mannheimia succiniciproducens MBEL55E; identical to SEQ ID NO: 37202
  CDS (1)..(1119): transl_table=11

SEQ ID NO: 93727 - protein, 372 aa, Mannheimia succiniciproducens MBEL55E; identical to SEQ ID NO: 37203

SEQ ID NO: 93728 - DNA, 1107 bp, Bacillus licheniformis ATCC 14580; identical to SEQ ID NO: 37204
  CDS (1)..(1107): transl_table=11

SEQ ID NO: 93729 - protein, 368 aa, Bacillus licheniformis ATCC 14580; identical to SEQ ID NO: 37205

SEQ ID NO: 93730 - DNA, 1119 bp, Burkholderia mallei ATCC 23344; identical to SEQ ID NO: 37206
  CDS (1)..(1119): transl_table=11

SEQ ID NO: 93731 - protein, 372 aa, Burkholderia mallei ATCC 23344; identical to SEQ ID NO: 37207

SEQ ID NO: 93732 - DNA, 1071 bp, Methylococcus capsulatus str. Bath; identical to SEQ ID NO: 37208
  CDS (1)..(1071): transl_table=11

SEQ ID NO: 93733 - protein, 356 aa, Methylococcus capsulatus str. Bath; identical to SEQ ID NO: 37209

SEQ ID NO: 93734 - DNA, 1068 bp, Nocardia farcinica IFM 10152; identical to SEQ ID NO: 37210
  CDS (1)..(1068): transl_table=11

SEQ ID NO: 93735 - protein, 355 aa, Nocardia farcinica IFM 10152; identical to SEQ ID NO: 37211

SEQ ID NO: 93736 - DNA, 1143 bp, Photobacterium profundum SS9; identical to SEQ ID NO: 37212
  CDS (1)..(1143): transl_table=11

SEQ ID NO: 93737 - protein, 380 aa, Photobacterium profundum SS9; identical to SEQ ID NO: 37213

SEQ ID NO: 93738 - DNA, 1137 bp, Photobacterium profundum SS9; identical to SEQ ID NO: 37214
  CDS (1)..(1137): transl_table=11

SEQ ID NO: 93739 - protein, 378 aa, Photobacterium profundum SS9; identical to SEQ ID NO: 37215

SEQ ID NO: 93740 - DNA, 1161 bp, Haloarcula marismortui ATCC 43049; identical to SEQ ID NO: 37216
  CDS (1)..(1161): transl_table=11

SEQ ID NO: 93741 - protein, 386 aa, Haloarcula marismortui ATCC 43049; identical to SEQ ID NO: 37217

SEQ ID NO: 93742 - DNA, 1128 bp, Haloarcula marismortui ATCC 43049; identical to SEQ ID NO: 37218
  CDS (1)..(1128): transl_table=11

SEQ ID NO: 93743 - protein, 375 aa, Haloarcula marismortui ATCC 43049; identical to SEQ ID NO: 37219

SEQ ID NO: 93744 - DNA, 1197 bp, Haloarcula marismortui ATCC 43049; identical to SEQ ID NO: 37220
  CDS (1)..(1197): transl_table=11

SEQ ID NO: 93745 - protein, 398 aa, Haloarcula marismortui ATCC 43049; identical to SEQ ID NO: 37221

SEQ ID NO: 93746 - DNA, 1131 bp, Haloarcula marismortui ATCC 43049; identical to SEQ ID NO: 37222
  CDS (1)..(1131): transl_table=11

SEQ ID NO: 93747 - protein, 376 aa, Haloarcula marismortui ATCC 43049; identical to SEQ ID NO: 37223

SEQ ID NO: 93748 - DNA, 1113 bp, Geobacillus kaustophilus HTA426; identical to SEQ ID NO: 37224
  CDS (1)..(1113): transl_table=11

SEQ ID NO: 93749 - protein, 370 aa, Geobacillus kaustophilus HTA426; identical to SEQ ID NO: 37225

SEQ ID NO: 93750 - DNA, 1002 bp, Silicibacter pomeroyi DSS-3; identical to SEQ ID NO: 37226
  CDS (1)..(1002): transl_table=11

SEQ ID NO: 93751 - protein, 333 aa, Silicibacter pomeroyi DSS-3; identical to SEQ ID NO: 37227

SEQ ID NO: 93752 - DNA, 1305 bp, Synechococcus elongatus PCC 6301; identical to SEQ ID NO: 37228
  CDS (1)..(1305): transl_table=11

SEQ ID NO: 93753 - protein, 434 aa, Synechococcus elongatus PCC 6301; identical to SEQ ID NO: 37229

SEQ ID NO: 93754 - DNA, 1113 bp, Bacillus clausii KSM-K16; identical to SEQ ID NO: 37230
  CDS (1)..(1113): transl_table=11

SEQ ID NO: 93755 - protein, 370 aa, Bacillus clausii KSM-K16; identical to SEQ ID NO: 37231

SEQ ID NO: 93756 - DNA, 1110 bp, Rhodobacter sphaeroides 2.4.1; identical to SEQ ID NO: 37232
  CDS (1)..(1110)

SEQ ID NO: 93757 - protein, 369 aa, Rhodobacter sphaeroides 2.4.1; identical to SEQ ID NO: 37233

SEQ ID NO: 93758 - DNA, 1026 bp, Rhodobacter sphaeroides 2.4.1; identical to SEQ ID NO: 37234
  CDS (1)..(1026)

SEQ ID NO: 93759 - protein, 341 aa, Rhodobacter sphaeroides 2.4.1; identical to SEQ ID NO: 37235

SEQ ID NO: 93760 - DNA, 999 bp, Rhodobacter sphaeroides 2.4.1; identical to SEQ ID NO: 37236
  CDS (1)..(999)

SEQ ID NO: 93761 - protein, 332 aa, Rhodobacter sphaeroides 2.4.1; identical to SEQ ID NO: 37237

SEQ ID NO: 93762 - DNA, 1080 bp, Rhodobacter sphaeroides 2.4.1; identical to SEQ ID NO: 37238
  CDS (1)..(1080)

SEQ ID NO: 93763 - protein, 359 aa, Rhodobacter sphaeroides 2.4.1; identical to SEQ ID NO: 37239

SEQ ID NO: 93764 - DNA, 1122 bp, Rhodobacter sphaeroides 2.4.1; identical to SEQ ID NO: 37240
  CDS (1)..(1122)

SEQ ID NO: 93765 - protein, 373 aa, Rhodobacter sphaeroides 2.4.1; identical to SEQ ID NO: 37241

SEQ ID NO: 93766 - DNA, 1185 bp, Xylella fastidiosa Dixon; identical to SEQ ID NO: 37242
  CDS (1)..(1185)

SEQ ID NO: 93767 - protein, 394 aa, Xylella fastidiosa Dixon; identical to SEQ ID NO: 37243

SEQ ID NO: 93768 - DNA, 1185 bp, Xylella fastidiosa Ann-1; identical to SEQ ID NO: 37244
  CDS (1)..(1185)

SEQ ID NO: 93769 - protein, 394 aa, Xylella fastidiosa Ann-1; identical to SEQ ID NO: 37245

SEQ ID NO: 93770 - DNA, 1104 bp, Lactobacillus gasseri; identical to SEQ ID NO: 37246
  CDS (1)..(1104)

SEQ ID NO: 93771 - protein, 367 aa, Lactobacillus gasseri; identical to SEQ ID NO: 37247

SEQ ID NO: 93772 - DNA, 1110 bp, Azotobacter vinelandii; identical to SEQ ID NO: 37248
  CDS (1)..(1110)

SEQ ID NO: 93773 - protein, 369 aa, Azotobacter vinelandii; identical to SEQ ID NO: 37249

SEQ ID NO: 93774 - DNA, 1122 bp, Desulfitobacterium hafniense DCB-2; identical to SEQ ID NO: 37250
  CDS (1)..(1122)

SEQ ID NO: 93775 - protein, 373 aa, Desulfitobacterium hafniense DCB-2; identical to SEQ ID NO: 37251

SEQ ID NO: 93776 - DNA, 1104 bp, Desulfitobacterium hafniense DCB-2; identical to SEQ ID NO: 37252
  CDS (1)..(1104)

SEQ ID NO: 93777 - protein, 367 aa, Desulfitobacterium hafniense DCB-2; identical to SEQ ID NO: 37253

SEQ ID NO: 93778 - DNA, 1179 bp, Desulfitobacterium hafniense DCB-2; identical to SEQ ID NO: 37254
  CDS (1)..(1179)

SEQ ID NO: 93779 - protein, 392 aa, Desulfitobacterium hafniense DCB-2; identical to SEQ ID NO: 37255

SEQ ID NO: 93780 - DNA, 1134 bp, Nostoc punctiforme PCC 73102; identical to SEQ ID NO: 37256
  CDS (1)..(1134)

SEQ ID NO: 93781 - protein, 377 aa, Nostoc punctiforme PCC 73102; identical to SEQ ID NO: 37257

SEQ ID NO: 93782 - DNA, 1359 bp, Nostoc punctiforme PCC 73102; identical to SEQ ID NO: 37258
  CDS (1)..(1359)

SEQ ID NO: 93783 - protein, 452 aa, Nostoc punctiforme PCC 73102; identical to SEQ ID NO: 37259

SEQ ID NO: 93784 - DNA, 1128 bp, Bifidobacterium longum DJO10A; identical to SEQ ID NO: 37260
  CDS (1)..(1128)

SEQ ID NO: 93785 - protein, 375 aa, Bifidobacterium longum DJO10A; identical to SEQ ID NO: 37261

SEQ ID NO: 93786 - DNA, 1137 bp, Actinobacillus pleuropneumoniae serovar 1 str. 4074; identical to SEQ ID NO: 37262
  CDS (1)..(1137)

SEQ ID NO: 93787 - protein, 378 aa, Actinobacillus pleuropneumoniae serovar 1 str. 4074; identical to SEQ ID NO: 37263

SEQ ID NO: 93788 - DNA, 1113 bp, Pseudomonas aeruginosa UCBPP-PA14; identical to SEQ ID NO: 37264
  CDS (1)..(1113)

SEQ ID NO: 93789 - protein, 370 aa, Pseudomonas aeruginosa UCBPP-PA14; identical to SEQ ID NO: 37265

SEQ ID NO: 93790 - DNA, 1101 bp, Anabaena variabilis ATCC 29413; identical to SEQ ID NO: 37266
  CDS (1)..(1101)

SEQ ID NO: 93791 - protein, 366 aa, Anabaena variabilis ATCC 29413; identical to SEQ ID NO: 37267

SEQ ID NO: 93792 - DNA, 1254 bp, Synechococcus elongatus PCC 7942; identical to SEQ ID NO: 37268
  CDS (1)..(1254)

SEQ ID NO: 93793 - protein, 417 aa, Synechococcus elongatus PCC 7942; identical to SEQ ID NO: 37269

SEQ ID NO: 93794 - DNA, 1110 bp, Ralstonia eutropha JMP134; identical to SEQ ID NO: 37270
  CDS (1)..(1110)

SEQ ID NO: 93795 - protein, 369 aa, Ralstonia eutropha JMP134; identical to SEQ ID NO: 37271

SEQ ID NO: 93796 - DNA, 1140 bp, Methylobacillus flagellatus KT; identical to SEQ ID NO: 37272
  CDS (1)..(1140)

SEQ ID NO: 93797 - protein, 379 aa, Methylobacillus flagellatus KT; identical to SEQ ID NO: 37273

SEQ ID NO: 93798 - DNA, 1098 bp, Crocosphaera watsonii WH 8501; identical to SEQ ID NO: 37274
  CDS (1)..(1098)

SEQ ID NO: 93799 - protein, 365 aa, Crocosphaera watsonii WH 8501; identical to SEQ ID NO: 37275

SEQ ID NO: 93800 - DNA, 1230 bp, Rubrobacter xylanophilus DSM 9941; identical to SEQ ID NO: 37276
  CDS (1)..(1230)

SEQ ID NO: 93801 - protein, 409 aa, Rubrobacter xylanophilus DSM 9941; identical to SEQ ID NO: 37277

SEQ ID NO: 93802 - DNA, 1086 bp, Rubrobacter xylanophilus DSM 9941; identical to SEQ ID NO: 37278
  CDS (1)..(1086)

SEQ ID NO: 93803 - protein, 361 aa, Rubrobacter xylanophilus DSM 9941; identical to SEQ ID NO: 37279

SEQ ID NO: 93804 - DNA, 1056 bp, Mesorhizobium sp. BNC1; identical to SEQ ID NO: 37280
  CDS (1)..(1056)

SEQ ID NO: 93805 - protein, 351 aa, Mesorhizobium sp. BNC1; identical to SEQ ID NO: 37281

SEQ ID NO: 93806 - DNA, 1143 bp, Pseudomonas syringae pv. syringae B728a; identical to SEQ ID NO: 37282
  CDS (1)..(1143)

SEQ ID NO: 93807 - protein, 380 aa, Pseudomonas syringae pv. syringae B728a; identical to SEQ ID NO: 37283

SEQ ID NO: 93808 - DNA, 1059 bp, Rhodobacter sphaeroides 2.4.1; identical to SEQ ID NO: 37284
  CDS (1)..(1059)

SEQ ID NO: 93809 - protein, 352 aa, Rhodobacter sphaeroides 2.4.1; identical to SEQ ID NO: 37285

SEQ ID NO: 93810 - DNA, 1101 bp, Bacillus cereus G9241; identical to SEQ ID NO: 37286
  CDS (1)..(1101): transl_table=11

SEQ ID NO: 93811 - protein, 366 aa, Bacillus cereus G9241; identical to SEQ ID NO: 37287

SEQ ID NO: 93812 - DNA, 1161 bp, Pseudomonas fluorescens PfO-1; identical to SEQ ID NO: 37288
  CDS (1)..(1161)

SEQ ID NO: 93813 - protein, 386 aa, Pseudomonas fluorescens PfO-1; identical to SEQ ID NO: 37289

SEQ ID NO: 93814 - DNA, 1119 bp, Rhodospirillum rubrum; identical to SEQ ID NO: 37290
  CDS (1)..(1119)

SEQ ID NO: 93815 - protein, 372 aa, Rhodospirillum rubrum; identical to SEQ ID NO: 37291

SEQ ID NO: 93816 - DNA, 1110 bp, Burkholderia fungorum LB400; identical to SEQ ID NO: 37292
  CDS (1)..(1110)

SEQ ID NO: 93817 - protein, 369 aa, Burkholderia fungorum LB400; identical to SEQ ID NO: 37293

SEQ ID NO: 93818 - DNA, 1110 bp, Enterococcus faecium; identical to SEQ ID NO: 37294
  CDS (1)..(1110)

SEQ ID NO: 93819 - protein, 369 aa, Enterococcus faecium; identical to SEQ ID NO: 37295

SEQ ID NO: 93820 - DNA, 1233 bp, Thermobifida fusca; identical to SEQ ID NO: 37296
  CDS (1)..(1233)

SEQ ID NO: 93821 - protein, 410 aa, Thermobifida fusca; identical to SEQ ID NO: 37297

SEQ ID NO: 93822 - DNA, 1113 bp, Clostridium thermocellum ATCC 27405; identical to SEQ ID NO: 37298
  CDS (1)..(1113)

SEQ ID NO: 93823 - protein, 370 aa, Clostridium thermocellum ATCC 27405; identical to SEQ ID NO: 37299

SEQ ID NO: 93824 - DNA, 1209 bp, Oenococcus oeni PSU-1; identical to SEQ ID NO: 37300
  CDS (1)..(1209)

SEQ ID NO: 93825 - protein, 402 aa, Oenococcus oeni PSU-1; identical to SEQ ID NO: 37301

SEQ ID NO: 93826 - DNA, 1122 bp, Oenococcus oeni PSU-1; identical to SEQ ID NO: 37302
  CDS (1)..(1122)

SEQ ID NO: 93827 - protein, 373 aa, Oenococcus oeni PSU-1; identical to SEQ ID NO: 37303

SEQ ID NO: 93828 - DNA, 1140 bp, Moorella thermoacetica ATCC 39073; identical to SEQ ID NO: 37304
  CDS (1)..(1140)

SEQ ID NO: 93829 - protein, 379 aa, Moorella thermoacetica ATCC 39073; identical to SEQ ID NO: 37305

SEQ ID NO: 93830 - DNA, 1059 bp, Silicibacter sp. TM1040; identical to SEQ ID NO: 37306
  CDS (1)..(1059)

SEQ ID NO: 93831 - protein, 352 aa, Silicibacter sp. TM1040; identical to SEQ ID NO: 37307

SEQ ID NO: 93832 - DNA, 1098 bp, Silicibacter sp. TM1040; identical to SEQ ID NO: 37308
  CDS (1)..(1098)

SEQ ID NO: 93833 - protein, 365 aa, Silicibacter sp. TM1040; identical to SEQ ID NO: 37309

SEQ ID NO: 93834 - DNA, 1095 bp, Silicibacter sp. TM1040; identical to SEQ ID NO: 37310
  CDS (1)..(1095)

SEQ ID NO: 93835 - protein, 364 aa, Silicibacter sp. TM1040; identical to SEQ ID NO: 37311

SEQ ID NO: 93836 - DNA, 1005 bp, Silicibacter sp. TM1040; identical to SEQ ID NO: 37312
  CDS (1)..(1005)

SEQ ID NO: 93837 - protein, 334 aa, Silicibacter sp. TM1040; identical to SEQ ID NO: 37313

SEQ ID NO: 93838 - DNA, 1101 bp, Desulfovibrio desulfuricans G20; identical to SEQ ID NO: 37314
  CDS (1)..(1101)

SEQ ID NO: 93839 - protein, 366 aa, Desulfovibrio desulfuricans G20; identical to SEQ ID NO: 37315

SEQ ID NO: 93840 - DNA, 1107 bp, Chloroflexus aurantiacus; identical to SEQ ID NO: 37316
  CDS (1)..(1107)

SEQ ID NO: 93841 - protein, 368 aa, Chloroflexus aurantiacus; identical to SEQ ID NO: 37317

SEQ ID NO: 93842 - DNA, 1071 bp, Polaromonas sp. JS666; identical to SEQ ID NO: 37318
  CDS (1)..(1071)

SEQ ID NO: 93843 - protein, 356 aa, Polaromonas sp. JS666; identical to SEQ ID NO: 37319

SEQ ID NO: 93844 - DNA, 1032 bp, Polaromonas sp. JS666; identical to SEQ ID NO: 37320
  CDS (1)..(1032)

SEQ ID NO: 93845 - protein, 343 aa, Polaromonas sp. JS666; identical to SEQ ID NO: 37321

SEQ ID NO: 93846 - DNA, 1074 bp, Polaromonas sp. JS666; identical to SEQ ID NO: 37322
  CDS (1)..(1074)

SEQ ID NO: 93847 - protein, 357 aa, Polaromonas sp. JS666; identical to SEQ ID NO: 37323

SEQ ID NO: 93848 - DNA, 1023 bp, Polaromonas sp. JS666; identical to SEQ ID NO: 37324
  CDS (1)..(1023)

SEQ ID NO: 93849 - protein, 340 aa, Polaromonas sp. JS666; identical to SEQ ID NO: 37325

SEQ ID NO: 93850 - DNA, 1104 bp, Pseudomonas fluorescens; identical to SEQ ID NO: 37326
  CDS (1)..(1104): transl_table=11

SEQ ID NO: 93851 - protein, 367 aa, Pseudomonas fluorescens; identical to SEQ ID NO: 37327

SEQ ID NO: 93852 - DNA, 999 bp, Rhodobacter capsulatus; identical to SEQ ID NO: 37328
  CDS (1)..(999): transl_table=11

SEQ ID NO: 93853 - protein, 332 aa, Rhodobacter capsulatus; identical to SEQ ID NO: 37329

SEQ ID NO: 93854 - DNA, 1101 bp, Bacillus firmus; identical to SEQ ID NO: 37330
  CDS (1)..(1101): transl_table=11

SEQ ID NO: 93855 - protein, 366 aa, Bacillus firmus; identical to SEQ ID NO: 37331

SEQ ID NO: 93856 - DNA, 1134 bp, Streptomyces reticuli; identical to SEQ ID NO: 37332
  CDS (1)..(1134): transl_table=11

SEQ ID NO: 93857 - protein, 377 aa, Streptomyces reticuli; identical to SEQ ID NO: 37333

SEQ ID NO: 93858 - DNA, 1131 bp, Klebsiella oxytoca; identical to SEQ ID NO: 37334
  CDS (1)..(1131): transl_table=11

SEQ ID NO: 93859 - protein, 376 aa, Klebsiella oxytoca; identical to SEQ ID NO: 37335

SEQ ID NO: 93860 - DNA, 1167 bp, Rhizobium leguminosarum; identical to SEQ ID NO: 37336
  CDS (1)..(1167): transl_table=11

SEQ ID NO: 93861 - protein, 388 aa, Rhizobium leguminosarum; identical to SEQ ID NO: 37337

SEQ ID NO: 93862 - DNA, 945 bp, Streptomyces lividans; identical to SEQ ID NO: 37338
  CDS (1)..(945): transl_table=11

SEQ ID NO: 93863 - protein, 314 aa, Streptomyces lividans; identical to SEQ ID NO: 37339

SEQ ID NO: 93864 - DNA, 1110 bp, uncultured bacterium 582; identical to SEQ ID NO: 37340
  CDS (1)..(1110): transl_table=11

SEQ ID NO: 93865 - protein, 369 aa, uncultured bacterium 582; identical to SEQ ID NO: 37341

SEQ ID NO: 93866 - DNA, 1080 bp, Rhizobium sp; identical to SEQ ID NO: 37342
  CDS (1)..(1080): transl_table=11

SEQ ID NO: 93867 - protein, 359 aa, Rhizobium sp; identical to SEQ ID NO: 37343

SEQ ID NO: 93868 - DNA, 1155 bp, Alicyclobacillus acidocaldarius; identical to SEQ ID NO: 37344
  CDS (1)..(1155): transl_table=11

SEQ ID NO: 93869 - protein, 384 aa, Alicyclobacillus acidocaldarius; identical to SEQ ID NO: 37345

SEQ ID NO: 93870 - DNA, 1113 bp, Lactobacillus acidophilus; identical to SEQ ID NO: 37346
  CDS (1)..(1113): transl_table=11

SEQ ID NO: 93871 - protein, 370 aa, Lactobacillus acidophilus; identical to SEQ ID NO: 37347

SEQ ID NO: 93872 - DNA, 1107 bp, Lactobacillus acidophilus; identical to SEQ ID NO: 37348
  CDS (1)..(1107): transl_table=11

SEQ ID NO: 93873 - protein, 368 aa, Lactobacillus acidophilus; identical to SEQ ID NO: 37349

SEQ ID NO: 93874 - DNA, 1128 bp, Erwinia chrysanthemi; identical to SEQ ID NO: 37350
  CDS (1)..(1128): transl_table=11

SEQ ID NO: 93875 - protein, 375 aa, Erwinia chrysanthemi; identical to SEQ ID NO: 37351

SEQ ID NO: 93876 - DNA, 1062 bp, Thermoplasma volcanium; identical to SEQ ID NO: 37352
  CDS (1)..(1062)

SEQ ID NO: 93877 - protein, 353 aa, Thermoplasma volcanium; identical to SEQ ID NO: 37353

SEQ ID NO: 93878 - DNA, 1110 bp, Erwinia rhapontici; identical to SEQ ID NO: 37354
  CDS (1)..(1110): transl_table=11

SEQ ID NO: 93879 - protein, 369 aa, Erwinia rhapontici; identical to SEQ ID NO: 37355

SEQ ID NO: 93880 - DNA, 1092 bp, Sphingomonas sp; identical to SEQ ID NO: 37356
  CDS (1)..(1092): transl_table=11

SEQ ID NO: 93881 - protein, 363 aa, Sphingomonas sp; identical to SEQ ID NO: 37357

SEQ ID NO: 93882 - DNA, 1110 bp, Clostridium perfringens; identical to SEQ ID NO: 37358
  CDS (1)..(1110): transl_table=11

SEQ ID NO: 93883 - protein, 369 aa, Clostridium perfringens; identical to SEQ ID NO: 37359

SEQ ID NO: 93884 - DNA, 1116 bp, Thermoanaerobacter ethanolicus; identical to SEQ ID NO: 37360
  CDS (1)..(1116): transl_table=11

SEQ ID NO: 93885 - protein, 371 aa, Thermoanaerobacter ethanolicus; identical to SEQ ID NO: 37361

SEQ ID NO: 93886 - DNA, 1119 bp, Thermococcus litoralis; identical to SEQ ID NO: 37362
  CDS (1)..(1119): transl_table=11

SEQ ID NO: 93887 - protein, 372 aa, Thermococcus litoralis; identical to SEQ ID NO: 37363

SEQ ID NO: 93888 - DNA, 1119 bp, Thermococcus litoralis; identical to SEQ ID NO: 37364
  CDS (1)..(1119): transl_table=11

SEQ ID NO: 93889 - protein, 372 aa, Thermococcus litoralis; identical to SEQ ID NO: 37365

SEQ ID NO: 93890 - DNA, 1089 bp, Rhizobium meliloti; identical to SEQ ID NO: 37366
  CDS (1)..(1089): transl_table=11

SEQ ID NO: 93891 - protein, 362 aa, Rhizobium meliloti; identical to SEQ ID NO: 37367

SEQ ID NO: 93892 - DNA, 1116 bp, Shigella flexneri; identical to SEQ ID NO: 37368
  CDS (1)..(1116): transl_table=11

SEQ ID NO: 93893 - protein, 371 aa, Shigella flexneri; identical to SEQ ID NO: 37369

SEQ ID NO: 93894 - DNA, 1122 bp, Vibrio cholerae; identical to SEQ ID NO: 37370
  CDS (1)..(1122): transl_table=11

SEQ ID NO: 93895 - protein, 373 aa, Vibrio cholerae; identical to SEQ ID NO: 37371

SEQ ID NO: 93896 - DNA, 1098 bp, Bacillus subtilis; identical to SEQ ID NO: 37372
  CDS (1)..(1098): transl_table=11

SEQ ID NO: 93897 - protein, 365 aa, Bacillus subtilis; identical to SEQ ID NO: 37373

SEQ ID NO: 93898 - DNA, 999 bp, Rhodobacter sphaeroides; identical to SEQ ID NO: 37374
  CDS (1)..(999): transl_table=11

SEQ ID NO: 93899 - protein, 332 aa, Rhodobacter sphaeroides; identical to SEQ ID NO: 37375

SEQ ID NO: 93900 - DNA, 1071 bp, Escherichia coli; identical to SEQ ID NO: 37376
  CDS (1)..(1071): transl_table=11

SEQ ID NO: 93901 - protein, 356 aa, Escherichia coli; identical to SEQ ID NO: 37377

SEQ ID NO: 93902 - DNA, 22 bp, Primer
atggctcagctttcgttacaac

SEQ ID NO: 93903 - DNA, 22 bp, Primer
ttaactcgtgcccccaaccgtg

SEQ ID NO: 93904 - protein, 522 aa, consensus; identical to SEQ ID NO: 37380
  MISC_FEATURE (1)..(522): consensus for the disclosure of xaa see table XV

SEQ ID NO: 93905 - protein, 88 aa, consensus; identical to SEQ ID NO: 37381
  MISC_FEATURE (1)..(88): consensus for the disclosure of xaa see table XV

SEQ ID NO: 93906 - protein, 142 aa, consensus; identical to SEQ ID NO: 37382
  MISC_FEATURE (1)..(142): consensus for the disclosure of xaa see table XV

SEQ ID NO: 93907 - DNA, 846 bp, Escherichia coli; identical to SEQ ID NO: 52293
  CDS (1)..(846)

SEQ ID NO: 93908 - protein, 281 aa, Escherichia coli; identical to SEQ ID NO: 52294

SEQ ID NO: 93909 - DNA, 873 bp, Danio rerio; identical to SEQ ID NO: 52295
  CDS (1)..(873)

SEQ ID NO: 93910 - protein, 290 aa, Danio rerio; identical to SEQ ID NO: 52296

SEQ ID NO: 93911 - DNA, 792 bp, Staphylococcus epidermidis RP62A; identical to SEQ ID NO: 52297
  CDS (7)..(792)

SEQ ID NO: 93912 - protein, 261 aa, Staphylococcus epidermidis RP62A; identical to SEQ ID NO: 52298

SEQ ID NO: 93913 - DNA, 837 bp, Mesorhizobium loti MAFF303099; identical to SEQ ID NO: 52299
  CDS (1)..(837): transl_table=11

SEQ ID NO: 93914 - protein, 278 aa, Mesorhizobium loti MAFF303099; identical to SEQ ID NO: 52300

SEQ ID NO: 93915 - DNA, 813 bp, Mesorhizobium loti MAFF303099; identical to SEQ ID NO: 52301
  CDS (1)..(813): transl_table=11

SEQ ID NO: 93916 - protein, 270 aa, Mesorhizobium loti MAFF303099; identical to SEQ ID NO: 52302

SEQ ID NO: 93917 - DNA, 801 bp, Staphylococcus aureus subsp. aureus Mu50; identical to SEQ ID NO: 52303
  CDS (1)..(801): transl_table=11

SEQ ID NO: 93918 - protein, 266 aa, Staphylococcus aureus subsp. aureus Mu50; identical to SEQ ID NO: 52304

SEQ ID NO: 93919 - DNA, 828 bp, Caulobacter crescentus CB15; identical to SEQ ID NO: 52305
  CDS (1)..(828): transl_table=11

SEQ ID NO: 93920 - protein, 275 aa, Caulobacter crescentus CB15; identical to SEQ ID NO: 52306

SEQ ID NO: 93921 - DNA, 801 bp, Staphylococcus aureus subsp. aureus MW2; identical to SEQ ID NO: 52307
  CDS (1)..(801): transl_table=11

SEQ ID NO: 93922 - protein, 266 aa, Staphylococcus aureus subsp. aureus MW2; identical to SEQ ID NO: 52308

SEQ ID NO: 93923 - DNA, 840 bp, Bacillus anthracis str. A2012; identical to SEQ ID NO: 52309
  CDS (1)..(840): transl_table=11

SEQ ID NO: 93924 - protein, 279 aa, Bacillus anthracis str. A2012; identical to SEQ ID NO: 52310

SEQ ID NO: 93925 - DNA, 768 bp, Bacillus anthracis str. A2012; identical to SEQ ID NO: 52311
  CDS (1)..(768): r means g or a

SEQ ID NO: 93926 - protein, 255 aa, Bacillus anthracis str. A2012; identical to SEQ ID NO: 52312
  misc_feature (237)..(237): Xaa can be Glu or Gly

SEQ ID NO: 93927 - DNA, 846 bp, Escherichia coli CFT073; identical to SEQ ID NO: 52313
  CDS (1)..(846): transl_table=11

SEQ ID NO: 93928 - protein, 281 aa, Escherichia coli CFT073; identical to SEQ ID NO: 52314

SEQ ID NO: 93929 - DNA, 786 bp, Staphylococcus epidermidis ATCC 12228; identical to SEQ ID NO: 52315
  CDS (1)..(786): transl_table=11

SEQ ID NO: 93930 - protein, 261 aa, Staphylococcus epidermidis ATCC 12228; identical to SEQ ID NO: 52316

SEQ ID NO: 93931 - DNA, 807 bp, Vibrio parahaemolyticus RIMD 2210633; identical to SEQ ID NO: 52317
  CDS (1)..(807): transl_table=11

SEQ ID NO: 93932 - protein, 268 aa, Vibrio parahaemolyticus RIMD 2210633; identical to SEQ ID NO: 52318

SEQ ID NO: 93933 - DNA, 846 bp, Salmonella enterica subsp. enterica serovar Typhi Ty2; identical to SEQ ID NO: 52319
  CDS (1)..(846): transl_table=11

SEQ ID NO: 93934 - protein, 281 aa, Salmonella enterica subsp. enterica serovar Typhi Ty2; identical to SEQ ID NO: 52320

SEQ ID NO: 93935 - DNA, 840 bp, Streptomyces avermitilis MA-4680; identical to SEQ ID NO: 52321
  CDS (1)..(840)

SEQ ID NO: 93936 - protein, 279 aa, Streptomyces avermitilis MA-4680; identical to SEQ ID NO: 52322

SEQ ID NO: 93937 - DNA, 840 bp, Bacillus cereus ATCC 14579; identical to SEQ ID NO: 52323
  CDS (1)..(840): transl_table=11

SEQ ID NO: 93938 - protein, 279 aa, Bacillus cereus ATCC 14579; identical to SEQ ID NO: 52324

SEQ ID NO: 93939 - DNA, 831 bp, Mycobacterium avium subsp. paratuberculosis str. k10; identical to SEQ ID NO: 52325
  CDS (1)..(831): transl_table=11

SEQ ID NO: 93940 - protein, 276 aa, Mycobacterium avium subsp. paratuberculosis str. k10; identical to SEQ ID NO: 52326

SEQ ID NO: 93941 - DNA, 792 bp, Bacillus cereus ATCC 10987; identical to SEQ ID NO: 52327
  CDS (1)..(792): s means g or c

SEQ ID NO: 93942 - protein, 263 aa, Bacillus cereus ATCC 10987; identical to SEQ ID NO: 52328
  misc_feature (103)..(103): Xaa can be Ala or Gly

SEQ ID NO: 93943 - DNA, 933 bp, Neurospora crassa; identical to SEQ ID NO: 52329
  CDS (1)..(933)

SEQ ID NO: 93944 - protein, 310 aa, Neurospora crassa; identical to SEQ ID NO: 52330

SEQ ID NO: 93945 - DNA, 1113 bp, Magnaporthe grisea 70-15; identical to SEQ ID NO: 52331
  CDS (1)..(1113)

SEQ ID NO: 93946 - protein, 370 aa, Magnaporthe grisea 70-15; identical to SEQ ID NO: 52332

SEQ ID NO: 93947 - DNA, 963 bp, Magnaporthe grisea 70-15; identical to SEQ ID NO: 52333
  CDS (1)..(963)

SEQ ID NO: 93948 - protein, 320 aa, Magnaporthe grisea 70-15; identical to SEQ ID NO: 52334

SEQ ID NO: 93949 - DNA, 1032 bp, Gibberella zeae PH-1; identical to SEQ ID NO: 52335
  CDS (1)..(1032)

SEQ ID NO: 93950 - protein, 343 aa, Gibberella zeae PH-1; identical to SEQ ID NO: 52336

SEQ ID NO: 93951 - DNA, 960 bp, Gibberella zeae PH-1; identical to SEQ ID NO: 52337
  CDS (1)..(960)

SEQ ID NO: 93952 - protein, 319 aa, Gibberella zeae PH-1; identical to SEQ ID NO: 52338

SEQ ID NO: 93953 - DNA, 957 bp, Gibberella zeae PH-1; identical to SEQ ID NO: 52339
  CDS (1)..(957)

SEQ ID NO: 93954 - protein, 318 aa, Gibberella zeae PH-1; identical to SEQ ID NO: 52340

SEQ ID NO: 93955 - DNA, 1119 bp, Ustilago maydis 521; identical to SEQ ID NO: 52341
  CDS (1)..(1119)

SEQ ID NO: 93956 - protein, 372 aa, Ustilago maydis 521; identical to SEQ ID NO: 52342

SEQ ID NO: 93957 - DNA, 1623 bp, Aspergillus nidulans FGSC A4; identical to SEQ ID NO: 52343
  CDS (1)..(1623)

SEQ ID NO: 93958 - protein, 540 aa, Aspergillus nidulans FGSC A4; identical to SEQ ID NO: 52344

SEQ ID NO: 93959 - DNA, 873 bp, Gallus gallus; identical to SEQ ID NO: 52345
  CDS (1)..(873)

SEQ ID NO: 93960 - protein, 290 aa, Gallus gallus; identical to SEQ ID NO: 52346

SEQ ID NO: 93961 - DNA, 873 bp, Pan troglodytes; identical to SEQ ID NO: 52347
  CDS (1)..(873)

SEQ ID NO: 93962 - protein, 290 aa, Pan troglodytes; identical to SEQ ID NO: 52348

SEQ ID NO: 93963 - DNA, 840 bp, Bacillus thuringiensis serovar konkukian str. 97-27; identical to SEQ ID NO: 52349
  CDS (1)..(840): transl_table=11

SEQ ID NO: 93964 - protein, 279 aa, Bacillus thuringiensis serovar konkukian str. 97-27; identical to SEQ ID NO: 52350

SEQ ID NO: 93965 - DNA, 792 bp, Bacillus thuringiensis serovar konkukian str. 97-27; identical to SEQ ID NO: 52351
  CDS (1)..(792): transl_table=11

SEQ ID NO: 93966 - protein, 263 aa, Bacillus thuringiensis serovar konkukian str. 97-27; identical to SEQ ID NO: 52352

SEQ ID NO: 93967 - DNA, 801 bp, Staphylococcus aureus subsp. aureus MRSA252; identical to SEQ ID NO: 52353
  CDS (1)..(801): transl_table=11

SEQ ID NO: 93968 - protein, 266 aa, Staphylococcus aureus subsp. aureus MRSA252; identical to SEQ ID NO: 52354

SEQ ID NO: 93969 - DNA, 840 bp, Bacillus cereus ZK; identical to SEQ ID NO: 52355
  CDS (1)..(840): transl_table=11

SEQ ID NO: 93970 - protein, 279 aa, Bacillus cereus ZK; identical to SEQ ID NO: 52356

SEQ ID NO: 93971 - DNA, 759 bp, Bacillus licheniformis ATCC 14580; identical to SEQ ID NO: 52357
  CDS (1)..(759): transl_table=11

SEQ ID NO: 93972 - protein, 252 aa, Bacillus licheniformis ATCC 14580; identical to SEQ ID NO: 52358

SEQ ID NO: 93973 - DNA, 873 bp, Burkholderia pseudomallei K96243; identical to SEQ ID NO: 52359
  CDS (1)..(873): transl_table=11

SEQ ID NO: 93974 - protein, 290 aa, Burkholderia pseudomallei K96243; identical to SEQ ID NO: 52360

SEQ ID NO: 93975 - DNA, 882 bp, Nocardia farcinica IFM 10152; identical to SEQ ID NO: 52361
  CDS (1)..(882): transl_table=11

SEQ ID NO: 93976 - protein, 293 aa, Nocardia farcinica IFM 10152; identical to SEQ ID NO: 52362

SEQ ID NO: 93977 - DNA, 882 bp, Desulfitobacterium hafniense DCB-2; identical to SEQ ID NO: 52363
  CDS (1)..(882)

SEQ ID NO: 93978 - protein, 293 aa, Desulfitobacterium hafniense DCB-2; identical to SEQ ID NO: 52364

SEQ ID NO: 93979 - DNA, 840 bp, Pseudomonas aeruginosa UCBPP-PA14; identical to SEQ ID NO: 52365
  CDS (1)..(840)

SEQ ID NO: 93980 - protein, 279 aa, Pseudomonas aeruginosa UCBPP-PA14; identical to SEQ ID NO: 52366

SEQ ID NO: 93981 - DNA, 846 bp, Ralstonia eutropha JMP134; identical to SEQ ID NO: 52367
  CDS (1)..(846)

SEQ ID NO: 93982 - protein, 281 aa, Ralstonia eutropha JMP134; identical to SEQ ID NO: 52368

SEQ ID NO: 93983 - DNA, 834 bp, Burkholderia cepacia R1808; identical to SEQ ID NO: 52369
  CDS (1)..(834)

SEQ ID NO: 93984 - protein, 277 aa, Burkholderia cepacia R1808; identical to SEQ ID NO: 52370

SEQ ID NO: 93985 - DNA, 840 bp, Bacillus cereus G9241; identical to SEQ ID NO: 52371
  CDS (1)..(840): transl_table=11

SEQ ID NO: 93986 - protein, 279 aa, Bacillus cereus G9241; identical to SEQ ID NO: 52372

SEQ ID NO: 93987 - DNA, 879 bp, Pseudomonas fluorescens PfO-1; identical to SEQ ID NO: 52373
  CDS (1)..(879)

SEQ ID NO: 93988 - protein, 292 aa, Pseudomonas fluorescens PfO-1; identical to SEQ ID NO: 52374

SEQ ID NO: 93989 - DNA, 879 bp, Ralstonia metallidurans CH34; identical to SEQ ID NO: 52375
  CDS (1)..(879)

SEQ ID NO: 93990 - protein, 292 aa, Ralstonia metallidurans CH34; identical to SEQ ID NO: 52376

SEQ ID NO: 93991 - DNA, 825 bp, Burkholderia fungorum LB400; identical to SEQ ID NO: 52377
  CDS (1)..(825)

SEQ ID NO: 93992 - protein, 274 aa, Burkholderia fungorum LB400; identical to SEQ ID NO: 52378

SEQ ID NO: 93993 - DNA, 882 bp, Novosphingobium aromaticivorans DSM 12444; identical to SEQ ID NO: 52379
  CDS (1)..(882)

SEQ ID NO: 93994 - protein, 293 aa, Novosphingobium aromaticivorans DSM 12444; identical to SEQ ID NO: 52380

SEQ ID NO: 93995 - DNA, 846 bp, Novosphingobium aromaticivorans DSM 12444; identical to SEQ ID NO: 52381
  CDS (1)..(846)

SEQ ID NO: 93996 - protein, 281 aa, Novosphingobium aromaticivorans DSM 12444; identical to SEQ ID NO: 52382

SEQ ID NO: 93997 - DNA, 801 bp, Microbulbifer degradans 2-40; identical to SEQ ID NO: 52383
  CDS (1)..(801)

SEQ ID NO: 93998 - protein, 266 aa, Microbulbifer degradans 2-40; identical to SEQ ID NO: 52384

SEQ ID NO: 93999 - DNA, 813 bp, Chloroflexus aurantiacus; identical to SEQ ID NO: 52385
  CDS (1)..(813)

SEQ ID NO: 94000 - protein, 270 aa, Chloroflexus aurantiacus; identical to SEQ ID NO: 52386

SEQ ID NO: 94001 - DNA, 759 bp, Angiococcus disciformis; identical to SEQ ID NO: 52387
  CDS (1)..(759): transl_table=11

SEQ ID NO: 94002 - protein, 252 aa, Angiococcus disciformis; identical to SEQ ID NO: 52388

SEQ ID NO: 94003 - DNA, 834 bp, Brachydanio rerio; identical to SEQ ID NO: 52389
  CDS (1)..(834)

SEQ ID NO: 94004 - protein, 277 aa, Brachydanio rerio; identical to SEQ ID NO: 52390

SEQ ID NO: 94005 - DNA, 807 bp, Brachydanio rerio; identical to SEQ ID NO: 52391
  CDS (1)..(807)

SEQ ID NO: 94006 - protein, 268 aa, Brachydanio rerio; identical to SEQ ID NO: 52392

SEQ ID NO: 94007 - DNA, 873 bp, Macaca mulatta; identical to SEQ ID NO: 52393
  CDS (1)..(873)

SEQ ID NO: 94008 - protein, 290 aa, Macaca mulatta; identical to SEQ ID NO: 52394

SEQ ID NO: 94009 - DNA, 873 bp, Rattus norvegicus; identical to SEQ ID NO: 52395
  CDS (1)..(873)

SEQ ID NO: 94010 - protein, 290 aa, Rattus norvegicus; identical to SEQ ID NO: 52396

SEQ ID NO: 94011 - DNA, 1029 bp, Streptomyces hygroscopicus; identical to SEQ ID NO: 52397
  CDS (1)..(1029): transl_table=11

SEQ ID NO: 94012 - protein, 342 aa, Streptomyces hygroscopicus; identical to SEQ ID NO: 52398

SEQ ID NO: 94013 - DNA, 828 bp, Streptomyces murayamaensis; identical to SEQ ID NO: 52399
  CDS (1)..(828): transl_table=11

SEQ ID NO: 94014 - protein, 275 aa, Streptomyces murayamaensis; identical to SEQ ID NO: 52400

SEQ ID NO: 94015 - DNA, 774 bp, Streptomyces hygroscopicus; identical to SEQ ID NO: 52401
  CDS (1)..(774): transl_table=11

SEQ ID NO: 94016 - protein, 257 aa, Streptomyces hygroscopicus; identical to SEQ ID NO: 52402

SEQ ID NO: 94017 - DNA, 873 bp, Homo sapiens; identical to SEQ ID NO: 52403
  CDS (1)..(873)

SEQ ID NO: 94018 - protein, 290 aa, Homo sapiens [sequence omitted]

SEQ ID NO: 94019 - DNA, 834 bp, Streptomyces hygroscopicus; identical to SEQ ID NO: 52405
  CDS (1)..(834): transl_table=11

SEQ ID NO: 94020 - protein, 277 aa, Streptomyces hygroscopicus; identical to SEQ ID NO: 52406

SEQ ID NO: 94021 - DNA, 780 bp, Actinosynnema pretiosum; identical to SEQ ID NO: 52407
  CDS (1)..(780): transl_table=11

SEQ ID NO: 94022 - protein, 259 aa, Actinosynnema pretiosum; identical to SEQ ID NO: 52408

SEQ ID NO: 94023 - DNA, 873 bp, Mus spretus; identical to SEQ ID NO: 52409
  CDS (1)..(873)

SEQ ID NO: 94024 - protein, 290 aa, Mus spretus; identical to SEQ ID NO: 52410

SEQ ID NO: 94025 - DNA, 873 bp, Mus spretus; identical to SEQ ID NO: 52411
  CDS (1)..(873)

SEQ ID NO: 94026 - protein, 290 aa, Mus spretus; identical to SEQ ID NO: 52412

SEQ ID NO: 94027 - DNA, 873 bp, Mus spretus; identical to SEQ ID NO: 52413
  CDS (1)..(873)

SEQ ID NO: 94028 - protein, 290 aa, Mus spretus; identical to SEQ ID NO: 52414

SEQ ID NO: 94029 - DNA, 873 bp, Cricetulus griseus; identical to SEQ ID NO: 52415
  CDS (1)..(873)

SEQ ID NO: 94030 - protein, 290 aa, Cricetulus griseus; identical to SEQ ID NO: 52416

SEQ ID NO: 94031 - DNA, 873 bp, Homo sapiens; identical to SEQ ID NO: 52417
  CDS (1)..(873)

SEQ ID NO: 94032 - protein, 290 aa, Homo sapiens [sequence omitted]

SEQ ID NO: 94033 - DNA, 873 bp, Homo sapiens; identical to SEQ ID NO: 52419
  CDS (1)..(873)

SEQ ID NO: 94034 - protein, 290 aa, Homo sapiens [sequence omitted]

SEQ ID NO: 94035 - DNA, 873 bp, Gallus gallus; identical to SEQ ID NO: 52421
  CDS (1)..(873)

SEQ ID NO: 94036 - protein, 290 aa, Gallus gallus; identical to SEQ ID NO: 52422

SEQ ID NO: 94037 - DNA, 873 bp, Homo sapiens; identical to SEQ ID NO: 52423
  CDS (1)..(873)

SEQ ID NO: 94038 - protein, 290 aa, Homo sapiens; identical to SEQ ID NO: 52424

SEQ ID NO: 94039 - DNA, 873 bp, Mesocricetus auratus; identical to SEQ ID NO: 52425
  CDS (1)..(873)

SEQ ID NO: 94040 - protein, 290 aa, Mesocricetus auratus; identical to SEQ ID NO: 52426

SEQ ID NO: 94041 - DNA, 873 bp, Oryctolagus cuniculus; identical to SEQ ID NO: 52427
  CDS (1)..(873)

SEQ ID NO: 94042 - protein, 290 aa, Oryctolagus cuniculus; identical to SEQ ID NO: 52428

SEQ ID NO: 94043 - DNA, 873 bp, Rattus norvegicus; identical to SEQ ID NO: 52429
  CDS (1)..(873)

SEQ ID NO: 94044 - protein, 290 aa, Rattus norvegicus; identical to SEQ ID NO: 52430

SEQ ID NO: 94045 - DNA, 873 bp, Gallus gallus; identical to SEQ ID NO: 52431
  CDS (1)..(873)

SEQ ID NO: 94046 - protein, 290 aa, Gallus gallus; identical to SEQ ID NO: 52432

SEQ ID NO: 94047 - DNA, 873 bp, Homo sapiens; identical to SEQ ID NO: 52433
  CDS (1)..(873)

SEQ ID NO: 94048 - protein, 290 aa, Homo sapiens; identical to SEQ ID NO: 52434

SEQ ID NO: 94049 - DNA, 873 bp, Mesocricetus auratus; identical to SEQ ID NO: 52435
  CDS (1)..(873)

SEQ ID NO: 94050 - protein, 290 aa, Mesocricetus auratus; identical to SEQ ID NO: 52436

SEQ ID NO: 94051 - DNA, 873 bp, Mus musculus; identical to SEQ ID NO: 52437
  CDS (1)..(873)

SEQ ID NO: 94052 - protein, 290 aa, Mus musculus; identical to SEQ ID NO: 52438

SEQ ID NO: 94053 - DNA, 873 bp, Oryctolagus cuniculus; identical to SEQ ID NO: 52439
  CDS (1)..(873)

SEQ ID NO: 94054 - protein, 290 aa, Oryctolagus cuniculus; identical to SEQ ID NO: 52440

SEQ ID NO: 94055 - DNA, 873 bp, Rattus norvegicus; identical to SEQ ID NO: 52441
  CDS (1)..(873)

SEQ ID NO: 94056 - protein, 290 aa, Rattus norvegicus; identical to SEQ ID NO: 52442

SEQ ID NO: 94057 - DNA, 864 bp, Gallus gallus; identical to SEQ ID NO: 52443
  CDS (1)..(864)

SEQ ID NO: 94058 - protein, 287 aa, Gallus gallus; identical to SEQ ID NO: 52444

SEQ ID NO: 94059 - DNA, 828 bp, Mycobacterium smegmatis; identical to SEQ ID NO: 52445
  CDS (1)..(828)

SEQ ID NO: 94060 - protein, 275 aa, Mycobacterium smegmatis; identical to SEQ ID NO: 52446

SEQ ID NO: 94061 - DNA, 783 bp, Amycolatopsis mediterranei; identical to SEQ ID NO: 52447
  CDS (1)..(783): transl_table=11

SEQ ID NO: 94062 - protein, 260 aa, Amycolatopsis mediterranei; identical to SEQ ID NO: 52448

SEQ ID NO: 94063 - DNA, 765 bp, Bacillus subtilis; identical to SEQ ID NO: 52449
  CDS (1)..(765): transl_table=11

SEQ ID NO: 94064 - protein, 254 aa, Bacillus subtilis; identical to SEQ ID NO: 52450

SEQ ID NO: 94065 - DNA, 24 bp, Primer
atgacgcccattctgaatcactat

SEQ ID NO: 94066 - DNA, 22 bp, Primer
ttattttcccgcctccgggtgc

SEQ ID NO: 94067 - protein, 311 aa, consensus; identical to SEQ ID NO: 52453
  MISC_FEATURE (1)..(311): consensus for the disclosure of xaa see table XV

SEQ ID NO: 94068 - protein, 129 aa, consensus; identical to SEQ ID NO: 52454
  MISC_FEATURE (1)..(129): consensus for the disclosure of xaa see table XV

SEQ ID NO: 94069 - DNA, 747 bp, Escherichia coli
  CDS (1)..(747)
atgatcgttttagtaactggagcaacggcaggttttggtgaatgcattactcgtcgttttattcaacaagggcataaagttatcgccactggccgtcgccaggaacggttgcaggagttaaaagacgaactgggagataatctgtatatcgcccaactggacgttcgcaaccgcgccgctattgaagagatgctggcatcgcttcctgccgagtggtgcaatattgatatcctggtaaataatgccggcctggcgttgggcatggagcctgcgcataaagccagcgttgaagactgggaaacgatgattgataccaacaacaaaggcctggtatatatgacgcgcgccgtcttaccgggtatggttgaacgtaatcatggtcatattattaacattggctcaacggcaggtagctggccgtatgccggtggtaacgtttacggtgcgacgaaagcgtttgttcgtcagtttagcctgaatctgcgtacggatctgcatggtacggcggtgcgcgtcaccgacatcgaaccgggtctggtgggtggtaccgagttttccaatgtccgctttaaaggcgatgacggtaaagcagaaaaaacctatcaaaataccgttgcattgacgccagaagatgtcagcgaagccgtctggtgggtgtcaacgctgcctgctcacgtcaatatcaataccctggaaatgatgccggttacccaaagctatgccggactgaatgtccaccgtcagtaa

SEQ ID NO: 94070 - protein, 248 aa, Escherichia coli
MIVLVTGATAGFGECITRRFIQQGHKVIATGRRQERLQELKDELGDNLYIAQLDVRNRAAIEEMLASLPAEWCNIDILVNNAGLALGMEPAHKASVEDWETMIDTNNKGLVYMTRAVLPGMVERNHGHIINIGSTAGSWPYAGGNVYGATKAFVRQFSLNLRTDLHGTAVRVTDIEPGLVGGTEFSNVRFKGDDGKAEKTYQNTVALTPEDVSEAVWWVSTLPAHVNINTLEMMPVTQSYAGLNVHRQ

SEQ ID NO: 94071 - DNA, 837 bp, Mesorhizobium loti MAFF303099
  CDS (1)..(837): transl_table=11
atgacaaagacatggttcatcaccggcgcaagcagtggctttggacggcagttgacggagctcttgctcgaacgcggagatcgcgtcgccgccacggttcgcaagcccgacgctctccacgacctcgccaccaaatatggcgagcggctttgggtcggcatcctcgatgtgacagacagttccgctgtccgtgacatcgtcggcaaagcctttgccgagctcaagcggatcgacgtcgtcgtcagcaatgccggctatgcccttttcggcgccgccgaggaggttgctgacgcacagatcgaacgccagatcgacacgaatcttgtcggctcgatttcggttgcccgcgcggtgatccctgatttgcgccagcaagggggtggccggattgtccagatttcgtcttccgtaggacagtcggcctatccgacgatgggcgtctatgccgccaccaaatggggcattgagggcttctacgagggcactatcccggagatcgcgccgttcggcatcgaggtgaccctggtcgaaccgggtgcctcgcgcacaaacttcgcgtcgtccagcgcggatgccggacagatcctcgacgtctacgaccagacgccggtcggggacttccgtcgcctggtcgcatcggctggtctcgccatgtttcccggagatcctcgcaaggtcgcttcggcgatcatcgcatcagcggagcagaccccggcacccaggaggctaacgcttggaagcgacgcctacgcgcttgtccataccgcgctgactgaacgtctggccgcgctcgagagccagaaggcattggcccgctccaccgatgtggacgcctag

SEQ ID NO: 94072 - protein, 278 aa, Mesorhizobium loti MAFF303099
MTKTWFITGASSGFGRQLTELLLERGDRVAATVRKPDALHDLATKYGERLWVGILDVTDSSAVRDIVGKAFAELKRIDVVVSNAGYALFGAAEEVADAQIERQIDTNLVGSISVARAVIPDLRQQGGGRIVQISSSVGQSAYPTMGVYAATKWGIEGFYEGTIPEIAPFGIEVTLVEPGASRTNFASSSADAGQILDVYDQTPVGDFRRLVASAGLAMFPGDPRKVASAIIASAEQTPAPRRLTLGSDAYALVHTALTERLAALESQKALARSTDVDA

SEQ ID NO: 94073 - DNA, 753 bp, Helicobacter pylori 26695
  CDS (1)..(753): transl_table=11
atggcgcacattttagttagcggggcgacttcagggtttggattagaaatcgctaaagcgtttttacaaaaaaaccatgtggtttttggcacagggaggcgaaaagagaatttacaaaaattgcaactcgcttaccctaagcatttcattcccttgtgttttgatcttcaaaacaagcttgaaactaagcgagcgttagaggctattttttccatgacggatcgcattgacgctctgatcaataacgccggcttagcactaggcttgaacaaggcttatgaatgcgagttagacgactgggaaatcatgatagatacgaatatcaaggggttgttgcatctcacccgcttgatcttgccctctatgatagagcatgaccaagggactatcatcaatcttggttctatcgctggcacttacgcctatcctggagggaatgtctatggagcgagcaaggcgtttgtgaaacaattttctttaaatttgcgagcggatttggctggcactaacattagagtgagtaatgttgaacccggtttgtgcggcgaaaccgaattcagcatggtgcgttttaaaggcgataaaatcaaagcccaatccgtctatgaaaacaccatctacctcaaaccacaagatattgctaacatcgtgctatggatttatgaacaacccttgcatgtcaatatcaaccgcatagaaatcatgcctataagccaaactttcgctcccctacccacccataaaaacccttaa

SEQ ID NO: 94074 - protein, 250 aa, Helicobacter pylori 26695
MAHILVSGATSGFGLEIAKAFLQKNHVVFGTGRRKENLQKLQLAYPKHFIPLCFDLQNKLETKRALEAIFSMTDRIDALINNAGLALGLNKAYECELDDWEIMIDTNIKGLLHLTRLILPSMIEHDQGTIINLGSIAGTYAYPGGNVYGASKAFVKQFSLNLRADLAGTNIRVSNVEPGLCGETEFSMVRFKGDKIKAQSVYENTIYLKPQDIANIVLWIYEQPLHVNINRIEIMPISQTFAPLPTHKNP

SEQ ID NO: 94075 - DNA, 720 bp, Vibrio cholerae O1 biovar eltor str. N16961
  CDS (1)..(720): transl_table=11
atgaaatcattagtcgttattacaggtgcaagttctggtattggtgaagcgattgcacgccgtttcagtgaagcgggtcatccattgctgttggtggcacgccgtgtggagcgtttagaggcactgaacctgcccaacacactgtgtgaaaaagtggatgtgacggaggccgcgaccttagtggctgcgattgcgaaagccgaagcgctgtatggccctgcggatctgctggtgaacaatgccggtgtcatgctgcttgggcagattgatactcaagaagcgaatgaatggaagcgcatgtttgatgtgaatgtgttgggtctgctcaatggtatgcacgccgtgttggccgatatgaaagatcgcaactacggtacgatcgtgaacatcagttctattgcgggtaagaaaactttcccgaatcatgctgcttactgtggaactaagtttgcggtacatgcgatttctgaaaacgtgcgtgaggaagtggctgcgagcaatgtacgtgtgaccacaattgctccaggagcggtagaaacagagctgctttcacacaccacatcaaacgaaattaaagagggctacgatgcttggaaagtggatatgggcggtgtgttggccgcggatgatgtggcgcgtgcggtgctgtttgcttatcagcagccacaaagcgtgtgcattcgtgagattgcgttggcaccgaccaaacaacagccctag

SEQ ID NO: 94076 - protein, 239 aa, Vibrio cholerae O1 biovar eltor str. N16961
MKSLVVITGASSGIGEAIARRFSEAGHPLLLVARRVERLEALNLPNTLCEKVDVTEAATLVAAIAKAEALYGPADLLVNNAGVMLLGQIDTQEANEWKRMFDVNVLGLLNGMHAVLADMKDRNYGTIVNISSIAGKKTFPNHAAYCGTKFAVHAISENVREEVAASNVRVTTIAPGAVETELLSHTTSNEIKEGYDAWKVDMGGVLAADDVARAVLFAYQQPQSVCIREIALAPTKQQP

SEQ ID NO: 94077 - DNA, 780 bp, Bacillus halodurans C-125
  CDS (1)..(780): transl_table=11
atgagaaagaaaacaatctttattacgggtgcttccagtggactaggacgacagcttgccattgacttttcgtgggaagagacggtgttatgtttgtttgcccgttctcaagaacgtttagaaaatgtccagcgaattgttgtcgaaaacggaggcgaagcccatatttatcccgtagatttggctgatccacagtcgatagatcgctcgtttgcagaagccatcagcgccgttggtgtggttgatgtactaataaataacgccggttatggtgtgtttgaacctttctgtgatagtcagatggatgagaatgaacggatgtttcgtgtcaatgtattcggcttgatgcgagcaacagccgctgtcttaccgacgatgcgtgaacaaggaagcggtcatattattaacattgcgtcccaagctggaaagattgctacagccaaatcagctatttactctgcaacaaagcatgccgttttaggatttacaaacagcctgagaatggagttgaaagggacagggattcatgtctcagctgtgaatccaggaccgatccaaacgccattttttgatcaagcagacaaggaaggcgcatatacttctaaagttcagcgaatcatgctcgatccagaagatgtatcagaaaaaattgtgcaattaacgaaaaagccaaagcgcgaattaaacctaccttggtggatgaacattggagctactgcttatcaggttgcgccccgtctattggagcttttagcagggaagcaatttcgtcaaaagtaa

SEQ ID NO: 94078 - protein, 259 aa, Bacillus halodurans C-125
MRKKTIFITGASSGLGRQLAIDFSWEETVLCLFARSQERLENVQRIVVENGGEAHIYPVDLADPQSIDRSFAEAISAVGVVDVLINNAGYGVFEPFCDSQMDENERMFRVNVFGLMRATAAVLPTMREQGSGHIINIASQAGKIATAKSAIYSATKHAVLGFTNSLRMELKGTGIHVSAVNPGPIQTPFFDQADKEGAYTSKVQRIMLDPEDVSEKIVQLTKKPKRELNLPWWMNIGATAYQVAPRLLELLAGKQFRQK

SEQ ID NO: 94079 - DNA, 759 bp, Pasteurella multocida subsp. multocida str. Pm70
  CDS (1)..(759): transl_table=11
atgaaaaaaattgcactagtgactggtgccaccgccggatttggcaccgcgatttgtcgtacattaattcagcataattacaacgtgattggcacagggcgacgtgctgaacgtttagccgcattacagcaagaatttggtgccgattttttgccacttgcctttgatctctgcgatcgccacgccacagaaaaagcgattaacaacctgcctcaagcctggcaagcagtagatcttttagtcaataatgcggggttagcattagggcttgatcgtgctgataaagctgaattagatgactggatacaaatgatcaacaccaacatcacaggattagtcaccgtcactcgcctactgctaccgcaaatggtcagtcgcaatcaaggacatattattaatttaggatcgattgcagggacttacccatatccgggtggcaatgtttatggcgcaagcaaagcctttatcaaacaatttagcttaaacttacgtgccgatctcgcaggcaccgccattcgtgtgaccaatattgaaccgggattatgcggagggacggagttttccaatgtgcgatttaaaggtgatgatcaacgcgccgcaaaattatatgaagatgtgcagtttgttactcctgaagatattgccaatattgtcttgtgggcaaatcaacagcctgaacacgtcaacattaaccgcattgaagtgatgccaacagcgcaaagtagcgcgccactcaatgtcgtcaaacaaacgaaataa

SEQ ID NO: 94080 - protein, 252 aa, Pasteurella multocida subsp. multocida str. Pm70
MKKIALVTGATAGFGTAICRTLIQHNYNVIGTGRRAERLAALQQEFGADFLPLAFDLCDRHATEKAINNLPQAWQAVDLLVNNAGLALGLDRADKAELDDWIQMINTNITGLVTVTRLLLPQMVSRNQGHIINLGSIAGTYPYPGGNVYGASKAFIKQFSLNLRADLAGTAIRVTNIEPGLCGGTEFSNVRFKGDDQRAAKLYEDVQFVTPEDIANIVLWANQQPEHVNINRIEVMPTAQSSAPLNVVKQTK

SEQ ID NO: 94081 - DNA, 762 bp, Pseudomonas aeruginosa PAO1
  CDS (1)..(762): transl_table=11
atgtcgtccaccctgttcatcaccggcgccacctcaggcttcggcgaagcctgcgcccgtcgtttcgccgaggccggctggtcgctggtgctcaccggccgtcgcgaggagcgtctgcaagccctggccggtgagctttcggcgaagacccgggtgttgccgctgaccctggacgtgcgcgaccgcgcggcgatgagcgcggccgtggacaacctgccggaagagttcgccaccctgcgcggcctgatcaacaacgccggcctggcgctgggcaccgacccggcgcagtcctgcgacctggacgactgggacaccatggtcgacaccaacatcaagggcctgctctacagcacgcgcctgctgctgccgcggctgatcgcccacggcgccggggcgagcatcgtcaacctgggttcggtggccggcaagtggccctatccgggtagccatgtctacggcggcaccaaggccttcgtcgagcaattctccctgaacctgcgttgcgacctgcagggcaccggggtgcgcgtgaccaacctcgagccggggctgtgcgagagcgagttctccctggtccgcttcggcggcgaccaggcgcgctacgacaagacctacgccggggcccatccgatccagccggaagacatcgccgagaccatcttctggatcatgaaccagcccgcccacctgaacatcaacagcctcgagatcatgccggtgagccagtcctgggccggcttcgccatccaccgcgaaagctga

SEQ ID NO: 94082 - protein, 253 aa, Pseudomonas aeruginosa PAO1
MSSTLFITGATSGFGEACARRFAEAGWSLVLTGRREERLQALAGELSAKTRVLPLTLDVRDRAAMSAAVDNLPEEFATLRGLINNAGLALGTDPAQSCDLDDWDTMVDTNIKGLLYSTRLLLPRLIAHGAGASIVNLGSVAGKWPYPGSHVYGGTKAFVEQFSLNLRCDLQGTGVRVTNLEPGLCESEFSLVRFGGDQARYDKTYAGAHPIQPEDIAETIFWIMNQPAHLNINSLEIMPVSQSWAGFAIHRES

SEQ ID NO: 94083 - DNA, 753 bp, Lactococcus lactis subsp. lactis Il1403
  CDS (1)..(753): transl_table=11
atgtcaaacaatattgaaaacaaagtcgtcttaatcacaggagcctcaagcggtattggccaagcaactgccgaattacttgctaaaaaaggagccaaaattgtactagcagcaaggcgtgaaaatcgtttgcaggagctggctgataaaattaaaaaggctggtggacaagcaatctatcaagtgacagatgtaactaatccagaagaaagtaaaaagttggtacaatatgcgaaagaaaattttggcaaaattgatgctattttcttgaatgcaggaatcatgccaagttcccctttatcagctcttcatgttgaagaatgggaaaatatggttgatattaatttaaaaggtgtacttaatgggctcgctgctgtactgcctgaatttacagctcaaaaatcaggacatgttatcacaacgagttcagttgctggcctaaaagcatatcccaatggtggtgtttatggggcaacaaaatgggcggttcgtgaattaatggaggtactccgaatggaatctgctcaagaaggaactcatattcggacagctactatttatccggctgctataaatactgagttactgaatacaatcactgacaaagatgcagcagaaggaatgacagctctgtatgaacaatatgggattagtccagaggcaattgctcgcattgttgcttttgctcttgaacaacctgaagacgttaacgtcagcgagtttactgttggacctacaacacaaccttggtaa

SEQ ID NO: 94084 - protein, 250 aa, Lactococcus lactis subsp. lactis Il1403
MSNNIENKVVLITGASSGIGQATAELLAKKGAKIVLAARRENRLQELADKIKKAGGQAIYQVTDVTNPEESKKLVQYAKENFGKIDAIFLNAGIMPSSPLSALHVEEWENMVDINLKGVLNGLAAVLPEFTAQKSGHVITTSSVAGLKAYPNGGVYGATKWAVRELMEVLRMESAQEGTHIRTATIYPAAINTELLNTITDKDAAEGMTALYEQYGISPEAIARIVAFALEQPEDVNVSEFTVGPTTQPW

SEQ ID NO: 94085 - DNA, 783 bp, Halobacterium salinarum NRC-1
  CDS (1)..(783): transl_table=11
atggaagccgactcagacccaacagacgcgcagtccgcacacgaccacgaactcgccggtgacgtcgcaatcgtcacgggcgcgtcctcgggcatcggcgaggccaccgccgaagcactcgccgcggagggcgcccacgtcgtcctcgcagcccgccgcgccgacgaactggcggcgctcgccgaccgcatcgaggacaccgacggtgacgcgctcgtcgtccccacggacatcaccgacgacgacgccatcgacgacctcgtttcggagaccgtcgacgagtacggccgcatcgacatcctcgtcaacaacgccggcgtcatgctgctcgaaccgctggagcgggccgaccgctcgaacctccgccagatggtggaagtcaacctgctcgggctcatgaacctcacccacgccgtcgtcccgatcatgcaagaccaggacgccggccacgtcgtcaacgtctcctcggtcgccggccggcaggccgacgccgactccagcggctacaacgccaccaagttcggcgtgaacgcgttcaccgacgcgatccgccaggagctcaccagccaggacatccgcaccaccatcatcgaaccgggggctgtcgacaccgaactctccacgcacgtgcccgacgagcaagtcctcgaacgcttcgcggagatggacctgcccatgctgcaccccgatgacatcgcgcgcggcatcgtctacgcgacgagccagccacagcgcgtggacgtcaacgaactcctgatccgcccgaccggccaggaactgtag

SEQ ID NO: 94086 - protein, 260 aa, Halobacterium salinarum NRC-1
MEADSDPTDAQSAHDHELAGDVAIVTGASSGIGEATAEALAAEGAHVVLAARRADELAALADRIEDTDGDALVVPTDITDDDAIDDLVSETVDEYGRIDILVNNAGVMLLEPLERADRSNLRQMVEVNLLGLMNLTHAVVPIMQDQDAGHVVNVSSVAGRQADADSSGYNATKFGVNAFTDAIRQELTSQDIRTTIIEPGAVDTELSTHVPDEQVLERFAEMDLPMLHPDDIARGIVYATSQPQRVDVNELLIRPTGQEL

SEQ ID NO: 94087 - DNA, 744 bp, Halobacterium salinarum NRC-1
  CDS (1)..(744): transl_table=11
atggaaacggctccgctcgacggcgacgtcgccgtcatcactggcgcatcgagtggcatcggggaagcaaccgcacacgcgctcgccgagaacggcgcgacggtcgtgctcgccgcgcgcagcgaagagacgctcaccgagatcgcggacacgatcacggcaacgtacgacactgccgcccacgccgtgcccaccgacgtcaccgaccgggcggccgtcgacgcgctcgtcgagacggccgtcgaggagtacggcagcctggatctcctcgtcaacaacgccgggctcgcgcgcggcgacgacgtcgcggccctcaccgacgacgagtaccgtcagatgatggccgtgaactgcgacggcatgttctacgccacccgggcggcgctcccgcacctcaccgacgccgacggcaccatcgttttcctgggtagtttcgcggggcagtacccccgccccagcaatcccgtctacgccgcgaccaaatggtggacgcgcgggttcgcccacagcgtcgaggcgcgctacggcgacgacggcctgggtgtcaccgtagtcaaccccacggaggtgcgaacccggttcaacgacgaagacggcaccgccttcgaggaggcctacgacgaagccgaggtgtcccggccgaccgacatcgccgacgccatcgcgttcgcggcgacccagagtgcgcccacggtggcgagcgagatcgacatgtaccgccaggacaagttctcggagttctag

SEQ ID NO: 94088 - protein, 247 aa, Halobacterium salinarum NRC-1
METAPLDGDVAVITGASSGIGEATAHALAENGATVVLAARSEETLTEIADTITATYDTAAHAVPTDVTDRAAVDALVETAVEEYGSLDLLVNNAGLARGDDVAALTDDEYRQMMAVNCDGMFYATRAALPHLTDADGTIVFLGSFAGQYPRPSNPVYAATKWWTRGFAHSVEARYGDDGLGVTVVNPTEVRTRFNDEDGTAFEEAYDEAEVSRPTDIADAIAFAATQSAPTVASEIDMYRQDKFSEF

SEQ ID NO: 94089 - DNA, 822 bp, Neisseria meningitidis Z2491
  CDS (1)..(822): transl_table=11
atggctgttttaattaccggtgcttcggcaggattcggcgaagcgatgtgccgtgcgtttgtcggggcgggataccgcgttatcggtgcggcgcgccgtgcggacaggcttcaggccttggcggatgaattgggtgctttgttttaccctttggaaatggacgtgtcgcgacgcgagtcggtggaaaacgccttaaacggcatccccgatgaattttccgacatcgactgcctcatcaacaatgccgggctggctttgggtctggacacggcggacaaggcggattttgaagattgggaaacgatgattcaaaccaatgttttgggtttgacgttcctgacgcgcaaaattttgccgcaaatggtggaacgcggcggcggttatgtgatgaatttgggttcgattgcaggcaattatgcttatgccggcagcaacgtttacggggcgaccaaggcgtttgtgcgccagttcagcctgaatttgcgcgcggagttggcggataagaacatccgcgttaccaatatcgagccgggtttgtgcggcaatacggagttttccaacgtgcgcttcaaaggcgatgacgagaaggcagcaggcgtgtatgagggtgtggaatttatccgccccgaagatattgcggaaaccgcattgtggctgtaccgccggccggcgcatatgaatgtgaacacgattgaaattatgcccgtggcgcagacttttgcaggaatgaaggtgataaaaaaagccgtgccggaagtgcgggaagactttgaaaaacagagtatgtcgctgttttcccgcatcagatcttggttcaaatga

SEQ ID NO: 94090 - protein, 273 aa, Neisseria meningitidis Z2491
MAVLITGASAGFGEAMCRAFVGAGYRVIGAARRADRLQALADELGALFYPLEMDVSRRESVENALNGIPDEFSDIDCLINNAGLALGLDTADKADFEDWETMIQTNVLGLTFLTRKILPQMVERGGGYVMNLGSIAGNYAYAGSNVYGATKAFVRQFSLNLRAELADKNIRVTNIEPGLCGNTEFSNVRFKGDDEKAAGVYEGVEFIRPEDIAETALWLYRRPAHMNVNTIEIMPVAQTFAGMKVIKKAVPEVREDFEKQSMSLFSRIRSWFK

SEQ ID NO: 94091 - DNA, 744 bp, Xylella fastidiosa 9a5c
  CDS (1)..(744): transl_table=11
atgatcaaagacaaagtcgtcatcatcaccggcgcatcgtccggcatcggcgaagcgaccgccaagctgctcgccagccagggcgccaaggtcgtgctcggcgcacggcgcaccgacaacctcaagcgcatcgccgacgagatcaagcaaagcggcggccaggtggcctatcaggcgctggacgtcaccaggcaggaggacaacgaccgcatcgtcaagctggcccaggacaccttcggccgcgtggatgtcatcttcctcaacgccggcctgatgcccaactcgccgctgtcggcgctcaagaccgacgactggcaccagatggtcgatgtcaacgtcaagggcgtgctcaacggcgttgccgccgtgctgccggccttcaccgcgcagaagtcgggccacgtcatcaccacctcgtcggtggccggcctgaaggcctacccaggcggcgccgtgtatggcggcaccaagtggttcgtgcgcgacttcatggaagtgctgcgcatggaatcggcgatggaaggcaccaacatccgcaccgcgacgatctacccggccgccatcaacaccgagctgctgaccaccatcagcgacaagacttcgcgcgagcagatggagagcacctacgacaagtacggcatctcgcccgaccgcatcgccagcatcgtcgccttcgccatcgaccagcccgaggacacgacggtcaacgagttcacggtcggcccggcgaaccagccctggtga

SEQ ID NO: 94092 - protein, 247 aa, Xylella fastidiosa 9a5c
MIKDKVVIITGASSGIGEATAKLLASQGAKVVLGARRTDNLKRIADEIKQSGGQVAYQALDVTRQEDNDRIVKLAQDTFGRVDVIFLNAGLMPNSPLSALKTDDWHQMVDVNVKGVLNGVAAVLPAFTAQKSGHVITTSSVAGLKAYPGGAVYGGTKWFVRDFMEVLRMESAMEGTNIRTATIYPAAINTELLTTISDKTSREQMESTYDKYGISPDRIASIVAFAIDQPEDTTVNEFTVGPANQPW

SEQ ID NO: 94093 - DNA, 807 bp, Mycobacterium tuberculosis CDC1551
  CDS (1)..(807): transl_table=11
atgccgatacccgcgcccagccccgacgcacgtgccgttgtcaccggggcttcgcagaacatcggcgcggcgctggccaccgaactggccgcacgcgggcaccacctgatcgtcaccgcacgacgcgaggacgtgttgaccgagttggctgcccggctggccgacaagtaccgcgtcacggtcgacgtgcgaccggccgatctggccgatccgcaagaacgatcgaaactggccgacgagctggctgcccggcccatctcgatcctgtgcgccaacgcgggtaccgcgacattcggcccgatcgcatcgctcgatcttgccggcgaaaagacgcaggtgcagttgaatgccgtggcggtgcacgaccttacgttggcggtgttgccgggcatgatcgagcgcaaggccggcggcatcttgatttctggttcggcggccggcaattcaccgattccctacaacgccacctatgccgcgaccaaggccttcgtgaacaccttcagcgaatctctgcgcggtgagctacgcggctccggcgtgcacgtcacggtgctggccccgggcccggttcgcaccgagctaccggatgcctccgaagcgtcactggtcgagaagctggtgccggacttcctgtggatctcgacggagcacaccgcccgggtatcgctgaatgccttggagcgcaacaagatgcgcgtcgttccgggtctgacgtcaaaggcgatgtcggtggccagccaatacgctccgcgcgccatcgtggcgccaatcgtgggtgccttttacaagaggcttgggggcagctag

SEQ ID NO: 94094 - protein, 268 aa, Mycobacterium tuberculosis CDC1551
MPIPAPSPDARAVVTGASQNIGAALATELAARGHHLIVTARREDVLTELAARLADKYRVTVDVRPADLADPQERSKLADELAARPISILCANAGTATFGPIASLDLAGEKTQVQLNAVAVHDLTLAVLPGMIERKAGGILISGSAAGNSPIPYNATYAATKAFVNTFSESLRGELRGSGVHVTVLAPGPVRTELPDASEASLVEKLVPDFLWISTEHTARVSLNALERNKMRVVPGLTSKAMSVASQYAPRAIVAPIVGAFYKRLGGS

SEQ ID NO: 94095 - DNA, 789 bp, Clostridium acetobutylicum ATCC 824
  CDS (1)..(789): transl_table=11
atgacggtacttataacaggagcttctacaggaataggatatgaaattacgaggatatttgctagaaatggttatgatgtcgtaattacagctagagatgaaaaaagactcatagaattagctaaaaatattaacacaaaggttacagtgataaaaaaggatctttcaaggccagattctgctaatgagcttttcaatgagattaaggaaaataatattgaagttgatatattggttaacaatgcaggtatgggagatactggattatttcacaaatcaagtgttgataaaattaatgaaatgcttgaacttaatataaaaagtttaactattttaactagacttgtttcagctgaaatggtgaaaaaaagaagtggtatgattttgaatgtggcatctacaggttcatatatgccgggaccatttattgcagtgtattatgctacaaaagcttatgttttatcttttactgaagctattggagaagaattaaagaaattcaatgtcaaagtgtctgctttatgtccaggcgccacggctactgaattttctaaaagggcaggaaaacttgagcttaaaggtgctatgagtgctaaaagtgtagctgaaattgcttacaaagaatttatgaacggaaaaaaagtaataattcctggatgttttaataaagtagggatacttttttctaaaatccttccgagaaatatgatgggtaaaataataggaaaaagtcagaagaaattacatgaagaatttatgattaaaaataacatcagtggtaaagaataa

SEQ ID NO: 94096 - protein, 262 aa, Clostridium acetobutylicum ATCC 824
MTVLITGASTGIGYEITRIFARNGYDVVITARDEKRLIELAKNINTKVTVIKKDLSRPDSANELFNEIKENNIEVDILVNNAGMGDTGLFHKSSVDKINEMLELNIKSLTILTRLVSAEMVKKRSGMILNVASTGSYMPGPFIAVYYATKAYVLSFTEAIGEELKKFNVKVSALCPGATATEFSKRAGKLELKGAMSAKSVAEIAYKEFMNGKKVIIPGCFNKVGILFSKILPRNMMGKIIGKSQKKLHEEFMIKNNISGKE

SEQ ID NO: 94097 - DNA, 816 bp, Agrobacterium tumefaciens str. C58
  CDS (1)..(816): transl_table=11
atgattgaggcgattatcacgacaatgccaaaactttatcttgcccgcaacggtcgcttccagaaaaccggccgtaacagcaaggagaaaaccatggcattgaacaaagtcgttctcatcacgggtgcatcgagcgggatcggtgagggcatcgcaagggagcttgcgggcgccggggcgaagctggtgcttggcgcacgccgcatggaccgtttgcagtccctcgcggaagaactgcgtcggaagggtgccgaggtcgttatccatacgcttgatgtaacggacaggcagagcgtcgaggcttttgccgaggcgggacgcaaggccttaggccagatcgacgttatcgtcaacaatgcggggatcatgccgttgtcgctgatgtcgtcgctcaaagtcgacgaatgggaccgcatgatagaggtcaacatcaagggcgtgctttacggcgtcgccgcggtgctgccggaaatgacggcacgcgcttccggacacatcatcaacatcgcctccatcggtgcgctggccgtctcgccgacggctgccgtttattgcgcgacgaaatttgcggtccgcgccatttcggacgggctgcgtcaggaaaaccgtgacctgcgcgtcacctgcattcaccccggcgtggtggaaagcgaactcgcccacaccatcaccgatccggccgccgcggaactgatgcagagctaccgggccatcgccctgaagcccgacgctatcggccgcgccgtccgttacgccatcgagcaacccgatgatgtcgatgtcaatgaaatcgtcatccgccccaccgctgcctga

SEQ ID NO: 94098 - protein, 271 aa, Agrobacterium tumefaciens str. C58
MIEAIITTMPKLYLARNGRFQKTGRNSKEKTMALNKVVLITGASSGIGEGIARELAGAGAKLVLGARRMDRLQSLAEELRRKGAEVVIHTLDVTDRQSVEAFAEAGRKALGQIDVIVNNAGIMPLSLMSSLKVDEWDRMIEVNIKGVLYGVAAVLPEMTARASGHIINIASIGALAVSPTAAVYCATKFAVRAISDGLRQENRDLRVTCIHPGVVESELAHTITDPAAAELMQSYRAIALKPDAIGRAVRYAIEQPDDVDVNEIVIRPTAA

SEQ ID NO: 94099 - DNA, 762 bp, Streptococcus pneumoniae R6
  CDS (1)..(762): transl_table=11
atggcaaaaaatgtagtgattacgggagcaacctcaggaatcggtgaagcgattgcgcgtgcttatctggagcagggtgaggatgtcgttctaacaggacgacggatagacagattagaaatcctcaagtcggagtttgcagtaagctttccaaatcaaaccgtctggacttttccactagatgtgacggatatggtcatggtgaagactgtttgctctgatattctagaaacgatagggaggattgatatcttggtcaacaacgccggactggctcttgacttggctccctatcaagactatgaggagttggatatgttgaccatgttggataccaatgttaaaggtctgatggcggttactcactgtttcttgccagcaatgataaaagtcaatcaaggtcatattatcaatatggggtcaaccgcaggaatctacgcctatgctggtgccgctgtttactcagctaccaaggcagcggttaagaccttttcggatggactgcgaattgataccatcgcaacggatatcaaggtgacaaccattcagcctgggattgtcgaaacagatttctcaactgttcgttttcatggtgataaagaacgagctgcgtccgtttaccaaggaatagaagccttgcaagctcaggatattgcagacacagtagtctatgtgaccagtcagcctcgccgtgttcagattacagatatgaccattatggccaatcaacaggcgacaggtttcatgattcataaaaaataa

SEQ ID NO: 94100 - protein, 253 aa, Streptococcus pneumoniae R6
MAKNVVITGATSGIGEAIARAYLEQGEDVVLTGRRIDRLEILKSEFAVSFPNQTVWTFPLDVTDMVMVKTVCSDILETIGRIDILVNNAGLALDLAPYQDYEELDMLTMLDTNVKGLMAVTHCFLPAMIKVNQGHIINMGSTAGIYAYAGAAVYSATKAAVKTFSDGLRIDTIATDIKVTTIQPGIVETDFSTVRFHGDKERAASVYQGIEALQAQDIADTVVYVTSQPRRVQITDMTIMANQQATGFMIHKK

SEQ ID NO: 94101 - DNA, 747 bp, Bacillus subtilis subsp. subtilis str. 168
  CDS (1)..(747): transl_table=11
atgggtaaatttgaaggtaaaatagcgcttgtaacgggtggaacaagtgggattggtcttgctacagcacaaaaatttgtaaacgaaggtgcatatgtttatattacgggacgtagacaaaacgaacttgataaagctgttaaccaaattggcaagaacgtaaccggtgttcaaggtgatatttctaagcttgaagacttagacaaactatatgacattataaagcaggaaaaaggtaagttggacattctttttgctaatgcaggcatcggcaacttccttccattaggtgaaattactgaagagcaggttgatagaacgttcgacattaacgttaaaggaaccatctttactgttcaaaaagcgttatcactattcccggacaaagtaggttctattattgtaacgggctctactgctggatcaattggcaacccagcgtttagtgtatatggagcatctaaagcagcattaagagcactagttcgcaactggattcttgacctaaaaggtactgaaatccgtgtaaatgtggttagtccaggaggtattcttacacctgcctacgatgagctttttggtgatgcacttgaagaggtactggaaaatagcagaaatactgttccagctggaaaagttgggacacctgaagaagtagcaaacgctgtatctttccttgcttcagacgaaagcagttacttgacgggtgttgaattgttcgtagatggcgggctagcacaggtataa

SEQ ID NO: 94102 - protein, 248 aa, Bacillus subtilis subsp. subtilis str. 168
MGKFEGKIALVTGGTSGIGLATAQKFVNEGAYVYITGRRQNELDKAVNQIGKNVTGVQGDISKLEDLDKLYDIIKQEKGKLDILFANAGIGNFLPLGEITEEQVDRTFDINVKGTIFTVQKALSLFPDKVGSIIVTGSTAGSIGNPAFSVYGASKAALRALVRNWILDLKGTEIRVNVVSPGGILTPAYDELFGDALEEVLENSRNTVPAGKVGTPEEVANAVSFLASDESSYLTGVELFVDGGLAQV

SEQ ID NO: 94103 - DNA, 801 bp, Caulobacter crescentus CB15
  CDS (1)..(801): transl_table=11
atggcccgtcgtctcgccctgatcaccggcgcttccgccggcatcggagccgcctccgcccgcatctacgccagccacggctacgacgtggccttgaccgcgcgccgggtcgaccgccttgagggcctggcggccgagatcaagctgcgctcgggcgtcgaggcctacgcgatccccgccgacctcgccgaaccgggcggtgtcggcgccgtcctcgcggcgatcgccgagcagggccgggaggtcgacgccctgatcaacaacgccggctacggcctgcccggaacctatgacgccaccagctgggaggatcaggccaagttcctgcagctgatgctgaccagcgtctgcgaaatgacccacaaggtcctgccgggcatggtcgagcgcaggttcggccgcatcgtcaatgtggcctcgctggcgggtctggttcccggcgcggccggccacaccctctatgccgccaccaagggctttctggtgaagttctcccaaagcctgcacctggagaacctggccaacggcgtccatgtcagcgccctgtgccctggcttcacctattcggagttccacgacgtcaacggcacccgcgcccaggtcagccagggcgtgcccgagtggatgtggctgggggccgacgaggtcgccgccgccggttacgaggccgccgaggccaaccgctcgatctgcgtgcccggcgcgcccaacaaggccatcgccgccatcgccaagatcgtccccgacgactgggccctggccctgatggccagccagggaagccggttccggaaggtgtag

SEQ ID NO: 94104 - protein, 266 aa, Caulobacter crescentus CB15
MARRLALITGASAGIGAASARIYASHGYDVALTARRVDRLEGLAAEIKLRSGVEAYAIPADLAEPGGVGAVLAAIAEQGREVDALINNAGYGLPGTYDATSWEDQAKFLQLMLTSVCEMTHKVLPGMVERRFGRIVNVASLAGLVPGAAGHTLYAATKGFLVKFSQSLHLENLANGVHVSALCPGFTYSEFHDVNGTRAQVSQGVPEWMWLGADEVAAAGYEAAEANRSICVPGAPNKAIAAIAKIVPDDWALALMASQGSRFRKV

SEQ ID NO: 94105 - DNA, 804 bp, Sinorhizobium meliloti 1021
  CDS (1)..(804): transl_table=11
atgacccagcattcaaaaggcaccgcgctcgttaccggcgcttcctccggcatcggtgcgatctatgccgatcgcttggcgcgccggggatatgatctgatcctcgtcgcccgaaaccagacccgcctcgaccaactggccaggcgtcttaccgacgagaccgggcgctccgtcgaagtcgtcgcagcggaccttggcaagaggaccgacgccgcacgcatcgagaaggtgctacgcaccgatgccagcatcaccatgctggtcaacaatgccggcgtcggtgcaaccgggccattgctcgcctcggatgtcgacaaaatggaggagatgatcgcgctcaacgtcaacgcgctgacgcggctgacctatgccgccgtgcctggcttcgtagcacgcggctcgggtgcgatcataaatattgcttcgatcgtcgggatcgcgccggaagtgctgaacggcgtgtacggaggaagcaaagcgttcgtcctcgccttcacgctgtcgcttcaaaaggagcttgaaggcaggaacatccgcatacaggccgttctccctggcgcgacggccaccgacttctggggaattgccggcacacctgtcgagcatttgccgaacgagatcgtcatgcccgccgaggatatggtcgacgccgcgctcgtgggcttcgatctcggtgaaccgatcaccattccatcgcttcccgacgctgccgattgggaggcctatgaagcggcgcgccagaagctcgtcccgaacctctctctcagtgttcccgccgcgcggtatcgggctgcggctgcatag

SEQ ID NO: 94106 - protein, 267 aa, Sinorhizobium meliloti 1021
MTQHSKGTALVTGASSGIGAIYADRLARRGYDLILVARNQTRLDQLARRLTDETGRSVEVVAADLGKRTDAARIEKVLRTDASITMLVNNAGVGATGPLLASDVDKMEEMIALNVNALTRLTYAAVPGFVARGSGAIINIASIVGIAPEVLNGVYGGSKAFVLAFTLSLQKELEGRNIRIQAVLPGATATDFWGIAGTPVEHLPNEIVMPAEDMVDAALVGFDLGEPITIPSLPDAADWEAYEAARQKLVPNLSLSVPAARYRAAAA

SEQ ID NO: 94107 - DNA, 735 bp, Synechocystis sp. PCC 6803
  CDS (1)..(735): transl_table=11
atgttaaatatagaaaataaagtaattgtcatcactggagccagtagcggtattggtgaagccaccgcgaaactgctcgcccaaaatggtgcaaaagttgttttggggggacggcggatagacaagctagagaagctaattaaacagattcatgcatctggtgggacagcagaatttaaaacggttgatgtcaccgatcgccacgatgtaaaagcatttgttgagttcgccaacgacaaatttggccgtgtcgatgtcatctttaacaatgctggcgtgatgcccctgtcgccgatgaatgccctgaaagtcgaggaatgggacaacatgattaatgtgaatattcgtggcgtgcttaatggcattgcagcgggcttgccaattatggaagcgcaagggggcgggcaaatcatcaatactgcctccattggtgcccatgtggtagtgcccactgcagcagtttactgtgcaaccaagtatgcggtttgggcaatttctgaaggactgcggcaggaatcacaaaacatccgcgtcaccaccatctctccgggagtcgttgccactgaacttggctctgatatcaccgatgagtcatccaaaggcttgttagaagaacttcgcaaaaccgcccttacctcagaggcgatcgccagagccgttttatacgctgtttcccagccggacgatgttgacgtcaatgaaatcatagtccgaccgacggccagtacgttttga

SEQ ID NO: 94108 - protein, 244 aa, Synechocystis sp. PCC 6803
MLNIENKVIVITGASSGIGEATAKLLAQNGAKVVLGGRRIDKLEKLIKQIHASGGTAEFKTVDVTDRHDVKAFVEFANDKFGRVDVIFNNAGVMPLSPMNALKVEEWDNMINVNIRGVLNGIAAGLPIMEAQGGGQIINTASIGAHVVVPTAAVYCATKYAVWAISEGLRQESQNIRVTTISPGVVATELGSDITDESSKGLLEELRKTALTSEAIARAVLYAVSQPDDVDVNEIIVRPTASTF

SEQ ID NO: 94109 - DNA, 792 bp, Listeria monocytogenes EGD-e
  CDS (1)..(792): transl_table=11
atgaacccttttttgaagaataaaacggttttaattaccggagcttctaacggtcttggagctgaaatcgcaagacaagttgctatgtccggtggtaatgttattataacagccagaagtacgaaaaaattaatagaattacaaaaagatatacatgataaattttcagtagaagcaacttattttactttagatatgacggatttcgagcaagtgaaacaagtcagcgcagagataaatgcatcgtatcaaattgatgtattagtcaactgtgcaggttttggtttatttgaaaacgcgatagatattccatttgagacaattgaaaaaatgtttgatacgaatgtacttggcttaattcaactcacacaactgattttaccgcaaatgcaagcgcgcaaagctggacatattattaatattgcctctcaagctgctaaaatcgctacaccaaaatcaaccgtttactcagccacgaaatatgcggttttaggtttttcaaatgcacttcgtttggaactaatgccagataaaatcaatgttacaacgatcaatcctggtccaattgccacgaactttttcgatgtagcggataaatcaagcaactatttagaaacagttggcaaattagtgttaaagccagaaaaagttgcgcataaaacagtgcaaattatgggaactaagcgccgcgaaatcaatttaccttttgtgatgaacattgcaacacgactttatcaagtaatgccacaagttatcgaattcttcggtaaaggtgcgtttttaaagaaataa

SEQ ID NO: 94110 - protein, 263 aa, Listeria monocytogenes EGD-e
MNPFLKNKTVLITGASNGLGAEIARQVAMSGGNVIITARSTKKLIELQKDIHDKFSVEATYFTLDMTDFEQVKQVSAEINASYQIDVLVNCAGFGLFENAIDIPFETIEKMFDTNVLGLIQLTQLILPQMQARKAGHIINIASQAAKIATPKSTVYSATKYAVLGFSNALRLELMPDKINVTTINPGPIATNFFDVADKSSNYLETVGKLVLKPEKVAHKTVQIMGTKRREINLPFVMNIATRLYQVMPQVIEFFGKGAFLKK

SEQ ID NO: 94111 - DNA, 792 bp, Listeria innocua Clip11262
  CDS (1)..(792): transl_table=11
atgaacccttttttgaagaataaaacggtattaattaccggggcttctaacggtcttggcgctgaaattgcaagacaagttgctgcgtccggtggcaatgttattataacagccagaagtacggaaaaattactagatttacaaaaagatatacatgataatttttcagtagaagcgacttattttactttagatatgacggatttcgagcaagtgaaacaagtcagcgcagagataaatgcttcgtatcaaatcgacgtattagtcaactgtgcaggttttggtttatttgaaaacgcggtagatattccatttgagacaattgaaaaaatgtttgatacgaatgtactgggcttaattcaactcacacaactgattttaccgcaaatgcaagcacgcaaagcaggacatattattaatattgcttcccaagctgctaaaatagctacaccaaaatcaactgtttactcagcaacgaaatatgcggttttaggtttttctaatgcacttcgtttagaactaatgccagacaaaatccatgttacaacgatcaatcctggcccaattgctacaaactttttcgatgtagcggataaatcagggaactatttagaaacagttggcaaattagtgttacagccagaaaaggttgcgcgtaaaacagtgcaaattatgggaactaagcgccgcgaaatcaatttaccttttgtaatgaatattgcgacacgactttatcaagtaatgccacaagttatcgaattcttcggtaaaggggcatttttaaagaaataa

SEQ ID NO: 94112 - protein, 263 aa, Listeria innocua Clip11262
MNPFLKNKTVLITGASNGLGAEIARQVAASGGNVIITARSTEKLLDLQKDIHDNFSVEATYFTLDMTDFEQVKQVSAEINASYQIDVLVNCAGFGLFENAVDIPFETIEKMFDTNVLGLIQLTQLILPQMQARKAGHIINIASQAAKIATPKSTVYSATKYAVLGFSNALRLELMPDKIHVTTINPGPIATNFFDVADKSGNYLETVGKLVLQPEKVARKTVQIMGTKRREINLPFVMNIATRLYQVMPQVIEFFGKGAFLKK

SEQ ID NO: 94113 - DNA, 774 bp, Nostoc sp. PCC 7120
  CDS (1)..(774): transl_table=11
atgatttccctgaagaatcaaattgttttgattaccggcgcaagtagtgggattggtaatgcttgcgctaggatttttgctggtgcgggtgcaaaactgatcttggcggcgcgacggttggcaaggttgcagcagttggctgatgaactaaatcaagattttggtgtagagattcacttattacagttagatgtgcgcgatcgccctagtgttgaatctgctattgctagtttaccccctgcttggtcggcaatcgatattcttattaataacgctggtctcagtcgcggtttagataagctccatgaaggcgaccttcaagactgggaagagatgattgataccaatgttaaaggtctgctttatctgactcgttatgtggttccagggatggtaaatcgtggccgtggtcatgtcatcaaccttggttccatcgccggacatcaaacctatcctggtggtaatgtttactgtggaacaaaagctgccgtcaaggcaatttccgaaggcttaaaacaagatttgttaggtactccagtacgggtgacttctgttgaccctggtatggtagaaacggaatttagtgaagtccgctttcatggtgatacagaacgggcgaaaaaagtttaccaaggagtcaacccactgacaccagaggatgttgctgatgtcatctttttttgtgccacgcgatcgcctcatgtcaatattaatgaagtcatcctcatgcctgttgaccaggccagcgccactctagttcatcggcaaacctaa

SEQ ID NO: 94114 - protein, 257 aa, Nostoc sp. PCC 7120
MISLKNQIVLITGASSGIGNACARIFAGAGAKLILAARRLARLQQLADELNQDFGVEIHLLQLDVRDRPSVESAIASLPPAWSAIDILINNAGLSRGLDKLHEGDLQDWEEMIDTNVKGLLYLTRYVVPGMVNRGRGHVINLGSIAGHQTYPGGNVYCGTKAAVKAISEGLKQDLLGTPVRVTSVDPGMVETEFSEVRFHGDTERAKKVYQGVNPLTPEDVADVIFFCATRSPHVNINEVILMPVDQASATLVHRQT

SEQ ID NO: 94115 - DNA, 735 bp, Nostoc sp. PCC 7120
  CDS (1)..(735): transl_table=11
atgtcaactgatgagaacaaagttattgcgattactggagctagtagcggtattggtgaagcaactgctagattgctggctcgccagggtttacgggttatgttaggggcgcggcgtaccgatcgattggaagcgatcgctgccgaaattcgctctaaaggtggcgaagcagaataccgcacccttgatgtcaccaacctcgaagatatgcaagcctttgtcgagtttgcccaagataaatttggtcgccttgatgttgtggtgaacaatgcgggcttgatgccgctttccaggctagaggtgctgaagatcgatgaatggaaccgcatgattgatgtgaacattcgcggtgtgcttcatgggattgctgctgcactacccctctttaagcagcaacgatcagggcagtttgtcaatctatcctcgattggcgggcataacgtctatccaaccgcagccgtgtactgcgccactaagtttgcagtttgggcgatttccgagggactgcggcaagaatcgacggacatccgggttacggtgatttcgcctggagtgacggaaactgaacttgccagcacgatcacggatgctgaagcagcagaatgggtggagggatttcgtgaggcagtgattccggcagatgcgatcgcgcgtgcgattgcctttgcgatcgagcaacccgtagaggtagatgtgaatgaaatcattgttcgaccgattggacaaatgagctaa

SEQ ID NO: 94116 - protein, 244 aa, Nostoc sp. PCC 7120
MSTDENKVIAITGASSGIGEATARLLARQGLRVMLGARRTDRLEAIAAEIRSKGGEAEYRTLDVTNLEDMQAFVEFAQDKFGRLDVVVNNAGLMPLSRLEVLKIDEWNRMIDVNIRGVLHGIAAALPLFKQQRSGQFVNLSSIGGHNVYPTAAVYCATKFAVWAISEGLRQESTDIRVTVISPGVTETELASTITDAEAAEWVEGFREAVIPADAIARAIAFAIEQPVEVDVNEIIVRPIGQMS

SEQ ID NO: 94117 - DNA, 882 bp, Nostoc sp. PCC 7120
  CDS (1)..(882): transl_table=11
atggatttgtattcaagcattttcaggtgtttgtgtattgtagaagctcaagtcaacagctatatgactaacacagtaattatcacaggcgcatctcaaggcattggcaaagccacagcattattatttgctcgtcacaactataatgttgtgctggcagctcgccaacttgatcgtttagaagcgatcgccacggagatacgggaaatgggacaacaagcgatcgccatttctaccgatgtgaaagatgctacacaagtcaataacatgatgcaaaaggcgatcgctcattttggtcaagtagatgtattaattaataatgcaggtatcttttgtttaggttctgtggaaaatttcagcttagaagattggcatcaaattattgatactaatttgtggggttatatccataccattcatgccatattgccccattttctccagcgtggtgcaggaactattgtgaatgtcagttctattggtggtttagaacctattccttatcatgtgccttacacagccagcaaatacgccataacagggttaacaaaatccctacacgcagagttatcacctaaaaacattcacgttagcggcatttatcccagcttcatcagcacccaacttatggaacgagccatttttcgtggtaaagatgaggaaatggctcaggcgcggactgaattagtaggtaaggcgattcaaatgcctgtgttagaaaaaccagaagacgtagccaaagcaatttggagtgcagtcaaagaaaagcgttctgatgtcgtcgttggttcagctaacttttggaaggcagcttatcaattgactcctagtttgatacagtctcttgtccggcgcgtttttggcatggaagaacgcaagtag

SEQ ID NO: 94118 - protein, 293 aa, Nostoc sp. PCC 7120
MDLYSSIFRCLCIVEAQVNSYMTNTVIITGASQGIGKATALLFARHNYNVVLAARQLDRLEAIATEIREMGQQAIAISTDVKDATQVNNMMQKAIAHFGQVDVLINNAGIFCLGSVENFSLEDWHQIIDTNLWGYIHTIHAILPHFLQRGAGTIVNVSSIGGLEPIPYHVPYTASKYAITGLTKSLHAELSPKNIHVSGIYPSFISTQLMERAIFRGKDEEMAQARTELVGKAIQMPVLEKPEDVAKAIWSAVKEKRSDVVVGSANFWKAAYQLTPSLIQSLVRRVFGMEERK

SEQ ID NO: 94119 - DNA, 768 bp, Nostoc sp. PCC 7120
  CDS (1)..(768): transl_table=11
gtgacaagggcttgcaaaactgccaaaaaattgggagaaagcatgagtttggagcagaaacgacgcgctctgattactggggcaagtagtggaattggcaaagcaacggcgttagcctttgcaaaagcgggaatagacgtggctttggtgagccgttctttggataaattgacacctgtagtagaagcaacaaaacagactggagtagtagccaaagcgtatactgtagacttagcagacgtatcgcaagtagaggcaaaaatccaagcgatcgctattgactttggagatatagatattcttgtcaataatgcgggtgtagcatatacggctaccttgagcgaaacgcctttagcagactggcaacaagtaattaacttgaacctgacgggcgtatttgaatgtattaaaggaattttgccaacaatgcgcgatcggcatacaggcacaatcatcaatgtgtcttcgattgcagctaaacaatcttttccgcactggggagtttacagcgtcagtaaagcaggattaatggcactttctcaaaccttggcacaagaagaacgtgtccacggtattcgggtaactgcgatttgtcctggggcagtaaatactggactttgggatacagagacggttaaagctgactttgaccgttccaaaatgctcaccccggaaattgtggctcagtcaattctctacactgcattattaccaccacaagcagtaattgatgaattgacgctcatgcccagcgcaggtgcgctgtaa

SEQ ID NO: 94120 - protein, 255 aa, Nostoc sp. PCC 7120
MTRACKTAKKLGESMSLEQKRRALITGASSGIGKATALAFAKAGIDVALVSRSLDKLTPVVEATKQTGVVAKAYTVDLADVSQVEAKIQAIAIDFGDIDILVNNAGVAYTATLSETPLADWQQVINLNLTGVFECIKGILPTMRDRHTGTIINVSSIAAKQSFPHWGVYSVSKAGLMALSQTLAQEERVHGIRVTAICPGAVNTGLWDTETVKADFDRSKMLTPEIVAQSILYTALLPPQAVIDELTLMPSAGAL

SEQ ID NO: 94121 - DNA, 789 bp, Ralstonia solanacearum GMI1000
  CDS (1)..(789): transl_table=11
ttgcacttcgcttatctctggctcggagacacgtccatgatcgtattcgtgaccggcgcaacggccggcttcggggcagccgttgcgcggcgtttcgtgcgggaagggcaccgcgtgatcgcagcgggccgccgccaagatcgccttgatgcgctcaaagccgaactgggcgatgcgctgctgccgttcctgctggatgtgcaggatgccgccgccgtcgccgccctgccgggggccctgccggagggctggcgggaggtcgacgtgctggtcaacaatgccggcttggcgctcggcctggagccggcgcatcgggccagcctgtccgactgggacctgatgatcggtaccaatgtcacggggctggtgcatgtgacgcgtgcattgctgccgggcatggtggcgcgcaaccgcggccatgtcatcaacctgggctcgatcgccggaacgtatccgtatccgggcggcaacgtgtacggcggcaccaaggctttcgtgcgccagttctcgctgaacctgcgcgccgacctgaccggcacccgcgtgcgcgtgtcgaacgtcgagccgggcctgtgctcgggcaccgagttttcgaacgtgcgcttcaagggcgatgacgcccgcgtgaccaaggtctacgagggaaccgaggcgctgacggccgacgacatcgccgagaccatctactggatggcggcgctgccggcgcatttcaatgtcaacgcgatcgagatcatgcccgtttgccagtcgttctctgcgaccagcgtgacgcgcgacatggcttga

SEQ ID NO: 94122 - protein, 262 aa, Ralstonia solanacearum GMI1000
MHFAYLWLGDTSMIVFVTGATAGFGAAVARRFVREGHRVIAAGRRQDRLDALKAELGDALLPFLLDVQDAAAVAALPGALPEGWREVDVLVNNAGLALGLEPAHRASLSDWDLMIGTNVTGLVHVTRALLPGMVARNRGHVINLGSIAGTYPYPGGNVYGGTKAFVRQFSLNLRADLTGTRVRVSNVEPGLCSGTEFSNVRFKGDDARVTKVYEGTEALTADDIAETIYWMAALPAHFNVNAIEIMPVCQSFSATSVTRDMA

SEQ ID NO: 94123 - DNA, 753 bp, Ralstonia solanacearum GMI1000
  CDS (1)..(753): transl_table=11
atgtcattcgcagactacaaaaccgctctggtcactggagcgtcttccggaatcggtgccgccgttgtcgaacgcttgtgccgtgagggcgtgcaggtccatgccttggcacgaagcgcgcaggcgctggccgagctggccgagcgtaccggctgcattgcgcacgccatcgacgtgaccgacctggacggcatcaccgcactcacgagcgagcacgcgttcgacatcctcgtcaacaacgccggtgtggatcgtcccggctcgctgctcaacgccgatgcgcagggcatcgacctgctcgtggacgtcaacctgcgcgcggtgctgcatctttgccggctcgtgctgccgggcatggtggcgcgcgaccgggggcacgtggtcaacatcagttcgattgccggtgcgtacaactttggcgggaactccacgtaccacgccaccaaggcggcgatccacatgctgtcgcggcagttgcgcatcgatgcctacggcaagcgcgtgcgcgtgaccgagatctgccccgggcgcgtggccaccgacatctttgcccacgtgcacggcgacagcgccgagacctatgagcgcttcgtcaagggcttcgagctgccgcaggccgccgacatcgccgaagccatcgcctttgccattgccgcgcccgtcgccgtcaatatcgggcacatggagatcactccgacgctgcaggtgcccggcggcctctccacgatgcgcccggaaccatcgcaagactga

SEQ ID NO: 94124 - protein, 250 aa, Ralstonia solanacearum GMI1000
MSFADYKTALVTGASSGIGAAVVERLCREGVQVHALARSAQALAELAERTGCIAHAIDVTDLDGITALTSEHAFDILVNNAGVDRPGSLLNADAQGIDLLVDVNLRAVLHLCRLVLPGMVARDRGHVVNISSIAGAYNFGGNSTYHATKAAIHMLSRQLRIDAYGKRVRVTEICPGRVATDIFAHVHGDSAETYERFVKGFELPQAADIAEAIAFAIAAPVAVNIGHMEITPTLQVPGGLSTMRPEPSQD

SEQ ID NO: 94125 - DNA, 738 bp, Agrobacterium tumefaciens str. C58; identical to SEQ ID NO: 7054
  CDS (1)..(738): transl_table=11

SEQ ID NO: 94126 - protein, 245 aa, Agrobacterium tumefaciens str. C58; identical to SEQ ID NO: 7055

SEQ ID NO: 94127 - DNA, 780 bp, Agrobacterium tumefaciens str. C58
  CDS (1)..(780): transl_table=11
atgccattttccgattacaagaccgcattggtcactggcgcttcgtccggtatcggcgctgcagtcgtcgagcggctgcgccgcgaaaacattgaagtccacgccatcgcccgcagtgccgatgcattgaaggagctggccgatcggactgggtgtgtcgcgcatgtcatcgacgtaaccgatcgtgctgcgattgccgacctcgcaagccgggtgcagtttgatattctggtcaacaatgccggcgtggatcgcccgaagaaatttctcgaggcggatgaagccgatatcgatcttctggtcgacgtcaatctgcgtgccgtcctccacatctgccggctgatcgttccaggcatggtggagcgcgatcgcggccacgtcatcaatatctcatccatcgccggaaattataatttcggcggcaattccacctatcacgccgtgaaggctggcgtcgccatgctctcgaaccagcttcggatcgatgcattcggcaagcgcgtgcgcgtgacggaaatctgtcccggccgcgtggcgacggatattttcagccacgttcacggcaatgatccgagcgtgcgcgagcgtttcatcgacggtttcgaattgccgaaggcggaagacattgccgatgcgatcggttttgccattgccgcgccggttgccgtcaatattggccatatggaaatcaccccgacattgcaggtcatgggcggccttcaaactgccaagccccagacagcagcccaggaaggcacaaagaaggagcagaagccgtga

SEQ ID NO: 94128 - protein, 259 aa, Agrobacterium tumefaciens str. C58
MPFSDYKTALVTGASSGIGAAVVERLRRENIEVHAIARSADALKELADRTGCVAHVIDVTDRAAIADLASRVQFDILVNNAGVDRPKKFLEADEADIDLLVDVNLRAVLHICRLIVPGMVERDRGHVINISSIAGNYNFGGNSTYHAVKAGVAMLSNQLRIDAFGKRVRVTEICPGRVATDIFSHVHGNDPSVRERFIDGFELPKAEDIADAIGFAIAAPVAVNIGHMEITPTLQVMGGLQTAKPQTAAQEGTKKEQKP

SEQ ID NO: 94129 - DNA, 780 bp, Schizosaccharomyces pombe
  CDS (1)..(780)
atgagccgtttggatggaaaaacgattttaatcactggtgcctcttctggaattggaaaaagcactgcttttgaaattgccaaagttgccaaagtaaaacttattttggctgctcgcagattttctaccgttgaagaaattgcaaaggagttagaatcgaaatatgaagtatcggttcttcctcttaaattggatgtttctgatttgaagtctattcctggggtaattgagtcattgccaaaggaatttgctgatatcgatgtcttgattaataatgctggacttgctctaggtaccgataaagtcattgatcttaatattgatgacgccgttaccatgattactaccaatgttcttggtatgatggctatgactcgtgcggttcttcctatattctacagcaaaaacaagggtgatattttgaacgttggcagtattgccggcagagaatcatacgtaggcggctccgtttactgctctaccaagtctgcccttgctcaattcacttccgctttgcgtaaggagactattgacactcgcattcgtattatggaggttgatcctggcttggtcgaaaccgaattcagcgttgtgagattccacggagacaaacaaaaggctgataatgtttacaaaaatagtgagcctttgacacccgaagacattgctgaggtgattctttttgccctcactcgcagagaaaacgtcgttattgccgatacacttgttttcccatcccatcaaggtggtgccaatcatgtgtacagaaagcaagcgtag

SEQ ID NO: 94130 - protein, 259 aa, Schizosaccharomyces pombe
MSRLDGKTILITGASSGIGKSTAFEIAKVAKVKLILAARRFSTVEEIAKELESKYEVSVLPLKLDVSDLKSIPGVIESLPKEFADIDVLINNAGLALGTDKVIDLNIDDAVTMITTNVLGMMAMTRAVLPIFYSKNKGDILNVGSIAGRESYVGGSVYCSTKSALAQFTSALRKETIDTRIRIMEVDPGLVETEFSVVRFHGDKQKADNVYKNSEPLTPEDIAEVILFALTRRENVVIADTLVFPSHQGGANHVYRKQA

SEQ ID NO: 94131 - DNA, 762 bp, Corynebacterium glutamicum ATCC 13032
  CDS (1)..(762): transl_table=11
atgctggtttctgtacaaaacgtaggtgactttaaggagaatgcagtggctgaaaatgggcaaaaagttgcggtcgtaactggtggatcaagcggaattggcgcagcttcagctcgagcattggcagctgacggttggaaagtaattgtggcagcacgtcgcctcgagcgcttggaagcactcgctcaggaaatcggcggaactgcagtggcactcgatgtcactgaccaagaatcagtcaacgcattttcagtcaccgttggggaagtcgatctgttggtcaacaacgcaggcggtgccaaaggcctagacagcatccatgacgccaacattgatgattggacctggatgtacgaaaccaacgtgctgggcactttgcgcgtcaccaaagccctcatggacggcctcatcgcacgtgacggtcacgtgatcaacattggttccattgcaggagaaaacccctacattggcggagctggatacaacgcagcaaaattcggtgtagcagcattcaaccgtgtgcttcgcttggaaacccaccagcagacccttcgcgtatctgagatcgatccaggtcgagttgccacggaagaattctccctcgttcgtttcggcggagataaagaacgcgcagaagcagtctatgacgacgtcctcaacctcaccgctgaagacatcgcagagtctgtgcgttgggtcgcgagccttccaaagcacatgaacattgaccgcatgcgtattacacctcgcgatcaggtctaa

SEQ ID NO: 94132 - protein, 253 aa, Corynebacterium glutamicum ATCC 13032
MLVSVQNVGDFKENAVAENGQKVAVVTGGSSGIGAASARALAADGWKVIVAARRLERLEALAQEIGGTAVALDVTDQESVNAFSVTVGEVDLLVNNAGGAKGLDSIHDANIDDWTWMYETNVLGTLRVTKALMDGLIARDGHVINIGSIAGENPYIGGAGYNAAKFGVAAFNRVLRLETHQQTLRVSEIDPGRVATEEFSLVRFGGDKERAEAVYDDVLNLTAEDIAESVRWVASLPKHMNIDRMRITPRDQV

SEQ ID NO: 94133 - DNA, 783 bp, Fusobacterium nucleatum subsp. nucleatum ATCC 25586
  CDS (1)..(783): transl_table=11
atggaagaaaatcgtgttaaaggaaagattgcatttatttcaggagcaagtagtggaattggaaaagccacagcagaaaagttagcacagatgggagttaatttaattttgtgtgctaggagagaaaatattttaaatgaattaaaagaaaatcttgaaaagcaatatggaattaaagttaaaaatttagtttttgatgtaagaaattataatgatgttttaaaaaatataaattcattagatgatgaatggaagaaaattgatatattagttaataatgctggacttgcagttggacttgaaaaattctatgaatataatatggaagatgttgataaaatggttgatactaacataaaaggttttgtatatattgcaaatacaattattccccttatgttagcaactgataaagtttgtacaatagttaatataggttctgttgcaggagaaatagcatatccaaatggaagtatatattgtgcaactaaatttgcagtgagagcaataagtgatgctatgagatcagaacttatagataaaaaaataaaagtgactaatataaaaccaggacttgttgatacaggatttagtttagttagatttagaggagataaagaaaaagctgacaatgtatataaaggaatagatcctttgtatgcagaagatatagcagatacagtagcttatgttgttaatttaccagaaaaagtacaaattacagatttatctataacaccattacatcaagcaaatgctatacatatttataaagaaaaataa

SEQ ID NO: 94134 - protein, 260 aa, Fusobacterium nucleatum subsp. nucleatum ATCC 25586
MEENRVKGKIAFISGASSGIGKATAEKLAQMGVNLILCARRENILNELKENLEKQYGIKVKNLVFDVRNYNDVLKNINSLDDEWKKIDILVNNAGLAVGLEKFYEYNMEDVDKMVDTNIKGFVYIANTIIPLMLATDKVCTIVNIGSVAGEIAYPNGSIYCATKFAVRAISDAMRSELIDKKIKVTNIKPGLVDTGFSLVRFRGDKEKADNVYKGIDPLYAEDIADTVAYVVNLPEKVQITDLSITPLHQANAIHIYKEK

SEQ ID NO: 94135 - DNA, 738 bp, Streptomyces coelicolor A3(2)
  CDS (1)..(738)
atgtcgggaatcgaaggcaaggtcgtggcgatcaccggtgccagtggcggcatcggcgaggcgagcgccctcctgctcgccgagcgcggagccaaggtcgtgctcggggcgcgccgtccggagcgtctggcggacctggccctgcgcatcggcaggagcggaggggaggcggcctggatccgtacggacgtgacccgccgcgaggacgtcgccgcactcgtcgccctggcccgcgaacgtttcggccggctcgacgtcctcgtcggcaacgccggcgtcggcctgatctcacccctggacgaactccgcgtcgaggactgggagcggatgatcgacgtcaacctgaagggtgtcctgtacggcatcgccgaggccctgcccgtcttccgggaacagggttccggccacttcgtcaacatcgtctccaccgccggactgcgcatcagcccgctcatgtcggtctacgccgggacgaagaacgcggtgcgcaccgtgtcggaggggctgcgccaggaggccggtgacagcctgcgggtcaccgtggtctcaccggggttcgtccacacggacttcgcggacggcatcccggacgccggggccagggcccaaatcctcgacaccagggaccgggtcgccatcccgccgcaggccgtggcccgcgcggtcgccttcgccgtcgagcagcccgacggcgtcgacgtgggcgacatcgtggtccgtcccaccgcacaggactag

SEQ ID NO: 94136 - protein, 245 aa, Streptomyces coelicolor A3(2)
MSGIEGKVVAITGASGGIGEASALLLAERGAKVVLGARRPERLADLALRIGRSGGEAAWIRTDVTRREDVAALVALARERFGRLDVLVGNAGVGLISPLDELRVEDWERMIDVNLKGVLYGIAEALPVFREQGSGHFVNIVSTAGLRISPLMSVYAGTKNAVRTVSEGLRQEAGDSLRVTVVSPGFVHTDFADGIPDAGARAQILDTRDRVAIPPQAVARAVAFAVEQPDGVDVGDIVVRPTAQD

SEQ ID NO: 94137 - DNA, 783 bp, Streptomyces coelicolor A3(2)
  CDS (1)..(783)
atggccaccgcagcagccgccccgtccgccgcctcccgcatcgccgtcgtgaccggcgcgagcagcggcatcggcgccgccacggcgcggcagctcgccgcggccgggtaccgcgtggtcctcaccgcccgccgcaaggaccgcatcgaggcgctcgccggggagatcgaggcggccggccacaaggcgacggcctaccccctggacgtcaccgaccgcgaggcggtcgacgagttcgcgaccgcgttcaagacggtcggcgtcctggtcaacaacgcgggcggcgcgctcggcgccgacccggtggccaccggcgacccggacgactggcgccgcatgtacgagacgaacgtcatcggcaccctcaacctcacccaggccctgctccccaagctggaggcgagcggcgacggcacggtcgtggtcgtctcctccaccgcgggcctgtccacctacgagggcggcgcgggctacgtcgccgccaagcacggcgagcacgtcctcgccgagaccctgcgcctggagatcgtcggccgcccggtccgcgtcgtcgagatcgcgcccggcatggtcaagaccgacgagttcgccctgacccgcttcgccggcgaccaggacaaggcggccaaggtctaccagggcgtcgccgcccccctgaccgccgacgacgtcgccgacaccatcacctgggcggtcacccgccccgcccacgtcaacatcgacctcctggtcgtccgcccccgcgcccaggcctcgaacacgaaggtgcaccgggaggcgtag

SEQ ID NO: 94138 - protein, 260 aa, Streptomyces coelicolor A3(2)
MATAAAAPSAASRIAVVTGASSGIGAATARQLAAAGYRVVLTARRKDRIEALAGEIEAAGHKATAYPLDVTDREAVDEFATAFKTVGVLVNNAGGALGADPVATGDPDDWRRMYETNVIGTLNLTQALLPKLEASGDGTVVVVSSTAGLSTYEGGAGYVAAKHGEHVLAETLRLEIVGRPVRVVEIAPGMVKTDEFALTRFAGDQDKAAKVYQGVAAPLTADDVADTITWAVTRPAHVNIDLLVVRPRAQASNTKVHREA

SEQ ID NO: 94139 - DNA, 1758 bp, Streptomyces coelicolor A3(2)
  CDS (1)..(1758)
atgacggtgctggagggtgcgcgggagcgccgggtgcgcacgggcggggtcgagctgtgcgtggcggagctgggcgatccgcggcggcccacggtcgtcctggtgcacggctacccggacagcaaggaggtctggtccgaggtcgccgcccgcctggccggccgcttccacgtggtcctctacgacgtccgcggccacggccggtcgagcgcgccgagcccgctgcggggcggcttcacgctggagaagctgacggacgacttcctggcggtggccgacgcggtcagcccggaccgcccggtgcacctggtgggccacgactggggctcggtgcagtcctgggagttcgtcacggtcaagcgcaccgaggggcgcatcgcctccttcacctcgatgtccgggccctccctcgaccacttcgggcactggatcaacaagcgcctcaggcgtcccaccccgcgccgggtcggacagctcctcggccagggcgccaagtcctggtacgtctacctgctgcacacccccgtgctcccggagctggcctggcgcggcccgctcggcaagcgctggccgggcatcctggagcgcgtcgagaaggtgcccggcggcgactacccgaccgcgtccctgccgtcggacgccgcgcacggggcgtggctctaccgggacaacgtccggccccggctgcgcaggccgcgcgaggacgcctacgcgcacgcgcccgtgcagctcatcacgcccctgggcgacgcgttcctgtcggagcggctctacgacggcctcgagctgtgggcgccgcggctcacccggcgcacgctgcccgcgaagcactgggtgccgcgcacccggccggaccggctggcggactggatcacggagttcgtcaccgcgaccgaggacggccggtccgagacggcggcgaacgggaagtacgcggaccgcttcggcgggcagctggtcctggtcaccggtgcgggcagcggcatcgggcgggcgacggcgttcgcgttcgccgaggccggagcgcgtgtggtggccgtcgaccgggacgccgaggccgccgcccggaccgcggagctgtcccggctgatcggtgcccgggccgcctgggcggaggccgtcgacgtctccgacgagcaggccatggagaagctggcggccagggtcgccgccgaatacggcgtggtggacgtgctcgtgaacaacgccgggatcggtctgtcgggctccttcttcgacaccacgccggaggactggaagaaggtcctcgacgtcaacctgtggggcgtgatccacggctgccgtctgttcggccggcagatggccgagcgcgggcagggcggccacatcgtcaacaccgcgtcggcggcggccttccagccctccagggtgctgcccgcctacggcacctcgaaggcggccgtgctgatgctgagcgagtgcctgcgcgccgagctggccgaccggggcatcggcgtcacggcgatctgccccggcctggtcaacaccaacatcacctccacggcgcacttcgcgggcgtggacgccgaggaggagaagcgccggcagcagcgcaccgcacggctgtacggggcgcgcaactacccgccggagaaggtggcggacgccgtgctggaggcggtcgtgcgcaacagggcggtggtcccggtgacgccggaggcgcgcggcgcccacctcatgtcccggttcgcaccccggatgctgcggcgcctcgcccgggtgaagccgcctctgtag

SEQ ID NO: 94140 - protein, 585 aa, Streptomyces coelicolor A3(2)
MTVLEGARERRVRTGGVELCVAELGDPRRPTVVLVHGYPDSKEVWSEVAARLAGRFHVVLYDVRGHGRSSAPSPLRGGFTLEKLTDDFLAVADAVSPDRPVHLVGHDWGSVQSWEFVTVKRTEGRIASFTSMSGPSLDHFGHWINKRLRRPTPRRVGQLLGQGAKSWYVYLLHTPVLPELAWRGPLGKRWPGILERVEKVPGGDYPTASLPSDAAHGAWLYRDNVRPRLRRPREDAYAHAPVQLITPLGDAFLSERLYDGLELWAPRLTRRTLPAKHWVPRTRPDRLADWITEFVTATEDGRSETAANGKYADRFGGQLVLVTGAGSGIGRATAFAFAEAGARVVAVDRDAEAAARTAELSRLIGARAAWAEAVDVSDEQAMEKLAARVAAEYGVVDVLVNNAGIGLSGSFFDTTPEDWKKVLDVNLWGVIHGCRLFGRQMAERGQGGHIVNTASAAAFQPSRVLPAYGTSKAAVLMLSECLRAELADRGIGVTAICPGLVNTNITSTAHFAGVDAEEEKRRQQRTARLYGARNYPPEKVADAVLEAVVRNRAVVPVTPEARGAHLMSRFAPRMLRRLARVKPPL

SEQ ID NO: 94141 - DNA, 759 bp, Xanthomonas campestris pv. campestris str. ATCC 33913
  CDS (1)..(759): transl_table=11
atgcaaaccgtactcatcaccggctgttcgtcgggctttggcctggcaaccgcacattactttctcgaacgcgactggaacgtggttgccaccatgcgcactccacgtgaggacctgtttcctgtatcgccaaggttgaaggtgctgcagctcgacgtcaccgacgccgcgagcatccaggccgcgattgctgcggccggcacggtggacacgctcgtcaataacgcaggcttcggtgcgcccgcaccgctggaactgacaagcctgcaggcggtacgcgacctgttcgaaaccaacaccttcggcacgctggctgttacgcaggcggtcttgccgcagatgcgcgcgcgccgcgccggggtcatcgtcaatgtgtcgtcgagcgcaacgctcaagccacttccgctgatcggcgcctaccgtgcggcgaaggcggcggtgaatgcgctgagcgaatcgctggccgccgagctggaggcgttcggtatccgcgtgcgggttatctcgccaggctcctgcggtgagacggactttcgtgccaccgcccgcgcgggtctacgcggcgctgatgacgagatctatggtgcgtttatgcaacagacgctggcgcgcatgagcgcatctaccggcccagggacgcggtcgatcgacgtcgcgcaggccgtctggcgcgcagccaccgacccggctgcgccgatgtttattcctgcaggcgcagatgcagaactgtgggctgccgaagctgccgagcgtggctaa

SEQ ID NO: 94142 - protein, 252 aa, Xanthomonas campestris pv. campestris str. ATCC 33913
MQTVLITGCSSGFGLATAHYFLERDWNVVATMRTPREDLFPVSPRLKVLQLDVTDAASIQAAIAAAGTVDTLVNNAGFGAPAPLELTSLQAVRDLFETNTFGTLAVTQAVLPQMRARRAGVIVNVSSSATLKPLPLIGAYRAAKAAVNALSESLAAELEAFGIRVRVISPGSCGETDFRATARAGLRGADDEIYGAFMQQTLARMSASTGPGTRSIDVAQAVWRAATDPAAPMFIPAGADAELWAAEAAERG

SEQ ID NO: 94143 - DNA, 756 bp, Xanthomonas campestris pv. campestris str. ATCC 33913
  CDS (1)..(756): transl_table=11
atgtccaagaccgtcctgatcaccggcgccacctccggattcggcagtgccgccgtccgccgttttgccgcagccggctggaacgtcatcgccaccggccggcgtgccgaccgcctgcaagcgctggccgctgaactccccgccggccaggtgcacaccgccgccttcgacatgcgcgatgcacaggccctgggcgctgccatcgacgcgctgccggcggacttcgccgacatcgacgtgctggtcaacaacgccggcctggcgctgggcaccgcaccggcgcagcaggccgacctgagccagtggcagcagatgatcgacaccaatgtcaccgcgctggtgacgctcacccatcgcctgctgccggcgctgatcgcgcgccgcggcgccatcatcaacatcgcctcggtcgcggcgacctacccctacaccggcggcaatgtgtacggcggcaccaaggcgttcgtgcagcaattttcgctgggcctgcgctcggatctgcacggtaccggcgtgcgtgtgacttcgatcgaaccgggcatggccgaaaccgaattcaccctggtgcgcaccggcggcaaccaggccgcctcggacacgctgtaccgcggtgccacaccgatgacggccgaggatatcgccgagcagatcttctacgtggccagcctgccgccgcacttgaacatcaaccggctggagatcatgccggtgacgcagtcgtttgcaggcttccaggtggcacgcgacgcgcagtga

SEQ ID NO: 94144 - protein, 251 aa, Xanthomonas campestris pv. campestris str. ATCC 33913
MSKTVLITGATSGFGSAAVRRFAAAGWNVIATGRRADRLQALAAELPAGQVHTAAFDMRDAQALGAAIDALPADFADIDVLVNNAGLALGTAPAQQADLSQWQQMIDTNVTALVTLTHRLLPALIARRGAIINIASVAATYPYTGGNVYGGTKAFVQQFSLGLRSDLHGTGVRVTSIEPGMAETEFTLVRTGGNQAASDTLYRGATPMTAEDIAEQIFYVASLPPHLNINRLEIMPVTQSFAGFQVARDAQ

SEQ ID NO: 94145 - DNA, 873 bp, Xanthomonas campestris pv. campestris str. ATCC 33913
  CDS (1)..(873): transl_table=11
gtggggctcctctccgaaccacaggccactcccatgtccacgacctggctcatcactggcgcctcttccggcttcggccgcggcctgacccagaccctgctggcgcgcggcgatcgcgtcgccgccaccgtgcggcgggcggacgccctggccgacctgcaggcagcgcacggcaacgcattgaccgtactgcagctggacgtgcgcgacaccgccgcggtgcaggcggtcgtggcacaggcattcgcggcgctgggccgcatcgatgtggtgatcagcaacgccggctacggcacgctgggcgcggccgaggccgccaccgacgcgcaggtgcgcgcgctgatcgacaccaacctcatcggctccatcagcgtgatccaggccgcgctgccgcacctgcgccggcaaggtggcgggcacgtggtgcaagtgtcctccgagggcgggcagatcgcctaccccggcttcagcctgtaccacgccagcaagtgggggatcgaaggctatgtcgaagcggtgcgccaggaagtggccggcttcggcatccagttcaccctggccgaacccggcccggcgcgcaccaacttcggcgccgcactggaacgcaccgcactgccgcccgactacgccaacaccccggtcgacgcactgctccgcgcgctggacgacggcagctgggtcatcaccggcgacccgcagcgcatggtggacgcgatgatcgcctgcaccgaacagaccccaccgccgctgcgcctggtcatgggcaccgcggcgtatcacgccatccacgccgccctcagcacgcgcctggctgcgctcgaagcccaacgcgcgatcgcgttttccactgatgcaccggcgacggcgcactag

SEQ ID NO: 94146 - protein, 290 aa, Xanthomonas campestris pv. campestris str. ATCC 33913
MGLLSEPQATPMSTTWLITGASSGFGRGLTQTLLARGDRVAATVRRADALADLQAAHGNALTVLQLDVRDTAAVQAVVAQAFAALGRIDVVISNAGYGTLGAAEAATDAQVRALIDTNLIGSISVIQAALPHLRRQGGGHVVQVSSEGGQIAYPGFSLYHASKWGIEGYVEAVRQEVAGFGIQFTLAEPGPARTNFGAALERTALPPDYANTPVDALLRALDDGSWVITGDPQRMVDAMIACTEQTPPPLRLVMGTAAYHAIHAALSTRLAALEAQRAIAFSTDAPATAH

SEQ ID NO: 94147 - DNA, 756 bp, Xanthomonas axonopodis pv. citri str. 306
  CDS (1)..(756): transl_table=11
atgtccaagaccgtcctgatcactggtgctacctccggattcggcagcgccgccgtgcgccgcttcgctgcagccggctggaaggtcatcgccaccggccggcgcgccgaacgcctgcaggcgctggccgctgaactgccggccgggcaggtccacaccgccgcgttcgacatgcgcgatgcacgcgccttgtcggacgcgatcgacgcagtgccggccgcattcgccgatatcgacgtgctggtcaacaacgccggcctggcgctgggcaccgcaccggcgcagcaggccgacctggcgcagtggcagcagatgatcgacaccaatgtcactgcgctggtcacgctcacccaccgcctgctgccggcgttgatcgcgcgccgcggcgccatcatcaacatcgcctcggtcgcggcaacctacccatataccggcggcaacgtctacggcggtaccaaggccttcgtgcagcagttttcgctgggcctgcgctctgatctgcacggcaccggcgtgcgcgtgacctcgatcgaaccgggcatggccgagaccgaattcaccctggtgcgcaccgggggcaaccaggcggcgtcggatacgctataccgtggcgccaccccgatgacggcagaagacatcgccgaacagatcttctatgtcgccagcctgccggcgcatttgaatatcaaccgcctggaaatcatgccggtgacccagtcctttgcggggttccaggtggcgcgcgacgcgcagtga

SEQ ID NO: 94148 - protein, 251 aa, Xanthomonas axonopodis pv. citri str. 306
MSKTVLITGATSGFGSAAVRRFAAAGWKVIATGRRAERLQALAAELPAGQVHTAAFDMRDARALSDAIDAVPAAFADIDVLVNNAGLALGTAPAQQADLAQWQQMIDTNVTALVTLTHRLLPALIARRGAIINIASVAATYPYTGGNVYGGTKAFVQQFSLGLRSDLHGTGVRVTSIEPGMAETEFTLVRTGGNQAASDTLYRGATPMTAEDIAEQIFYVASLPAHLNINRLEIMPVTQSFAGFQVARDAQ

SEQ ID NO: 94149 - DNA, 981 bp, Drosophila melanogaster
  CDS (1)..(981)
atgaaggtgcaggacatggacaaatgtgctcccagcagcgactggaacgttctttactgggtgctgggcacggtcctgatgccggtggcacttccactggccatcatcaacatttggcagcgattccaggcccagaaattccgcaatcaattgcccggcaaggtggtgctcatcacgggggccagttcgggcctgggcgaatctctggcccacgtcttctaccgcgctggatgcagggttattttggcggcacgtcgcactcaggaattggagcgggttaagaaggacctcctcgcattggatgtggatcccgcttatccgccgacagtgcttcccctggatctggctgaactgaactccattccagaatttgtcacccgggtgctggccgtgtacaaccaagtggacatactcatcaacaacggagggatcagtgtgcgagccgatgtggcatccacggcagtggatgtggatctcaaggtgatggtggttaactactttggcagcgttgccctgaccaaagctctacttccttcgatggtgaaacgtggtagtggtcacatatgcttcattagctctgttcagggaaagtttgccattccccaaagggctgcctattccgcctcgaaacatgccatgcaggcttttgccgattccctgcgagccgaggtggcaaataagaacataaacgtgtcctgcgtgagtcctggctacatacgcacccagctgtccttgaatgcattgacaggatcgggaagcagttacggcaaagtggatgaaaccacggccaagggcatgtcaccggataaacttgcagaacgcattctgcagtgcattcttcgcaaagaaccggacattattgtcagcgatgtccaggccaagatcgcctactatcttcgtcatctttgcccgagtctctacttttggatcatggccaagcgcgccgtcaaactggagaatgctgagaaaaagtccacttga

SEQ ID NO: 94150 - protein, 326 aa, Drosophila melanogaster
MKVQDMDKCAPSSDWNVLYWVLGTVLMPVALPLAIINIWQRFQAQKFRNQLPGKVVLITGASSGLGESLAHVFYRAGCRVILAARRTQELERVKKDLLALDVDPAYPPTVLPLDLAELNSIPEFVTRVLAVYNQVDILINNGGISVRADVASTAVDVDLKVMVVNYFGSVALTKALLPSMVKRGSGHICFISSVQGKFAIPQRAAYSASKHAMQAFADSLRAEVANKNINVSCVSPGYIRTQLSLNALTGSGSSYGKVDETTAKGMSPDKLAERILQCILRKEPDIIVSDVQAKIAYYLRHLCPSLYFWIMAKRAVKLENAEKKST

SEQ ID NO: 94151 - DNA, 963 bp, Rhizobium etli
  CDS (1)..(963): transl_table=11
gtgaaggagcacgtcatgtcacatctgaaaaacaaggtcgccatcgtcacaggggcttcctcgggcattggagcggcgaccgccagaggattggcggaaaaaggtgcgcgcgtcgtccttgccggccgcaatgaggaacgcctcagtcagatcgtcgaagacatcaccggttcgggaggtattgccagctacaaggttgctgatgccacggattttgagagtaccaaggccctcgtcgcgttcgccacaacgacgtacggcccggtcgatatattggtcaacaatgccggcctcatgctcttttcctattggaaggatgccgccgtcggcgattggaacaagatgatcgataccaacctgcgtggctatctgcatgcgatcgccgcggtgctgccgtcgatgttggagcgccggtccggccgcatcctgaatatgagctctatcgccggcgttcatgtcggcgaggcggcaggggtttacggagccacgaagttcttcatacgcggtattaccgaaagcctcaggaaggaggtgggcgtgggtagcgggatccaagtgtctatgatcagccctggcgtgatcgataccggctgggccgacaaggttcatgacgagacgggcagaaagatcgccggagagctcaacaagcagggtattccgccgtcgtcggtggctgaagccgtggtctatgcactagaccagcccccggagatcacgatcaacgacatttcgtccatccaacccggcaggactggtagcccgcgttttcgagagctcagaactagaacctccgggactgttagaccgcctcgcggaaccaaccggtgccgtctctcgtggctgtggacacgaagatcttcattgcatgacgatctaatcccggacgttttcgtttttcagcgaccgggccatctccgccgtccttcgcaggatccaacatggatcactaggtcaaatttttga

SEQ ID NO: 94152 - protein, 320 aa, Rhizobium etli
MKEHVMSHLKNKVAIVTGASSGIGAATARGLAEKGARVVLAGRNEERLSQIVEDITGSGGIASYKVADATDFESTKALVAFATTTYGPVDILVNNAGLMLFSYWKDAAVGDWNKMIDTNLRGYLHAIAAVLPSMLERRSGRILNMSSIAGVHVGEAAGVYGATKFFIRGITESLRKEVGVGSGIQVSMISPGVIDTGWADKVHDETGRKIAGELNKQGIPPSSVAEAVVYALDQPPEITINDISSIQPGRTGSPRFRELRTRTSGTVRPPRGTNRCRLSWLWTRRSSLHDDLIPDVFVFQRPGHLRRPSQDPTWITRSNF

SEQ ID NO: 94153 - DNA, 738 bp, Brucella suis 1330; identical to SEQ ID NO: 7034
  CDS (1)..(738): transl_table=11

SEQ ID NO: 94154 - protein, 245 aa, Brucella suis 1330; identical to SEQ ID NO: 7035

SEQ ID NO: 94155 - DNA, 756 bp, Streptococcus mutans UA159
  CDS (1)..(756): transl_table=11
atggcagaaacagtattgattacaggtgcttcggcgggttttggcaaggctatgactgaaacttttattcattctggttaccgtgttatcggagcagccagacgcttagaaaaacttggaaaacttagagaagccttaggggaacatttttatcctttgcaattagatatgactgatacatcctctattaacaaggctttagcgaatttacctaaagaatggtcaaaaattgaactccttgttaacaatgcaggactggctttaggtcttgataaggcttatgaggctaatttcaaggattgggaaaccatgattgcgactaatatcattggtctgacttatttaacccgtcaaattttgcctgatatggttgcaagaaaatcagggcatattatcaatatcggctcgactgcaggtacttatccttatccgggcggtaatgtttatggtgccagcaaagcctttgttaagcaattcagtttgaacctacgagcggatttggctggtactaaagtgcgagtgaccaacattgaacccggactttgtggtagcacagaattctcgaccattcgtttcaaaggagataagaagcgtgctgaacagctatatgaaggtgctcacagcattcagccgcaagatattgccaatgctgttctctggacttttcaacaacctaaacacgttaatatcaatcgtattgaaattatgccaacatcgcaaagtttcggtcctcagccagttgaaagggactattag

SEQ ID NO: 94156 - protein, 251 aa, Streptococcus mutans UA159
MAETVLITGASAGFGKAMTETFIHSGYRVIGAARRLEKLGKLREALGEHFYPLQLDMTDTSSINKALANLPKEWSKIELLVNNAGLALGLDKAYEANFKDWETMIATNIIGLTYLTRQILPDMVARKSGHIINIGSTAGTYPYPGGNVYGASKAFVKQFSLNLRADLAGTKVRVTNIEPGLCGSTEFSTIRFKGDKKRAEQLYEGAHSIQPQDIANAVLWTFQQPKHVNINRIEIMPTSQSFGPQPVERDY

SEQ ID NO: 94157 - DNA, 762 bp, Streptococcus agalactiae NEM316
  CDS (1)..(762): transl_table=11
atgatatcacgtaaagttgcgcttgtgacgggggcatctgctggttttggtgcagctattgttactaaattagtttcagatggttatagcgttattggttgtgctcgtcgaatggataaattaaaatgctttggagaaaagttttcagagggttacttttatccacttcaaatggatattacaagtagagaatcggttgacaaagctttagaaagtctgcctaaaaatttgcaatcaattgatttgttggttaataatgcaggtttagcacttggattggataaatcatatgaagctgattttgaagattggatgactatgattaatactaacgttgtaggattaatttacttgacacgatgcattttaccgaaaatggtagaagttaatagagggttaattatcaatttgggatcaactgcaggaacaattccttatccaggagctaatgtctatggcgcatcaaaagcttttgtaaaacaattttctctcaacttgcgtgccgatttagctggaactaaaatcagagttactaacctagaacccggtttatgtgaagggacagaattttcaactgtacgtttcaaaggagatcataaaagagttgaaaaactttatgaaggtgcgcatgcaattcaagcagaggatattgctaataccgtgtcatgggttgctagccaaccagaacacattaatattaatcgcatagaaataatgccagtcagtcaaacttatggacctcaacctgtttatcgtgattaa

SEQ ID NO: 94158 - protein, 253 aa, Streptococcus agalactiae NEM316
MISRKVALVTGASAGFGAAIVTKLVSDGYSVIGCARRMDKLKCFGEKFSEGYFYPLQMDITSRESVDKALESLPKNLQSIDLLVNNAGLALGLDKSYEADFEDWMTMINTNVVGLIYLTRCILPKMVEVNRGLIINLGSTAGTIPYPGANVYGASKAFVKQFSLNLRADLAGTKIRVTNLEPGLCEGTEFSTVRFKGDHKRVEKLYEGAHAIQAEDIANTVSWVASQPEHININRIEIMPVSQTYGPQPVYRD

SEQ ID NO: 94159 - DNA, 780 bp, Corynebacterium efficiens YS-314
  CDS (1)..(780): transl_table=11
gtgaagtgggatgacggggcgtttgagcatctcgggtgccctgtgcatggcatccttgtgaacatgactgacaccacacagaaaatcgcacttgtcaccggagcctccagtggaatcggggaggcctccgcccgcgccctggccgccgacggctggaaggtcaacgtggccgcccgccgcgttgagcgtctggagaaactcgccgaggagatcgggggagtggcgcaccatctggatgtcacctccgatgactccgtggcggcgctcgcggaggcggtgggtccgatcgatctcctggtcaacaatgccggcggggcgaagggactggacagcatccgggatgcgaagctggaggactggcagtggatgtatgacaccaacgtgctgggcaccctccgggttacccgcgccttcatggatttcctgtctgagcgtgacggcctgatcatcaacatcggttccgtcgccgggcacatcccctatgccggtggtgcgggatacaacgcggccaagcatggtgtcgccgccatgagccgggtgctgcgcctggaaacccatcagcagccgctgcgtgtcaccgagatcgatccgggtcgtgtggataccgaggaattctcactggtccgtttcaagggtgatgcggaacgcgcacgggcggtctatgaggatgtgctcaacctctcggcgggggatatcgccgaggccgtccggtgggtggcgagcctgccgagccacgtcaatatcgacaccatgagggtcaccccgcgcgatcaggtttaa

SEQ ID NO: 94160 - protein, 259 aa, Corynebacterium efficiens YS-314
MKWDDGAFEHLGCPVHGILVNMTDTTQKIALVTGASSGIGEASARALAADGWKVNVAARRVERLEKLAEEIGGVAHHLDVTSDDSVAALAEAVGPIDLLVNNAGGAKGLDSIRDAKLEDWQWMYDTNVLGTLRVTRAFMDFLSERDGLIINIGSVAGHIPYAGGAGYNAAKHGVAAMSRVLRLETHQQPLRVTEIDPGRVDTEEFSLVRFKGDAERARAVYEDVLNLSAGDIAEAVRWVASLPSHVNIDTMRVTPRDQV

SEQ ID NO: 94161 - DNA, 828 bp, Corynebacterium efficiens YS-314
  CDS (1)..(828): transl_table=11
gtgattatcaaatccaaggagtttgccatggcattgcccaccccgagccacagtgcccgcgcactggtcaccggcgccagccagggaatcggcctggccattgcccgggatctcgcccgctatggccacaacctcatcctggcggcccgccgcggcgagctgctgcaggagatcgcggaggagctcgagtcccgccacggcgtgatcgtggaggtccgcgccgtggatctggccgaccgggagcagcgcgcggagctgatcgaggagatcagggggcgtgagatcaacatcatcatcaactccgccggtatcgccagcttcggccccttcaaggatcaggactgggactatgagaccacgcagttcgatctcaacgccaccgccgtgttcgagctgacccgcgcggtgctcgacggcatgctggaacgtggcaccggtgcgatctgcaatgtcggttccgcggccggtaatgtgccgatccccaacaacgccacctatgtgctcaccaaggccggggtcaacgcgtttaccgaggccctgcactatgagctgcggggcaccggcgtggcctgcacgctcctggcaccgggtccggtgcgggaatcggtggtaccggaatccgagcagtccattgtggacaaggtggtgccggacttcctgtggaccacctatgaatcctgctccgccgagaccctgcgtgccctgtcacgcaaccgtcgccgtgtggtgccgggcccgttgtccaaggcgatgaacgcgatctccaccatcgcccccaccgcggtgctgtccccggtcatgggctgggtctattcgaagatgagctga

SEQ ID NO: 94162 - protein, 275 aa, Corynebacterium efficiens YS-314
MIIKSKEFAMALPTPSHSARALVTGASQGIGLAIARDLARYGHNLILAARRGELLQEIAEELESRHGVIVEVRAVDLADREQRAELIEEIRGREINIIINSAGIASFGPFKDQDWDYETTQFDLNATAVFELTRAVLDGMLERGTGAICNVGSAAGNVPIPNNATYVLTKAGVNAFTEALHYELRGTGVACTLLAPGPVRESVVPESEQSIVDKVVPDFLWTTYESCSAETLRALSRNRRRVVPGPLSKAMNAISTIAPTAVLSPVMGWVYSKMS

SEQ ID NO: 94163 - DNA, 765 bp, Pseudomonas putida KT2440
  CDS (1)..(765): transl_table=11
atgacgtccaccgtattcatcactggcgcgacttccggtttcggcgaggccaccgcccgccgcttcgcagaagccggctggaagctggtactcactgggcgccgcaaagagcgcctggatgccctgtgcgctgaactgtcggccaagaccgaagtgcatggcctggtgctggacgtgcgtgaccgcaaggccatggagcaggctattgccaatctgccggccggctttgaaaagattcgcggtctggtcaacaacgccggcttggcgctgggtgtggatgctgcgcagaactgcagcctggatgactgggaaaccatggtcgacaccaacatcaagggcctgatgtacaccactcgcctgctgctgccacggctcatcgcccatggccgcggcgcgtcgatcctgaacgtcgggtcggtggcgggcaactatccgtacccgggcagcaacgtgtatggcggcaccaaggccttcgtcggccagttctcgctgagcctgcgttgcgacctgcgcggtaccggcgtgcgtgtgagcaacatcgagccgggcctgtgcgagagcgagttctcgctggtgcgcttcgggggtgaccaggccaagtacgatgctacctacgcgggtgcggagccgatccagccacaggatattgccgagaccatcttctggatcctcaaccagccggcgcacatcaacatcaacagcctggaactgatgccggtgagccaggactgggcagggttctcgatcgaccgatcaaaaggctaa

SEQ ID NO: 94164 - protein, 254 aa, Pseudomonas putida KT2440
MTSTVFITGATSGFGEATARRFAEAGWKLVLTGRRKERLDALCAELSAKTEVHGLVLDVRDRKAMEQAIANLPAGFEKIRGLVNNAGLALGVDAAQNCSLDDWETMVDTNIKGLMYTTRLLLPRLIAHGRGASILNVGSVAGNYPYPGSNVYGGTKAFVGQFSLSLRCDLRGTGVRVSNIEPGLCESEFSLVRFGGDQAKYDATYAGAEPIQPQDIAETIFWILNQPAHININSLELMPVSQDWAGFSIDRSKG

SEQ ID NO: 94165 - DNA, 1134 bp, Bradyrhizobium japonicum USDA 110
  CDS (1)..(1134)
atgggattttcggactaccgaacggcgttggtgacgggcgcgtcctcgggaatcggggctgcgacggttcgtcgcctccgtgccgaggggctcgaggtccacgcgctggcgcgggatgttcgccggctagccagcctgtcggccgagaccggatgccgcgccggtgcagtcgacgtgaacgaccacgacgccttgatgcgccttgccggttcggccgaattcgatgttctcgtcaacaatgccggccagtcgcggcgcggcaatatcctggagatggcatcggatgatgtcgacacgctggtcgacgtcaatctgcgcgcggtcctgcacctgacgcgattgatcgcacctggcatggcgaggcgcaaccgtggccacgtggtcaacgtctcctcgatcgcgggccattacgccttcggcgaaaacgccacgaccttcaactcatccgtggcctatcacgcgacgaaggcgggcattcattcgctctcgcagcaattgcgcgtcgacctctacggcaccggcgttcgcgtcaccgaagtctcgcccgggcgcgtggcgacgagcatcttccagaaccagaacaccaccgacaatccggatgcccggttcgtcggcggcttcgagacgctccagtccgaagacatcgccgacgccattgcgttcgcggtgggatcgccggcgcggatgaacgtcgcgatgatcgaggtcgtacccacgttccaggtcgttggcgaattgcgatttgcgagccgatccgaggccgcgcgtttgaaagaaatgagaagtggagctgacaatgcccgaactcgcaaaccgcctcaagactgtgaaggtgtcggcctcggcggcgatgacggacaaggcgcgcgagctccgcgacgcgggtgtcaagatcgtcggcttgtcgtccggcgagcccgattttccgacgccgccgcatgcgatcgaggccgcacatcgggccgccctggccggcgataccaagtacccggcgcagccggggactgtcgcgttgcggaccgcggtccagcgcaagttcaagcgcgagaacaatctcgactacgccctcgacgagatcctgatcgccaacggcggcaagcagattatcttcaacgcgctgttcgccacctgtaa

SEQ ID NO: 94166 - protein, 377 aa, Bradyrhizobium japonicum USDA 110
MGFSDYRTALVTGASSGIGAATVRRLRAEGLEVHALARDVRRLASLSAETGCRAGAVDVNDHDALMRLAGSAEFDVLVNNAGQSRRGNILEMASDDVDTLVDVNLRAVLHLTRLIAPGMARRNRGHVVNVSSIAGHYAFGENATTFNSSVAYHATKAGIHSLSQQLRVDLYGTGVRVTEVSPGRVATSIFQNQNTTDNPDARFVGGFETLQSEDIADAIAFAVGSPARMNVAMIEVVPTFQVVGELRFASRSEAARLKEMRSGADNARTRKPPQDCEGVGLGGDDGQGARAPRRGCQDRRLVVRRARFSDAAACDRGRTSGRPGRRYQVPGAAGDCRVADRGPAQVQAREQSRLRPRRDPDRQRRQADYLQRAVRHL

SEQ ID NO: 94167 - DNA, 759 bp, Bradyrhizobium japonicum USDA 110
  CDS (1)..(759)
atgggattttcggactatcggacggccctggtgacgggcgcatcctccggaataggggctgcgacggttcgccgcctgagtgcagaagggctcgaggtctacgctgtggcccgcgacgccgctcgcctcagcgccttatctgcggagaccggttgccgcccctgcgccgtggacatcagcgacctcaatgcgcttgcggcattggcgaagtcggctgagttcgacgtcctggtcaacaacgccggccagtcccgccgcggcaatattctggacacgacggcagaggatgtcgacgccctcatcgacgtcaatttgcgcgcggtcctgcatctgacgcggctgatcgtgccgggcatggcgcgccgcgaccgcggccatgtcgtcaacatctcctcgatcgcaggtcactacgcgttcggtggcggaaacaccgtgtatcacgccacgaaggctggcattcactcgctgtcgcagcaactgcgcgtcgacctctacgggaccagggttcgcgtcaccgagatatcgccggcccgggtcgagacggaagtgttcggacggctgctgggtgatctggccgaagccaagcgccgcttctttgacgattatgatgctctccagcccgaggacatcgccaattcgatcgcgttcgcggttgggtccccggcacgcatgaatgttgccttcatggaagtcctgccgacccagcaggtcgtcggcggcctcaattttgcacagaagagccggccgccggccgagtga

SEQ ID NO: 94168 - protein, 252 aa, Bradyrhizobium japonicum USDA 110
MGFSDYRTALVTGASSGIGAATVRRLSAEGLEVYAVARDAARLSALSAETGCRPCAVDISDLNALAALAKSAEFDVLVNNAGQSRRGNILDTTAEDVDALIDVNLRAVLHLTRLIVPGMARRDRGHVVNISSIAGHYAFGGGNTVYHATKAGIHSLSQQLRVDLYGTRVRVTEISPARVETEVFGRLLGDLAEAKRRFFDDYDALQPEDIANSIAFAVGSPARMNVAFMEVLPTQQVVGGLNFAQKSRPPAE

SEQ ID NO: 94169 - DNA, 738 bp, Bradyrhizobium japonicum USDA 110
  CDS (1)..(738)
atgacgggcatcgcaggcaaagtcatcgccatcacgggcgccagcagcggaataggcgcagccgccgcccggcatctcgcggaacgtggcgccatcgtggtcctcggcgcacggcgcgccgaccggctggagatgctggccgcgagcatcgcgtcaaagggcggaaaggcgtcgtacctcgtcaccgacgtcaggcaacgcgaggatgtcgccgggctcgtcggactggcaacggatcgatacgggaagctggacgtcctgatcaacaatgcggggattgccccgatttcgctcctggacgatctgagggtcgacgactgggacgacatgatcgacgtgaacgtgaagggcgtgctctacgggatcgccgcggccctgcccgtgttccgtcgtcagggcttcggccatttcgtcaacaccctgtcgaccgccggcctcaagatcgttccgacaatggccgtctatgcggggtccaagaatgccgtcagggcgatttccgaaggacttcgtcaggaggtcggcccgtcccttcgcgtgacgaccatctcacccggttatgtcgacaccgaactgccgtcctccatgacggattccgcgttacgggagcaaggacaggcaagcatgaaggcgatggccattccggcgagcgcaatcgcggaggcgatggccttcgcgatagcgcagccggatagcgtggacgtcggcgagatcgttattcgccccacggctcaggcataa

SEQ ID NO: 94170 - protein, 245 aa, Bradyrhizobium japonicum USDA 110
MTGIAGKVIAITGASSGIGAAAARHLAERGAIVVLGARRADRLEMLAASIASKGGKASYLVTDVRQREDVAGLVGLATDRYGKLDVLINNAGIAPISLLDDLRVDDWDDMIDVNVKGVLYGIAAALPVFRRQGFGHFVNTLSTAGLKIVPTMAVYAGSKNAVRAISEGLRQEVGPSLRVTTISPGYVDTELPSSMTDSALREQGQASMKAMAIPASAIAEAMAFAIAQPDSVDVGEIVIRPTAQA

SEQ ID NO: 94171 - DNA, 816 bp, Xylella fastidiosa Temecula1
  CDS (1)..(816): transl_table=11
atgactaaaaccatattgatcacaggagccacatccggcttcggcagagccgccgtgcatcgcttcgccaacgccggctggcgtgtcatcgccacaggacgccgcattgagcgcctggaagcactcgccgccgaatggcctcctggacacatccacatcaccgccttcgatatgcgggatagcgccacactacacaccgcgattcaaacgctaccagcagactttgccgacatcgacgtcctggtcaacaacgctggtctggcactgggcaccgcaccagcacaacacgccgacctggcacagtggcgggagatgatcgacaccaacatcacctcattggtgaccttaacccaccacgtcctaccgacactgatcgaacgcaaaggcacgatcatcaacatcagctccgtcgccgcgacctatccctacacaggcggtaatgtttacgctggcacgaaagcatttgtgaaacaattttccctgggcctgcgctcggatctccatggcaccggcgtacgcgtgaccagcatagaaccagggatggccgagaccgaattcaccttagtccgtactggcggcaaccaagccgcttccgacgctctgtatcgtggcgctcacccgatcacagccgaagatattgccgaacaaatcttctacgtcgccacactaccaccacatctcaacatcaatcggctagagatcatgcccgttaaccaatcgttcgctggcttccaagtcgcacgacaacagcaatcacaattgatcaccccgccccacacacttcccactcactccagcggcacatctgacaaatag

SEQ ID NO: 94172 - protein, 271 aa, Xylella fastidiosa Temecula1
MTKTILITGATSGFGRAAVHRFANAGWRVIATGRRIERLEALAAEWPPGHIHITAFDMRDSATLHTAIQTLPADFADIDVLVNNAGLALGTAPAQHADLAQWREMIDTNITSLVTLTHHVLPTLIERKGTIINISSVAATYPYTGGNVYAGTKAFVKQFSLGLRSDLHGTGVRVTSIEPGMAETEFTLVRTGGNQAASDALYRGAHPITAEDIAEQIFYVATLPPHLNINRLEIMPVNQSFAGFQVARQQQSQLITPPHTLPTHSSGTSDK

SEQ ID NO: 94173 - DNA, 744 bp, Lactobacillus plantarum WCFS1
  CDS (1)..(744): transl_table=11
atgacagttaaaaacaaagtcgttgtgattacgggggcctcgtccggaattggggcgacgaccgctaagcaattagccagtaatggtgctaaagtcgtattgggcgcacggcgtgaagaacgcctggctgctttagttgatgaaatcaaggcagctggtggacaagcggcctatcaggtgacggatgtaacgaagtcggccgatgtacaagcactggttaagctagcgcaaacgcaattcggtgggcttgacgtgattttcaataatgctgggattatgccgacatcgccaatcagtgccttgcacacggatgaatgggaccagatggttgatattaacatcaaaggcgtcttgaacggggtggcagcggttatgccaatctttaccgctcaaaaatctggtcagattattacgacatcttcagtggctgggattaagtcctttgctggctccggcgtgtacggtgctacgaagtttgcggttcgtaatttgatggaagtcattcggatggaaagtgcccaagaaggtaccaatattcgaacggtcagcttatatccagcggccatcaatacggaattactgcacacgattacggataagacggccaaacagaatatgactgatttttatcaacaagtgggaatcagtccagcagctgttgcgaacgtggttaactttgccattgaccaaccagaagatgttaacgttaatgaatttacgatttatccgacgaagcaggcttaa

SEQ ID NO: 94174 - protein, 247 aa, Lactobacillus plantarum WCFS1
MTVKNKVVVITGASSGIGATTAKQLASNGAKVVLGARREERLAALVDEIKAAGGQAAYQVTDVTKSADVQALVKLAQTQFGGLDVIFNNAGIMPTSPISALHTDEWDQMVDINIKGVLNGVAAVMPIFTAQKSGQIITTSSVAGIKSFAGSGVYGATKFAVRNLMEVIRMESAQEGTNIRTVSLYPAAINTELLHTITDKTAKQNMTDFYQQVGISPAAVANVVNFAIDQPEDVNVNEFTIYPTKQA

SEQ ID NO: 94175 - DNA, 744 bp, Lactobacillus plantarum WCFS1
  CDS (1)..(744): transl_table=11
atgtcagtaaaaaacaaagttatcgttattacaggagcctcatcgggtattggcgaagccagtgccaaattgttagccagccatggtgccaaagttgttttaggtgcacggcgtgaacaacgcctacagaaattagccaataaaatccagcaacaaggtgggcaagccacttaccgcgtaacggacgtgactaagcctgaagacttaacagcgttagtcgctttagccaagcgagaatttggcggtattgatgtcattttcaataatgccggtatcatgccgacttcaccaatcagtgcactaaaaactgatgaatggaatgccatgatcgatgtgaacttaaaaggtgttttgaacggtgtcgccgcagtaatgcctgatttcaccaatcaaaagtatggtcaaatcattacgacatcttcagtagctgggcttaagagtttcgctggttccggcatctatggtgcaactaaatttgcagtacgcaacttaatggaagtaatccgcatggaaagtgctcaagaacacaccaatattcggaccaccagcctctatccggcagctatcaacactgaattattgcacaccattaccgataccaatgctaagcaaggtatgaataaattatatgcatccgtcggtatcaccccagatgcagtggcccgtgtcgttgacttcgcagttgcacaaccagatgacgtcaacgtcaatgaatttaccatttacccgacaaagcaaggctaa

SEQ ID NO: 94176 - protein, 247 aa, Lactobacillus plantarum WCFS1
MSVKNKVIVITGASSGIGEASAKLLASHGAKVVLGARREQRLQKLANKIQQQGGQATYRVTDVTKPEDLTALVALAKREFGGIDVIFNNAGIMPTSPISALKTDEWNAMIDVNLKGVLNGVAAVMPDFTNQKYGQIITTSSVAGLKSFAGSGIYGATKFAVRNLMEVIRMESAQEHTNIRTTSLYPAAINTELLHTITDTNAKQGMNKLYASVGITPDAVARVVDFAVAQPDDVNVNEFTIYPTKQG

SEQ ID NO: 94177 - DNA, 747 bp, Lactobacillus plantarum WCFS1
  CDS (1)..(747): transl_table=11
atgagtattaaaggtaaagtggttgttattacgggtgcgtccagcggtattggtgccgccacggccaagttattagcggctaaaggcgctaaagttgtattgggggcgcgtcgagaagagcggttacaggccttgagtcaagcgattggtgacaacgcggtctatcaagtaactgatgtaacagatcggcaacaagttcgcgctttgattgacttggccgtttccaagtttgggcgtgtcgatgtgctatataataatgccggtacgatgccccagggtaatctgagtgaccgtgaatacgataagtggcagatgatgttgaacgtgaatattatgggggttttgaatggaattggtgaagtattgccaatcatgcaaaagcaacatgatggtttgattatcgcaacggattcagttgccggacacgttgtttatcccgcatcagcggtgtataacgggactaagtatgcggtccgggccattatggaaggcttgcggcaggaagaaaaggaacacggaattcgttcaaccatcgtgtcgccaggtgcagttcggacggagttggtcaatacaatcggcaatacgcaaattcaggccggtatcagcgagctgatgaatgcggacgatcgtcaaggattggctttaaatccggaagatattgctaacgcggtattatttgcgatcgatcagcctaaacacgtcgccattagtgaagtgttagtacggccagcacaacaggaagtttaa

SEQ ID NO: 94178 - protein, 248 aa, Lactobacillus plantarum WCFS1
MSIKGKVVVITGASSGIGAATAKLLAAKGAKVVLGARREERLQALSQAIGDNAVYQVTDVTDRQQVRALIDLAVSKFGRVDVLYNNAGTMPQGNLSDREYDKWQMMLNVNIMGVLNGIGEVLPIMQKQHDGLIIATDSVAGHVVYPASAVYNGTKYAVRAIMEGLRQEEKEHGIRSTIVSPGAVRTELVNTIGNTQIQAGISELMNADDRQGLALNPEDIANAVLFAIDQPKHVAISEVLVRPAQQEV

SEQ ID NO: 94179 - DNA, 753 bp, Pseudomonas syringae pv. tomato str. DC3000
  CDS (1)..(753): transl_table=11
atgcctttttccgattacaaaaccgcgctggtcaccggcgcttcctccggcattggcgaagctgtggtcgaacggctgtgtgccgaaggcctgcaggttcatgcgctggcacgcagtgccgacaaactggcgacgctggcgcagcgtaccggttgcatcgcgcacgctattgatgtgactgatctggctggcctgacggtcttgttcgaggctcagcggtttgatgtggtggtcaataatgccggggttgaccggcccggctcgctgctcaaggcggatgccgagggtattgatctgctgatcgatgtgaacctgcgcgccgtgttgcagatcgcccggttgtcgctgcccggcatggtcgagcgtgactgtgggcacatcatcaacatcagctcgattgccgccgcctacaacttcggcggcaattcgacctaccacgccaccaaggcggcagtgagcatgctctctcgccagttgcgtatcgatgccttcggcaagcgggtgcgggtgactgaaatctgcccgggccgtgttgcgacagacatttttgcccatgtgcatggcgactccgaagaagtgcgcaagcgttttatcgagggttatgagctgcctgtggccaaggacattgccgacgccatcgcctacgtgattgccgcgcccatcgcggtgaatatcgggcacatggaaatcactccgactttgcaggtgcccggtgggctgtccactgcacgcccgcaggactatgaaggctga

SEQ ID NO: 94180 - protein, 250 aa, Pseudomonas syringae pv. tomato str. DC3000
MPFSDYKTALVTGASSGIGEAVVERLCAEGLQVHALARSADKLATLAQRTGCIAHAIDVTDLAGLTVLFEAQRFDVVVNNAGVDRPGSLLKADAEGIDLLIDVNLRAVLQIARLSLPGMVERDCGHIINISSIAAAYNFGGNSTYHATKAAVSMLSRQLRIDAFGKRVRVTEICPGRVATDIFAHVHGDSEEVRKRFIEGYELPVAKDIADAIAYVIAAPIAVNIGHMEITPTLQVPGGLSTARPQDYEG

SEQ ID NO: 94181 - DNA, 735 bp, Vibrio parahaemolyticus RIMD 2210633; identical to SEQ ID NO: 61887
  CDS (1)..(735): transl_table=11

SEQ ID NO: 94182 - protein, 244 aa, Vibrio parahaemolyticus RIMD 2210633; identical to SEQ ID NO: 61888

SEQ ID NO: 94183 - DNA, 720 bp, Vibrio parahaemolyticus RIMD 2210633
  CDS (1)..(720): transl_table=11
atgaaaaaactggttgttattactggtgcaagttcaggtattggtgaagctatcgcacgtcgttttagtgaagaaggccaccctctccttcttgtggctcgtcgcgtagaacgtttagaggcactaaatttaccaaacaccttatgtgaaaaagtcaatgtcactgaccaagcgagtttgataacagcgattgaaaaagcagaagctcaatttggtccagctgacgtgctagtcaacaatgcgggtgtaatgttgcttggtcagatcgacacgcaggacgccgctgaatggaagcgtatgttcgacgttaacgtgcttggtttgcttaatggtatgcactccgtacttgcatcaatgaaagcgcgcaatagtggcacaataattaacatcagctctattgcaggtaaaaagacgttccctgaccacgctgcatattgtgggactaagttcgcagttcatgcaatttcagaaaatgtgcgcgaagaagtggccgcatcaaatgtgcgtgttacgactattgcaccgggcgcagtagagacggaactgctttctcacaccacttcacaagacattaaagatggatacgatgcttggaaagtggatatgggtggtgtactcgccgcagacgatgtcgcgcgtgcagtaatgttcgcttaccaacaaccacaaaatgtctgtatccgagaaattgcgctcgcgccgaccaagcagcaaccataa

SEQ ID NO: 94184 - protein, 239 aa, Vibrio parahaemolyticus RIMD 2210633
MKKLVVITGASSGIGEAIARRFSEEGHPLLLVARRVERLEALNLPNTLCEKVNVTDQASLITAIEKAEAQFGPADVLVNNAGVMLLGQIDTQDAAEWKRMFDVNVLGLLNGMHSVLASMKARNSGTIINISSIAGKKTFPDHAAYCGTKFAVHAISENVREEVAASNVRVTTIAPGAVETELLSHTTSQDIKDGYDAWKVDMGGVLAADDVARAVMFAYQQPQNVCIREIALAPTKQQP

SEQ ID NO: 94185 - DNA, 771 bp, Bacteroides thetaiotaomicron VPI-5482
  CDS (1)..(771): transl_table=11
atgaaagcgaagattgtttttataaccggagcgagcagcggaatcggcgaaggatgcgcccgtaaatttgctaaggaaggatggaacctgattttgaatgcccgtacagtgtcgaagctggaagaactgaaggctgaactggaaaaagagtatggaatacaggtctatgtgttgccttttgatgttcgcgaccggaaacaggctgccgccgcactagaagcgttgccggaagaatggaaatcgattgatgtattgattaacaatgccggactggtgatcggagtggacaaagagttcgaaggtagtctggacgagtgggatatcatgatcgatacgaatataagaggtttgctcgccatgacacgtctggtagttccgggcatggtggaacggggatgcggacacattattaatataggttctatcgccggagatgccgcctatcccggaggcagtgtttactgcgccaccaaagctgctgtgaaggcactttcggacggacttcggatagacttggtggatacgccgctgcgggtgacgaatatcaaaccgggcatggtggaaacaaactttacagtggtccgttaccgtggtgacaagcaggcggctgataatttttacaagggaatccgcccgctgaccggagacgatattgccgaaacggtatattatgctgcctcggctcctgcgcatattcagattgcagaggtgcttttgatgccgacttatcaggcaacgggcactatttcttataagaagaaggcagaatag

SEQ ID NO: 94186 - protein, 256 aa, Bacteroides thetaiotaomicron VPI-5482
MKAKIVFITGASSGIGEGCARKFAKEGWNLILNARTVSKLEELKAELEKEYGIQVYVLPFDVRDRKQAAAALEALPEEWKSIDVLINNAGLVIGVDKEFEGSLDEWDIMIDTNIRGLLAMTRLVVPGMVERGCGHIINIGSIAGDAAYPGGSVYCATKAAVKALSDGLRIDLVDTPLRVTNIKPGMVETNFTVVRYRGDKQAADNFYKGIRPLTGDDIAETVYYAASAPAHIQIAEVLLMPTYQATGTISYKKKAE

SEQ ID NO: 94187 - DNA, 738 bp, Enterococcus faecalis V583
  CDS (1)..(738): transl_table=11
atgaaatcattatcagaaaaagttattgttatcatgggcgcttccagtggcatcggtgaggcaacagcccgtttacttgccagaaaaggagcgaagttagtcattgcagcacgtcgacaagaacgtttaattgctataaaaaaagaacttcctgaagcaacgattctcgtgcaacaagcagatgtaacgaaagaagaggaagttcagcgtgtaatcaagcttacaatggaaaaatatggacgaattgatgttctttttaacaatgcaggagttatgccaacggcgcctcttattgaagcaccaaaaggagaatggcgtcaaatgctagatattaatattatgggtgttttaaatggcattgcggcagttcttccaattatggttgaacaaaaatcagggcagattattgctactgattctgtggcaggacatgtcgtttatccagattcggctgtctactgtggaacaaagtttgctgttcgagcaattatggaaggattgcgacaagaacaaagagagaataacattaaatcaacgattatttcaccaggtgctgtacaaacagaactttatcaaacaatttctaatcgagtagtagctgaaacgttacatctagaacagttaagttggggcttaaaggcggaagacattgcgcaagcagtggtctttgccatagacacgccagatcgtatgtcaatcagtgaaatggttgttcgcccgaccacacaaacgatttaa

SEQ ID NO: 94188 - protein, 245 aa, Enterococcus faecalis V583
MKSLSEKVIVIMGASSGIGEATARLLARKGAKLVIAARRQERLIAIKKELPEATILVQQADVTKEEEVQRVIKLTMEKYGRIDVLFNNAGVMPTAPLIEAPKGEWRQMLDINIMGVLNGIAAVLPIMVEQKSGQIIATDSVAGHVVYPDSAVYCGTKFAVRAIMEGLRQEQRENNIKSTIISPGAVQTELYQTISNRVVAETLHLEQLSWGLKAEDIAQAVVFAIDTPDRMSISEMVVRPTTQTI

SEQ ID NO: 94189 - DNA, 846 bp, Coxiella burnetii RSA 493
  CDS (1)..(846): transl_table=11
atgagttataatcgattgattttccggaaaataacagacctaaggtttttgattatgccaacagtgttgataacaggcgcgtccagcggtattggtaaagcgttagcgcttgtgtatgcttctcaccaacacgcgcttctattaaccggacgcgatgaggatgcgttaaatcaagtggcgcagaagtgccgtcaatattcagttgaggtctttatctacgcgaaagatttatgtttgcccgatgccgtccaatccttaatgaaatttattgaagaaaaacagttgaaaatcgatctattaattaataatgcgggtgcggggtgctatcgaaatttttctgaaattccgtttaactccttagaacaaatgttgcgtgttaatatcgacgggctggtcaaattaacccggcaattattgccgtccatgattaaacaagggaagggaagcattgtgaatattggttctgtttattcatttgtgcccgtcgcttcacaggcggtttatgccgccagcaaggcctttgtaaaatcattttctttgggattacaggccgaattaaagaaaaccggcgtttcggtgagttgtgtttttccagggtcgactgaaagtgctttccgagcgcgagcgggggtcgtcagtgattcaaaacgttttacattgccctcgactattgtagcttataaaatttatcaaggcgttaagcgcaagcgtttgtttattatcccaggctggtataattggctttttgtcttcttgatacaatacgttcctattttttggttaccgaaaattataaatttcttagcctatcggatgcgtcgaatagagaaaaagccgtcaaattaa

SEQ ID NO: 94190 - protein, 281 aa, Coxiella burnetii RSA 493
MSYNRLIFRKITDLRFLIMPTVLITGASSGIGKALALVYASHQHALLLTGRDEDALNQVAQKCRQYSVEVFIYAKDLCLPDAVQSLMKFIEEKQLKIDLLINNAGAGCYRNFSEIPFNSLEQMLRVNIDGLVKLTRQLLPSMIKQGKGSIVNIGSVYSFVPVASQAVYAASKAFVKSFSLGLQAELKKTGVSVSCVFPGSTESAFRARAGVVSDSKRFTLPSTIVAYKIYQGVKRKRLFIIPGWYNWLFVFLIQYVPIFWLPKIINFLAYRMRRIEKKPSN

SEQ ID NO: 94191 - DNA, 777 bp, Coxiella burnetii RSA 493
  CDS (1)..(777): transl_table=11
atgaatatcgagttgtcaaaaaaaattgtctttataaccggtgcttctagcgggattgggcgcgcctgtgcggagcaatttgcccaaaaaggggcgcgtcttttgttgtgtgcgcgacgtgagagccgactgacggacgtggtggcggatttaaaacagcgatttcaatcggatatttattcttttccgttgaacgtcagcgattctgcggctgtggaaagaaaactgcaagaattgccgactgagtggcaaccgatcgatattcttatcaacaatgccggcttggcgttaggcttggaaaagctgcaagaagggaatattgaagattgggataccatgattgataccaatgtcaaaggcgtgttgtacatcagccgtcaagtgttgggaactatgctgaagcgaaaccaggggcatatcattaatatcggatcgatttcctcgcatcaagtgtattcgggaggcgtcgtttattgtgcgactaaatttgcgttaaaggccattagtgaaggattaaaaatggatgtccacgggacgctcattcgcgtaagttcagttgaccctggaatggtcgaaacggaattttccgctgttcgttttggtggtgaccaaaagaaagtggaagcggtttataaaggatttacgcctttaaaagccgaagatattgctgaagctgtcttattttgtgcgacgcgaccattgcatgtcgatgttcgtgcaatcaaaatttacccgacagcgcaaacggctgctcatttgataagtcgaggtaattga

SEQ ID NO: 94192 - protein, 258 aa, Coxiella burnetii RSA 493
MNIELSKKIVFITGASSGIGRACAEQFAQKGARLLLCARRESRLTDVVADLKQRFQSDIYSFPLNVSDSAAVERKLQELPTEWQPIDILINNAGLALGLEKLQEGNIEDWDTMIDTNVKGVLYISRQVLGTMLKRNQGHIINIGSISSHQVYSGGVVYCATKFALKAISEGLKMDVHGTLIRVSSVDPGMVETEFSAVRFGGDQKKVEAVYKGFTPLKAEDIAEAVLFCATRPLHVDVRAIKIYPTAQTAAHLISRGN

SEQ ID NO: 94193 - DNA, 756 bp, Mycobacterium bovis AF2122/97
  CDS (1)..(756): transl_table=11
atgacgacaatcggcacccgcaagcgagtcgccgtggtcaccggcgccagttccggtatcggcgaggcaaccgcgagaacccttgcggcccaggggtttcacgtggtcgcggtggcgcgtcgggcggaccggatcaccgcgctggccaaccagatcggcggaaccgcaattgtggccgatgtcactgacgacgccgccgtcgaagcgttggcccgcgcgctgagccgggtggacgtgctggtcaacaacgccggtggcgccaaggggcttcagttcgtcgccgatgccgatttggagcactggcgatggatgtgggacaccaacgtactgggcacgctgcgggtaacccgcgcgctgctgcccaagctgatcgactccggcgacggcctgatcgtcaccgtcacctcgatcgccgcgctcgaggtgtacgacggcggcgccggctacaccgctgccaagcacgcgcagggcgcgctgcatcgcacgctgcgcggcgaactgctggggaagccggtccggctcacggagatcgctccaggcgcggtcgagaccgaattttcgctggtccgcttcgacggcgaccagcaacgcgcggacgcggtttatgccggcatgacaccgctagtagccgccgacgtcgccgaggtgatcggattcgtggccacccggccctcacacgtcaaccttgaccagatcgtcatccggccccgcgaccaggcatcagctagccgtcgcgctacccacccggtccgttag

SEQ ID NO: 94194 - protein, 251 aa, Mycobacterium bovis AF2122/97
MTTIGTRKRVAVVTGASSGIGEATARTLAAQGFHVVAVARRADRITALANQIGGTAIVADVTDDAAVEALARALSRVDVLVNNAGGAKGLQFVADADLEHWRWMWDTNVLGTLRVTRALLPKLIDSGDGLIVTVTSIAALEVYDGGAGYTAAKHAQGALHRTLRGELLGKPVRLTEIAPGAVETEFSLVRFDGDQQRADAVYAGMTPLVAADVAEVIGFVATRPSHVNLDQIVIRPRDQASASRRATHPVR

SEQ ID NO: 94195 - DNA, 753 bp, Helicobacter hepaticus ATCC 51449
  CDS (1)..(753): transl_table=11
atgacagcactcatcactggagcatcatcgggttttggtaaagcaatcgctcggctttttgtccgcaatgggcacaaagtaattattcttgcacgaagagaagaacgaataaatacgctacaaaatgagcttggtgcattatgtgaaaaaattatatgcgatgtgcgagatacacaaaaaatagaatctgcactcaaattgcttcctcaagaatttcaaaacattgatgtgcttatcaataatgcaggtttagcacttggtttaaccagcgcggataaagcaaatattgccgattgggaacaaatggtagaggttaatatcttagctctcataaagcttacgcatcttattttgccccaaatggtagctcaaggttatgggcatattatcaacattggctcaatcgcaggcacctactcctatccgggtggcaatgtgtatggtgctacaaaagcttttgtgaagagatttagcctcaatctccgtgctgatttatatgataaaaatatccgtataagtgatattgaaccgggcttatgtggtggaagtgaattttcacaagtgcgctttaagggtgatgaaagtaaggcaaaaagtgtatatgaaggcacaacacctcttatgcctgaagatattgctcaaagtgtattgtgggttgcctcactgccccaacacatcaatgttaatacacttgaaataatgcccacaacccaagctccagcagcactaaatgtatataaaaatacaaaataa

SEQ ID NO: 94196 - protein, 250 aa, Helicobacter hepaticus ATCC 51449
MTALITGASSGFGKAIARLFVRNGHKVIILARREERINTLQNELGALCEKIICDVRDTQKIESALKLLPQEFQNIDVLINNAGLALGLTSADKANIADWEQMVEVNILALIKLTHLILPQMVAQGYGHIINIGSIAGTYSYPGGNVYGATKAFVKRFSLNLRADLYDKNIRISDIEPGLCGGSEFSQVRFKGDESKAKSVYEGTTPLMPEDIAQSVLWVASLPQHINVNTLEIMPTTQAPAALNVYKNTK

SEQ ID NO: 94197 - DNA, 912 bp, Rhodopirellula baltica SH 1
  CDS (1)..(912): transl_table=11
gtgcgaggcttcttcccgctcacctctcgattcgtcacgcattgtcttgcgtgtggacgactgatcatgtcgttcctggtgaaagcccgatcccgagccttttcttttcgtcgcctcaatggacacccatcgatgactcaacacaacaccgcactcatcactggagcctcatcgggtatcggacgagaactagcgattcacttcgcaaatggtggaaacgacgtcgtcttggtcgcccgcagcgaagacaaactccgcgaattggcgacagagattgaatcccaatcgggacggtccgctaccgtgatcacaagcgatctctcgcgtattgagtcggttgaccaactgtgcaacgaactgacccagcggtccatcacgatcaacacgcttgtcaacaacgccggttttggcgcactaggcaagttctccgagctttccgctgatcgtcagaccgacatggtgatggtcaatgtagttgcattgactcgcctgacccgtcaattgctgccgagcatgttgcagcaaaaccgtggcggcatcctcaacgtgggttccatcgcggcgtaccaagccggtcccaacatggccgtctactacgccacgaaggcatacgtgctctcgttcaccgaggctctgcgtgaggagttgtccggaaccaaattgcatgtcacctgtctcgaaccaggcccgaccgaaaccggcttcggagaagattctgggatgggaaaactggacatattctcatccaccgcgatgaccgcaaaagcggtcgcttttgccggctacgaaggctacctcaacaacgaagacgttgtcattccaggttggaaaaaccgtttaatggtgacttcggcaggtttcttgcctcgtttcgcaacccggaagttggttggaaaaatgcagagtgcataa

SEQ ID NO: 94198 - protein, 303 aa, Rhodopirellula baltica SH 1
MRGFFPLTSRFVTHCLACGRLIMSFLVKARSRAFSFRRLNGHPSMTQHNTALITGASSGIGRELAIHFANGGNDVVLVARSEDKLRELATEIESQSGRSATVITSDLSRIESVDQLCNELTQRSITINTLVNNAGFGALGKFSELSADRQTDMVMVNVVALTRLTRQLLPSMLQQNRGGILNVGSIAAYQAGPNMAVYYATKAYVLSFTEALREELSGTKLHVTCLEPGPTETGFGEDSGMGKLDIFSSTAMTAKAVAFAGYEGYLNNEDVVIPGWKNRLMVTSAGFLPRFATRKLVGKMQSA

SEQ ID NO: 94199 - DNA, 723 bp, Chromobacterium violaceum ATCC 12472
  CDS (1)..(723): transl_table=11
atgaacaagcccctgatcgtgatcaccggcgcgagctccggcatcggcgccgccgccgccaagcggttttcccaggcaggccacccgctgctgctgctggcgcgccgcgtcgacaagctggaggcgctggaattgccgaacaccttgtgccgccgggtggacgtgagcgatggcgcccagctgcaggccgcgcaggccgaggctgaggcgcgcttcggtcctgccgacgccatcgtcaacaacgccggcgtgatgctgctgggcgcgatggccaagcaggatcccgacgagtggcagcgcatgctggacgtcaacgtcaagggcctgctcaacggcatccacgcggtgctggccggcatggtggcgcgcggccgcggcaccatcatcaacatcagctccatcgccgggcgcaagacctttcccaaccacgtggcctactgcggcaccaagttcgccgtgcacgcgatctcggaaaacctgcgcgaggaagtggccgccagcggcgtgcgggtgatcaccatcgcgccgggcgcggtggaaaccgagctcctgggccataccaccgacgaagcgatcaaggccggctaccaggaatggaagcagcagatgggcggcgtgctggaggcggatgacgtggccgaggccatcgcctacgcctacggccaaccgcagcgggtgtgcgtacgcgagatcgtgctggcggccaccgggcaatcagcctaa

SEQ ID NO: 94200 - protein, 240 aa, Chromobacterium violaceum ATCC 12472
MNKPLIVITGASSGIGAAAAKRFSQAGHPLLLLARRVDKLEALELPNTLCRRVDVSDGAQLQAAQAEAEARFGPADAIVNNAGVMLLGAMAKQDPDEWQRMLDVNVKGLLNGIHAVLAGMVARGRGTIINISSIAGRKTFPNHVAYCGTKFAVHAISENLREEVAASGVRVITIAPGAVETELLGHTTDEAIKAGYQEWKQQMGGVLEADDVAEAIAYAYGQPQRVCVREIVLAATGQSA

SEQ ID NO: 94201 - DNA, 762 bp, Porphyromonas gingivalis W83
  CDS (1)..(762): transl_table=11
atgaaccctatcgcattaatcaccggagccacatccggcatcggtgcagcttcggctcgccgcttggcatcgctcgattataaccttatcatcacgggacgacgctccgaacgtttgcaaaacattgccgatgaaatcagagctgaataccctgtcgaaatcctcccgctctctttcgatgtccgcaatcgcgaagaagtagaagcccatttgggcaatttgcctgatccttggcaggccgtttccgtcctcgtgaataatgccggcttggcagcgggactcgaccccatacagtccggtgacattgaagactgggaacgtatgatagacaccaatatcaaaggactcctctacgtaactcgcacaatcagcccgggtatgatagcccgaagcgccggccatatcatcaatatcgggtctattgccggcaaggaagtttactctaacggcaatgtctattgtgccacgaagcatgccgtagatgctctttcgaaagcgatgcgtatagatatgcttccttatggcatcaaagtcacacagatttgtcccggagcagtggagacggagttctcgctggtgcgcttccatgatgatcaggccaaggccgatgccgtgtacaagggcttcactcctctctgtgcgaacgacatagcggagtgtattgcggccgtactgaacctgcctgataatatctgtatcaacgatatggtggtcatgccgaaagcgcaggccggcagcggacactttttcaaacaagtttga

SEQ ID NO: 94202 - protein, 253 aa, Porphyromonas gingivalis W83
MNPIALITGATSGIGAASARRLASLDYNLIITGRRSERLQNIADEIRAEYPVEILPLSFDVRNREEVEAHLGNLPDPWQAVSVLVNNAGLAAGLDPIQSGDIEDWERMIDTNIKGLLYVTRTISPGMIARSAGHIINIGSIAGKEVYSNGNVYCATKHAVDALSKAMRIDMLPYGIKVTQICPGAVETEFSLVRFHDDQAKADAVYKGFTPLCANDIAECIAAVLNLPDNICINDMVVMPKAQAGSGHFFKQV

SEQ ID NO: 94203 - DNA, 762 bp, Wolinella succinogenes DSM 1740
  CDS (1)..(762): transl_table=11
atgatgaaacccgttgcccttatcactggtgcctcctctggctttggagaggcaagcgcaaggcttttggctcctcactatcgcttgattctagcggctcgccgtcttgagagactcactcatctccaagaagagcttcaagccctcaccgaggtctatcctctggagctggatgtgcgccatcaggcggatgtctctaaagcgatcgattctcttcctgattccttctctgcgattgatcttctcatcaacaacgcagggctagcactagggctagagggggcatgggagtgcgatttggaggattgggagaggatggtggacaccaatattaaaggggtgctctattgcacgcgcgcgattcttcctcagatggtggagcgcaactgcggctacatcatcaatattggctccatcgcgggcaactggccttatgcaggtggaaacgtctatggagcgaccaaagctttcatcgagcagttttcacgcaatcttcgatgcgacttagcaggcaagagaatcagggtcaccactcttaagcccggaatggcggagagcgaattctctcttgtgcgtttcaagggcgatgaagagcgcgccaaaaaggtctatgaaggaatcgagcctctcactcctgaagatattgccgcgaccattctctatctagtctcgctccctgagcggattaatgtgaatgaaattgaggtgatgccgctttgccaaagctttggccgcacgaccatcacccccgtgaaagagtga

SEQ ID NO: 94204 - protein, 253 aa, Wolinella succinogenes DSM 1740
MMKPVALITGASSGFGEASARLLAPHYRLILAARRLERLTHLQEELQALTEVYPLELDVRHQADVSKAIDSLPDSFSAIDLLINNAGLALGLEGAWECDLEDWERMVDTNIKGVLYCTRAILPQMVERNCGYIINIGSIAGNWPYAGGNVYGATKAFIEQFSRNLRCDLAGKRIRVTTLKPGMAESEFSLVRFKGDEERAKKVYEGIEPLTPEDIAATILYLVSLPERINVNEIEVMPLCQSFGRTTITPVKE

SEQ ID NO: 94205 - DNA, 741 bp, Gloeobacter violaceus PCC 7421
  CDS (1)..(741): transl_table=11
atgggggtcaaacgggtggcggtggtgacgggggcgtcggcgggcatcggtgcagcgaccgcccgggtgttggcgggcgagggtttttcggtctacggcggtgcccggcgcgtcgagcggctggaagctttggcgcgggaggcgggctgtattcccctggccctcgatgtcaccgacccggcgagtgtcgatgccttcgccgcccacctgcccgatcgggtgcatgtgctggtcaacaacgccgggggggcgctggggctcgaccgcatcgtcgagatggacgagcagcggtggcttgcgatgtaccagacaaatgtgctcgggctggtgcgggtgagcaaagcgcttttcggccgccttgaagcctccggttccgcccatgtggtcaatatcggcagcatcgcgggcctggaaacttacgtgggaggcggcggttacaccgccgtcaagcacgccgtgcgcgccatcaacgacacgatgcgcctggagtgggtgggtaaaccgattcgggtgagcgagatcgatccggggctggtggagaccgaatttagcctggtgcgcttcgcgggggacgccgagcgggccggggcggtttacgtcggcatgcagcccttgacggcggcggatatcgccgaggcggtgcgctgggtggtgagcctgccgccccacgtcaatatcgatcagatcgtcatcaaaccgctcgcccaggcgcgcgccgcgctcgtccaccggcaaagctga

SEQ ID NO: 94206 - protein, 246 aa, Gloeobacter violaceus PCC 7421
MGVKRVAVVTGASAGIGAATARVLAGEGFSVYGGARRVERLEALAREAGCIPLALDVTDPASVDAFAAHLPDRVHVLVNNAGGALGLDRIVEMDEQRWLAMYQTNVLGLVRVSKALFGRLEASGSAHVVNIGSIAGLETYVGGGGYTAVKHAVRAINDTMRLEWVGKPIRVSEIDPGLVETEFSLVRFAGDAERAGAVYVGMQPLTAADIAEAVRWVVSLPPHVNIDQIVIKPLAQARAALVHRQS

SEQ ID NO: 94207 - DNA, 756 bp, Gloeobacter violaceus PCC 7421
  CDS (1)..(756): transl_table=11
atggcacagtttaaaggaaagcgcgcctggatcacaggcgccagcagcgggattggcgctgccaccgcgttgaccctggcggagcggagggccgaagtggtactctccgcccggcgactcgacaggctcgaaagcctggccgccaaaatccgccagacagggggcaaagcgatggtccgggaactgaacgtggcggaccgggccgccgtgcaaaccctcggtcgcgagcttgaagccagtggcggagtggatattctcgtcaacaacgccgggctgatgccgctttcgcccctgctcaaaggccgggtcgacgaatgggacgcgatcgtcgacatcaacatcaaaggacttctctacgtcacccacgccgtgctgcccggcatgatcgcccgccggcacggccacatcgtcaatatcggctcggtcgccgggcaattgaccttcccggggggagccgtctactgtgacagcaaattcgcggtgcgcgccatctcggacgcgctgcgcaaggaagtgctcagttacgacattcgcgtcaccgacatccagtcgggtgctgtcgataccgaactcatcgactcggtcaaagaccccgagatcaaacaggcgcctacttcagaaggctcgttcttcgggcccgatgcccggatgctgcaggcgcaggacattgccaacgccattttgtacgcgctgagccaaccgctgcggatgaacgtttgcgagttgctggtgcgtccgctgtcccaggaattttga

SEQ ID NO: 94208 - protein, 251 aa, Gloeobacter violaceus PCC 7421
MAQFKGKRAWITGASSGIGAATALTLAERRAEVVLSARRLDRLESLAAKIRQTGGKAMVRELNVADRAAVQTLGRELEASGGVDILVNNAGLMPLSPLLKGRVDEWDAIVDINIKGLLYVTHAVLPGMIARRHGHIVNIGSVAGQLTFPGGAVYCDSKFAVRAISDALRKEVLSYDIRVTDIQSGAVDTELIDSVKDPEIKQAPTSEGSFFGPDARMLQAQDIANAILYALSQPLRMNVCELLVRPLSQEF

SEQ ID NO: 94209 - DNA, 750 bp, Photorhabdus luminescens subsp. laumondii TTO1
  CDS (1)..(750): transl_table=11
atgatcatttttgtgacaggagcaacttcaggttttggtgaatcaattgccagaaaattcattcaaaacggagctaaagttattgcgactggacgccgtaaagaacggttagaaaaattaaaagctgagctgggtgataacttttactttgttcaacttgatgtcactgatcgggccgctatcaaccaggttgtagagcaattacccgaatcactccgccatatcgatattttagtcaataatgccggtttagcgcttggattagaacccgctcatctggctaatttggatgactgggaaataatgattgataccaatgtcaaagggctcgtcaatatgacccgtgctctactgcctgaaatggtaaaaagaaatcatgggcatattattaatatcggttctaccgctgcaagctggccatattccggtgggaatgtttatggcgcaactaaagccttcgtcaaacagtttagtttgggcttacgagccgatttgcagggaaaaaatatccgagtcactgatatagaacccggcttagtgagtggcactgagttttctttagtacgttttaaaggcgacaatgataaagtgaataaaacctacgatggcacgcaagcattaaccgccgaagatgtcactgaagctgttttttgggtcgctaatttacctgctcatgtcaacattaatacattagaaatgatgccagtttgccagtcatttgccgggcttaatgtgcacagaaatgaataa

SEQ ID NO: 94210 - protein, 249 aa, Photorhabdus luminescens subsp. laumondii TTO1
MIIFVTGATSGFGESIARKFIQNGAKVIATGRRKERLEKLKAELGDNFYFVQLDVTDRAAINQVVEQLPESLRHIDILVNNAGLALGLEPAHLANLDDWEIMIDTNVKGLVNMTRALLPEMVKRNHGHIINIGSTAASWPYSGGNVYGATKAFVKQFSLGLRADLQGKNIRVTDIEPGLVSGTEFSLVRFKGDNDKVNKTYDGTQALTAEDVTEAVFWVANLPAHVNINTLEMMPVCQSFAGLNVHRNE

SEQ ID NO: 94211 - DNA, 729 bp, Corynebacterium diphtheriae NCTC 13129
  CDS (1)..(729): transl_table=11
atgtcgaatcaacatgtggttaatgagaaaaagattgcggttgttaccggtgcctcctctggcattggtgaggctgccgcgcgtgctcttgcggccgatggttggcatgtgatcgtagcggcacggcgcaaacacctgttggatgttctggctgctgatattgccggtacagcgattgaacttgatgtgacaagcgatgagtccgtggctgcgtttgcggcgcagattccgcgatgtgacctgctggtgaataacgcgggaggcgcattagggcttgatcccattgcccaagcaaaccttgaggattggcagtggatgtataacaccaacgtgttaggcacattgcgggtaacgagggctctgcttgatgcgttgagcagcagtaatggtctgattatcaacatcagttcgatcgccggtatcgcgccctatgccggtggcgctggctataacgctgcgaagttcggggtatcggccatggataaggtcatgcgcattgagttccaagaacgaggtatccgtgtggcagaaatcaacccaggtcgggtgcatactgatttttcgctggtgcggtttaaaggtgaccagcaggcagccaatgccgtctatgagggcaaggtgaatctcaccgcgggcgatattgcggaaacgatccggtgggtggcctcgttgcctacacacgtcaacattgaccggcttgtgatcaccccacaggatcaggtgatctag

SEQ ID NO: 94212 - protein, 242 aa, Corynebacterium diphtheriae NCTC 13129
MSNQHVVNEKKIAVVTGASSGIGEAAARALAADGWHVIVAARRKHLLDVLAADIAGTAIELDVTSDESVAAFAAQIPRCDLLVNNAGGALGLDPIAQANLEDWQWMYNTNVLGTLRVTRALLDALSSSNGLIINISSIAGIAPYAGGAGYNAAKFGVSAMDKVMRIEFQERGIRVAEINPGRVHTDFSLVRFKGDQQAANAVYEGKVNLTAGDIAETIRWVASLPTHVNIDRLVITPQDQVI

SEQ ID NO: 94213 - DNA, 765 bp, Geobacter sulfurreducens PCA
  CDS (1)..(765): transl_table=11
atgagcagaacggtattcatcaccggggcgtcggcggggttcggcgcggcatgcgcccggctcttcgccgacaggggagaccggctggttctggcggcccgccgggaggaaccgctcctggcgctcagggacgaattggcgccgcggacggaggtgcacgccgtcacccttgacgtgcggcggcgcaaggcggtgcaggatgcgattgaggggctgcccgacgctttcagccaaatcgacatcctcgtcaacaacgcggggctcgcgctgggactggagccggcccacgagacgaacccggacgactgggacgccatggtcgacaccaacatcaaggggctgatctactgcacccgctttctccttccgggcatggtggcccgcaaccggggacatatcgtcaacatcgggtcggtggccggttcctggccctatcccggcggcaacgtctacgggggcaccaaggcgttcgtggagcagttttcccgtaacctccgggccgatctgctggggaagcaggtgcgggtcacctgcctggcgccggggatggccgaaaccgagttctccatggtccgcttcaagggcgatgcggaacgggcggcccaggtctacgccgggacccaggccctcacggccgaggacatcgcgggcatcgtcgcctgggtgacggaactcccgccccatgtgaacgtcaacgccctggaggtcatgtcgatctatcagtcgtgggggccgctggcggtccatcgggatggggcgaactga

SEQ ID NO: 94214 - protein, 254 aa, Geobacter sulfurreducens PCA
MSRTVFITGASAGFGAACARLFADRGDRLVLAARREEPLLALRDELAPRTEVHAVTLDVRRRKAVQDAIEGLPDAFSQIDILVNNAGLALGLEPAHETNPDDWDAMVDTNIKGLIYCTRFLLPGMVARNRGHIVNIGSVAGSWPYPGGNVYGGTKAFVEQFSRNLRADLLGKQVRVTCLAPGMAETEFSMVRFKGDAERAAQVYAGTQALTAEDIAGIVAWVTELPPHVNVNALEVMSIYQSWGPLAVHRDGAN

SEQ ID NO: 94215 - DNA, 804 bp, Mycobacterium avium subsp. paratuberculosis str. k10
  CDS (1)..(804): transl_table=11
atgagccttcccaaacccgacatcgcgaccaccgtcgtcatcaccggcgcctcgtccggcatcggcgccgaactggcgcgcggcctggcccgccgtggcttcccgctgctgctggtcgcccggcgccgtgagcggctcgacgatctcgccaacgaggtgggcgggcagtactcggtcggcgtcgaggtgctgccgctggacctcggcgactcgaaggcccgtgcccggttggccggccggctgcgcagcgaatcgatcgccgggttgtgcaacagcgcgggcttcggcaccagcggggtcttccacgagctgccgatggagcgcgagagcgaagaggtcaccctcaacgcgctggcgctgatggagctgacgcacgcgacgctgcccggcatggtgtcgcggggggcgggcgcggtgctgaacatcgcgtcgatcgcgggttttcagccggttccctacatggccgtctactcggcgaccaaggcgttcgtgcagacgttctccgaggccgtgcacgaggagctgcacggcagcggggtgtcggtcacctgtctgtgtccgggcccggtgcccaccgagtgggccgagatcgccaacgccgagcggttcagcatcccgatcgcgcaggtttcgccgcgggacgtggccgaggcggcgatcggcggcatgctcaccggccgtcgcaccgtggtgccgggcgtggtgcccaaggtggtcagcacaggcggccgtttcgccccgcgcagcctgctgctgccgggcatccggatcggcaaccggttccgcggcgggcccaagcgctga

SEQ ID NO: 94216 - protein, 267 aa, Mycobacterium avium subsp. paratuberculosis str. k10
MSLPKPDIATTVVITGASSGIGAELARGLARRGFPLLLVARRRERLDDLANEVGGQYSVGVEVLPLDLGDSKARARLAGRLRSESIAGLCNSAGFGTSGVFHELPMERESEEVTLNALALMELTHATLPGMVSRGAGAVLNIASIAGFQPVPYMAVYSATKAFVQTFSEAVHEELHGSGVSVTCLCPGPVPTEWAEIANAERFSIPIAQVSPRDVAEAAIGGMLTGRRTVVPGVVPKVVSTGGRFAPRSLLLPGIRIGNRFRGGPKR

SEQ ID NO: 94217 - DNA, 750 bp, Mycobacterium avium subsp. paratuberculosis str. k10
  CDS (1)..(750): transl_table=11
atggttggaactggcaggaatgaacgcgtcgcggtggtcaccggggccagctcgggaatcggcgaggcaaccgcccgaaccctggctgcacagggctttcacgtcgtcgcggtggcgcggcgggccgagcggatccacgccctggccaacgagatcggcggtaccgccattgtggccgatgtcacagacgacgccgcggtggcggcgctggcgagcaaattgagccgggtcgacgtgctggtcaacaacgccggcggagcccgcggcctggaaccggtcgccgaggccgacctcgagcactggcggtggatgtgggagaccaacgtgatcggcacgctgcgggtcacccgcgcgctgctgcccaagctggtcgattccggcgacggactgatcgtcaccgtgacttccgttgcggcacttgaggtttacgacggcggcgccggctacacggctgcgaagcacgggcagggggcgttgcaccgcacgctgcgcggcgagctgctgggcaagcccgtgcggctgaccgagatcgccccgggcgcagtggaaaccgagttctcgctggtgcgcttcgacggcgaccaacaacgcgccgacgccgtctacaccggcatcaccccgctggtggcggccgacgtggccgaggtgatcgggttcgtcgcgtcacgaccggcgcacgtcaacctggatctgatcgtgatgaagccgcgcgatcaggcgtcggccagccggttcaaccgccgggggtag

SEQ ID NO: 94218 - protein, 249 aa, Mycobacterium avium subsp. paratuberculosis str. k10
MVGTGRNERVAVVTGASSGIGEATARTLAAQGFHVVAVARRAERIHALANEIGGTAIVADVTDDAAVAALASKLSRVDVLVNNAGGARGLEPVAEADLEHWRWMWETNVIGTLRVTRALLPKLVDSGDGLIVTVTSVAALEVYDGGAGYTAAKHGQGALHRTLRGELLGKPVRLTEIAPGAVETEFSLVRFDGDQQRADAVYTGITPLVAADVAEVIGFVASRPAHVNLDLIVMKPRDQASASRFNRRG

SEQ ID NO: 94219 - DNA, 768 bp, Bdellovibrio bacteriovorus HD100
  CDS (1)..(768): transl_table=11
atgatggcgaagtgggctttgattactggggcaagttcgggaattggctgggcaacggccgaggcgctggcagcgcaaggatttgatattttcgtgactggcagacgctatgaaaaactgcaagagctggaaaaagccatcaaagcccgtcatcccaagactcaggtgaagctggcttgttttgacgtgtccgaccgtttcgaggtcagtgaattcgtcaaagctcacaagactgaaatttctgaggtggaaattctggtcaacaacgcaggcctggctcgtggagttgaaaaaatgcaggacgcctctttggatgattgggaggtcatgatcgacaccaacatcaaaggcctgttgttcatgacccgcgccgtggtggaacacatggtgaaaaagaattccggtcatattataaatttaggctcggtggcgggtcgctggacttatccaggcggtggagtttactgcgctaccaagtttgctgtgcgtgcattgtctgaaggactgcgcatggatttgctgggcaccaaggtgcgtgtcaccaacattgaaccgggcatggtgaacacggaattttccgtggttcgcctgggggatcaggccaaggccgacaaggtctatgaaggcatgactccgctgtcggctcaggatatcgccgagacggtcgcttggtgcgcagccagaccggcccatgtgaacattcaagaactcgtgatttatcccacagatcaggcccatgtcggccaggtcgctcgcaaaggagtgtag

SEQ ID NO: 94220 - protein, 255 aa, Bdellovibrio bacteriovorus HD100
MMAKWALITGASSGIGWATAEALAAQGFDIFVTGRRYEKLQELEKAIKARHPKTQVKLACFDVSDRFEVSEFVKAHKTEISEVEILVNNAGLARGVEKMQDASLDDWEVMIDTNIKGLLFMTRAVVEHMVKKNSGHIINLGSVAGRWTYPGGGVYCATKFAVRALSEGLRMDLLGTKVRVTNIEPGMVNTEFSVVRLGDQAKADKVYEGMTPLSAQDIAETVAWCAARPAHVNIQELVIYPTDQAHVGQVARKGV

SEQ ID NO: 94221 - DNA, 723 bp, Mycoplasma mycoides subsp. mycoides SC str. PG1
  CDS (1)..(723): transl_table=4
atgaaaaaattagttgttattactggagcaagttctggaatcggtttagcttgtgctaagtatttttcaaataaaggtcatcctttattaatacttgcaagaagaaaagaattattagatgatttaaacttaccaaatactttaactgctagagttgatgttagagattttgaccaattagatcaagcaattaaacaagcagaaaatatatatggtccagttgatctattaattaataatgctggaattatgattctagaaaaatatcaagatcaaaaattagaagataaatacaatatgattgatattaacattaaaggtgttattaatggaatggatgctgttttaaaaagtatgttaaaacaaaatcatggaacaatagttaatatttcaagtgttgcagctagatatacttatactgatcattcagtttattgtggatctaaatatgccattaacgcaataactgaacaattaagaagagaactaagcaatactaatattagatttactttaattgaaccagcaattgttaacactaatttattaaatagtacaacaaataaacaagtaaaagatgattatcaaaaatcaattgatgagatcaatggtggattaaaaccagaacaaattgctcaaactatttattatgtgtattgcttaccagatgatgtgatgattcctgaattaatgattgctcacactaatgaatctgaagtttaa

SEQ ID NO: 94222 - protein, 240 aa, Mycoplasma mycoides subsp. mycoides SC str. PG1
MKKLVVITGASSGIGLACAKYFSNKGHPLLILARRKELLDDLNLPNTLTARVDVRDFDQLDQAIKQAENIYGPVDLLINNAGIMILEKYQDQKLEDKYNMIDINIKGVINGMDAVLKSMLKQNHGTIVNISSVAARYTYTDHSVYCGSKYAINAITEQLRRELSNTNIRFTLIEPAIVNTNLLNSTTNKQVKDDYQKSIDEINGGLKPEQIAQTIYYVYCLPDDVMIPELMIAHTNESEV

SEQ ID NO: 94223 - DNA, 720 bp, Mycoplasma mycoides subsp. mycoides SC str. PG1
  CDS (1)..(720): transl_table=4
atgaaaccattagttgtaattactggagcaagttctggaattggattggcttgtgcaaaatatttttcaaataaaggttatcctttattaatacttgcaagaagaaaagaaatattagataatttaaacttgccaaacacaatcacagcaaaagttgatgttagagattttaatcaattaaatgatgcaattaaaaaagcagaaaatatttatggtccagttgatttgttaattaataatgcaggaattatgccaatggatcaatatgttgatcaaagtttagaagataaatataatactttagatgtcaatattaaaggtgttactaatgggatggatgctgttttaaaaagcatgttaaaacaaaatcacggaacaatagttaatatttcaagtgttgctggaagatatacttatgctgatcattctatttataatggatcgaaatttgctgttaatgcaattacagaacaagttagaagagaattaagtgatactaatattagatttagtttaattgaacctgcaattgttgatactaatttattatcaacaactaaaaatcaaaaaattttagatagttatatagcaagaaaaaatagtttaaatggtggattaaaaccagagcaactagctgaagttatttattatatttattcattacctcaagatgtagtgattcctgaattaatgatttctcatactaatcaaaaagtttag

SEQ ID NO: 94224 - protein, 239 aa, Mycoplasma mycoides subsp. mycoides SC str. PG1
MKPLVVITGASSGIGLACAKYFSNKGYPLLILARRKEILDNLNLPNTITAKVDVRDFNQLNDAIKKAENIYGPVDLLINNAGIMPMDQYVDQSLEDKYNTLDVNIKGVTNGMDAVLKSMLKQNHGTIVNISSVAGRYTYADHSIYNGSKFAVNAITEQVRRELSDTNIRFSLIEPAIVDTNLLSTTKNQKILDSYIARKNSLNGGLKPEQLAEVIYYIYSLPQDVVIPELMISHTNQKV

SEQ ID NO: 94225 - DNA, 771 bp, Bacillus cereus ATCC 10987
  CDS (1)..(771): transl_table=11
atgaacttaggggaatttgatgggaaaactgttttagtaacaggtgcagctcaaggtataggtagtgttgttgccaaaatgtttttagaaagaggagctacagttattgcggttgatcaaaatgaagagggattaaacgaactcttaaatgaaatacatttgaaaacgttttgcttagatgtgagtgatagtaccgcagttgaacagatggtaaatgatattgaaaatgaaatagcgccaatagatatattagtaaatgttgcaggggttttacgtatgggagcgattcactcgttaagtgatgaagattggaataaaacgttttctgtaaattctacaggagttttctatatgtcccgagcagtaagtaaacatatgatgcaaagaaagtcaggggcaattgttacagttggttcaaatgcagcaaatacgccgagaatggagatggctgcatatgctgcatcaaaagctgctacgacgatgtttatgaaatgtttaggattagaacttgcagcgtacaacattcgctgtaacgtagtttctccaggttctactgaaactgaaatgcaaaggctactatgggctgatgagaatggagaaaaaaatataattgctggttctcaaagtacatatagactcggtataccgttacaaaaaattgcacagccttcagaaattgctgaagcagtattgtttttagcttcagataaagctagtcatattacaatgcataatttatgtgttgatggcggagctacattaggcgtttaa

SEQ ID NO: 94226 - protein, 256 aa, Bacillus cereus ATCC 10987
MNLGEFDGKTVLVTGAAQGIGSVVAKMFLERGATVIAVDQNEEGLNELLNEIHLKTFCLDVSDSTAVEQMVNDIENEIAPIDILVNVAGVLRMGAIHSLSDEDWNKTFSVNSTGVFYMSRAVSKHMMQRKSGAIVTVGSNAANTPRMEMAAYAASKAATTMFMKCLGLELAAYNIRCNVVSPGSTETEMQRLLWADENGEKNIIAGSQSTYRLGIPLQKIAQPSEIAEAVLFLASDKASHITMHNLCVDGGATLGV

SEQ ID NO: 94227 - DNA, 804 bp, Eremothecium gossypii
  CDS (1)..(804)
atgtccctaggaagaaaagcagctgaaagattagccaacaaaattgtgcttgtgactggtgcctctgcgggcattggccgtgctacagccattaactatgcagacgcgacggacggggcaatcaagttgattttggtggcaagacgcgcagaaaagctcaccagcttgaaacaggagatcgaaagcaagtatcccaacgccaagatccatgtcggacaattggatgtgacccaactggaccagatccgcccatttttggagggactacctgaggagttccgagacattgatattttaattaacaacgcaggtaaggccctcggcactgagagggtgggggaaatctcgatggacgatatccaggaggttttcaacactaatgttatcggcttggtgcacttgactcaggaggttctacctattatgaaagccaagaattccggggacattgtcaatgttgggtcgattgccggccgcgaagcctaccctggtggctctatttactgtgccacgaaacatgcggtcaaggctttcaccagggccatgcggaaggagctcattagcaccaagatccgggtcttcgaaattgcgccgggctctgtagaaacggaattctccatggttcgtatgcgcggtaacgaagagaatgccaagaaagtgtaccagggatttgaacccctagatggtgatgatatcgctgatacaattgtctatgccacatccagaagatccaacaccgtagttgcagagatggtcgtttacccatccgcgcaaggttctctgtacgatactcaccgcaactaa

SEQ ID NO: 94228 - protein, 267 aa, Eremothecium gossypii
MSLGRKAAERLANKIVLVTGASAGIGRATAINYADATDGAIKLILVARRAEKLTSLKQEIESKYPNAKIHVGQLDVTQLDQIRPFLEGLPEEFRDIDILINNAGKALGTERVGEISMDDIQEVFNTNVIGLVHLTQEVLPIMKAKNSGDIVNVGSIAGREAYPGGSIYCATKHAVKAFTRAMRKELISTKIRVFEIAPGSVETEFSMVRMRGNEENAKKVYQGFEPLDGDDIADTIVYATSRRSNTVVAEMVVYPSAQGSLYDTHRN

SEQ ID NO: 94229 - DNA, 768 bp, Gallus gallus
  CDS (1)..(768)
atggagcggtggaccgggcgcgtggcgttggtcaccggcgcctcggtgggcatcggcgcggccgtggcgcgggcgctggtgcagcacggcatgaaggtggtggggtgcgcccgtagcgtggacaagatcgagaaattggcagctgaatgccagagtgccggctaccctgggaccctcattccgtacaagtgtgatctctccaatgaagaggagatcctgtccatgttctctgccatcaagacccttcaccagggagttgatgtgtgcatcaacaacgcagggctggctcgcccggagcctctgctctcagggaagacagaaggctggcggacaatgatagacgtcaacgtgatggctgtgagcatctgcacccgagaggcctatcagtccatgaaggagagaaacatcgatgacggtcatattattaacattaacagcatgaatggtcacagcgttgtgccacagtcggtggtgcatttttacagtgccaccaagtatgcagtcacggccctcacagaggggctgaggcaagaactcagagaagcaaagactcatatacgagctacatgtatatctccaggactggtagaaacgggatttgcttttaaacttcatgataatgaccctgagagagctgctgcaacctatgagagcattcggtgtctcaaagctgaagatatggctaatgctgtcatatatgtccttagtgccccacctcatgtacagattggagatatacagatgaggcccacggaacaaatatcatag

SEQ ID NO: 94230 - protein, 255 aa, Gallus gallus
MERWTGRVALVTGASVGIGAAVARALVQHGMKVVGCARSVDKIEKLAAECQSAGYPGTLIPYKCDLSNEEEILSMFSAIKTLHQGVDVCINNAGLARPEPLLSGKTEGWRTMIDVNVMAVSICTREAYQSMKERNIDDGHIININSMNGHSVVPQSVVHFYSATKYAVTALTEGLRQELREAKTHIRATCISPGLVETGFAFKLHDNDPERAAATYESIRCLKAEDMANAVIYVLSAPPHVQIGDIQMRPTEQIS

SEQ ID NO: 94231 - DNA, 741 bp, Anopheles gambiae str. PEST
  CDS (1)..(741)
atggaccgctggatcggaaaggtggcgatcgtaaccggtgcaagctcgggcattggtgcaacggcagtgaaagctctagccaccgccggcatggtcgtgatcggactggcacgccgtgccgagcgtgttctggagctgaagaaaactgtcccaccggaagtggcacaccgaatacactcccaccgctgtgatgtgaccagtgagcaatcgatagtggacgcttttgcgctgatcgatcatcagtttggcggtgtggacgtgctgatcaacaatgccggtgtgtcgaaactgacctgcacgctgctgacggcgggcaatggggcagacttacgcacggtactggacacgaacgtgatgggtctggtgctgtgcagtcgcgaggcattccagtcgatgaagcgtcgctcgatcgatggccatatcgtgaacattaacagcatcctcggccacaagtacatcggctttccgaacctaaacatctacggtgcatccaagtatgccgttaccgcgataacggaaacgttgcgcaatgacctgcgcaacgaaggtacgcgggtgaaggttacgagcatcagcccgggcatcgtgcggacggagatggtcccggagggtgaccagtttcaagatacgcccatgctggaggcggacgatgttgtcggtgcgattctgtatgcgctcgggacgcctcctcatgtgcaggtgcacgaggttatcatcaagccggtgggcgaaatgaattga

SEQ ID NO: 94232 - protein, 246 aa, Anopheles gambiae str. PEST
MDRWIGKVAIVTGASSGIGATAVKALATAGMVVIGLARRAERVLELKKTVPPEVAHRIHSHRCDVTSEQSIVDAFALIDHQFGGVDVLINNAGVSKLTCTLLTAGNGADLRTVLDTNVMGLVLCSREAFQSMKRRSIDGHIVNINSILGHKYIGFPNLNIYGASKYAVTAITETLRNDLRNEGTRVKVTSISPGIVRTEMVPEGDQFQDTPMLEADDVVGAILYALGTPPHVQVHEVIIKPVGEMN

SEQ ID NO: 94233 - DNA, 741 bp, Anopheles gambiae str. PEST
  CDS (1)..(741)
atggatcgttggactggccgggtggccgtcgttaccggtgccagctccggtattggtgcggccgtagtgaaatcactcgccaacgcgggcatgatcgtgatcggcctggcaaggcgtgtcgaacgggtggaggaactgcgccaacagctctccgaacaggccgcccaacggctgcacgcgatccggtgtgatgtaacgcgggaagaagatatagtggccgctttcgaccaaatcgagcagcagtacggtggtgttgatgtgttgatcaacaatgctggtattgcgcggggtggaatcaatctgttcacaccgggcaataccgatccgctgcgccaggtactcaatacgaacgtaatgggtgtggtgctgtgcagccgcgaagcgttccaatcgatgaagcgccgctcggtcgatggacacatcgtgcaggtgaacagtgtggtaggccatacggtgcccgcgttcgctagcttcaacatctatccggcgtccaagtttgcggtgacggcgctgacagaatcgatgcgccatgagttgcggatagagggaacgcgcatcaaagtgacgagtattagtccgggactggtcaggacggaggcggtccctagtgagctgaaaacgggccagacaccaatactggaaccggaggatattgcggatgccgtgctgtacgtgctgggcaccccgccgagggtacaggtccatgagcttaccattagacccgttggtgaaatgatgtga

SEQ ID NO: 94234 - protein, 246 aa, Anopheles gambiae str. PEST
MDRWTGRVAVVTGASSGIGAAVVKSLANAGMIVIGLARRVERVEELRQQLSEQAAQRLHAIRCDVTREEDIVAAFDQIEQQYGGVDVLINNAGIARGGINLFTPGNTDPLRQVLNTNVMGVVLCSREAFQSMKRRSVDGHIVQVNSVVGHTVPAFASFNIYPASKFAVTALTESMRHELRIEGTRIKVTSISPGLVRTEAVPSELKTGQTPILEPEDIADAVLYVLGTPPRVQVHELTIRPVGEMM

SEQ ID NO: 94235 - DNA, 738 bp, Anopheles gambiae str. PEST
  CDS (1)..(738)
atggatcgttggaacggtaaggtagcggtagtgacgggcgccagttccggcatcggggccgagattgccaaagatctggccaaagccggcatgattacgatcggactggcccggcgtgtcgagcgagtcgaacagctgaagcagcagctgccgaaggaagcggccaaccggcttcacgcaatgaagtgtgacgtttcgatcgaaaccgacatcgagcggacgttccagcgcatcgcggacacgtacggtggggtggacgtgctggtaaacaatgccggcatcgtgcgccagaacaatctgctcgacctcggtacggcggccgatctgcgcgccgtgctggacacgaacgtgacggggctggtgctgtgcagccagtgggcctacaagtcgatggtggaccggaaggtggatgggcacattgtgcacatcagcagcattgccggccacagtgtgccgaacttcccgaagcttaacatctaccccggtacgaagcatgcggtgcgcgcgatcacggaaacgatgcgccacgagatgcgggacgctggcacgaagattaaggtgacgagcgttagccctggtgcagtgaagacggaaattctggacggtgttcctattccggaagaaatgccattgctcgaggcggaagacatctcggcggccgtactgtacgccatcggcacaccgccccacgtacaggtgcacgagctcatcatcaagccggttggggaagtcatgtag

SEQ ID NO: 94236 - protein, 245 aa, Anopheles gambiae str. PEST
MDRWNGKVAVVTGASSGIGAEIAKDLAKAGMITIGLARRVERVEQLKQQLPKEAANRLHAMKCDVSIETDIERTFQRIADTYGGVDVLVNNAGIVRQNNLLDLGTAADLRAVLDTNVTGLVLCSQWAYKSMVDRKVDGHIVHISSIAGHSVPNFPKLNIYPGTKHAVRAITETMRHEMRDAGTKIKVTSVSPGAVKTEILDGVPIPEEMPLLEAEDISAAVLYAIGTPPHVQVHELIIKPVGEVM

SEQ ID NO: 94237 - DNA, 3843 bp, Magnaporthe grisea 70-15
  CDS (1)..(3843)
atgacggtccttgatatgaacaaggacctggcggcgctgttctgcaaacaggcagccgcgacgcctgacgctgtagctctggaagacgagaccacgacattgacgtatgcggagctggagaggcaaaccggccttcttgccaaccgcttgcgacaacagggtgttggcagagacagcctcgtcggcgtgctgctgggacgcagcgccgactacgtcattgcctgtctcgccgccctccgcgcgggcggtgcattcctggtcctcgaactcgcatatcctcctcagcttctctgtgatgttattgacgacgccaacccaaccgttgtggtaactcacagagcccacgccggtttgatcaagcctgaaattccccttgtggttcttgacgagcccaacgctacccctgaggactctgcacaacctactggcgatgccaaccaagaattgcctgccgacgatgacctcgaccgccttgcattcgtgtgctacacatcaggcacgacagggcgtcctaagggaatcgccaacccgcacagggcccctgttcgctcttacagcttaagattcgagctgagtgatctcaagccgggcgaccgcgtggcgtgcaatgtcttcttcatctgggagatactgcgtcctctgctgcgaggagctaccgttgtggccgtgcccgacaacgtgagctacgacccagttgctcttgtcgatttgttagcatctcggaaaattaccgagacactgatgacgccgactctcctggccacagtcctctctcggcactcgaagcttggagaccgccttcccgacctgcgcacactctggttgaatggcgaggttgtcatggcggatctggcgcgccgcaccctcagtgcacttcccaacacccggttgctgaactgctacagcgccagcgaaacgcacgaaatcgcctgtggcgacattagggagatgctcaccgaggacgcctccgtctgtcccgttgggcctcctctggatcccaagcatacctacatcctcgacgaaaatttccagaaagtcgagcctggctctagtggcgagcttttcctcggtggccatctccttgcccggggttatctcaacctgcccgaaaccacagccaaatcattcctacccgatgccttcgacctggccccaggtgctcggatgtaccgaactggcgatctggccagaatcctcccctcgggcttgttggagatcacaggtcgagtcggaggcatgataaaagtacgcggctacagcgttcagcctggagcagtggagagcgttgtgatgaagcatctggccgtcaggcactgcgcagtggtctcccatggggagggcctcaagcgccagctggtttcctattttgtcagagacaaggaaaatcccggtgaccgtgtcgaccctatcgtgcaagagtcaggttacagccctgtggcccggaagacgttgtcggcccatctcgcccactacatgattcctgcgctgtggatcgaactgactgagctgcccacgcatgaggtttcagggaagattgacctcaaaagactacctggaccatcagggagcaagacaaatggcaacgggcgtcagcaggagcgcaataaggaagtcaaggtggaaaccatcatccagaactgggctgcctcattggatctccctcccagtgttattacaccggagcatgacttctttgatcttggaggtcactccttggctctggctgacctggcgcgtcgtctctccgatgcctttgggtttccggtgccggtggctcgcctcgccggacgaccgacccttgacggccatgtggaagtcgtccgcgctgcacgcgatggccacactgcggccatccaggccgacctacctgcggtcctcaaggctgattccatccttcccgatgacatcaagcctactaaaaccgccatgtgcccgctgaatgaggctaagactatcctgctcaccggtgtgactggctatcttggcgcgttcctcctgaagtctttgatagagaacacatctgctcgcattctttgccttgtccgttttgctcgaccttcccacggcacggaatcccgcggtatggcgagaattcgccaaaacctccttgacctgggcatatgggatccgtccatcatggatagagttgaggtggtgcccggaaacctgggtcgaaagggcctcgggctctctgacgaggactttaatgagttggcttccgacctcgacgtgattattcacgctggcgccactgtcaacttggtgtacccctacgcagccatgcgcactgccaacgtcggtggcaccaaggagatcctgcgactcgcgagccgaagcggtgcgactgttcaccatgtctcgactaacggtgtgcttccaccgtcctcggaaggctggtcagaggatacgatcttggacgtggaagaagtcgcagagaagctcctggacggttacggccataccaagtgggttgctgaacaactcgtacttgaggctggccgacgaggcttgcctgtgaagatctaccgccccggtacaatcagtggtcatagtgttctgggatcgaccaacacgtatgatcttctgacggcactgttcgttgaatcgatccacctcggtcacgcgcctgatatcccgaattggcttgcagagatgacgccggtggactttgtgagccaagccatcatcactctgtccaaccatgttgatactgatcagaaaatctaccatatcggagaccccaagccggtgacggccacggagcttcttgacgatctggctggtctcggatatccaaccgacctgatgggctgggatgaatgggtcgcaaactggaacgagaggagagggaaccccggtactagtggcgacgattccttcactgctggcattcttcgccgtggtatgcccgaggtcgagttccttcgagccgtcacagtcctaaacgatgcaaagacgcagtcagtgctagatctttacgacgttaagcgcccgaagatcgacagcaaattgttcgagacgtacactcgcgattggtacgcccgcggttggctttcccatccgcctcgtcgtgatggtgtggcgctccgcgtccgggccaagggacctctatctggcaaggtggccgtcgtcactggagcgtcgtcaggaatcggtgctgctgtggctactgctctgagcaaggaaggtgtccatgtggctcttgcagctcgacgaacagaagccctcgatgccctgaaggcaaagatcgccacgaacggaaccaaggtgatcgtccacaagacggatgtcaccgacaaagctcaggttgagtcgctcatcaagacggccagcgaggagctgggacctgttgatatccttgtcagctgtgcaggcgtcatgtacttcaccatgatggccaatgtgcagacggacgagtgggagcgcacggtcgacgtcaattgcaagggattgcttcactgtctttcgtctacagttccgtcaatgctttctcgtggcaaggggcacatcgtcgccatttcgtctgacgccggcagaaaggtgttccctggacttggcgtctattcggccagcaagttcttcgttgaggctacgctgcagagtcttcgtgtcgagacggccggcactgggctccgggtaacatctgtccagccaggtaataccgcaacggaacttctcggcatgtcaacggatcaggaggccatcaagaagtatggtgagccaacgggggccaaggttctcgacgccgaggacgtggccaactcgatcgtgtatgcgctgcgccagcccgagcatgtggctgtcaacgaggtcttgattgagccccgcgacgaacccatctag

SEQ ID NO: 94238 - protein, 1280 aa, Magnaporthe grisea 70-15
MTVLDMNKDLAALFCKQAAATPDAVALEDETTTLTYAELERQTGLLANRLRQQGVGRDSLVGVLLGRSADYVIACLAALRAGGAFLVLELAYPPQLLCDVIDDANPTVVVTHRAHAGLIKPEIPLVVLDEPNATPEDSAQPTGDANQELPADDDLDRLAFVCYTSGTTGRPKGIANPHRAPVRSYSLRFELSDLKPGDRVACNVFFIWEILRPLLRGATVVAVPDNVSYDPVALVDLLASRKITETLMTPTLLATVLSRHSKLGDRLPDLRTLWLNGEVVMADLARRTLSALPNTRLLNCYSASETHEIACGDIREMLTEDASVCPVGPPLDPKHTYILDENFQKVEPGSSGELFLGGHLLARGYLNLPETTAKSFLPDAFDLAPGARMYRTGDLARILPSGLLEITGRVGGMIKVRGYSVQPGAVESVVMKHLAVRHCAVVSHGEGLKRQLVSYFVRDKENPGDRVDPIVQESGYSPVARKTLSAHLAHYMIPALWIELTELPTHEVSGKIDLKRLPGPSGSKTNGNGRQQERNKEVKVETIIQNWAASLDLPPSVITPEHDFFDLGGHSLALADLARRLSDAFGFPVPVARLAGRPTLDGHVEVVRAARDGHTAAIQADLPAVLKADSILPDDIKPTKTAMCPLNEAKTILLTGVTGYLGAFLLKSLIENTSARILCLVRFARPSHGTESRGMARIRQNLLDLGIWDPSIMDRVEVVPGNLGRKGLGLSDEDFNELASDLDVIIHAGATVNLVYPYAAMRTANVGGTKEILRLASRSGATVHHVSTNGVLPPSSEGWSEDTILDVEEVAEKLLDGYGHTKWVAEQLVLEAGRRGLPVKIYRPGTISGHSVLGSTNTYDLLTALFVESIHLGHAPDIPNWLAEMTPVDFVSQAIITLSNHVDTDQKIYHIGDPKPVTATELLDDLAGLGYPTDLMGWDEWVANWNERRGNPGTSGDDSFTAGILRRGMPEVEFLRAVTVLNDAKTQSVLDLYDVKRPKIDSKLFETYTRDWYARGWLSHPPRRDGVALRVRAKGPLSGKVAVVTGASSGIGAAVATALSKEGVHVALAARRTEALDALKAKIATNGTKVIVHKTDVTDKAQVESLIKTASEELGPVDILVSCAGVMYFTMMANVQTDEWERTVDVNCKGLLHCLSSTVPSMLSRGKGHIVAISSDAGRKVFPGLGVYSASKFFVEATLQSLRVETAGTGLRVTSVQPGNTATELLGMSTDQEAIKKYGEPTGAKVLDAEDVANSIVYALRQPEHVAVNEVLIEPRDEPI

SEQ ID NO: 94239 - DNA, 807 bp, Magnaporthe grisea 70-15
  CDS (1)..(807)
atgtcagccaccgcaatggggaagcgcctcgagggcaagacaatcgtcatcaccggagcttcatccgggatcgggcgcagctgtgcctttgagtttgctcgcaccagccccaagagcttgaagctggtcctgactgctcgccgcatcgacacgctcaaggagattgccaaggagataaatgctgaggtcggcgagggcgtcaaggtgttgccattccagctcgacgtcagcaaaccggatgaggtccgtgggtttgtccaggcgctgcccgaggagttccgggatattaatgttctcgtcaacaatgcgggtctggtgaaaggagttgcacaggctcctgcgatcgccgaggaggatataaacatcatgatggcgaccaatgtaacgggtctcatcaacatgacgcaggccgtgcttgccgtctacaaaaagcgacctgaaggaggtgctggcgatattatcaacatcggtagcattgctggtcgtgagccatacgccggcggtagcatatactgcgcaaccaaggctgcggttcggagctttagtgattcgttgcgaaaggagttggtagccactcggatccgggttatggagatcgatccgggtcaagttgaaaccgagttttctgttattcggttttatggtgacaaggcaaaggcggatgcagtctatgctggttgtgaccctctcacgccagatgacatcgccgaggtggttgtgttcgtcgcaggacggagagataacgtcgttgtagccgatactctcatctttcctcagcaccaggcaagttgtaaccttattatctga

SEQ ID NO: 94240 - protein, 268 aa, Magnaporthe grisea 70-15
MSATAMGKRLEGKTIVITGASSGIGRSCAFEFARTSPKSLKLVLTARRIDTLKEIAKEINAEVGEGVKVLPFQLDVSKPDEVRGFVQALPEEFRDINVLVNNAGLVKGVAQAPAIAEEDINIMMATNVTGLINMTQAVLAVYKKRPEGGAGDIINIGSIAGREPYAGGSIYCATKAAVRSFSDSLRKELVATRIRVMEIDPGQVETEFSVIRFYGDKAKADAVYAGCDPLTPDDIAEVVVFVAGRRDNVVVADTLIFPQHQASCNLII

SEQ ID NO: 94241 - DNA, 816 bp, Gibberella zeae PH-1
  CDS (1)..(816)
atgtcatccgcagtttctaaacgcctcgaaggcaagactgttctcatcaccggagcatcttccggcattggaaagtccacagcgtttgaatttgcccgcacaagccccaagaacttgaagctggttcttacagctcgtcgaatcgacagcctcaaacaaattgctgaagaaattgtcaaagaagtcggcgatggcgttaaggtgcacccagttcaacttgatgtcagcaagcctgatgaagtgcgctcttttgtgagcaagcttcctgctgagttcagcgagattgatgtgttggtaaacaacgccggtcttgtcaagggtgtcgacaaggcacctgagatcaaggaagaggatatcaacgtcatgttcgctactaatgttacgggcttgatcaacatgacacaagctatcttgcccggtatgctcaagcgcaacaacggcgaaggggctggcgacatcatcaacattggttccattgctggccgcgagccttatcccggcggcagcatttactgcgctaccaaggccgctatccattccttcacagagagtctgcgcaaggagcttatttcaaagcgtgtccgtgtgatcaggattgatcctggtcaggtagagactgagttctccgttgtgagattctacggcgacaagtcaaaggccgatgccgtatatgccggctgtgagcccttgacaccggatgatattgctgaggccattgtctttgctgctggcagaagggaaaatgttgtcattgcggatacgttgatattccccaaccatcaggctgcggcaaccgtcatgcacaggaagtcatag

SEQ ID NO: 94242 - protein, 271 aa, Gibberella zeae PH-1
MSSAVSKRLEGKTVLITGASSGIGKSTAFEFARTSPKNLKLVLTARRIDSLKQIAEEIVKEVGDGVKVHPVQLDVSKPDEVRSFVSKLPAEFSEIDVLVNNAGLVKGVDKAPEIKEEDINVMFATNVTGLINMTQAILPGMLKRNNGEGAGDIINIGSIAGREPYPGGSIYCATKAAIHSFTESLRKELISKRVRVIRIDPGQVETEFSVVRFYGDKSKADAVYAGCEPLTPDDIAEAIVFAAGRRENVVIADTLIFPNHQAAATVMHRKS

SEQ ID NO: 94243 - DNA, 819 bp, Gibberella zeae PH-1
  CDS (1)..(819)
atggcttcagctgctgccaaacgtctcgccggcaagaccatccttgtcactggtgcctcctccggcatcggacgttccactgctctcgagtttgcccgaactgcgcccaagaatgacctacgtctcattctcactgcgcgccgtgttgactccctcaaggagcttgccgagaagatcaagagcgaagtcggtgatggcgttcaggtccttccgttcaagcttgatgttagcaaccctgccgaagtgaagggtatcgtaaacaacttgcccgaagagtggaggaacatcgatgttcttgttaacaatgcaggccttgtcaagggcgtggctcgggctccagaaatcgctgaggaggatatcaacatcatgttccagacaaatgtcaccggtcttatcaacatgacccaggccatcctccctatcttccttgcccgacctgacggcggccatggcgacatcatcaatgtgggttctatcgctggtcgagaaccctaccctggcggtggtatttactgcgccaccaaggctgctgtccgcagcttcactgagagcttgcgaaaggagctcattgccagccgcgttcgtgtcattgagattgaccccggccaagttgagactgagttctccgtggtgcgattctatggtgacaagtcaaaggccgatgcagtctatgctgggtgcgaacctcttacacccgaagacattgctgaggtcgtcgtgtttacggccacccgtcgggagaacgttgttattgctgatacactagttttccccagtcatcaggctggtgccggttccatgcatcgaaagggggcatag

SEQ ID NO: 94244 - protein, 272 aa, Gibberella zeae PH-1
MASAAAKRLAGKTILVTGASSGIGRSTALEFARTAPKNDLRLILTARRVDSLKELAEKIKSEVGDGVQVLPFKLDVSNPAEVKGIVNNLPEEWRNIDVLVNNAGLVKGVARAPEIAEEDINIMFQTNVTGLINMTQAILPIFLARPDGGHGDIINVGSIAGREPYPGGGIYCATKAAVRSFTESLRKELIASRVRVIEIDPGQVETEFSVVRFYGDKSKADAVYAGCEPLTPEDIAEVVVFTATRRENVVIADTLVFPSHQAGAGSMHRKGA

SEQ ID NO: 94245 - DNA, 999 bp, Ustilago maydis 521
  CDS (1)..(999)
atgtcattcattgccgtctcacgaaacgcatttcgaatcgttccccaagccggcgcctctgcacgacgtcttgctatccctttgtcaagtcgcatcagttgtgctcgagcgcttgcttcgtcctcaatcgtcagaactagttctacctcgtcatcgtctggacctgatcgcatctttccgagcatgacgaccgtgtttcctacgcagcgtttgcacaacaagacggtgcttgtcacgggtgcctcaggcgggattggcaaggagaccgccatcctgttcgcgcgcgctgggtgcaatgtgattcttaccgcacgtcgagcggaagagctcgctgtcgccgccaccgaatgctcgctcgccaatcagcaaggccagacgggcgcgggcggaaactttgtcgccatcacactcgacatgcgcgaccgcagccagctcgacggcctgctctcctcactccctgactgggccaaagacattgacatcctggtcaataatgccggtctcgtcctcggcactgacaaagtcggcgacatctcgcccgacgaaatcgacgtcatgatcgacaccaacgtcaaaggtctcatccaccttacacagatttttgtgcgagaattcaaaaaacgcaactcgggccatatcatcaatctcggcagcatcgccggtagagaaggctacccgggaggctccatctactgcgccaccaagtttgcggtaaatgccttcacttcggcgctgttgaaggagctcgtggatacgccgatccgagtcaccgagattcagccaggcatggtcgagaccagcttcagcgtgaccagattccgaggcgacaagaacgccgccgataaggtgtaccagggtctgcaaccgctcagtggacaggacatcgctgaagaaatcgtctgggccgccaacaggccgccgcatgtcaacattgccgagacgctcgtcttccctgtcaaccaggccagtccgtaccatgcttaccgtggaggaaaatag

SEQ ID NO: 94246 - protein, 332 aa, Ustilago maydis 521
MSFIAVSRNAFRIVPQAGASARRLAIPLSSRISCARALASSSIVRTSSTSSSSGPDRIFPSMTTVFPTQRLHNKTVLVTGASGGIGKETAILFARAGCNVILTARRAEELAVAATECSLANQQGQTGAGGNFVAITLDMRDRSQLDGLLSSLPDWAKDIDILVNNAGLVLGTDKVGDISPDEIDVMIDTNVKGLIHLTQIFVREFKKRNSGHIINLGSIAGREGYPGGSIYCATKFAVNAFTSALLKELVDTPIRVTEIQPGMVETSFSVTRFRGDKNAADKVYQGLQPLSGQDIAEEIVWAANRPPHVNIAETLVFPVNQASPYHAYRGGK

SEQ ID NO: 94247 - DNA, 816 bp, Aspergillus nidulans FGSC A4
  CDS (1)..(816)
atggcttccgcaatggcaaagcgccttgagggcaagacaatcgtcatcactggcgcctcgtcaggcattggccgaagcacagccagggaattcgcgcggacagctccaaaggaccttaagcttattgtgacagcaaggcgcatcgacgccctcgaggagctggcaaaggagattaaagaggaagtcggcgagggtgtcaagaccctgcccgtgaagctcgatgtcagtaacccggaggaggtcaagaactttgtcccatctctccctgccgagttccaggatattgacatccttgtcaacaatgctggtctcgtcaaaggcgtcgctcaagcccccaacatcgaccctgaagatatcaacatcatgttcgcaacaaacgtcactggattgatcaacctcacccaagctgtcctgcctattttcaagaagcgtagcgatggcggccgtggagacatcatcaatattggaagcatcgctggtcgtgagccctaccccggcggtagcatctactgctctaccaaggctgcggtcaagtcattcaccgaagccctgaggaaagagctcatctccacgcgcatccgcgtcattgagatcgaccccggtcaagtcgagactgagttctctattgttcggttctacggagacaagagcaaggccaatgccgtctatgctaactgcgagccacttacaccggacgatatcgccgaggtcatcgtcttcgccgctggtcggagggagaacgttgtcattgctgatactttgatcttccccagccaccaggcgtctcccggtcatctgtacaagaagcctcaataa

SEQ ID NO: 94248 - protein, 271 aa, Aspergillus nidulans FGSC A4
MASAMAKRLEGKTIVITGASSGIGRSTAREFARTAPKDLKLIVTARRIDALEELAKEIKEEVGEGVKTLPVKLDVSNPEEVKNFVPSLPAEFQDIDILVNNAGLVKGVAQAPNIDPEDINIMFATNVTGLINLTQAVLPIFKKRSDGGRGDIINIGSIAGREPYPGGSIYCSTKAAVKSFTEALRKELISTRIRVIEIDPGQVETEFSIVRFYGDKSKANAVYANCEPLTPDDIAEVIVFAAGRRENVVIADTLIFPSHQASPGHLYKKPQ

SEQ ID NO: 94249 - DNA, 807 bp, Aspergillus nidulans FGSC A4
  CDS (1)..(807)
atgtacaccgcaaaacgtctctccggcaaaaccatcctcataacgggtgcctcctcagggatcggccgttcgacagccctcgaattcgcacgcagctcgcccgacaatctcaaactgatcctgacggcgcggcgcattgacagactccgagaactggcaagtgaaatcacaagcgagcgtccgggagtgaaagtttacccgatccatctggacgtaagcaatccagaggaagtcaacgggctactcggaactctgccgagcgagttcaaagaggttgatgttttggtcaacaatgcaggcttggtcaagggtgtcgcccgcgcccctgaaattgctgaagaggacatagccaccatgttctccacgaacgtccacggcctcataaatatgacccaagcaatcctcccttccatgctatcgcgcaacaacgggcagggagcaggagatatcatcaacatcggctccatcgctggccgcgagccctacgtgggtgggagtatttactgcgcgacgaaagccgccgtgcgcagctttacggaggctctgcgcaaggagctcattgcatccagggtgaggattattgcagtagaccccgggcaggtcgagacagagttttcggttgtgaggttttatggggataagagtaaggcggatgcggtctatgcaggatgcgagccgttgacgccggatgatattgcagaggtgatagtgttcacggcgagtaggagagagaatgctgttgtggcagatacgttggtttatcctaaccatcaggcgagtgcgactatcatgcatcggaagaattga

SEQ ID NO: 94250 - protein, 268 aa, Aspergillus nidulans FGSC A4
MYTAKRLSGKTILITGASSGIGRSTALEFARSSPDNLKLILTARRIDRLRELASEITSERPGVKVYPIHLDVSNPEEVNGLLGTLPSEFKEVDVLVNNAGLVKGVARAPEIAEEDIATMFSTNVHGLINMTQAILPSMLSRNNGQGAGDIINIGSIAGREPYVGGSIYCATKAAVRSFTEALRKELIASRVRIIAVDPGQVETEFSVVRFYGDKSKADAVYAGCEPLTPDDIAEVIVFTASRRENAVVADTLVYPNHQASATIMHRKN

SEQ ID NO: 94251 - DNA, 807 bp, Candida glabrata CBS138
  CDS (1)..(807)
atgtctcaaggaagaaaagctgctgagaggttacaagggaagattgcctttattacgggtgcctctgcgggcatcggtaaagctacagccattgagtatttggatgcttccaatggtagtgtgaagctagttcttggtgcacgtagaatggagaaattggaggagttgaagaaggaattgctggctcaatatcctgatgcaaagattcatataggtaaactggatgttacagactttgaaaacgtcaagcagtttttggctgacttgccagaagagttcaaggacatcgacatcctgatcaataacgctggtaaagcgttggggtctgacaaagttggagacattgaccctgaggatatcgcaggaatggttaacaccaacgtccttgcattgatcaatttaacacaattgttgttgccattattcaagaagaagaacagtggtgatatcgtcaacttgggatcgattgctggtagagacgcatacccaacgggtgctatatactgtgcaacaaaacatgctgtcagggcattcacacaatccttaaggaaggaattgatcaacaccgacattagagtaattgaaattgctcctggtatggtcgaaaccgagttttctgtggtcaggtacaaaggtgacaagtccaaagcagacgacgtctacagaggtacaacaccactatatgccgatgatatcgcggatttgattgtgtactctaccagcagaaagccaaacatggtggtagcagatgtcctggtcttcccaacacaccaggcatcggcttcgcacatctacaggggcgactaa

SEQ ID NO: 94252 - protein, 268 aa, Candida glabrata CBS138
MSQGRKAAERLQGKIAFITGASAGIGKATAIEYLDASNGSVKLVLGARRMEKLEELKKELLAQYPDAKIHIGKLDVTDFENVKQFLADLPEEFKDIDILINNAGKALGSDKVGDIDPEDIAGMVNTNVLALINLTQLLLPLFKKKNSGDIVNLGSIAGRDAYPTGAIYCATKHAVRAFTQSLRKELINTDIRVIEIAPGMVETEFSVVRYKGDKSKADDVYRGTTPLYADDIADLIVYSTSRKPNMVVADVLVFPTHQASASHIYRGD

SEQ ID NO: 94253 - DNA, 807 bp, Kluyveromyces lactis NRRL Y-1140
  CDS (1)..(807)
atgtctcaaggtagaaaggctgctgaaagattgcaaaacaagacaattttcattaccggtgcttctgcaggtattggtcaagccacagcattggaatatctagatgctgctaacggtaatgtcaaattgatcttagcagcaagaaggttggctaagttggaagaattgaaggaaaaaatcaatgctgaatacccacaagctaaagtatatatcggtcaattggacgtcactgaaactgagaagattcaacctttcattgataacttgccggaagaattcaaggatatcgatattttgattaacaatgccggtaaagctttgggatctgatgttgtcggtaccatcagtagcgaggacatcaaaggtatgatagatactaacgttgttgcccttatcaacgttacccaagctgttttgcctattttcaaagcaaagaattccggtgacatcgttaacttaggttctgttgccggtagagatgcatatccaactggttctatctattgtgcttcgaagcatgctgtcagagcgttcactcagtctttgagaaaagaattaatcaatactggtattagggtcattgagattgctccaggtaatgtcgaaactgagttctctctagttagatacaagggtgatgccgatcgtgctaaacaggtttacaaaggtactactcctctatatgcagatgacattgctgacttgatcgtttatgccacttcaagaaaacctaatactgtcatcgctgatgttttggtatttgcttccaaccaagcatctccttaccacatttaccgtggcgaatag

SEQ ID NO: 94254 - protein, 268 aa, Kluyveromyces lactis NRRL Y-1140
MSQGRKAAERLQNKTIFITGASAGIGQATALEYLDAANGNVKLILAARRLAKLEELKEKINAEYPQAKVYIGQLDVTETEKIQPFIDNLPEEFKDIDILINNAGKALGSDVVGTISSEDIKGMIDTNVVALINVTQAVLPIFKAKNSGDIVNLGSVAGRDAYPTGSIYCASKHAVRAFTQSLRKELINTGIRVIEIAPGNVETEFSLVRYKGDADRAKQVYKGTTPLYADDIADLIVYATSRKPNTVIADVLVFASNQASPYHIYRGE

SEQ ID NO: 94255 - DNA, 792 bp, Debaryomyces hansenii CBS767
  CDS (1)..(792)
atgaacaataaaatagagtttgctttaattaccggtgcatcaaacggaattggtctagaattatcacgagtttttgctaaaaataattatggtataattgcagttgctaggaatagggacaatttagaaattttaaagaatgaattacaaaactacggttctgaagtacacgttttggtcgccgatttaagtgatttcaatgaaatcaaaaaagtcgaggcagaagttgaaaaccataagtggaatattgatactatagtgctcaatgctggacaaggattagggggtgatttcatagaacatactgatttagaagcagaattgaaactaatacgtttaaatgttgattcttatgtccacttatcaaaaatatttttccctaaattgattgaaagaggtagggggagcgttttaatgacttcatctgtttctggtacaactcctattccttatgaagctgtctatggagcgacaaaggcatttgtgaattcatttttctgggctgttcgaaatgaacttaaggggaaaggcataaatatgactctacttatgccgggagcaacggaaacaaacttttttataaatgctggccttggagaaacaactattggatctggtgaaaaggatgatgcaagagatgtcgctgaaagagcatggtatgcattacagagcggacatgaatatgtttatggtagcgagaaagcagagtatgaaggtgatgttttaaatagaattcaaagcgagctgcaaaaagcacagaggcatcggattgtctctgagcctaagaaatga

SEQ ID NO: 94256 - protein, 263 aa, Debaryomyces hansenii CBS767
MNNKIEFALITGASNGIGLELSRVFAKNNYGIIAVARNRDNLEILKNELQNYGSEVHVLVADLSDFNEIKKVEAEVENHKWNIDTIVLNAGQGLGGDFIEHTDLEAELKLIRLNVDSYVHLSKIFFPKLIERGRGSVLMTSSVSGTTPIPYEAVYGATKAFVNSFFWAVRNELKGKGINMTLLMPGATETNFFINAGLGETTIGSGEKDDARDVAERAWYALQSGHEYVYGSEKAEYEGDVLNRIQSELQKAQRHRIVSEPKK

SEQ ID NO: 94257 - DNA, 813 bp, Debaryomyces hansenii CBS767
  CDS (1)..(813)
atgtcgtacggatctaaagctgctgaacgtgttgccaataagattgtcttaatcactggtgcttcatctggaattggtgaagcaactgccaaagaaattgcatcagccgctaatggcaatttaaaattagtgttgtgtgctagacgaaaagaaaagttggataatttatctaaagaattgactgacaaatattcatccatcaaggttcatgttgctcaactagatgtatctaagctcgagactatcaagccatttatcaatgatttaccgaaagaattctctgacgtggatgtattagtcaacaatgcaggcttggctttgggccgtgatgaagttggaaccattgacacagatgatatgttatcgatgtttcaaactaatgttttagggttaattaccatcacacaggctgttttgccaatcatgaaaaagaagaacagcggagatgttgttaatataggttcaattgctggaagagactcttaccctggaggtggaatttactgtccaactaaggcaagtgtcaagtcgttttcgcaagttttaagaaaggaattgattagcaccaagattagagttcttgaggttgaccctggtaatgttgaaactgaattttcaaatgtcagattcaagggcgatatggaaaaggcaaagctggtttacgcgggtactgaaccattattatccgaagacgtagctgaggttgtcgtattcggacttacaagaaagcaaaataccgttattgctgagacattagtcttttcaaccaatcaagccagctcatctcacttataccgtgaaagcgataaataa

SEQ ID NO: 94258 - protein, 270 aa, Debaryomyces hansenii CBS767
MSYGSKAAERVANKIVLITGASSGIGEATAKEIASAANGNLKLVLCARRKEKLDNLSKELTDKYSSIKVHVAQLDVSKLETIKPFINDLPKEFSDVDVLVNNAGLALGRDEVGTIDTDDMLSMFQTNVLGLITITQAVLPIMKKKNSGDVVNIGSIAGRDSYPGGGIYCPTKASVKSFSQVLRKELISTKIRVLEVDPGNVETEFSNVRFKGDMEKAKLVYAGTEPLLSEDVAEVVVFGLTRKQNTVIAETLVFSTNQASSSHLYRESDK

SEQ ID NO: 94259 - DNA, 813 bp, Debaryomyces hansenii CBS767
  CDS (1)..(813)
atgtcatttggagccaaggctgctgcacgtttagctaacaaggttattttaattacaggtgcttcttcgggtattggctctgcaactgccaaagaacttgcttccgctgcaaatggaaacattaagcttatcctaactgccagaagggaggacagattaaagaaattatccagtctgttaatgaatgattttccatcgcttaaaattcatttggctaaactagatgtttcagttgttaattcgattaaaccattcctcagtggtttaccaggagagttttctgatatcgatgttttaatcaataatgcgggtaaagcattggggaaggatgaaattggtgagatcaaagacgaagacattcaagggatgtttcaaacaaacgtcttagggttaattggattgactcaagcagtcattcctcgtttcaaggaaaagaatagtggagacattgtgaatattggttcagtcgctgggagagaaacctacccaggaggtggggtctattgtgcaaccaaggctagtgtcaaatatttttctcaagtattaagaaaggaattgattaacaccaagattagagttcttgaagttgatcccggtgctgttaatactgagttctctttggttagattttatggcgaccaggctaaagctaatgaagtatacgaaggggttgaaccccttctagctgaggatatcgctgaggtaattgtcttcggtattactaggaagcaaaaaaccgttattgcggagactttggttttcccgacttaccaagcaggatcggcaaacatttataaaggccctcttgaataa

SEQ ID NO: 94260 - protein, 270 aa, Debaryomyces hansenii CBS767
MSFGAKAAARLANKVILITGASSGIGSATAKELASAANGNIKLILTARREDRLKKLSSLLMNDFPSLKIHLAKLDVSVVNSIKPFLSGLPGEFSDIDVLINNAGKALGKDEIGEIKDEDIQGMFQTNVLGLIGLTQAVIPRFKEKNSGDIVNIGSVAGRETYPGGGVYCATKASVKYFSQVLRKELINTKIRVLEVDPGAVNTEFSLVRFYGDQAKANEVYEGVEPLLAEDIAEVIVFGITRKQKTVIAETLVFPTYQAGSANIYKGPLE

SEQ ID NO: 94261 - DNA, 807 bp, Yarrowia lipolytica CLIB99
  CDS (1)..(807)
atgtctttcggagataaagctgctgctcgacttgcgggcaagaccgtctttgttaccggcgcctcgtccggcattggccaggccactgttctcgctctagccgaagctgccaagggcgacctcaagtttgtgcttgctgcccgacgaaccgaccgtctggacgagctcaagaagaagctggagaccgactacaagggtatccaggtgctgcctttcaagctggacgtgtccaaggtcgaggagaccgagaacattgtgtccaagctgcccaaggagttttccgaggtggacgtgcttatcaacaacgccggcatggtccacggcaccgaaaaggttggctccatcaaccagaacgacattgagatcatgttccacacaaacgtgctcggactcatttctgtcactcagcagtttgtcggcgagatgcgaaagcgaaacaagggcgacattgtcaacattggctccatcgccggacgagagccctacgttggaggaggaatctactgtgccaccaaggccgccgtgcgatctttcactgagactctccgaaaagagaacatcgacactcgaatccgagtcattgaggttgatcctggagccgttgagaccgagttctccgtcgtgcgattccgaggagacaagtccaaggccgacgctgtttacgctggaaccgagcctctggtcgctgacgatattgccgagttcatcacctacactctcactcgacgagagaatgtcgtcattgccgatactctcattttccccaaccaccaggcttctcctactcacgtctaccgaaagaactga

SEQ ID NO: 94262 - protein, 268 aa, Yarrowia lipolytica CLIB99
MSFGDKAAARLAGKTVFVTGASSGIGQATVLALAEAAKGDLKFVLAARRTDRLDELKKKLETDYKGIQVLPFKLDVSKVEETENIVSKLPKEFSEVDVLINNAGMVHGTEKVGSINQNDIEIMFHTNVLGLISVTQQFVGEMRKRNKGDIVNIGSIAGREPYVGGGIYCATKAAVRSFTETLRKENIDTRIRVIEVDPGAVETEFSVVRFRGDKSKADAVYAGTEPLVADDIAEFITYTLTRRENVVIADTLIFPNHQASPTHVYRKN

SEQ ID NO: 94263 - DNA, 849 bp, Cryptococcus neoformans var. neoformans JEC21
  CDS (1)..(849)
atgtctgtattcagcacctctcgattggctggtaaaactgtccttgtgactggtgcctccgccggtatcggtgcctcaactgccgagctcttcgctaaatgcgggtccaatgtcgtcctcctcgcccgacgagcggacaaccttcaagcagtgaaagctaaatgtgaagctgcccacaaggagtctgggctaaaggagggcggtaaagtggtcgtcattgaggcagacatgcagaagaatgagcacttggatgccatccccaccaagcttgaaggcttggaagttgacattcttgtcaacaatgctggtatggtgaggggtaaagagcaagtgggagctgaagatgacatcaatgtgatgttctcaaccaacgtcctcggtctcattcacttaactcagatctttgttcgtcaattcaagcaacgaaacgctggcatgattattaacctcggttccatcgccggtcgtgaaccttacgctggtggtgccatctactgcgctaccaagcacgcccttgccgctttcaccggcagtttgttgagagaacttgtcaacacccccatcagagtctgtgaggttcaaccgggcatggtggagacagagttctccattgtcaggttcaggggcgacaaggacgctgccgatgctgtttacaaggggattcagccattggttgctcaggatatcgccgaagaaatcgtttggtgtgcctccaggcctgcgcatgtcaatattgcccaactctgtaaggtgactgttcccaagatgtgtatcgaactgacctcttttttttcagtcgtcatgcctgtcaaccaggccacgcctactcttgctcaccgaagttcttaa

SEQ ID NO: 94264 - protein, 282 aa, Cryptococcus neoformans var. neoformans JEC21
MSVFSTSRLAGKTVLVTGASAGIGASTAELFAKCGSNVVLLARRADNLQAVKAKCEAAHKESGLKEGGKVVVIEADMQKNEHLDAIPTKLEGLEVDILVNNAGMVRGKEQVGAEDDINVMFSTNVLGLIHLTQIFVRQFKQRNAGMIINLGSIAGREPYAGGAIYCATKHALAAFTGSLLRELVNTPIRVCEVQPGMVETEFSIVRFRGDKDAADAVYKGIQPLVAQDIAEEIVWCASRPAHVNIAQLCKVTVPKMCIELTSFFSVVMPVNQATPTLAHRSS

SEQ ID NO: 94265 - DNA, 915 bp, Cryptococcus neoformans var. neoformans JEC21
  CDS (1)..(915)
atgtccgacggcttctcgccattggcgattagcgagggggagatttcctttatcacggcgcaccgccttcaccttatcgcccgactgcaactcttccgcaactgtctttatatacctggtctccccctcttcgccctcacgtgtaaccatatacaaccatgccctcctcaaagccgctgttcaacactacacgccgtcgttactggcgcttcgggcggtatcggcgctgccactgccgttctctttgcccgagctggatgtaatgtcatcctcctcgctcgtcgccaagatgccctccacaaagttgcccagcaatgcaaggaagaaggcgctgaaggcatcaaggtgtttatcaagacgctcgatgtgaatgataggaaggccgtggacgatctgatccctgcgcttaagaaggagggctttgagacttttgatgttttggtcaacaatgcgggtggtgctattggcaaggataaagttggagtcatctccgtcatgcaaatcacccagctcttcttgaacgagatgaagaaggtcgacactggccacatcatcaacattggctctattgctggccgagagccatatgccgggggcggtgtctactgcgctgtcaaacacgccgttagatccttcaccagcaccctcatgaaagaagtcgtcgctaccggtattcgagtgacagaggtcgcgcccggatttgttgagaccaatttttcggtcacaagatttaggggggacgaggctgctgccaagaagatttatgaggggatgcaacctttgctggctgaggatatcgccgaagaagtcgtctggtgtgcccttcggcctcctcatgtacagatcgccgaaatgctggttttccctaatgcccaggctagtgcggagattattgccagaaagatatcatcatag

SEQ ID NO: 94266 - protein, 304 aa, Cryptococcus neoformans var. neoformans JEC21
MSDGFSPLAISEGEISFITAHRLHLIARLQLFRNCLYIPGLPLFALTCNHIQPCPPQSRCSTLHAVVTGASGGIGAATAVLFARAGCNVILLARRQDALHKVAQQCKEEGAEGIKVFIKTLDVNDRKAVDDLIPALKKEGFETFDVLVNNAGGAIGKDKVGVISVMQITQLFLNEMKKVDTGHIINIGSIAGREPYAGGGVYCAVKHAVRSFTSTLMKEVVATGIRVTEVAPGFVETNFSVTRFRGDEAAAKKIYEGMQPLLAEDIAEEVVWCALRPPHVQIAEMLVFPNAQASAEIIARKISS

SEQ ID NO: 94267 - DNA, 705 bp, Thermus thermophilus HB27
  CDS (1)..(705): transl_table=11
atggagggcatgaagggcgccgtcctcatcacgggagcgagccggggcatcggcgaggccaccgcccgcctcctccacgccaaggggtaccgggtgggcctcatggcccgggacgaaaagaggcttcaggccctcgccgccgagctggagggggccctaccccttcccggggacgtccgggaggagggggactgggcccgggccgtggccgccatggaggaggccttcggagagcttagcgccctggtgaacaacgccggggtcggggtgatgaagcccgtccacgagctcaccctggaggagtggcggctcgtgctggacaccaacctcacgggggccttcctcggcatccgccacgccgtccccgccctcctgcgccggggcgggggcaccatcgtcaacgtggggagcctcgcggggaagaaccccttcaagggcggggccgcctacaacgccagcaagttcggccttttgggcctcgccggggccgccatgctggacctccgggaggcgaacatccgggtggtgaacgtcctcccgggctccgtggacaccggcttcgccgggaacgttccgggccaggcctggaagctgcggcccgaggacgtggcccaggcggtcctcttcgccctggagatgcccgggcacgccatggtgagcgagattgagctccggcccacccggcccccgtccggcccgcggtaa

SEQ ID NO: 94268 - protein, 234 aa, Thermus thermophilus HB27
MEGMKGAVLITGASRGIGEATARLLHAKGYRVGLMARDEKRLQALAAELEGALPLPGDVREEGDWARAVAAMEEAFGELSALVNNAGVGVMKPVHELTLEEWRLVLDTNLTGAFLGIRHAVPALLRRGGGTIVNVGSLAGKNPFKGGAAYNASKFGLLGLAGAAMLDLREANIRVVNVLPGSVDTGFAGNVPGQAWKLRPEDVAQAVLFALEMPGHAMVSEIELRPTRPPSGPR

SEQ ID NO: 94269 - DNA, 792 bp, Parachlamydia sp. UWE25
  CDS (1)..(792): transl_table=11
ttgcaagaaagagctttaatgggacaattattcatcaattctacagttatgattactggggcaagctctggctttggagccgaaacggcccgattatttgctaaagaaggggctcgtttgattttgctcgcaaggcgaaaagatcgattagtagagttgcaaaatgagttaaaagaaaaatttcaaacaaaaagttactgtattactgctgatattggaaattttgagcttttagaagaacaaatatccgatcttgacaaaaattttgaacgaccaaacattttgattaataatgcaggaatggttaagggattggataaactgtgggaagttaagcctcaagattggaacacgatgattgatacaaatatcaaaggtgttcttaatgcaacaagactcattgtcccatccatgttaaaagctgatcaaggacatattattaatgtaggaagtacctctggtcacggaatttattctggaggtggggtttattgtgctacaaagtttgctttaagagctttaacagatactctcaggacagaacttatttcgacttctattcgcgtatcccttatttccccaggaatagcaaagacagaatttagtctggtccgttttgcaggagataagcaaaaagctgataaagtttatgaaggattagaagctttaaatgcgacagatattgccgaagcaattttgttcattgcatcgcgtcctgcccatgttaacattgctgatatggtgatctatccaaaaagtcaagcttcttcttcgatcatccatcgagcataa

SEQ ID NO: 94270 - protein, 263 aa, Parachlamydia sp. UWE25
MQERALMGQLFINSTVMITGASSGFGAETARLFAKEGARLILLARRKDRLVELQNELKEKFQTKSYCITADIGNFELLEEQISDLDKNFERPNILINNAGMVKGLDKLWEVKPQDWNTMIDTNIKGVLNATRLIVPSMLKADQGHIINVGSTSGHGIYSGGGVYCATKFALRALTDTLRTELISTSIRVSLISPGIAKTEFSLVRFAGDKQKADKVYEGLEALNATDIAEAILFIASRPAHVNIADMVIYPKSQASSSIIHRA

SEQ ID NO: 94271 - DNA, 756 bp, Parachlamydia sp. UWE25
  CDS (1)..(756): transl_table=11
atgaatcagttgttgttaaatcaagtagctattattacaggtggtaatgcaggaattggaaaagccattgcctcgaaatttgcagaagagggtgcaaaagttattatttttggaacgaatgcagaaacagggcaaaaagcaattaatgaaattcgagaaattacacaatctcaaactatttactttcgctgtgtggatgtttctcaaactcaactagttgatgaggcaattaaagatgttgtagaagaatttggagtggtggacattttgattaataatgcaggaatcactgctgatcaattgttgatgaagatgcctgaacaagattgggataaagttttagatactaatttgaaatcttgttttaacacttgtaaatctgtcgttcgtggaatgatgaaagccaaaaaaggaaaaattattaatatcagttctgtggttggattgatggggaatgccgggcagacaaattatgccgcttcaaaagcaggaatcatcggtttttcaaaagctttagctaaagaattagcttctcgaaatattttagtaaattgtattgctccaggtttcattcaaacaaaaatgaccgatgctttaacaccaatacagaaagaaatgattgtaaaagatattcctcttaatcgcttaggggagccttctgatattgctaatttagcttggtttttagctacgccactttctaactatgtcacaggccaggtcattactgtggatggtggaatggtgatgtcataa

SEQ ID NO: 94272 - protein, 251 aa, Parachlamydia sp. UWE25
MNQLLLNQVAIITGGNAGIGKAIASKFAEEGAKVIIFGTNAETGQKAINEIREITQSQTIYFRCVDVSQTQLVDEAIKDVVEEFGVVDILINNAGITADQLLMKMPEQDWDKVLDTNLKSCFNTCKSVVRGMMKAKKGKIINISSVVGLMGNAGQTNYAASKAGIIGFSKALAKELASRNILVNCIAPGFIQTKMTDALTPIQKEMIVKDIPLNRLGEPSDIANLAWFLATPLSNYVTGQVITVDGGMVMS

SEQ ID NO: 94273 - DNA, 762 bp, Desulfovibrio vulgaris subsp. vulgaris str. Hildenborough
  CDS (1)..(762): transl_table=11
atgcaagccaccatatgcatcaccggagcaaccgcagggttcggcgaagcctgcgcccgtcgtttcgccgccgagggctgccgccttatcatcaccggacgccgcaaggaacgccttgaaaaactcgccgccgaactcggtgaagacaggtgcttgccgctggtcttcgacgtgcgtgaccgcaaggctgtggaagcggcctttgccgccctgcccgaggcgttcgccaacgtggacgtactcatcaacaatgccgggctcgccctcggactcgaaccggcgcatcgcgcctctctcgaagactgggagacgatgatagacaccaacctcaaggggctcatgtactgcacccgcgccctgctaccgggcatggtggaacgcggcaagggacacgtggtcaacctcggttccattgcggggtcgtatccgtaccccggcgggaacacctacggagcgactaaagccttcgtgatgcaattctcccgcaacctgcgggcagacctgcacggaacgggcgtacgagtcaccaacatcgaaccgggactcgccgaaagcgaattctccgtgatacgcttcaagggcgatgcctcgaaggcggctggcgtctacaagggcacggaaccgctgcgccctgtcgacatcgccgacatcatccattttgcggtcacatgtccggcgcatgtgaacatcaatcgcatcgaagtcatgcccacgtgccaatccttcggtgcactgccggtacaccggacagaagccgactag

SEQ ID NO: 94274 - protein, 253 aa, Desulfovibrio vulgaris subsp. vulgaris str. Hildenborough
MQATICITGATAGFGEACARRFAAEGCRLIITGRRKERLEKLAAELGEDRCLPLVFDVRDRKAVEAAFAALPEAFANVDVLINNAGLALGLEPAHRASLEDWETMIDTNLKGLMYCTRALLPGMVERGKGHVVNLGSIAGSYPYPGGNTYGATKAFVMQFSRNLRADLHGTGVRVTNIEPGLAESEFSVIRFKGDASKAAGVYKGTEPLRPVDIADIIHFAVTCPAHVNINRIEVMPTCQSFGALPVHRTEAD

SEQ ID NO: 94275 - DNA, 747 bp, Listeria monocytogenes str. 4b F2365
  CDS (1)..(747): transl_table=11
atgacaatcaaaaataaagtaattattataaccggagcatcatccggaattggtgaagcaacagccttacttttagctgaaaaaggggcgaaagtggttcttgctgctcgtcgcgtagaaaagctggaaaaaattgttcaaacgattaaagcgagttcaggcgaagcaatttttgccaaaacggatgtgacaaaacgcgaagacaataagaaattagtagaattagcgattgaaacatacggaaaagtagatgcaatctttttaaatgcgggaatcatgccgaattcgccattatctgctttaaaagaagacgaatgggagcaaatggttgatatcaatattaaaggcgtactgaatggaattgccgcagttttgccttctttcatcgctcaaaaatcaggacatatcatcgccacttcttctgtagcaggattaaaagcatatcccggcggcgcagtatatggcgcgactaaatgggcagtccgtgacttaatggaagtattacggatggagtcagcgcaagaaggaaccaatatccgcacagcgaccatttatccagcagctatcaatacggaattactagaaacaatcacggataaagaaaccgaacaaggaatgacgagcttatacaaacaatacggcatcacacctgatcgtatcgcgagcattgttgcgtatgctatcgatcaacccgaagacgtcaacgtaaatgaattcacagtaggtccaaccagccaaccgtggtaa

SEQ ID NO: 94276 - protein, 248 aa, Listeria monocytogenes str. 4b F2365
MTIKNKVIIITGASSGIGEATALLLAEKGAKVVLAARRVEKLEKIVQTIKASSGEAIFAKTDVTKREDNKKLVELAIETYGKVDAIFLNAGIMPNSPLSALKEDEWEQMVDINIKGVLNGIAAVLPSFIAQKSGHIIATSSVAGLKAYPGGAVYGATKWAVRDLMEVLRMESAQEGTNIRTATIYPAAINTELLETITDKETEQGMTSLYKQYGITPDRIASIVAYAIDQPEDVNVNEFTVGPTSQPW

SEQ ID NO: 94277 - DNA, 777 bp, Bacillus thuringiensis serovar konkukian str. 97-27
  CDS (1)..(777): transl_table=11
atgaacgtaggggaatttgatgggaaaactgttttagtaacaggtgcagctcaaggaataggtagtgttgttgccaaaatgtttttagaaagaggagctacagtaattgcggttgatcaaaatggagagggattaaacgtactcttaaatcaaaatgaaacacgtatgaaaatatttcatttagatgtgagtgatagtaatgctgttgaggatacagtaaaacgtattgaaaatgatatagcaccaatagatatattagtaaatgttgcaggggttttacgtatgggagcgattcactcgttaagtgatgaagattggaataaaacattttctgtaaattctacaggagttttctatatgtctcgagcagtaagtaaacatatgatgcaaagaaagtcaggggcaattgttacagttggttcaaatgcagcaaatacgccgagagtggagatggctgcatatgctgcatcaaaagctgcaacgacgatgtttatgaagtgtttaggattagaacttgcagcgtacaacattcgctgtaacttagtttctcctggttctactgaaactgaaatgcaaaggttactatgggctgatgagaatggagcaaaaaatataattgctggttctcaaaatacatatagactcggtataccgttacaaaaaattgcacagccttcagaaattgctgaagcggtattgtttttagcttcagataaagcgagtcatattacaatgcacaatttatgtgtcgatggcggagctacattaggagtttaa

SEQ ID NO: 94278 - protein, 258 aa, Bacillus thuringiensis serovar konkukian str. 97-27
MNVGEFDGKTVLVTGAAQGIGSVVAKMFLERGATVIAVDQNGEGLNVLLNQNETRMKIFHLDVSDSNAVEDTVKRIENDIAPIDILVNVAGVLRMGAIHSLSDEDWNKTFSVNSTGVFYMSRAVSKHMMQRKSGAIVTVGSNAANTPRVEMAAYAASKAATTMFMKCLGLELAAYNIRCNLVSPGSTETEMQRLLWADENGAKNIIAGSQNTYRLGIPLQKIAQPSEIAEAVLFLASDKASHITMHNLCVDGGATLGV

SEQ ID NO: 94279 - DNA, 696 bp, Staphylococcus aureus subsp. aureus MRSA252
  CDS (1)..(696): transl_table=11
atgacagtattaacagataaaatagcagtagttacaggtgcaggtagtggtattggagaagcaattgcaacattactacatgaagaaggggcgaaagttgtcttagccggtagaaataaagataaactacaaaatgtggcgaatcaattagctcaagatagtgtgaaggtagtgccaactgatgtaacgaaaaaagaagaagtcgatgaattgataaaaatggcacaacaaacattcggtggtttggatattgtcatcaatagtgcggggcaaatgttgtcgtctaagattactgattatcaagtagatgaatgggatagtatgattgatgttaatatcaaaggcactttatacacggcaaaggctgcattaccaactatgttagaacaatcaagtggccatcttattaacattgcatctatttctggctttgaagtaacgaaaagcagtacgatttatagtgcgacgaaagcggcagttcacactattactcaaggattagaaaaagagttggcaaagacaggtgttaaagtaacaagcatttctccaggaatggttgatacagcaataactgccacatacaatccaacagatcgtaaaaaacttgagccacaagatattgcagaagcagtattatatgcattaacacaaccaaagcacgttaacgtgaatgaaattacagtgcgtcctgtataa

SEQ ID NO: 94280 - protein, 231 aa, Staphylococcus aureus subsp. aureus MRSA252
MTVLTDKIAVVTGAGSGIGEAIATLLHEEGAKVVLAGRNKDKLQNVANQLAQDSVKVVPTDVTKKEEVDELIKMAQQTFGGLDIVINSAGQMLSSKITDYQVDEWDSMIDVNIKGTLYTAKAALPTMLEQSSGHLINIASISGFEVTKSSTIYSATKAAVHTITQGLEKELAKTGVKVTSISPGMVDTAITATYNPTDRKKLEPQDIAEAVLYALTQPKHVNVNEITVRPV

SEQ ID NO: 94281 - DNA, 735 bp, Erwinia carotovora subsp. atroseptica SCRI1043; identical to SEQ ID NO: 61955
  CDS (1)..(735)

SEQ ID NO: 94282 - protein, 244 aa, Erwinia carotovora subsp. atroseptica SCRI1043; identical to SEQ ID NO: 61956

SEQ ID NO: 94283 - DNA, 750 bp, Erwinia carotovora subsp. atroseptica SCRI1043
  CDS (1)..(750)
atgattatttttgttaccggtgcaacggctgggtttggtgagtcaattacccgtaaatttattagcgcgggccataaagtgatcgcgacgggccgccgtcaggaacgtctggatgcgctgaaagcggaactgggtgatgcgttatatccgctaaaattagacgtgcgcgatcgtcaggcgattgagcaagccgttgcctctctgcctgccgaatggcgggcgattgatgtgctggtgaataacgctggattggcgttaggcctagagcctgcacataaggcatcggtagacgattgggaaaatatgatcgataccaacaacaaagggttggtgtttatgacgcgcgcgctgctgcctgacatggtggatcgcaatatcggtcatgttattaacatcggttctaccgcaggaaactggccatacgcaggcggtaacgtatacggtgccagcaaagcgttcgtgcagcagtttagcctgggattacgggccgatctgtctggcacccgagtccgtgtaacaaatatcgaacccggtctggttggcggaacagagttctcagccgtgcgtttcaagggcaatgacgacaaagtcagcaaaacctatgacaacacgacgccgttgaccgcagaagatgtgtctgaagccgttttctgggttgccaccctgccagcgcacgtcaacatcaacacgctggaaatgatgccagttagccaatctttcgctggattaagcgtacatcgcgaaggctga

SEQ ID NO: 94284 - protein, 249 aa, Erwinia carotovora subsp. atroseptica SCRI1043
MIIFVTGATAGFGESITRKFISAGHKVIATGRRQERLDALKAELGDALYPLKLDVRDRQAIEQAVASLPAEWRAIDVLVNNAGLALGLEPAHKASVDDWENMIDTNNKGLVFMTRALLPDMVDRNIGHVINIGSTAGNWPYAGGNVYGASKAFVQQFSLGLRADLSGTRVRVTNIEPGLVGGTEFSAVRFKGNDDKVSKTYDNTTPLTAEDVSEAVFWVATLPAHVNINTLEMMPVSQSFAGLSVHREG

SEQ ID NO: 94285 - DNA, 753 bp, Erwinia carotovora subsp. atroseptica SCRI1043
  CDS (1)..(753)
atgccattttcggattataacgttgccctggtaaccggagcatccgctgggatgggtgaggcaattgtcgaacggttatgccgggaaggcatcacggtacacgcggttgcccgccgccgtgaacaattggcggcactggctgaacgcaccgggtgtatcccgcatgcggtggatgtcgcagatttgcatgcgctgaccgaactgtgttgcgatcttaaggtggatattctggtcaataatgcgggtgtgtcgcacccgggatctatcctcaacgcggatgaaaacgtgattgacactcaggtggatgtcaatttacgtgcggtgctgcacttgtgccggcttctggtgcctggaatggtgtcgcgggattgtggtcacgtcattaacatcacctcgattgcggcaatttataacttcaacggcaattccgtttatcacgccaccaaagccggggtacacgccttgtcacgccaactgcgcgtcgactgctacggtaagcgggtacgtgttaccgaaatttgcccaggtcgtgtcgcaacggatattttcggcaatgtgtctggcgattatgaagaggcgcgcaaacgctttattgaaggatttgaactgccgcaggcgcaagatatcgctgattgtgttgcgtttgcccttagtgccccgatagcggtgaatatcggtaatatcgagattactccgacgctgcaagtacctggcgggctttctaccatgcggcctggcgacagtatcgcctga

SEQ ID NO: 94286 - protein, 250 aa, Erwinia carotovora subsp. atroseptica SCRI1043
MPFSDYNVALVTGASAGMGEAIVERLCREGITVHAVARRREQLAALAERTGCIPHAVDVADLHALTELCCDLKVDILVNNAGVSHPGSILNADENVIDTQVDVNLRAVLHLCRLLVPGMVSRDCGHVINITSIAAIYNFNGNSVYHATKAGVHALSRQLRVDCYGKRVRVTEICPGRVATDIFGNVSGDYEEARKRFIEGFELPQAQDIADCVAFALSAPIAVNIGNIEITPTLQVPGGLSTMRPGDSIA

SEQ ID NO: 94287 - DNA, 738 bp, Propionibacterium acnes KPA171202
  CDS (1)..(738): transl_table=11
atgactaaaactgcagtggtcacaggagcgagttcgggaatcggcgcggccacggcccgcgctctagcgggcgatagctggcacgtcatctgtgcagcccgccgagtcgagcgcatcgagccactctccgccgagatcggtgggcaagccgtagtatgcgacgtgacgagcgacgagtctgtcaccaacctcgtcaagactgtcggcggcaaggtcgatctcctcgtcaacaatgctggtggcgccgtcggtcaagaacccgtcactgaggctgacctcaatgcctggacgacgatgtaccaaaccaacgtgctaggcatggggcaggtcaccaaggctctcctgcccgcgctcgaaattgctgaaggcaccatcatcaccatcacctccaccgccgctgaatggggctacgagggcggtgccggatactgtgctgctaaatctggcgagagagctgttgtcgaagccctgcgcctagaactatgtggccatccggtgcgggtgtgcgaggtgagccccggcatggtgcacaccgaggagttctccctggtgcgtttccacggcgaccaggccaaagctgacaaggtttaccagggggtcgactctcccctggtcgccgctgacattgccgaatgcgtacgttggatctctgggctgcccagccacgtcaacattgatcgaatgatcgtccgtcctcgcgcccaggccgcccagtacaaggtggcacgcgaatcctga

SEQ ID NO: 94288 - protein, 245 aa, Propionibacterium acnes KPA171202
MTKTAVVTGASSGIGAATARALAGDSWHVICAARRVERIEPLSAEIGGQAVVCDVTSDESVTNLVKTVGGKVDLLVNNAGGAVGQEPVTEADLNAWTTMYQTNVLGMGQVTKALLPALEIAEGTIITITSTAAEWGYEGGAGYCAAKSGERAVVEALRLELCGHPVRVCEVSPGMVHTEEFSLVRFHGDQAKADKVYQGVDSPLVAADIAECVRWISGLPSHVNIDRMIVRPRAQAAQYKVARES

SEQ ID NO: 94289 - DNA, 774 bp, Streptococcus pyogenes MGAS10394
  CDS (1)..(774): transl_table=11
ttgaaggtgaggaaatgtatgggaaatattgccttagtaacaggggcttcagccggttttggcagagccattgtcgaacacttaattgcagatgggataaaggttattggtgcttctcgtcgtcttgagaaactcaaggtcttagaaacgagctttgggtcggacaacttttaccctttgcagatggatgtcacagataccaaagcgattgatgatgctttgacaagtctaccaaatcagtggcaagatattactattttagtgaataatgcaggcttagcattgggacttgataaggcttatgaagccgattttgagaattggatgacgatgattaataccaatattgttgggttgatttatctcacacgtcaattattaccacatatggtctccaaagatgatggtattattattaatttagggtcaaccgcagggacaattccctatccgggagctaatatttatggggctagcaaggcttttgttaagcagttctcactcaatttacgagctgatttagtaggtagccatatacgtgtgaccaatattgaacccggtctatgtgaagggacagaattttcaaaggttcgctttaatggtgatgaggaacgggtgaaggccatttatcaaggagcacatgccattcaacctcaagatattgcgtcgactgtatcatgggtgattcatcagccccctcatgttaatgttaatcgtattgagctgatgccagtgtcgcaaagttatggaccgcaaccagttagtcgtgactag

SEQ ID NO: 94290 - protein, 257 aa, Streptococcus pyogenes MGAS10394
MKVRKCMGNIALVTGASAGFGRAIVEHLIADGIKVIGASRRLEKLKVLETSFGSDNFYPLQMDVTDTKAIDDALTSLPNQWQDITILVNNAGLALGLDKAYEADFENWMTMINTNIVGLIYLTRQLLPHMVSKDDGIIINLGSTAGTIPYPGANIYGASKAFVKQFSLNLRADLVGSHIRVTNIEPGLCEGTEFSKVRFNGDEERVKAIYQGAHAIQPQDIASTVSWVIHQPPHVNVNRIELMPVSQSYGPQPVSRD

SEQ ID NO: 94291 - DNA, 849 bp, Leifsonia xyli subsp. xyli str. CTCB07
  CDS (1)..(849): transl_table=11
atgggccgtatgggcaaacgtgtgatcgtgacaggggcgagttcggggatcggggcggcgacggtccacctgttccgggagcggggctgggaggtggtgggcgtcgcacggcgctccgaccggctggcggcgctcgcggcggagaccggcgccgagacgttcgccgccgatctcacccggcaagaggacgtcgacgccctccgcgacctcctcgcggcgaccgggggcgtccacgctctcgtcaacaacgccggcggcgcgcgcgggctcgactcggtggagtcctccagcgtcgaggactggatctggatgttcgacatcaatgtgatcggaaccaagcgcgtgatctccaccctgcttccgctgatgcggcaaggtgcgcacgagaccggccacgccggcatcctgaacgtgacgtccatcgccggccacaccgcctacgcgagcggcggcggctacaacgccgcgaagttcgccgagcgcgcgctgaccgaggtgctgcggctggagctgaacggcgagcccatccgcgtgatcgaggtcgctcccgggatggtggcgaccgaggagttctccctcgtcagcttcggcggcgaccgggagaagcgcgacgccgtctacgaggatgtgccggagccgctcaccgccgaggatgtggcggaggccatcgtgcatgccctcaccctgccaaagcattgtggacctggacctcatcgtgatcaaaccggtggcgcaggccgcgccccaccggctccacaagggcgagctgcgggtgagaggctgaccagcgccgcgacgccgtcccgaatccggacgctccctttccgccgacgtcgtaacacagcgtga

SEQ ID NO: 94292 - protein, 282 aa, Leifsonia xyli subsp. xyli str. CTCB07
MGRMGKRVIVTGASSGIGAATVHLFRERGWEVVGVARRSDRLAALAAETGAETFAADLTRQEDVDALRDLLAATGGVHALVNNAGGARGLDSVESSSVEDWIWMFDINVIGTKRVISTLLPLMRQGAHETGHAGILNVTSIAGHTAYASGGGYNAAKFAERALTEVLRLELNGEPIRVIEVAPGMVATEEFSLVSFGGDREKRDAVYEDVPEPLTAEDVAEAIVHALTLPKHCGPGPHRDQTGGAGRAPPAPQGRAAGERLTSAATPSRIRTLPFRRRRNTA

SEQ ID NO: 94293 - DNA, 750 bp, Desulfotalea psychrophila LSv54
  CDS (1)..(750): transl_table=11
atgcaaaaaactattctaataacaggagcaacatctggatttggcaaggcaacagcaaaactttttgcagctcacaactggcagttaattctctgcggtagacgccaggatcgactcgaaacaatacaaaaagaactggaaaatgttcccgttcatatcgcccagtttgatatttctgtgcgagatgaggtggaagattttgtgagcaatattcctcaacaattttcccagattgatatacttgttaacaatgctggccttgccctcggcctggagggctcagataaagcagacttagatcattggcagacaatgatcaatactaatattagcggtcttctctatatgactcgccttattttaccgcagatgatgaaaaatagaaccggtcatattatcaatattggctcggtggcaggtagctatccctatccaggaggaaacacctatggtgcctccaaggcctttgtcgcccaattttcccgtaatctccgttgcgatgtcgcaggaacaggcattagagtaaccaatatagaaccaggccttgccgaaacagaattctccgctgttcgcttttcaggtgacgaaaaacgagccagtagtgtttatgctggtcatgaaaacctctcagccacggatattgcggaaactattttctggtctgccagtcgacccgcccatgtaaatattaactctatagaaatcatgcctgtctgtcaaagttgggcagcacttgccatcgacaagtaa

SEQ ID NO: 94294 - protein, 249 aa, Desulfotalea psychrophila LSv54
MQKTILITGATSGFGKATAKLFAAHNWQLILCGRRQDRLETIQKELENVPVHIAQFDISVRDEVEDFVSNIPQQFSQIDILVNNAGLALGLEGSDKADLDHWQTMINTNISGLLYMTRLILPQMMKNRTGHIINIGSVAGSYPYPGGNTYGASKAFVAQFSRNLRCDVAGTGIRVTNIEPGLAETEFSAVRFSGDEKRASSVYAGHENLSATDIAETIFWSASRPAHVNINSIEIMPVCQSWAALAIDK

SEQ ID NO: 94295 - DNA, 750 bp, Yersinia pseudotuberculosis IP 32953
  CDS (1)..(750): transl_table=11
atgatcatattcgtcactggtgcgacatcaggttttggtgaggcgattgcccgtaaatttattagccacggtcatcaggtcattgccgccggccgccgtcaggaacgtctggaagcgctacaagccgaactgggtgcacaactgcacatcgtacgtctggacgtgcgtaatcgcgcagctattcaacaagttattgatgaattacccgctgagctgaggaatatcgacttattggtaaacaacgccgggttggcattgggattagagccagcacataaagccaacgttgatgattgggatacaatgattgataccaataccaaagggttggtaaatatgactcgagccttattacctgcgatggttgaacgtaatgtgggacacattattaatattggctctaccgcggctaattggccatacgcggggggaaatgtgtacggcgcgacaaaagcgtttgttaaacaatttagtttgggtttacgtgccgacctacatggcactcatatccgtgttaccgatattgagcccggcctggtcggcggtactgagttttcagcggttcgttttaaaggtgatggagaaaaggtcaataaaacctacgatggtgcagatcccctgatgccagaagatatcgctgaagctgtttattgggttgcaacgctccctgcccgcgtcaatattaactcattggaaatgatgccagtaagtcagtcttttgctgggctgaatattcatcgcggttcctaa

SEQ ID NO: 94296 - protein, 249 aa, Yersinia pseudotuberculosis IP 32953
MIIFVTGATSGFGEAIARKFISHGHQVIAAGRRQERLEALQAELGAQLHIVRLDVRNRAAIQQVIDELPAELRNIDLLVNNAGLALGLEPAHKANVDDWDTMIDTNTKGLVNMTRALLPAMVERNVGHIINIGSTAANWPYAGGNVYGATKAFVKQFSLGLRADLHGTHIRVTDIEPGLVGGTEFSAVRFKGDGEKVNKTYDGADPLMPEDIAEAVYWVATLPARVNINSLEMMPVSQSFAGLNIHRGS

SEQ ID NO: 94297 - DNA, 777 bp, Bacillus cereus ZK
  CDS (1)..(777): transl_table=11
atgaacgtaggggaatttgatgggaaaactgttttagtaacaggtgcagctcaaggaataggtagtgttgttgccaaaatgtttttagaaagaggagctacagtaattgcggttgatcaaaatggagaggggttaaacgtactcttaaatcaaaatgaaacacgtatgaaaatatttcatttagatgtgagtgatagtaacgctgttgaagatacagtaaaacgtattgaaaatgatatagcaccaatagatatattagtaaatgttgcaggggttttacgtatgggagcaattcactcgttaagtgatgaagattggaataaaacattttctgtaaattctacaggagttttctatatgtctcgagcagtaagtaaacatatgatgcaaagaaagtcaggggcaattgttacagttggttcaaatgcagcaaatacgccgagaatggagatggctgcatatgctgcatcaaaagctgcaacgacgatgtttatgaagtgtttaggattagaacttgcagcgtacaacattcgctgtaacttagtttctcctggttctactgaaactgaaatgcaaaggttactatgggctgatgagaatggagcaaaaaatataattgctggttctcaaaatacatatagactcggtataccgttacaaaaaattgcacagccttcagaaattgctgaagcggtattgtttttagcttcagataaagcgagtcatattacaatgcacaatttatgtgtcgatggcggagctacattaggagtttaa

SEQ ID NO: 94298 - protein, 258 aa, Bacillus cereus ZK
MNVGEFDGKTVLVTGAAQGIGSVVAKMFLERGATVIAVDQNGEGLNVLLNQNETRMKIFHLDVSDSNAVEDTVKRIENDIAPIDILVNVAGVLRMGAIHSLSDEDWNKTFSVNSTGVFYMSRAVSKHMMQRKSGAIVTVGSNAANTPRMEMAAYAASKAATTMFMKCLGLELAAYNIRCNLVSPGSTETEMQRLLWADENGAKNIIAGSQNTYRLGIPLQKIAQPSEIAEAVLFLASDKASHITMHNLCVDGGATLGV

SEQ ID NO: 94299 - DNA, 747 bp, Mannheimia succiniciproducens MBEL55E
  CDS (1)..(747): transl_table=11
atggcaattttaataaccggtgcttcggcgggatttggtaaagcggcttgtataaccttggtcaaagcaggctataaagttatcggtgcggcgcgccgtttagaaaaattaaccgaattaaaacaacaacttggtgagaatttttatcctctacaaatggatgtatcgcaaactgccgaaattgacagcgcacttgcaagccttcccgcagactgggcggaaattgagcttttagtcaataatgcggggctcgctctcgggcttgaacctgcttataaagtcaattttgacgactggctcaccatgattaataccaatattatcggactgacttatctcacccgccaaattctgccgcaaatggtagaacgcaataaggggcatatcatcaaccttggctctattgccggcacttatccgtatccgggcggtaacgtatacggcgcaaccaaagcattcgttaaacaattcagtttaaatttacgtgccgatctagcgggcaccgccgtgcgcgtgagcaacattgaacccgggttatgcggcggtacggaattttccaacgtgcgttttaaaggtgacgatgaaaaggcggcgaacgtttataaaaatacgttgtctatccaacctgaagatattgccaatactatcctttggatttatcagcaacccgcacatgtgaatatcaaccgcattgaaataatgccgatcagccaaagcagcggcgcattgaatgttgttagagaatag

SEQ ID NO: 94300 - protein, 248 aa, Mannheimia succiniciproducens MBEL55E
MAILITGASAGFGKAACITLVKAGYKVIGAARRLEKLTELKQQLGENFYPLQMDVSQTAEIDSALASLPADWAEIELLVNNAGLALGLEPAYKVNFDDWLTMINTNIIGLTYLTRQILPQMVERNKGHIINLGSIAGTYPYPGGNVYGATKAFVKQFSLNLRADLAGTAVRVSNIEPGLCGGTEFSNVRFKGDDEKAANVYKNTLSIQPEDIANTILWIYQQPAHVNINRIEIMPISQSSGALNVVRE

SEQ ID NO: 94301 - DNA, 717 bp, Bacillus licheniformis ATCC 14580
  CDS (1)..(717): transl_table=11
atgcaatccttacaaaacaaaaccgctctgattacaggagggggaagaggaatcggccgcgccacagcgattgccctcgcaaaagaaggcgtacatatcggccttatcggccgtacagctgcgaatcttgaaaaagcggcagaggaattgaaggcgttcggtgtaaaagtatctgtagccgcagctgacgtaaaggatttaacagctgtagaacgtgcagtccaatccgtcaaagaagagcttggacaaatcgatattctcattaacaatgccgggatcggcgggtttgcaggatttcttgagcaatctcccgaagaatgggaaaatattatccaggttaatctgatgggggtttacaatgtaacacgcgccgttctgcctgaaatgattgaaagaaaagccggcgatatcattaatatttcttctacagccggccaaaggggagcagccggcacaagcgcctacagtgcgtctaagttcgctgtgctcgggctgaccgaatcgctgatgcaggaagtcagaaagcacaatatccgcgtgagcgcccttacaccaagcacggttgcgacggatttggcaatcgactcaaaattgacagacggcaatccggaacgcgtcatgcagcctgaagatctggcggaatacatggttgcccagctcaaactgcatccgcgcattttcattaaatcagccggcatgtggtctacaaatccttaa

SEQ ID NO: 94302 - protein, 238 aa, Bacillus licheniformis ATCC 14580
MQSLQNKTALITGGGRGIGRATAIALAKEGVHIGLIGRTAANLEKAAEELKAFGVKVSVAAADVKDLTAVERAVQSVKEELGQIDILINNAGIGGFAGFLEQSPEEWENIIQVNLMGVYNVTRAVLPEMIERKAGDIINISSTAGQRGAAGTSAYSASKFAVLGLTESLMQEVRKHNIRVSALTPSTVATDLAIDSKLTDGNPERVMQPEDLAEYMVAQLKLHPRIFIKSAGMWSTNP

SEQ ID NO: 94303 - DNA, 747 bp, Burkholderia mallei ATCC 23344
  CDS (1)..(747): transl_table=11
atgatcgtgttcgtcaccggtgcgtcggcaggtttcggcgccgccatcgcccgtgctttcgtccagggcggccaccgcgtcgtcgccgccgcccgccgcaaggagcgcctcgacgcgctcgccgccgagctcggcagcgcgctgttgccgatcgagctcgacgtgcgcgaccgtgcagccgtcgaagccgtggctgccgcgctgcccacggagttcgccgccatcgacgtcctcgtcaacaacgcgggcctcgcgctcggcgtcgagcccgcgcaccgggcgagcctcgacgagtggcagacgatgatcgacaccaactgcacgggcctcgtcacggtcacgcgcgcgctgctgcccggcatggtcgagcgcggccgcggccacatcttcaacctcggctcggtcgcgggcagctacccgtacccgggcggcaacgtctatggcgcgaccaaggcgttcgtgcgccagttcagcctgaacctgcgcgccgacctgatcggcacgccgctgcgcgtcaccgacatcgagccgggcctctgcggcggcaccgaattctcgaacgtgcgctaccgcggcgatgacgagaaggcggcgaacgtctacgcgaacgtccagccgctcaccgccgaagacatcgccgacacgatctactggatcgccacccgccccgcgcacgtgaacatcaacacgatcgagatgatgcccgtcgcgcaggcgcccgccggcctcgccgtccatcgcggctaa

SEQ ID NO: 94304 - protein, 248 aa, Burkholderia mallei ATCC 23344
MIVFVTGASAGFGAAIARAFVQGGHRVVAAARRKERLDALAAELGSALLPIELDVRDRAAVEAVAAALPTEFAAIDVLVNNAGLALGVEPAHRASLDEWQTMIDTNCTGLVTVTRALLPGMVERGRGHIFNLGSVAGSYPYPGGNVYGATKAFVRQFSLNLRADLIGTPLRVTDIEPGLCGGTEFSNVRYRGDDEKAANVYANVQPLTAEDIADTIYWIATRPAHVNINTIEMMPVAQAPAGLAVHRG

SEQ ID NO: 94305 - DNA, 735 bp, Nocardia farcinica IFM 10152
  CDS (1)..(735): transl_table=11
atgagcactcgcaccgccgtcgtcacgggagcaagttccggcatcggggaggccaccgcgcggcagctcgccgccgacggctaccacgtctacgtcggcgcgcgccggatggaccggctgcggacgctggccgaggagatcggtggcacggcactggaactcgacgtcacctccgaggattcggtgcgcgcgttcaccgatgcggtcgagcgggtggacgtgctggtcaacaacgccggtggcgcgaagggcctggcgccggtggccgaggccgacctcgacgactggcggtggatgtgggagaccaacgtgctcggcaccctgcgggtcaccaaggcgttgctgcccaagctcatcgactccggtgacggcctgatcgtcaccatcacctcggtggccgccttccacgcctacgacaacggctccggctacacctccgccaagcacgcccaggccgtgctgcaccgcacgttgcgcggcgagctgctggggcagccggtgcggctcaccgagatcgcgcccggcgcggtggaaaccgagttctcgctggtgcgcttcgacggtgacgccgagcgcgcggccaaggtctacgagggcatcgacccgctggtcgccgccgacatcgccgagatcgtcggcttcgtcgcctcgcggccgccgcacgtgaacctggaccagatcatcgtcaagccgcgcgaccaggccgatcccggccgcttcgcccgccgcggctga

SEQ ID NO: 94306 - protein, 244 aa, Nocardia farcinica IFM 10152
MSTRTAVVTGASSGIGEATARQLAADGYHVYVGARRMDRLRTLAEEIGGTALELDVTSEDSVRAFTDAVERVDVLVNNAGGAKGLAPVAEADLDDWRWMWETNVLGTLRVTKALLPKLIDSGDGLIVTITSVAAFHAYDNGSGYTSAKHAQAVLHRTLRGELLGQPVRLTEIAPGAVETEFSLVRFDGDAERAAKVYEGIDPLVAADIAEIVGFVASRPPHVNLDQIIVKPRDQADPGRFARRG

SEQ ID NO: 94307 - DNA, 774 bp, Legionella pneumophila str. Paris
  CDS (1)..(774): transl_table=11
atgaattttttaaacaataaaattgtaatgataaccggcgcgtccagcggcattggacaggcttgcgcccgactttttgctgcacaaggggcacggctcatcttggcggcacgacgagttgaacgtttacatgaattatccagcgagttaaaacatcataataatcaagaacattatattcttcctctggatgtctgtaagaaagatttggtgagacaacaaattgaatcgttgcccagtcagtggaactctattgatgtgttaattaataatgcgggtttggctctggacactttgcctttgcatcaaggaatattggagcattgggacaccatgatagataccaatattaaaggattgctttatattagccggctaattctcccagggatgttagaaaggaatagtgggcacgtcattaatattggttctatagcaggtcatgagtgttatcctaatggaaatgtttactcggccaccaagcatgctgttcatgcgatatcaaagtctatgcgattggatatgttaggaagtgcagttcgagtgactgaaattgcaccaggtgctgttgagacagagtttagcgaggttcgctggaaagacaaacagcgagctattgatttctataaggattttcaaccgcttatggccgaagatgttgctgatgctgctttgtattgcgccacaagacctctgcatgtcgatattgagcaaatgattattatgccaacagttcaggcttctgcaaatcatttgtcaaggagaggcagataa

SEQ ID NO: 94308 - protein, 257 aa, Legionella pneumophila str. Paris
MNFLNNKIVMITGASSGIGQACARLFAAQGARLILAARRVERLHELSSELKHHNNQEHYILPLDVCKKDLVRQQIESLPSQWNSIDVLINNAGLALDTLPLHQGILEHWDTMIDTNIKGLLYISRLILPGMLERNSGHVINIGSIAGHECYPNGNVYSATKHAVHAISKSMRLDMLGSAVRVTEIAPGAVETEFSEVRWKDKQRAIDFYKDFQPLMAEDVADAALYCATRPLHVDIEQMIIMPTVQASANHLSRRGR

SEQ ID NO: 94309 - DNA, 777 bp, Haloarcula marismortui ATCC 43049
  CDS (1)..(777): transl_table=11
atggcagataaatctgagacagacgacgaccagagcacacagcgactagcaggcgacgttgcgattgtcaccggcgcgtcatcgggaatcggtgaggcaactgccgaggcgctcgctgacgcgggcgcaagtgtcgcgctcgcggcccggcgcgctgacgaactggaggcccttgcggaccgaatcgagtcggccggcggggatgcactggttgtaccgaccgacgttaccgacgaggacgacatcgactcgctggtcgatgcaacgaccgacgagtacggtcgcatcgacattcttgtcaacaacgccggcgtgatgcttctcgaaccgctggaacgggcagaccgctcaaacctccgccagatggtcgaggtgaacctgctcgggctgatgaacctcacccacgcggtactcccggtcatgcaagagcaggagagcggccacgtcgtcaacgtctcttctgtcgcgggacgccgcgcatcggccgattcgagcggttacaacgcgacgaaattcggggtgaacgcgttcactgaggccgttcggcaggaagtaacgtcagagggcatccggacgacagttatcgaaccgggcgctgtcgatacggaactcgcaacacatgtgccggacgagcaggtgctggagcggttcgcggagatggacctcccgatgctccaccccgacgacatcgctcgcggcatcgtgtacgcaacgagccagcccgcccgtgtggacgtgaacgaactcctgatcagaccgaccggccaggatatctga

SEQ ID NO: 94310 - protein, 258 aa, Haloarcula marismortui ATCC 43049
MADKSETDDDQSTQRLAGDVAIVTGASSGIGEATAEALADAGASVALAARRADELEALADRIESAGGDALVVPTDVTDEDDIDSLVDATTDEYGRIDILVNNAGVMLLEPLERADRSNLRQMVEVNLLGLMNLTHAVLPVMQEQESGHVVNVSSVAGRRASADSSGYNATKFGVNAFTEAVRQEVTSEGIRTTVIEPGAVDTELATHVPDEQVLERFAEMDLPMLHPDDIARGIVYATSQPARVDVNELLIRPTGQDI

SEQ ID NO: 94311 - DNA, 744 bp, Haloarcula marismortui ATCC 43049
  CDS (1)..(744): transl_table=11
atggattcgggaccacttgcagagacaactgtactcgtcaccggagcgagttcgggtatcggcgcggcgaccgcccggaagctggcccgcgacggggctgacgtggcgttagttgcccgccgggaagaccgcctcactgaactggccgacgaaatcaccgacaaccacaccgtcggtacccacgtcgtgccagccgacgtcagcgaccgggcacaggtcacggccgctatcgaatcgaccgtcgaagcgttcggctcacttgacggcgttgtcgtcaacgccggggtcggccgcgggtcggacgttgagacgctgtcagacgagcagtaccggacgatgatggacgtcaacgtcgacggcgcgttctacaccgcccgcgagtcgctctcctatctccgggacggggccgggtcgctggtgttcgtcggtagcttcgccgggcagtatccccggccgttcaaccccgtctacgccgcgacgaagtggtggctccgtggcttcgcacatagcctcgccggccaggtcggtgacgacgacatcggcgtcacggttgtcaatccttcagaggtccggtcggagttcaactccgaggacggaacggcgttcaacgagcggttcgagccgggcgaggtgaccgagcccgaagaggtagccgacgctatcgccttcgccatgcgacaggagccaccgaccaccatcaacagcatcgacgtgttccgccgggacaaatttagccacttctag

SEQ ID NO: 94312 - protein, 247 aa, Haloarcula marismortui ATCC 43049
MDSGPLAETTVLVTGASSGIGAATARKLARDGADVALVARREDRLTELADEITDNHTVGTHVVPADVSDRAQVTAAIESTVEAFGSLDGVVVNAGVGRGSDVETLSDEQYRTMMDVNVDGAFYTARESLSYLRDGAGSLVFVGSFAGQYPRPFNPVYAATKWWLRGFAHSLAGQVGDDDIGVTVVNPSEVRSEFNSEDGTAFNERFEPGEVTEPEEVADAIAFAMRQEPPTTINSIDVFRRDKFSHF

SEQ ID NO: 94313 - DNA, 795 bp, Thermus thermophilus HB8
  CDS (1)..(795): transl_table=11
atgcgcctagcgggaaaagtagtggtggtcaccggcgcggggagcggcctgggccaggccctggccttggagcttttaaggcggggggcgagggtggcggcggtggacctaaggtcggagggcctccaagaaaccatggccaaggcgggaagcctaggggagggcttaagcctccaccccctggacatcaccgacaaggagaaggtggccgccctgcccgaggaggtggaacgggtccacggccaggtggacggcctcatcaacaacgccgggatcatccagccctttaagcgcctcttggacctggacgaggcggccatggagcgcgtgatgcgggtgaacttctggggtaccctccacatgacccgggcttttctgcccaggctcctcaagcgccccgaggcccacctggtgaacgtctccagcatgggggccttcgtgcccgtgccggggcaggccctttacggggcctctaaggcggcggtgatgctcctcaccgaggccctctgggccgaactccaggggaccccggtacgcgtcaccctggtcctgcccggggccatgcgcacggggatcgccgagcactcgggggtggaagccccgagggcggaaggggcgaaggtgcccgtcctcgagcccgaggtggcggccaagcgcctcctggacgccgtggaacgggacgccttccgagtgctcctgggccgggacgcccagaccatggacctcctctatcgcttaagccccgccctcgccgcccggatcgtccagcggcgcatggcccacctcctcacctga

SEQ ID NO: 94314 - protein, 264 aa, Thermus thermophilus HB8
MRLAGKVVVVTGAGSGLGQALALELLRRGARVAAVDLRSEGLQETMAKAGSLGEGLSLHPLDITDKEKVAALPEEVERVHGQVDGLINNAGIIQPFKRLLDLDEAAMERVMRVNFWGTLHMTRAFLPRLLKRPEAHLVNVSSMGAFVPVPGQALYGASKAAVMLLTEALWAELQGTPVRVTLVLPGAMRTGIAEHSGVEAPRAEGAKVPVLEPEVAAKRLLDAVERDAFRVLLGRDAQTMDLLYRLSPALAARIVQRRMAHLLT

SEQ ID NO: 94315 - DNA, 705 bp, Thermus thermophilus HB8
  CDS (1)..(705): transl_table=11
atggagggcatgaagggcgccgtcctcatcacgggagcgagccgcggcatcggcgaggccaccgcccgcctcctccacgccaaggggtaccgggtgggcctcatggcccgggacgaaaagaggctccaggccctcgccgccgagctggagggggccctaccccttcccggggacgtccgggaggagggggactgggcccgggccgtggccgccatggaggaggccttcggggagcttagcgccctggtgaacaacgccggggtcggggtgatgaagcccgtccacgagctcaccctggaggagtggcggctcgtgctggacaccaacctcacgggggccttcctcggcatccgccacgccgtccccgccctcctgcgccggggcgggggcaccatcgtcaacgtggggagcctcgcggggaagaaccccttcaagggcggggccgcctacaacgccagcaagttcggccttttgggcctcgccggggccgccatgctggacctccgggaggcgaacgtccgggtggtgaacgtcctcccgggctccgtggacaccggcttcgccgggaacaccccgggccaggcctggaagcttaagcccgaggacgtggcccaagcggtcctcttcgccctggagatgcccgggcacgccatggtgagcgagattgagctccggcccacccggcccacgtccggcccgcggtaa

SEQ ID NO: 94316 - protein, 234 aa, Thermus thermophilus HB8
MEGMKGAVLITGASRGIGEATARLLHAKGYRVGLMARDEKRLQALAAELEGALPLPGDVREEGDWARAVAAMEEAFGELSALVNNAGVGVMKPVHELTLEEWRLVLDTNLTGAFLGIRHAVPALLRRGGGTIVNVGSLAGKNPFKGGAAYNASKFGLLGLAGAAMLDLREANVRVVNVLPGSVDTGFAGNTPGQAWKLKPEDVAQAVLFALEMPGHAMVSEIELRPTRPTSGPR

SEQ ID NO: 94317 - DNA, 789 bp, Geobacillus kaustophilus HTA426
  CDS (1)..(789): transl_table=11
gtgcggctgaaggggcgccatgtcgtcattaccggagcgtcgggaggaattggcgagcaaatcgcctatgaagcggcgcgccaaggggcggtgccggtgctcttggcgcgcagtgaagaaaagctgaaagaagcgagcgcgcggatcgaagcgcaaaccggcattcgcgccccgtacgcgccgcttgatgtcagcgaccgcgagatggtcgaagcggtatttgcgaagctgtctgctgaactgggcgctatcgatgtgcttgtgaacaatgccggatttggcgtatttcgctacgtggaagatatcgaccttgacgagatggaacggatgtttgcggtcaatgtcttcggcttgatcgcctgcacgaaggcggtgtatccgcatatgaaagaacgccgaagcggccacattctcaatatcgcctcgcaagccggcaaaatcgcgacgccgaagtcgagtgtctattccgcgacgaaacacgcggtcgttggctttaccgacagcctccgcctcgaggcggggcgctttggcatttttgtcacggccgtcaatccggggccggtggagacgaactttttttcggccgctgatgaatcgggagagtatgtgcgcaatgtctcgcgttggatgttaaggccggaggcggtggcgaagcgcgttgttgccgcgatgatgacgccaacgcgcgaagtgaacatgccgcgttggatggatctcggcagccggctgtaccggctcgctccgggtcttgtggaaaaggtggcaaagcgggcgtttttccaaaagtaa

SEQ ID NO: 94318 - protein, 262 aa, Geobacillus kaustophilus HTA426
MRLKGRHVVITGASGGIGEQIAYEAARQGAVPVLLARSEEKLKEASARIEAQTGIRAPYAPLDVSDREMVEAVFAKLSAELGAIDVLVNNAGFGVFRYVEDIDLDEMERMFAVNVFGLIACTKAVYPHMKERRSGHILNIASQAGKIATPKSSVYSATKHAVVGFTDSLRLEAGRFGIFVTAVNPGPVETNFFSAADESGEYVRNVSRWMLRPEAVAKRVVAAMMTPTREVNMPRWMDLGSRLYRLAPGLVEKVAKRAFFQK

SEQ ID NO: 94319 - DNA, 675 bp, Idiomarina loihiensis L2TR
  CDS (1)..(675): transl_table=11
atgtccaaagtattattgataacaggtgcctcaagcggcattggtgaagccagtgcccgaaaagcggcgaaagaaggattaaagctgatattaacggcgcgccggaaagaaaaactggatgcgctggttaaggagtttggtgcggataatgctattggtgtggctgccgatgccggaaattatgaccagttagccgaggctgtaaagcagggcgttgataagtttggtcagctggatgcggtattcgctaacgccggaaccggggtttcgaccgccggaacagaagaaggcgacccagacgagtggaagtctatggtggatgtgaatatcaatggtcttctgtacacggcgaaactgaccttaccgcatttacgtaaaactaccggtcactttttaatgacaggctctgccgccgggcgaattacgctaaaaggttcggtttatggtgcgactaagtggttcgttcatggctttgcccagaacctggccgaagaaatgaaagagtggaacggccgctgcacaaccatagcaccgggtatggtcaatacgccgttcttcgatgaacctaagccggacaaactggctcctgaagacgttgccgatgcggtattgtattcaatcaatgcgaatccgcgtaattgtgtgcgcgaagtgttcttaatgccggcgtattga

SEQ ID NO: 94320 - protein, 224 aa, Idiomarina loihiensis L2TR
MSKVLLITGASSGIGEASARKAAKEGLKLILTARRKEKLDALVKEFGADNAIGVAADAGNYDQLAEAVKQGVDKFGQLDAVFANAGTGVSTAGTEEGDPDEWKSMVDVNINGLLYTAKLTLPHLRKTTGHFLMTGSAAGRITLKGSVYGATKWFVHGFAQNLAEEMKEWNGRCTTIAPGMVNTPFFDEPKPDKLAPEDVADAVLYSINANPRNCVREVFLMPAY

SEQ ID NO: 94321 - DNA, 738 bp, Idiomarina loihiensis L2TR
  CDS (1)..(738): transl_table=11
atgtcagaagtacaagataaagttgtgattattacaggtgcaagcagtggtttaggagaagagaccgctcgtatgcttgcagcaaaaggcgcaaaactgatgttagcggcgcgtcgcgaagatcgcctaaaagaattgactgagtcaattaagaaagacggtggccaggcagcttaccgtgtggttgatgtaaccgacaaagccgcagttcaaaaactggctgacgacaccaaagctgaatttggtcgtattgatgtcttaattaataacgccggactcatgccactggccccgctcgacgcgctgaaagtggacgaatgggacaccatgattgatgtgaacattaaaggtgttctatatggcgtagctgctgtattaccggttatgcgtgaacagcatgtgggtcatatcatcaacctgtcatcggttgcaggtcagaaagtttttgctggcggaacggtgtattgcgcaaccaagtttgcggtaaaagccatttccgaaggcattcgtcaggaatctaatggtgaaattcgcgcgaccaatatttcaccgggcgctgtagcaacagaactgacggatcacattagtgacaaagacgcgaaagaaatggctgacagtttgtattcagacgcgattgattctgcggctattgctcgtgccattacctttgcgattgagcaacctcagcaagttgacgtgaatgaaatgatcattcgcccaaccaagcaagagctgtaa

SEQ ID NO: 94322 - protein, 245 aa, Idiomarina loihiensis L2TR
MSEVQDKVVIITGASSGLGEETARMLAAKGAKLMLAARREDRLKELTESIKKDGGQAAYRVVDVTDKAAVQKLADDTKAEFGRIDVLINNAGLMPLAPLDALKVDEWDTMIDVNIKGVLYGVAAVLPVMREQHVGHIINLSSVAGQKVFAGGTVYCATKFAVKAISEGIRQESNGEIRATNISPGAVATELTDHISDKDAKEMADSLYSDAIDSAAIARAITFAIEQPQQVDVNEMIIRPTKQEL

SEQ ID NO: 94323 - DNA, 750 bp, Zymomonas mobilis subsp. mobilis ZM4
  CDS (1)..(750): transl_table=11
atgtccaagaccgctttaattacgggagcaacggcaggtttcggcgcagcgacagcacggcttttcgtgcgtcatggctggaaggtggtggcaacaggtcgcaggcgtgaccgtttagacgaattggttcgtgagctgggtgaagaaaatctttttccggcggttttcgatattagagatgaaaacgccatgaaggaggcgctgtcttctctgccttccgaattttctgaaattgatttgttaatcaataatgccggtcttgcccttggcaccaagcctgcgcctgatattcaattggatgattggcgtatcatgatcgataccaatgtcactgccttggccgttattacccagcatttattgcctaagctgatcgaacgtcagggtatgattatcaatttgagttcggttgctgcccattggccttatcccggcgggaattgctatggtgggacaaaagcctttgtccgtcaattttcttatggtttacgctgtgatttgcatggcaccggtgttcgtgtaacgtctattgaacccggtctttgcgagagtgagtttactttggtgcgaaccaaaggtgatcagaaagcctatgatgaaacctataagggggcaaaagctctacagccggaggatatcgccgagaccctgttctgggtcgccagtcagcctgcccatattaatatgaattcgattgagctgatgccggtcagccaaacatggaatccattccgaatttatcgcggttaa

SEQ ID NO: 94324 - protein, 249 aa, Zymomonas mobilis subsp. mobilis ZM4
MSKTALITGATAGFGAATARLFVRHGWKVVATGRRRDRLDELVRELGEENLFPAVFDIRDENAMKEALSSLPSEFSEIDLLINNAGLALGTKPAPDIQLDDWRIMIDTNVTALAVITQHLLPKLIERQGMIINLSSVAAHWPYPGGNCYGGTKAFVRQFSYGLRCDLHGTGVRVTSIEPGLCESEFTLVRTKGDQKAYDETYKGAKALQPEDIAETLFWVASQPAHINMNSIELMPVSQTWNPFRIYRG

SEQ ID NO: 94325 - DNA, 747 bp, Zymomonas mobilis subsp. mobilis ZM4
  CDS (1)..(747): transl_table=11
atgaaccagaatatccgcaataaaattgttgtcattacaggggctagcagtggtttaggcgctgaaacggcacggcatttgtcagatttgggggcaactgttgtgctgggtgcaaggcgagaggaacgcatcgcaacattagcgaattctatcgtcgctaagggtggtcaagccttggctatcaaaaccgatgtgactgaccgtgagtcggttaaaaatttggttgatacagctgtaaaaacctatgggcgggttgatgtccttctcaataacgccggtgtaatgcccctttccccgcttgagaaactacgcgtcgatgaatgggaattgatggttgatgttaatatcaaaggcgttctttatgggattgcagccgctctacctcatatgaaatcccaaaaatttggccatatcatcaatgtctcttcggttgccggtcacaaggttattgatgggggggcggtttattcggcgacaaaatttgccgttcgcgcgctttctgaaggattacgagccgaagtgaagtcctataatttacggacgaccatcatttcgccgggcgccgttcagtcggaattgattgatggtattcatgatgaagaatccgcgaaacaaatccgcgcaatagtcccagatatggcgatcggtgcggattcttttgcccgctgtgtggcctttgcgatcagccaacctgaaaatgtcgatattaatgaaattctgttccgaccgacaaaacaggcattataa

SEQ ID NO: 94326 - protein, 248 aa, Zymomonas mobilis subsp. mobilis ZM4
MNQNIRNKIVVITGASSGLGAETARHLSDLGATVVLGARREERIATLANSIVAKGGQALAIKTDVTDRESVKNLVDTAVKTYGRVDVLLNNAGVMPLSPLEKLRVDEWELMVDVNIKGVLYGIAAALPHMKSQKFGHIINVSSVAGHKVIDGGAVYSATKFAVRALSEGLRAEVKSYNLRTTIISPGAVQSELIDGIHDEESAKQIRAIVPDMAIGADSFARCVAFAISQPENVDINEILFRPTKQAL

SEQ ID NO: 94327 - DNA, 723 bp, Francisella tularensis subsp. tularensis Schu 4
  CDS (1)..(723): transl_table=11
atggctaaatcgttagtaataatcactggagcaagttcaggaattggtgcagctattgcaaaacgtttttctgaagcagggcattcacttttattagttggtagaagagtagagaaaattgaagaattaaatctaccaaatacactgatccgtaaagttgatgtaacagatgcacatgctttaaaaaatgcaataaaagaagcagaagcacagtatggacctgtagattgtctagtaaataatgcagggctaatgctacttggtcaaattgatacccaagatccgattgagtggcaaaaaatgtatgatgtgaatgtattagcattgcttaatggaatgcaggcagtactcgctgatatgagatctagaaaaactgggacaattattaatataagctcgattgctggtaaaaagtcatttgccaaccatgcagcatatgttgggacaaaatttgcagtttcttcgataagtgagacagttcgcgaagaggttgctaatgataatgtaagaattatgacaatttgtccaggtgcggttgaaactgagcttctaagccatactacttcagaaaaaataaaagaagattatcaaagctggaaagaatctatgggaggagtactagcagcagatgatattgcacgcacagcgatgtttatgtatagtcaaccacaaaatataaatattcgtgaggttgtgattgcagcaactaaacaacctgcatag

SEQ ID NO: 94328 - protein, 240 aa, Francisella tularensis subsp. tularensis Schu 4
MAKSLVIITGASSGIGAAIAKRFSEAGHSLLLVGRRVEKIEELNLPNTLIRKVDVTDAHALKNAIKEAEAQYGPVDCLVNNAGLMLLGQIDTQDPIEWQKMYDVNVLALLNGMQAVLADMRSRKTGTIINISSIAGKKSFANHAAYVGTKFAVSSISETVREEVANDNVRIMTICPGAVETELLSHTTSEKIKEDYQSWKESMGGVLAADDIARTAMFMYSQPQNINIREVVIAATKQPA

SEQ ID NO: 94329 - DNA, 750 bp, Campylobacter jejuni RM1221
  CDS (1)..(750): transl_table=11
atgaaaaccgcatttattacaggagctagttcaggttttggtagagcttgcgttgaagcttttatacaagaaggctacaaagtaatcgcccttgctagacgcaaagagcgtctagaagagctaaaaaatgcttacaaagataagatttacaccctttgcatagatgtaagaaatcaaaaagaaatctttgaagctattgaaaatttacctaaagaatttcaagaaattgatgtgctttttaataatgcaggcttggctttaggagtagatgaatttgataaattaaaccttgaagatattaacactatggtagatacaaacatcaaaggatttttatatgttgcaaaagctgttattcctatacttcgcaaacaaaaaaatgcttatatttttaacttaggttcggttgcgggacgcaatccttattttggaggcaatgtgtattgtggaaccaaagcctttgtaggacaattttcattggccttaagaaatgatcttagaggaagcaatatcaaagtaacaaacattgctccaggactttgcaaaactgaatttagtgaagtgcgttttaaaggagatatccaaaaagctgatgcagtgtatgaaaatacgcaatttatcagtgctaatgatattgccaaagtggtaatgtctatcattaacctaccaagccatattaatgttaatgaaatcgagcttatgccggtaacacaaacttggaatggattttatatagaaagagatgaatga

SEQ ID NO: 94330 - protein, 249 aa, Campylobacter jejuni RM1221
MKTAFITGASSGFGRACVEAFIQEGYKVIALARRKERLEELKNAYKDKIYTLCIDVRNQKEIFEAIENLPKEFQEIDVLFNNAGLALGVDEFDKLNLEDINTMVDTNIKGFLYVAKAVIPILRKQKNAYIFNLGSVAGRNPYFGGNVYCGTKAFVGQFSLALRNDLRGSNIKVTNIAPGLCKTEFSEVRFKGDIQKADAVYENTQFISANDIAKVVMSIINLPSHINVNEIELMPVTQTWNGFYIERDE

SEQ ID NO: 94331 - DNA, 756 bp, Gluconobacter oxydans 621H
  CDS (1)..(756): transl_table=11
atgcctctcaccgtcctcgtcaccggcgcaaccgcaggtttcggtcacgccatagcaacgcgcctcgtccgcgaaggtcaccgtgtcatcgcgaccggccgccgcaaggaacgtctggaagccctcaaggacgaactgggcgagagcgtccttccctatacgctcgacatgaccgaccgtgaggccctgcgcgccctgccggccgcgctgcccgaggagtggcaggatatcgacgtgctggtgaacaacgccggtctcgcactcggcatggagccggcgcaggatgccgagcccgacaactgggaatcgatgatcgccacgaacgtttcgggcgtcgtggagctgacccgcgcgctcctgccggggatggtccagcgcaatacgggctacatcatcgcactgggcagcacggccgggacctatccctacaccggcggcaacgtctatggcgcgaccaaggccttcgtgcaccagttcacccagaacctgcgcacggatctgctcggcacccgcatccgcgtgacgaatatcgaacccggcctgtgtggcggcagcgagttcagcaacgtgcgtctgggcgatgatgccaaggcggccgctgtctacaaggacacgacgccgctgacgcccgaagacatcgccgggaccgtctcctggctgattggcctgccctggcatgtgaacgtcaattatctggaaatgatgccggtctgtcaggcctcgggtggacttgcggtgaaccgtcatgtcggctga

SEQ ID NO: 94332 - protein, 251 aa, Gluconobacter oxydans 621H
MPLTVLVTGATAGFGHAIATRLVREGHRVIATGRRKERLEALKDELGESVLPYTLDMTDREALRALPAALPEEWQDIDVLVNNAGLALGMEPAQDAEPDNWESMIATNVSGVVELTRALLPGMVQRNTGYIIALGSTAGTYPYTGGNVYGATKAFVHQFTQNLRTDLLGTRIRVTNIEPGLCGGSEFSNVRLGDDAKAAAVYKDTTPLTPEDIAGTVSWLIGLPWHVNVNYLEMMPVCQASGGLAVNRHVG

SEQ ID NO: 94333 - DNA, 747 bp, Gluconobacter oxydans 621H
  CDS (1)..(747): transl_table=11
atgaccacggacaacatcgccggaaaggtcgtcctcatcacaggcggcagctccggactcggcgaagccacagcccgttacctcgcagcccagggcgcaaagatagccatcgccgcccgccgccgtgaccggctggacgaaatcgtctccgaactcacggcacagggccagaccgcccgcgcctacacactcgacgtcacgaaacgctccgaggtcgaagagaccgtcgccgccgtcacccgcgatttcggccgtctggacgttctggtgaacaatgctggcctcatggccatcgcccccatccggaagctgatggtcgatgaatgggaccggatgatcgacatcaacatcaagggcgtgctctacggcgtcgccgccgccctgccggtgttcgaaaaacagaaatccggacacgtcatcaacctgtcctccgtcgctggcctgaaggtctttgctccgggtggcacggtctattccggcacgaaattcgccgtccgcgccatcagcgaaggcctgcggcaggaagccggcaacaccttccgcgtcacctccatcgagcccggcgcggtccagagcgaactcaagtccggaagcggtgacacagacagtcgcaaaaccgtggaagagttctataagatggcgatcccggcggactcagtggcccgtgccatcgccttcgccatttcacagcctgacgacgtggacatcaacgagatcgtcctgcgcccgaccagacaggagttttaa

SEQ ID NO: 94334 - protein, 248 aa, Gluconobacter oxydans 621H
MTTDNIAGKVVLITGGSSGLGEATARYLAAQGAKIAIAARRRDRLDEIVSELTAQGQTARAYTLDVTKRSEVEETVAAVTRDFGRLDVLVNNAGLMAIAPIRKLMVDEWDRMIDINIKGVLYGVAAALPVFEKQKSGHVINLSSVAGLKVFAPGGTVYSGTKFAVRAISEGLRQEAGNTFRVTSIEPGAVQSELKSGSGDTDSRKTVEEFYKMAIPADSVARAIAFAISQPDDVDINEIVLRPTRQEF

SEQ ID NO: 94335 - DNA, 795 bp, Lactobacillus acidophilus NCFM
  CDS (1)..(795): transl_table=11
atgaaagattcattaagaaacaaagttgttgttattactggtgcttcgagtggtattggccgctcaattgcgcttgaaagtgcaggccgcggtgcaacggtgattttaatcgctagaagaaaagatcgtttagaagaaattactgctgaagcaaaagaattatcgggtgcagaggcatatgtttttccaactgatatgggtaagccagagagtattgaaaaaacttttgatgaaattactaaacaagttaaacatattgactttttagttaactgtgctggctttggtaaatttgaagaattcatggaacaaaagatgcaagatgttactaatatgttccaagttaatgttttggggctaatgtactttactagattgattggtcgtgtcatgatggatcaaaagactggtcaaatcattaactttggttcaattgcgggcaaggttccaacaactaaatctgctgcatatagtgcatccaaggcagcagttattcaattttctaatgtattacgtcttgaacttaagccatttggtgttaaagtgatgaccgtaaatccaggtcctgtatatactaatttctttaatgttgcagacaagactggtaattatgtcaaaaatgttcaagagtttatgcttgatccagatgatgtcgcatggcaagtagttcatttctttggtagtgataagcgtgaacttaatttgccacttagtttagcagttttagctaagttatataatttattcccaacaattggagataaaatttctttggagtttgcttctagaaagtaa

SEQ ID NO: 94336 - protein, 264 aa, Lactobacillus acidophilus NCFM
MKDSLRNKVVVITGASSGIGRSIALESAGRGATVILIARRKDRLEEITAEAKELSGAEAYVFPTDMGKPESIEKTFDEITKQVKHIDFLVNCAGFGKFEEFMEQKMQDVTNMFQVNVLGLMYFTRLIGRVMMDQKTGQIINFGSIAGKVPTTKSAAYSASKAAVIQFSNVLRLELKPFGVKVMTVNPGPVYTNFFNVADKTGNYVKNVQEFMLDPDDVAWQVVHFFGSDKRELNLPLSLAVLAKLYNLFPTIGDKISLEFASRK

SEQ ID NO: 94337 - DNA, 738 bp, Vibrio fischeri ES114; identical to SEQ ID NO: 61763
  CDS (1)..(738): transl_table=11

SEQ ID NO: 94338 - protein, 245 aa, Vibrio fischeri ES114; identical to SEQ ID NO: 61764

SEQ ID NO: 94339 - DNA, 720 bp, Vibrio fischeri ES114
  CDS (1)..(720): transl_table=11
atgaaaaaattagttgttattacaggtgcaagttctggtattggtgaagcaatcgctcgtcgtttaagcgatgaaggtcatcctctacttcttcttgctcgtcgtattgatcgccttgaagcacttaacctaccaaactctttatcagtaaaagtagacgtaacagacaaagcctcttttgaagcggctattgctcagggcgaagcaaagtttggtcctgtagatgctatcgtaaataacgctggcgcaatgcttcttggtcaaattgacactcaagatgcacaagagtggaaaaccatgtttgatgttaacgttcttggacttcttaatggtatgcaagcagttcttgctcctatgatggagcgtaacagcggtactatcattaacatcagctctattgctggtaagaaaacgttccctaaccatgcagcttactgtggtactaaatttgcggttcacgcaatctctgaaaacgtgcgtgaagaagtagcgctatcaaacgttcgtgtaacaacaattgcaccgggagcggttgagactgaacttctatctcatacgtcttctcaagaaattaaagatggctacggtgagtggaaagaaagcatgggtggcgtactagctgctgacgacattgctcgtgcagtatcttttgcttaccaacaacctcaaaacgtttgtattcgtgaaattgctcttgctccaactaagcagcagccatag

SEQ ID NO: 94340 - protein, 239 aa, Vibrio fischeri ES114
MKKLVVITGASSGIGEAIARRLSDEGHPLLLLARRIDRLEALNLPNSLSVKVDVTDKASFEAAIAQGEAKFGPVDAIVNNAGAMLLGQIDTQDAQEWKTMFDVNVLGLLNGMQAVLAPMMERNSGTIINISSIAGKKTFPNHAAYCGTKFAVHAISENVREEVALSNVRVTTIAPGAVETELLSHTSSQEIKDGYGEWKESMGGVLAADDIARAVSFAYQQPQNVCIREIALAPTKQQP

SEQ ID NO: 94341 - DNA, 738 bp, Magnetospirillum magnetotacticum MS-1
  CDS (1)..(738)
atgaagagcatcgcggacaaggtcgtcgccattaccggcgctggtagcggcatcggccgtgccatcgctctcgaactttccagccatggggctaagctcgtcttgagcggtcgtaccgcggcgccgctggaggaattggcgtcggagatcacaggctcgggcggcgacgcgattgtcgcgctcgccgaggtcagtcgccgcgatgacgtcgtagctctcgtccaggcggcgcttgatcgccatgggcaactcgatgcgatcgtcagcaatgccggcgtcgcgcccatctcgccgctcgccgacctgaaggtcgacgattgggattcgatggtcgacgtgaatattaaaggtgcgctgaacgtcgtagcggccgcattgccggtcttcctgcgccagcagaggggacactttgtcttcacagtctcgaccgcgggtctcatcgtcagccctaccatggcggtctatgccgcgacgaagaacgcaatccggacgcttgccgaagggctccgggttgagtccgaaggtaaatatcgggtgacgggaatctctcctggttttgtagcgaccaacctggcgcagtcgatgacagacgagaagatgcgggacgctatcaaggcgcagatggacgagatagcgctggcccctgaagacgtggcccgcgccgtgagtttcgcggtcgcccaacccgatcacgtcgatgtcggcgatatcgtgatccggccagcggtgcaaaactga

SEQ ID NO: 94342 - protein, 245 aa, Magnetospirillum magnetotacticum MS-1
MKSIADKVVAITGAGSGIGRAIALELSSHGAKLVLSGRTAAPLEELASEITGSGGDAIVALAEVSRRDDVVALVQAALDRHGQLDAIVSNAGVAPISPLADLKVDDWDSMVDVNIKGALNVVAAALPVFLRQQRGHFVFTVSTAGLIVSPTMAVYAATKNAIRTLAEGLRVESEGKYRVTGISPGFVATNLAQSMTDEKMRDAIKAQMDEIALAPEDVARAVSFAVAQPDHVDVGDIVIRPAVQN

SEQ ID NO: 94343 - DNA, 744 bp, Leuconostoc mesenteroides subsp. mesenteroides ATCC 8293
  CDS (1)..(744)
atggccgattcaaaagtaattgttataactggtgcctcatctggtattggtgaagctattgctaaaaagcaagcagcagccggagacaagattgttttaggtgcacgtcgtgaggaaaacttgaaacaaattaaggcagatattgaagctggcggaggtcaagcagagtatttagtaactgatgtcacagatgttgagcaagttaaagcgttggctcaaaaagctatggatgcctatggccgtattgatgtttggatcaacaatgcaggattgatgcctcattcattattaattgatgccagaattgacgattggaatcgcatgattgacgttaacttgaaaggtacgttgtacggtattgctgctgcacagcacatcttccatgatcaaaatacaggtcacttcatcaacttgggttctgtggctagtctttattcacatgctggtggagcggtttattcagctactaaatgggctgttaaagccatctctgaaagtttacgcgaagaagaagcgcaagctggtaaaaatgttcgtgtgacatcactttatcctggtgcaattgaatcagaattggttgctaatatgacggattcaaagcgtcgtgaagcaacagctgaattttacaagaactttgccattccagctgaacgtattgcgcaaattgttaatgatgtcttgaatatgccaacagatacgacactgaacgaaattgttgtacggccaacaactcaagtacaataa

SEQ ID NO: 94344 - protein, 247 aa, Leuconostoc mesenteroides subsp. mesenteroides ATCC 8293
MADSKVIVITGASSGIGEAIAKKQAAAGDKIVLGARREENLKQIKADIEAGGGQAEYLVTDVTDVEQVKALAQKAMDAYGRIDVWINNAGLMPHSLLIDARIDDWNRMIDVNLKGTLYGIAAAQHIFHDQNTGHFINLGSVASLYSHAGGAVYSATKWAVKAISESLREEEAQAGKNVRVTSLYPGAIESELVANMTDSKRREATAEFYKNFAIPAERIAQIVNDVLNMPTDTTLNEIVVRPTTQVQ

SEQ ID NO: 94345 - DNA, 759 bp, Azotobacter vinelandii
  CDS (1)..(759)
atgggcaacatcgtcttcatcaccggcgccacctccggtttcggccgcgccgcggcgcgccgcttcgccgccgcgggctggtccctggttctcagcggtcgtcgtctggaacgcttgcaggcgttgcaggaagaactccagggcaaggtgccggtgcacatcgccgcgctcgacgtgcgcgacgccgaggccgtgcgccaggtggtcgcggcgctgcccgagggcttccgccaggtccgggcgctgatcaacaacgccggcctggccctggccccgcagccggcgcagcaggtggcgctggaggattggcacaccatgatcgacaccaacgtcaccggcctggtcaacgtcacccacgcgctgctgccgaccctgatcgccagcggccagggcgccagcatcgtcaacctcggctcggtcgccggccactggccctatccgggcggccacgtctacggcgcgaccaaggccttcgtcgagcagttcggctacaacctgcgctgcgacctgctgggtaccggcgtgcgggtcaccgacatcgcgccgggcatggccgagaccgaattcaccctggtgcgcaccaagggcgaccaggccgcgtccgaccggctgtatcgcgggacgacgccgctgaccgccgaggacatcgccgagcagatcttctacgtggcgagcctgccggcgcacatcaacatcaatcgcctggaggtcatgccgacccgccaggcctggcagccgttcgccgtggaccgcgactga

SEQ ID NO: 94346 - protein, 252 aa, Azotobacter vinelandii
MGNIVFITGATSGFGRAAARRFAAAGWSLVLSGRRLERLQALQEELQGKVPVHIAALDVRDAEAVRQVVAALPEGFRQVRALINNAGLALAPQPAQQVALEDWHTMIDTNVTGLVNVTHALLPTLIASGQGASIVNLGSVAGHWPYPGGHVYGATKAFVEQFGYNLRCDLLGTGVRVTDIAPGMAETEFTLVRTKGDQAASDRLYRGTTPLTAEDIAEQIFYVASLPAHININRLEVMPTRQAWQPFAVDRD

SEQ ID NO: 94347 - DNA, 744 bp, Nostoc punctiforme PCC 73102
  CDS (1)..(744)
atgattaaagacaaagttgtaattattaccggcgcatcatcagggattggtgaagcaagtgcgaaattgcttgcaagcaaaggcgctaaagtcgtattgggtgcgcgacgcgatcgccaattgagacaactggttgatgaaattcaaagagatggcggacaagcagtctatcaagtgatggatgtggttaacccatctgatagcgctgaaatcgtcaaccttgccaaggaaagatttggaggcatcgatgttattttcttgaacgctggcataatgcccaattctccactctctgcattgaaaacggatgaatggaatcaaacagttgatatcaatatcaagggtgtactcaatggtatcgctgctgtgttaccaacgtttattagccaaaagtctgggcatgttatcacaacttcatcggttgctgggttaaaagcttatccaggtggtgcagtgtatggtgggacgaaatggttcgtgcgcgatttcatggaagttctacgcatggagtctgctcaagaggggactaagattcgtactgcgacaatttatcctgcggcaattaacactgagttgttaaatcagattaccaaccaagatatggctgaaaaaatgacagagttgtatgagcaatatggcatctcacccgatcgagtagccaatgttgtggcgtttgcgattgaccagccagaagacacaaacgtgaacgaatttacgattggcccaaccacgcagccttggtaa

SEQ ID NO: 94348 - protein, 247 aa, Nostoc punctiforme PCC 73102
MIKDKVVIITGASSGIGEASAKLLASKGAKVVLGARRDRQLRQLVDEIQRDGGQAVYQVMDVVNPSDSAEIVNLAKERFGGIDVIFLNAGIMPNSPLSALKTDEWNQTVDINIKGVLNGIAAVLPTFISQKSGHVITTSSVAGLKAYPGGAVYGGTKWFVRDFMEVLRMESAQEGTKIRTATIYPAAINTELLNQITNQDMAEKMTELYEQYGISPDRVANVVAFAIDQPEDTNVNEFTIGPTTQPW

SEQ ID NO: 94349 - DNA, 735 bp, Nostoc punctiforme PCC 73102
  CDS (1)..(735)
atgttaaacgtagaaaataaagtcattgcgatcgctggagccagtagcggtattggtgaagccacagctaagttactcgctaaaaatggtgcaaaagtcgttttaggggcacggcgcacccaaaagctagaaaagattatcgaggagatccgtaaccagggttatatagcggaattcaaagcggtggatgttacgaatcgtgaggatatgaaagcgttcattcacttcgccaaagataagtttggtcgtgtcgatgtcatctttaacaatgcaggcgtgatgcccctatcgccgatgaatgccctgaaagtcgaggaatgggacaacatgattaatgtgaatatccacggcgtattgaatggtattgctgctggtttaccaatcatggaagcgcaaggcagtggacagtttatcaataccgcgtccatcgccgcgcacatggtagggcctaccagcgcggtctattccgcgacaaaatttgctgtttgggccatatccgatggattacgtcaagaatcgaaaaatattcgcgtgacaataatatcccctggcgtggttgagactgaactcggctctgatatcacagatgaatcagcaacaggcttcttgaaagaacttcggaaaatcgcactgaccccagatgcgatcgctagagccgtcttatatgccgtatcccaaccggatgatgttgatatcaatgaagtgattgtccgtccgacggcaagcgcattctaa

SEQ ID NO: 94350 - protein, 244 aa, Nostoc punctiforme PCC 73102
MLNVENKVIAIAGASSGIGEATAKLLAKNGAKVVLGARRTQKLEKIIEEIRNQGYIAEFKAVDVTNREDMKAFIHFAKDKFGRVDVIFNNAGVMPLSPMNALKVEEWDNMINVNIHGVLNGIAAGLPIMEAQGSGQFINTASIAAHMVGPTSAVYSATKFAVWAISDGLRQESKNIRVTIISPGVVETELGSDITDESATGFLKELRKIALTPDAIARAVLYAVSQPDDVDINEVIVRPTASAF

SEQ ID NO: 94351 - DNA, 780 bp, Nostoc punctiforme PCC 73102
  CDS (1)..(780)
atgacttccctacaaaatcaaatcattttgattactggcgcaagtagtggtattggtactgcttgtgcgagaatcttcgctggtgcgggtgcaaaactaatcctagcagcacgacggttagaacgtttgcagcagctaaaagatgctctcattaaagaatttggtattgaaattcatttattacagctagatgtgcgcgatcgcaacgctgtcgaatctgccatctctactctaccgcctgcctggtctaacatcgacattctgattaacaatgctggtctaagtcgtggtttagacaagttgcacgaaggcagctttcaagactgggaagacatgattgatactaacgttaagggtttactttatgtttcccgttatgttgttccgggaatggtgagtcgcgatcgcggccatgtggtaaatttaggttccattgccggacatcaaacctatcccggtggcaatgtctactgtgctaccaaagctgctgtgagagcaatttctgaaggtttaaaacaagacttgttgggaacgcgggtacgtgtaacttccgttgaccctggtatggtggaaacggaatttagcgaggtgcggtttcacggaaatactgaacgtgctaaaacggtctatcaaggagttatcccactgacagcagatgatgtggctgatgtgatatttttctgtgtgacgcgatcgccccatgtcaatattaacgaagttgtgctgatgcctgttgaccaagctagcgctacgttagttaatcggcgaacagaaaaataa

SEQ ID NO: 94352 - protein, 259 aa, Nostoc punctiforme PCC 73102
MTSLQNQIILITGASSGIGTACARIFAGAGAKLILAARRLERLQQLKDALIKEFGIEIHLLQLDVRDRNAVESAISTLPPAWSNIDILINNAGLSRGLDKLHEGSFQDWEDMIDTNVKGLLYVSRYVVPGMVSRDRGHVVNLGSIAGHQTYPGGNVYCATKAAVRAISEGLKQDLLGTRVRVTSVDPGMVETEFSEVRFHGNTERAKTVYQGVIPLTADDVADVIFFCVTRSPHVNINEVVLMPVDQASATLVNRRTEK

SEQ ID NO: 94353 - DNA, 819 bp, Nostoc punctiforme PCC 73102
  CDS (1)..(819)
atggctcctacggtgctaattacaggtgcttctgaaggcattggcaaagcaacggctcttttatttgcgcggcaaggatatgacttggtacttgcagctcgtcatgctgaccgcttggaagccttagcgcaggaagtgcaaagcattggctgccctgcaccattaacgattacttgcgatgtcactgactcatctcaggtaaacgcgttagtgcaaaaggcattaggaaattatggctatatcgacgtgctgataaacaatgccggcatctttgcatcggggccagtagagcagttttctcttagtgattggcatcaaattatagacactaatttatggggatatatccacactattaatgcccttctgcctcatttcctccagcgtcgaagtggaactatagttaatttaagttccatcggtggtaaggtgccaagtgcttacttggttccctattgtactagtaagtttggtgtgacagggttgacggaatcgctgcaagtagaactacagccaaaaggtattcatgtttgtgggatttatccgaatttaattaagagtactttaatggaacgggcagtttttcgaggccaggatgagcaagatactcatactcgccgtggacagcttgagaatgtgctgaaaaatccggtggtggagaagcctgaagatgtagcaaatgctatctgggatgcagtcaagaataaaaagtcagaagtgatggttggttcggctaatttatcgcaaagtttgtatcgcttgtttcctggtttgataaagtgggtttcacggcaagggttgaagaatcaagataattaa

SEQ ID NO: 94354 - protein, 272 aa, Nostoc punctiforme PCC 73102
MAPTVLITGASEGIGKATALLFARQGYDLVLAARHADRLEALAQEVQSIGCPAPLTITCDVTDSSQVNALVQKALGNYGYIDVLINNAGIFASGPVEQFSLSDWHQIIDTNLWGYIHTINALLPHFLQRRSGTIVNLSSIGGKVPSAYLVPYCTSKFGVTGLTESLQVELQPKGIHVCGIYPNLIKSTLMERAVFRGQDEQDTHTRRGQLENVLKNPVVEKPEDVANAIWDAVKNKKSEVMVGSANLSQSLYRLFPGLIKWVSRQGLKNQDN

SEQ ID NO: 94355 - DNA, 735 bp, Pseudomonas syringae pv. syringae B728a
  CDS (1)..(735)
atgtcgaacattcaaggcaaggttgtactgatcaccggcgccagcagcggcattggcgaagctgccgcccgactcatcgccgccaagggcgcacacgtggtactgggcgctcggcgcagcgagcgtctgcagacgctggcggcagacatcgaagcgcagggcggctcggcacgcttccgcgcgctggacgtgaccgatgcgctcgacatgcaagcctttgccgacttcgccacacatgagttcggcaagattgacgtgatcatcaacaacgccggcgttatgcccctgtcgccgctcgccgcgctgaaaatcgcagagtggaaccagatgctcgacgtcaacgtgcgcggcgtactgcacggcatcgccgccgtgctgccgagtatgcaagcgcaagggcacggccagatcatcaacatctcgtccatcggcggcctcgccgtttccccgaccgccgcagtgtactgcgccaccaaattcgctgttcgcgccatctccgacggccttcggcaggaaaccgacaaaatccgcgtcaccgtcgtctgccccggcgtggtcgaatcagaactggcggactcgatttccgacgagaccgcgcgcgaggcgatgaaagcgtttcgaaaggttgccctggagccggatgcgatcgcacgtgcgcttgtttatgcaatcgagcagccggacggggtggatgtgagcgagattgtggtgcggcctacggggagtgcttattga

SEQ ID NO: 94356 - protein, 244 aa, Pseudomonas syringae pv. syringae B728a
MSNIQGKVVLITGASSGIGEAAARLIAAKGAHVVLGARRSERLQTLAADIEAQGGSARFRALDVTDALDMQAFADFATHEFGKIDVIINNAGVMPLSPLAALKIAEWNQMLDVNVRGVLHGIAAVLPSMQAQGHGQIINISSIGGLAVSPTAAVYCATKFAVRAISDGLRQETDKIRVTVVCPGVVESELADSISDETAREAMKAFRKVALEPDAIARALVYAIEQPDGVDVSEIVVRPTGSAY

SEQ ID NO: 94357 - DNA, 750 bp, Actinobacillus pleuropneumoniae serovar 1 str. 4074
  CDS (1)..(750)
atgaaaacagcattagtgaccggtgcaacggcaggattcggtttagcaatttgtaaattattgattcaatcaggttataaagtgattggtaccggcagacgtaaggaacgccttgacgaattacattcgcaattaggcaataattttttaccgcttgcgtttgatgtcagtgatgatgcggcaaccactcaggcgttaaataaccgtccggcaggctggcaagcggtggatttattagtcaataatgccggattagcattagggttggagccggcttataaaaccgatttaaaagattggtatcagatgatcgataccaatattaaagggcttgtaacggttactcgtttgattttaccggaaatggtagaacgtaatagcggacatatcatcaatttaggttcaatcgccggtaattatccttatccgggcggtaatgtttatggcggcacaaaagcctttgttaaacaattcagcctgaatttacgtgcggatttagccggtacgaaagtgcgtgtaacgaatgtagaacccggtttatgcggcggtacggaattttccaatgtacgctttaaaggcgatgacgacaaagccgcaaaagtatatgaaaacgtgaactatgtcgcaccggaagatattgccaatattgtgttatggctaaaccaacaaccggaacacgttaatattaaccgtattgaagtgatgccgaccgcacaaactttctcaccacttgcggtggcaagaggttaa

SEQ ID NO: 94358 - protein, 249 aa, Actinobacillus pleuropneumoniae serovar 1 str. 4074
MKTALVTGATAGFGLAICKLLIQSGYKVIGTGRRKERLDELHSQLGNNFLPLAFDVSDDAATTQALNNRPAGWQAVDLLVNNAGLALGLEPAYKTDLKDWYQMIDTNIKGLVTVTRLILPEMVERNSGHIINLGSIAGNYPYPGGNVYGGTKAFVKQFSLNLRADLAGTKVRVTNVEPGLCGGTEFSNVRFKGDDDKAAKVYENVNYVAPEDIANIVLWLNQQPEHVNINRIEVMPTAQTFSPLAVARG

SEQ ID NO: 94359 - DNA, 753 bp, Psychrobacter sp. 273-4
  CDS (1)..(753)
atgaacgtattgattacaggggcaagtgccggttttggtaaagcactagctgagcgtttggttgccaacggtcatcgtgtgattggctgtgctagacgccttgataagcttaatgccttggcagacactttgggtgaggcgtttttacctgtggtcatggatgtcagtgataccgcttctattccgcaaatcattgctaatttgcctaatcattttaagcaaatcgatgtcttggtgaataatgctgggcttgcgcttggtacagagcctgcgcacaatgctagtcttgatgattggatgcgtatgactgataccaatattaaaggtttgatggcgctgacccacgcggtcttgccagccatggttgcacgagatagcggttatatcattaatgtcggctctattgccggaagctggccttactttggcggtaacgtttatggtgcaacaaaagcctttgtaaaacagtttagtttaaacttacgagctgacttaattggtacgcaagtgcgcgtgaccaaccttgaacccggtaatgtcgcaggcactgagttttcaaacgtgcgctatcatggtgatgatgacaaggctgctcaagtttatgatggctttaaaaccatgacgggcgatgatattggcgatatcttattatggctgattgaatcgcctgcacatattaatgtcaatcgtttagaagtgatgccagtggcacaaacctataatggtctgacgattgctaagcaagattcttaa

SEQ ID NO: 94360 - protein, 250 aa, Psychrobacter sp. 273-4
MNVLITGASAGFGKALAERLVANGHRVIGCARRLDKLNALADTLGEAFLPVVMDVSDTASIPQIIANLPNHFKQIDVLVNNAGLALGTEPAHNASLDDWMRMTDTNIKGLMALTHAVLPAMVARDSGYIINVGSIAGSWPYFGGNVYGATKAFVKQFSLNLRADLIGTQVRVTNLEPGNVAGTEFSNVRYHGDDDKAAQVYDGFKTMTGDDIGDILLWLIESPAHINVNRLEVMPVAQTYNGLTIAKQDS

SEQ ID NO: 94361 - DNA, 759 bp, Haemophilus influenzae R2846
  CDS (1)..(759)
atgaaaaccacaaccgcattagttacaggtgcaaccgcaggctttggcttggcaatctgtaaaaaattgatcgaagcaggctataaagtgattggcacgggcagacgtgcagatcggttagcagaaattcattcacaattaggcaataattttctaccgcttgcctttgatattcgcgatgaacaagccacaattaacgctctaaatacccttcctgaaggctggcaagcggtcgatttattagtgaataatgcaggtttagccttgggattagagccagcacataaagcggatttacaagattggtatcagatgatcgataccaacatcaaaggattggttactatcactcgccttgtgttgccaaatatggtggctcgtaatcacgggcagattatcaatttgagttcaattgcaggtacttatccttatgctggcagtaatgtatatggtggaactaaagcttttgtcacacaatttagcttaaatttacgagccgatctggcaggcacaaaaattcgagtaagcaatgttgaaccgggtttatgtggcggtacggagttctctaatgtgcgttttcacggcgatgatgaaagagcggcaaaagtgtatgaaaacgtacaatcggttcagcctgaagatattgcgaacattgtattatggcttcatcaacaacctgaacacgtgaacattaatcgcattgaagtcatgccaaccgctcaatcttttgcgggaatgagcgttgcaaaagataactaa

SEQ ID NO: 94362 - protein, 252 aa, Haemophilus influenzae R2846
MKTTTALVTGATAGFGLAICKKLIEAGYKVIGTGRRADRLAEIHSQLGNNFLPLAFDIRDEQATINALNTLPEGWQAVDLLVNNAGLALGLEPAHKADLQDWYQMIDTNIKGLVTITRLVLPNMVARNHGQIINLSSIAGTYPYAGSNVYGGTKAFVTQFSLNLRADLAGTKIRVSNVEPGLCGGTEFSNVRFHGDDERAAKVYENVQSVQPEDIANIVLWLHQQPEHVNINRIEVMPTAQSFAGMSVAKDN

SEQ ID NO: 94363 - DNA, 735 bp, Anabaena variabilis ATCC 29413
  CDS (1)..(735)
atgttaaacattgagaacaaagtcattgcgatcactggagccagtagcgggattggcgaagccacagctaagttacttgctcgaaacggtgcaaaggtgcttttgggtgcacgacgcaccgaaaagctcgaaaagattgttgaggagatccacgcctcaggcggtacagcagaatttaaagccgtagatgtcaccgatcgagaagatgtgaaagcgttcattgggtttgcaaaagacaagttcgatcgcgttgatgtcatcttcaacaatgcaggcgtgatgcctctatccccgatgaatgctttgaaggtcgaggaatgggacaacatgattaacgtgaatatcaacggggtgttgaatggcattgcagcagctttgccgattatggaagcgcaaggtaacggacaaatcatcaatactgcgtcgattggtgcccatgtggtagtacccactagcgcagtttacagcgctaccaagtacgcagtttgggcaatctccgaaggactgcgacaggagtcgaaaatgattcgcgtcaccgtcatctctcccggtgtggttgagaccgaactcggctctgatatcacagacgagccaacaaaaggcttcttgaaagaacttcgcaaagacgcactcaacccggatacgattgccagcgctgttctgtatgccgtgtctcagccggatgatgtcgatgtcaacgaagtgattgttcgcccgatccgccatatgatgtag

SEQ ID NO: 94364 - protein, 244 aa, Anabaena variabilis ATCC 29413
MLNIENKVIAITGASSGIGEATAKLLARNGAKVLLGARRTEKLEKIVEEIHASGGTAEFKAVDVTDREDVKAFIGFAKDKFDRVDVIFNNAGVMPLSPMNALKVEEWDNMINVNINGVLNGIAAALPIMEAQGNGQIINTASIGAHVVVPTSAVYSATKYAVWAISEGLRQESKMIRVTVISPGVVETELGSDITDEPTKGFLKELRKDALNPDTIASAVLYAVSQPDDVDVNEVIVRPIRHMM

SEQ ID NO: 94365 - DNA, 819 bp, Anabaena variabilis ATCC 29413
  CDS (1)..(819)
atgactaatacagtaattatcacaggcgcatctcaaggtattggcaaagccacagcattattatttgcccgtcaaaattataatgttgtgctggcagctcgccaacctgatcgtttagaagcgatcgccaccgagatacgggaactgggacaagaagcgatcgccattcctaccgatgtcaaagatgctacacaagttaataacatgatacaaaaggcgatcgctcattttggtcaagtagatgtattaattaataatgcaggtatcttttgcttgggttctgtagaaaatttcagcttagaagatcggcatcaaattattgacactaatttgtggggttatattcataccatttatgccatattgccctattttctccagcgttgtgcaggaactattgtgaatgtcagttctattggtggtttagaacctattccttaccatgtgccttacacagccagcaaatacgccataacagggttgacaaaatccctacacgcagaattatcacctaaaggcattcacgttagcggcatttatcccagcttcatcagcacccaacttatggaacgagcaattttccgtggtaaagatgaagaaatagcgcaagcacggactgaattagtaggtaaggcgattcaaatgcctgtactagaaaaaccagaagatgtagccaaagcaatttggagtgcagtcaaaaacaagcgttctgatgtcgtcgtaggttcagctaacttttggaaggcggcttatcaattgactcctagtttgatacagtctcttgtccggcgcgtctttggcatggaagaacgcaaataa

SEQ ID NO: 94366 - protein, 272 aa, Anabaena variabilis ATCC 29413
MTNTVIITGASQGIGKATALLFARQNYNVVLAARQPDRLEAIATEIRELGQEAIAIPTDVKDATQVNNMIQKAIAHFGQVDVLINNAGIFCLGSVENFSLEDRHQIIDTNLWGYIHTIYAILPYFLQRCAGTIVNVSSIGGLEPIPYHVPYTASKYAITGLTKSLHAELSPKGIHVSGIYPSFISTQLMERAIFRGKDEEIAQARTELVGKAIQMPVLEKPEDVAKAIWSAVKNKRSDVVVGSANFWKAAYQLTPSLIQSLVRRVFGMEERK

SEQ ID NO: 94367 - DNA, 744 bp, Methylobacillus flagellatus KT
  CDS (1)..(744)
atgtcatccaccccatcgggcaccgccaaggtcatcgtgcttaccggcgccagcagcggcatcggcgaggccacggcgcgccatctggctaggttgggccaccatcttttcatcggcgcgcgtcgcctggaccggctcaccgcgctgcaggacgaactgcgcgccgaaggctgccatgtcgaagtgatgcaactggacgtcacgcgtctcgaagacctgcaaggcatcgcctcccagacgcatgccacgcatggccgcatcgacgtgctcatcaacaatgccggcgtcatgccgctgtcgccgctggctgcgctcaagatcgacgagtggaaccgcatgctggacgtcaacgtgcgcggtgtgctgcacggcattgccgctgcgctgccgatcatgcaggcgcaaggccacggacacatcatcaatatcgcctcgattggcgcgtaccaggtctggccgtcttcggccgtgtattgcgcaagcaagttcgcggtgcgcgccatctccgatggcctgcgccaggagactgatgccatccgcgtcacgctggtcagccccggtgtggtcgagtccgagctggccgatcacatcaccgacgagaccgcgcgagcagccatgcgcgagttccgccgtatcgccttgccgccgcaggcggtggcgcaggcgattgcctacgcgatcgcgcaacccgatggcgtggacgtgaacgagctcatcgtgcgcccgacggccagcccgtactga

SEQ ID NO: 94368 - protein, 247 aa, Methylobacillus flagellatus KT
MSSTPSGTAKVIVLTGASSGIGEATARHLARLGHHLFIGARRLDRLTALQDELRAEGCHVEVMQLDVTRLEDLQGIASQTHATHGRIDVLINNAGVMPLSPLAALKIDEWNRMLDVNVRGVLHGIAAALPIMQAQGHGHIINIASIGAYQVWPSSAVYCASKFAVRAISDGLRQETDAIRVTLVSPGVVESELADHITDETARAAMREFRRIALPPQAVAQAIAYAIAQPDGVDVNELIVRPTASPY

SEQ ID NO: 94369 - DNA, 750 bp, Crocosphaera watsonii WH 8501
  CDS (1)..(750)
atggtagaagaattatcgaaaaaagttgctttaattactggtgcatcgagtgggataggagaagcgatcgcccatcgtttagcagcagaaaactatcgtttagttatttgcgcccgtcgtcaagaaagattagatcaattaacaaaaacattacaagaaaaaaatagtgagatattagccataaaagttgatttacgtcaagaatcagaaatattaaacctttttaacaccattcggaagcaatggggtggtgttgatatattaattaataatgcagggttaggtcacaaagaacccttaatgacagggaaaacagaagcttggcgagaaatgttagaagtgaatgttttggctttatgtatttgtacccgtgaagcaattaaagatatgagcgatcgcaacgaaggccatattattcatattagttcaatgtcaggtcatcgtgttcctttatctagtggggtttatgctgctagtaaatatgcagtgagtgcgttaacagaagggttacgacaagagttaagagaagccaagaaaaacattaaaatctcttctattagtccaggttttgtggaaacagaatttgctgaaaaatataacaataacaaagaaaaagcacaagaactttatagtcgttttcccgtcttacaacccaaagatattgctaacgcagtttactatgttttatcccaaccagactatgtacaaattcatgatattttattgcgtcccactcaacaaaaaagttaa

SEQ ID NO: 94370 - protein, 249 aa, Crocosphaera watsonii WH 8501
MVEELSKKVALITGASSGIGEAIAHRLAAENYRLVICARRQERLDQLTKTLQEKNSEILAIKVDLRQESEILNLFNTIRKQWGGVDILINNAGLGHKEPLMTGKTEAWREMLEVNVLALCICTREAIKDMSDRNEGHIIHISSMSGHRVPLSSGVYAASKYAVSALTEGLRQELREAKKNIKISSISPGFVETEFAEKYNNNKEKAQELYSRFPVLQPKDIANAVYYVLSQPDYVQIHDILLRPTQQKS

SEQ ID NO: 94371 - DNA, 729 bp, Exiguobacterium sp. 255-15
  CDS (1)..(729)
atgatcgaaaacaaagtcgtcatcattacaggagcatcaagtggcattggggaagctactgctaagttactcgctaaacaaggtgcgcaactggtcctcgcagcgcgccgggaagatcgtttgaaaactttgcaacaggaaatcgaacaactcggtggtaaagccgtctatcaagtgacggacgtcacggattcggcgcaagtcgagcaactcgcaaaactcgcgcaggatacgttcggttcggtcgatgtcctcgtcaacaatgcgggcctgatgccgctgtcgaaactgaacaaaaacaagcaggacgagtggaacacgatggtcgacgtcaatattaaaggtgtgctgtacggcattggtgccgtcctgccatacatgcgtgagcaaaaacgcggacatatcatcaacatctcgtctgtcgcaggacacgacgtcatgccgtcgagtgccgtttacagcgggacgaaatttgccgtccgtgcgattacggaaggtttgcgaaaagaagagtcggtcgaaaacaatatccgcgcgacgatcatttcaccgggagccgttgataccgagctgaaagatcacatcacggacgaagaaatcaaacaaggcatcggcgacttaaaagcgatggacgctgacgccattgcccgtgcgattgcttacgccgtcaatgaaccggacgatgtcgcggtcaatgaaatcctgatccgcccgactgcccaacaataa

SEQ ID NO: 94372 - protein, 242 aa, Exiguobacterium sp. 255-15
MIENKVVIITGASSGIGEATAKLLAKQGAQLVLAARREDRLKTLQQEIEQLGGKAVYQVTDVTDSAQVEQLAKLAQDTFGSVDVLVNNAGLMPLSKLNKNKQDEWNTMVDVNIKGVLYGIGAVLPYMREQKRGHIINISSVAGHDVMPSSAVYSGTKFAVRAITEGLRKEESVENNIRATIISPGAVDTELKDHITDEEIKQGIGDLKAMDADAIARAIAYAVNEPDDVAVNEILIRPTAQQ

SEQ ID NO: 94373 - DNA, 738 bp, Exiguobacterium sp. 255-15
  CDS (1)..(738)
atgaacacaccactagataaagtcattgtcatcatgggcgcgtcaagcgggatcggcgaagcgactgcacgtctgctcgcagcacgcggagccaaattaatgctcgccgcccggcggctcgagcggttagaagccattcggaaagcgtatcccgaggcggatattcaaatcaaacaggcggacgtcactgagtttgatcaagttgaagctgtcgtacaggaagcaaaagcagtctacggccggattgatgttctcttcaacaacgccggtatcatgccgactgctccacttgcggctggacaccgggaggactggaaaaacatgctcgacatcaacgtgatgggcgtcttgaacggaattgccgcgacactgccgattatggaacagcaacaggccgggtatatcattgcgacagattcggtcgcgggacatattgtttatccggaatcagccgtctattgcgggacgaagtttgccgtccgggcaattatggaaggattacgtcaggagcaacgcgaaaataatgtcaaatcgacgattatttcaccgggtgccgtccaaacggaactctatacgacgatccgggatcaggcaacaggcgagtcgctccggcaagcgcaacaagagtggggattgacaagcgaagatgtcgcgcaagccgtcctatatgccattgatacaccggaccgggtctcaatcagtaacttaatcatccggccgacacaacaacaagtgtga

SEQ ID NO: 94374 - protein, 245 aa, Exiguobacterium sp. 255-15
MNTPLDKVIVIMGASSGIGEATARLLAARGAKLMLAARRLERLEAIRKAYPEADIQIKQADVTEFDQVEAVVQEAKAVYGRIDVLFNNAGIMPTAPLAAGHREDWKNMLDINVMGVLNGIAATLPIMEQQQAGYIIATDSVAGHIVYPESAVYCGTKFAVRAIMEGLRQEQRENNVKSTIISPGAVQTELYTTIRDQATGESLRQAQQEWGLTSEDVAQAVLYAIDTPDRVSISNLIIRPTQQQV

SEQ ID NO: 94375 - DNA, 765 bp, Rubrobacter xylanophilus DSM 9941
  CDS (1)..(765)
ttgggtgagaatttcgacggcccgcacgccctgatcaccggcggcagcaccggcatcggggccgccatcgcccgccgcctctcagcctccggcgcccggctgaccctggccggacggcgccccgaacccctgaagaaaacggcggcgagcctgagagaggcccaggcggtgccgttcgacgtaaccgatgaggccgcggtggaggaaggggtctcgatagccatcgaacgctatggcccggtggacatcctggtcaacaacgccggggccgccgggtccgcgccgttcacgaagacgaccccagacgcctggcgcgccacactggaggcaaacctgaccggcgtgttcctggtgagccgggcggtattgcccgcgatgctcgagcgcgggagagggcgcatcgtcaacatcgccagcaccgccggcctgaagggctatgcctacgtcgccgcctactgcgccgccaagcacggggtcatcgggctcacccggtcgctggcgctggaggtggcgagagaggggatcacggtgaacgccgtctgtcccggctacacggagacggagctcctgaagcgcagcgtcgccaacatcgtggagaagaccggcgcgagcgaggaggaggcgcgcgggcaactgcttcgcgtcaacccgcaggggcgcttcgtacggccggaggaggtggcggagacggtcgcctggctcgtcggtccgaactccggggccataaacggacaggccatagccgtagcaggaggggaggtttag

SEQ ID NO: 94376 - protein, 254 aa, Rubrobacter xylanophilus DSM 9941
MGENFDGPHALITGGSTGIGAAIARRLSASGARLTLAGRRPEPLKKTAASLREAQAVPFDVTDEAAVEEGVSIAIERYGPVDILVNNAGAAGSAPFTKTTPDAWRATLEANLTGVFLVSRAVLPAMLERGRGRIVNIASTAGLKGYAYVAAYCAAKHGVIGLTRSLALEVAREGITVNAVCPGYTETELLKRSVANIVEKTGASEEEARGQLLRVNPQGRFVRPEEVAETVAWLVGPNSGAINGQAIAVAGGEV

SEQ ID NO: 94377 - DNA, 741 bp, Mesorhizobium sp. BNC1
  CDS (1)..(741)
atgaccgagaacatcaaggacaaggtggtcgtcatcaccggcgcgtcgagcgggctgggcgcggaaaccgcccgccatctcgtgcgcgaaggggcgaaggtggtgctgggcgcgcggcgtctcgaccggctcgaggcgctggcgaaggaactgagtcttggtgaggaggctatcttcaaggtcgatgtcaccgaccgggagcaggttaaggcctttgtcgaccacgcggtcaagacccagggcaagattgacgtgatgatcaacaatgccgggatcatgccgctggcgccgctggagatgatgcgcttcgacgaatgggaccagtgcatcgacgtcaacatcaagggcgtactctggggcatcgcggcagcacttcctttcttcaaggagcaaaagagcggccagttcattaacgtctcgtcggtcgccggccacacgatcggcgccggcggcgcgatctattcggcgacgaagtattcggtgcgcgtgatctcggaagcactgcgcaaggaggtcaagccctacaacatccgcaccaccattctgtcgcccggtgccgtcgacacggagcttcccggttcggttggcgcccctggggtctcggaggccgtcgccggcttctatcatcaaaccgccattcccgccgacagcttcgcccgctgcgtcctcttcgccatgagccagcccgagaacgtcgacatcaacgaaatcctgtttcggccgacagcgcaggaactctga

SEQ ID NO: 94378 - protein, 246 aa, Mesorhizobium sp. BNC1
MTENIKDKVVVITGASSGLGAETARHLVREGAKVVLGARRLDRLEALAKELSLGEEAIFKVDVTDREQVKAFVDHAVKTQGKIDVMINNAGIMPLAPLEMMRFDEWDQCIDVNIKGVLWGIAAALPFFKEQKSGQFINVSSVAGHTIGAGGAIYSATKYSVRVISEALRKEVKPYNIRTTILSPGAVDTELPGSVGAPGVSEAVAGFYHQTAIPADSFARCVLFAMSQPENVDINEILFRPTAQEL

SEQ ID NO: 94379 - DNA, 744 bp, Mesorhizobium sp. BNC1
  CDS (1)..(744)
atgagattcctggcagacgagacagtggttgtaaccggatcatcgagcggaattggcgcttcagttgcccgtgcctttgcacgggagggcgctaaggtcgtcattaccggaagacgcaaggaacgtctggacgaacttgcgcaggaactcacgaatgacggcggacagatcgaaccggttgcgggggatatcaccgtccgcgaggaggtggatcgtcttttcgagcgctgcaagcagcgcttcggaccggtttcgatcctggtgaattgcgccggcattatgctcgccagccggttcgagcgcggtcaaatcgacgactgggagtacatgaacaagctcaatgtcatgtcgctcttctacacgtcctatcgcgcaatcgatcagatgaaatcgaacggaggcggcagcatcattcatatcggcagcagcgcagcccttcggcagaggccgctcactggcgcatatgcaggcaccaaggcagcgatccgcgccgcggcggattcaatgcggcaggaagtgatcgagcacaagatacgtgtctgcacgattatgccgggggccgttgccaccgatcttgtcagtcacattaccgatcccgagtctcaggcgggtttcgcacaggtgctcaagatggaacggcttcaggccgaggatatcgcaaacatcgtgacgttcgtggcgcggcagccggcctatgtcaacatcaacgaggtcgtcgtgcgccccttagcgcagcaactgtga

SEQ ID NO: 94380 - protein, 247 aa, Mesorhizobium sp. BNC1
MRFLADETVVVTGSSSGIGASVARAFAREGAKVVITGRRKERLDELAQELTNDGGQIEPVAGDITVREEVDRLFERCKQRFGPVSILVNCAGIMLASRFERGQIDDWEYMNKLNVMSLFYTSYRAIDQMKSNGGGSIIHIGSSAALRQRPLTGAYAGTKAAIRAAADSMRQEVIEHKIRVCTIMPGAVATDLVSHITDPESQAGFAQVLKMERLQAEDIANIVTFVARQPAYVNINEVVVRPLAQQL

SEQ ID NO: 94381 - DNA, 753 bp, Magnetospirillum magnetotacticum MS-1
  CDS (1)..(753)
atgtggaagaaccgcaccgttctggtcaccggcgccaccgccggcttcggcgccgccatcgcccgccgtttcgcggccgaaggcgctaatctggtgatttgcgggcgcaggagcgagcgcctggaagcgcttaaggcggaactgggcggcacgccttgccatgccgcccccctggacgtgcgcgaccgcgccgccgtggcggatttcaccgcgtctctgccctggaacgtggacgtcctggtcaataacgccggtttggccctggggcttgagccagcccaggccgccgatctggatgactgggagaccatgatcgataccaatctcaagggattgatgtatatgacgcgggccatcctgcccggcatggtggagcgcgatcgcggccatgtgatcaatatcagctcggtggccgggacctatccctatccgggcggcaatatgtatggcgccaccaaggcggcggtgtcccagttctcgctcaatctcatcgccgatctggtcaagaccaaggtgcgggtcaccaatatcgagcccggcatgtgcggcggcagcgagttttcccaggtgcgcttccacggagacgccgaaaaggccgccaaggtctatgaaggcacccagccgttgagtgccgaggatatcgccgagtccgtctactgggcggcctccctgcccgctcatgtcaatatcaaccgcatcgagatgatgccggtctgccaggcctcggccgccttcgccgtccaccggtcttaa

SEQ ID NO: 94382 - protein, 250 aa, Magnetospirillum magnetotacticum MS-1
MWKNRTVLVTGATAGFGAAIARRFAAEGANLVICGRRSERLEALKAELGGTPCHAAPLDVRDRAAVADFTASLPWNVDVLVNNAGLALGLEPAQAADLDDWETMIDTNLKGLMYMTRAILPGMVERDRGHVINISSVAGTYPYPGGNMYGATKAAVSQFSLNLIADLVKTKVRVTNIEPGMCGGSEFSQVRFHGDAEKAAKVYEGTQPLSAEDIAESVYWAASLPAHVNINRIEMMPVCQASAAFAVHRS

SEQ ID NO: 94383 - DNA, 747 bp, Burkholderia cepacia R18194
  CDS (1)..(747)
atgatcgtgttcgtcacaggcgcgtccgccggcttcggcgccgccatcgcccgtgccttcgtcaagggaggccaccgcgtcgtcgcgaccgcgcgccgcaaggatcgcctcgatgcgctcgccgccgaactcggcgattcccttctgccgctcgagctcgacgtccgcgatcgcgcggccgtcgaggccgtgccggccgcccttcccgccgaattcgcggcgctcgacgtgctcgtcaacaacgccggcctcgcgctcggcgtcgagccggcccaaaaggccagcctcgacgaatggcacacgatgatcgacacgaactgcacgggcctcgtcacggtcacgcacgcgctgctgcccggcatgatcgatcgcggccgcggtcacgtcttcaatatcggctcggtcgcgggttcgtacccttatgcgggcggcaacgtctacggcgcgaccaaggctttcgtcagacaattcagcctgaacctgcgcgccgacctgctcggcacgccgctgcgcgtcaccgacatcgagcctggcctgtgcggcggcaccgaattctcgaacatccgctatcgcggcgacgacgccaaagcggcgaacgtctacaacaatgtccagccgctgatgcccgaggacatcgccgacacgatctactggatcgcgacgcgtccggcgcatgtgaacgtcaacacgatcgagctgatgccgatcgcgcaagccccgggcggcccgaccgtccaccgcggctga

SEQ ID NO: 94384 - protein, 248 aa, Burkholderia cepacia R18194
MIVFVTGASAGFGAAIARAFVKGGHRVVATARRKDRLDALAAELGDSLLPLELDVRDRAAVEAVPAALPAEFAALDVLVNNAGLALGVEPAQKASLDEWHTMIDTNCTGLVTVTHALLPGMIDRGRGHVFNIGSVAGSYPYAGGNVYGATKAFVRQFSLNLRADLLGTPLRVTDIEPGLCGGTEFSNIRYRGDDAKAANVYNNVQPLMPEDIADTIYWIATRPAHVNVNTIELMPIAQAPGGPTVHRG

SEQ ID NO: 94385 - DNA, 741 bp, Burkholderia cepacia R18194; identical to SEQ ID NO: 62041
  CDS (1)..(741)

SEQ ID NO: 94386 - protein, 246 aa, Burkholderia cepacia R18194; identical to SEQ ID NO: 62042

SEQ ID NO: 94387 - DNA, 735 bp, Pseudomonas fluorescens PfO-1
  CDS (1)..(735)
atgtcgaacattcaaaacaaagtcgtcctgattaccggtgcaagcagtggtattggcgaagcagcggccaggttgattgctgccaaaggcgcgcatgtggtcctcggtgcccgccgcaccgagcgtctggacaaactggtcagcgaaatccaggccgaaggtggctcggcaagtgcctgcgcactggacgttacggatctgcaatcgatgcacgccttcgtggcgttcgccaagacgcaacatggcaaggtcgatgtgatcatcaacaacgcgggggtgatgcctttgtctccgctggcttcgttgaaggtcgatgaatggaaccagatgctcgatgtcaacgttcgcggtgtgctacacggtattgccgccgtcttgccggacatgcaggcgcagggtttcggtcaggtcatcaatatctcgtccattggtggactcgcggtttctccgacagcggcagtgtactgcgcgaccaaattcgcggtccgggctatctcggatggtctgcgccaggaaacggacaagatccgggtgaccgtggtgtgcccgggcgtcgtcgagtccgaactggccgatacgatttccgatgaggtggcacgcgaggaaatgaaagccttccggcgtgtggcgctcaatgcagacgccattgcgcgggcgctcacctatgccatcgagcagcctgatgatgtggacgtgagtgagattgtggttcgtccgaccgccagcccacactga

SEQ ID NO: 94388 - protein, 244 aa, Pseudomonas fluorescens PfO-1
MSNIQNKVVLITGASSGIGEAAARLIAAKGAHVVLGARRTERLDKLVSEIQAEGGSASACALDVTDLQSMHAFVAFAKTQHGKVDVIINNAGVMPLSPLASLKVDEWNQMLDVNVRGVLHGIAAVLPDMQAQGFGQVINISSIGGLAVSPTAAVYCATKFAVRAISDGLRQETDKIRVTVVCPGVVESELADTISDEVAREEMKAFRRVALNADAIARALTYAIEQPDDVDVSEIVVRPTASPH

SEQ ID NO: 94389 - DNA, 726 bp, Pseudomonas fluorescens PfO-1
  CDS (1)..(726)
atgagcaagccattgatcatcatcaccggcgccagctcgggcatcggcgaagccaccgcccgccgcttgagcgcggccggccatccgctgctgttgctggcccggcgcatcgaacgcctggaagcactggccctgccgaacactctcagccgccgcgtcgacatcaccgaccgcgccgcattgctggccgctgttgccgaggcggaagcgcagttcggtccggccgatgcgctgatcaacaacgccggggtgatgctgctgggcgagatgagcaaacaggatccggcgcagtgggaccagatgctcgacgtcaacgtgaaaggtctgctcaacggcgtgcacgcggtggtcgccgggatgatcgagcgcaagcacggcacgatcatcaacgtcagctcggtggccgggcgcaagaccttccccaaccatgtggcctatgtcgggaccaagtttgcggtgcatgggctgtcggagaatctgcgtgaagagctgtcgccgcataacgtgcgggtgaccacgattgcgccgggtgcggtggaaaccgagttgctgagccacaccacggatgaggcgatcaagaccggttatcaggcgtggaagcaggacatgggtggcacggtgttgagcgccgaggatgtggcgacggcgattgcctatgcgtatgggcagccgcagggggtttgtattcgcgagattgtgatggctgcgactcggcagcaggcctaa

SEQ ID NO: 94390 - protein, 241 aa, Pseudomonas fluorescens PfO-1
MSKPLIIITGASSGIGEATARRLSAAGHPLLLLARRIERLEALALPNTLSRRVDITDRAALLAAVAEAEAQFGPADALINNAGVMLLGEMSKQDPAQWDQMLDVNVKGLLNGVHAVVAGMIERKHGTIINVSSVAGRKTFPNHVAYVGTKFAVHGLSENLREELSPHNVRVTTIAPGAVETELLSHTTDEAIKTGYQAWKQDMGGTVLSAEDVATAIAYAYGQPQGVCIREIVMAATRQQA

SEQ ID NO: 94391 - DNA, 765 bp, Pseudomonas fluorescens PfO-1
  CDS (1)..(765)
atgtccaacaccctgtttatcaccggcgcgacctccggttttggtgaagcctgtgcccgtcgttttgccgaggccggctggaaactggtgctgaccggtcgtcgtgaagaacgcctcaacgcgctgtgcgccgagctgtcgaagcagaccgaagtgcatggtctggtgctggacgtgcgtgatcgcaaggcgatggaggaggcgattgccaacctgccgccatcgttcgccaagctgcgcggcctgatcaacaacgccggcctggcgctgggcgtggaccctgcaccgaagtgcgacctcgatgattgggacaccatggtcgacaccaacgtcaaaggcctgatgtacagcactcgcctgttgctgccgcgcctgatcgcccacggtcgcggcgccggtatcatcaacctcggttccatcgccggtaattacccgtacccgggcagccacgtttatggcgcgaccaaggcgttcgtcaaacagttctcgctgaacctgcgctgcgacctgcagggcactggcgtgcgcgtgagcaacatcgagccgggcctgtgcgagagcgagttctcgctggtgcgtttcgccggcgatcaggcgcgttacgacgccacctacgccggtgccgagccgatccagccgcaggacatcgccgagacgatcttctgggtgctgaacgcgccggcgcacatcaacatcaacagcctggaactgatgccggtgagccagacctgggccggttttgccatcgagcgcaacaaggcttga

SEQ ID NO: 94392 - protein, 254 aa, Pseudomonas fluorescens PfO-1
MSNTLFITGATSGFGEACARRFAEAGWKLVLTGRREERLNALCAELSKQTEVHGLVLDVRDRKAMEEAIANLPPSFAKLRGLINNAGLALGVDPAPKCDLDDWDTMVDTNVKGLMYSTRLLLPRLIAHGRGAGIINLGSIAGNYPYPGSHVYGATKAFVKQFSLNLRCDLQGTGVRVSNIEPGLCESEFSLVRFAGDQARYDATYAGAEPIQPQDIAETIFWVLNAPAHININSLELMPVSQTWAGFAIERNKA

SEQ ID NO: 94393 - DNA, 768 bp, Rhodospirillum rubrum
  CDS (1)..(768)
atgaccaacacggttttcatcaccggcgccaccgccggttttggcgaggcttgcgcgcggcggttcgccgaggccggctgggccctggtgctgaccggccggcgggcggagcggctggaggcgctgaaggccgaattgggcgccagcgtgcccgttcacgccgcggtgatggacgtgcgcgaccgcgcctcggtccaggcggtaatcgcggctctgcccgcgccgtttgacaaggtccatacgctgatcaacaacgccggtctggcggcggggctggaaaaggccgccgaggcctcgctcgacgactggcagacgatgatcgacaccaatgtcaccggtctggtcacctgcacccatgccctgctgccccggctgatcgcggcgggcaacgggtcgatcatcaatcttggctcggtcgccgggcgctggccctatccgggcggcagcgtctatggcgggaccaaggccttcgtccgccagttcagcctgaatttgcgcaatgacctgctgggcaccggggtgcgggtgaccgatatcgaaccaggcatggccgaaagcgagttttcgatcgtgcgcttcaagggcgaccgcgaggcggccagcaaggtttatgccggcgtcgatccgctgacccccaaggacatcgccgaaaccatcttctgggtcgccacccagcccccccatattaacatcaacaccctggaaatcatgcccgtcgcccaggcctgggccggcttcgccgtccaccgccgccccgccgccgagtag

SEQ ID NO: 94394 - protein, 255 aa, Rhodospirillum rubrum
MTNTVFITGATAGFGEACARRFAEAGWALVLTGRRAERLEALKAELGASVPVHAAVMDVRDRASVQAVIAALPAPFDKVHTLINNAGLAAGLEKAAEASLDDWQTMIDTNVTGLVTCTHALLPRLIAAGNGSIINLGSVAGRWPYPGGSVYGGTKAFVRQFSLNLRNDLLGTGVRVTDIEPGMAESEFSIVRFKGDREAASKVYAGVDPLTPKDIAETIFWVATQPPHININTLEIMPVAQAWAGFAVHRRPAAE

SEQ ID NO: 94395 - DNA, 735 bp, Burkholderia fungorum LB400
  CDS (1)..(735)
atgaatccgattgaagacaaggttgtcatgatcacgggcgcgagcagcggcatcggcgaagcaacggcgcgccggctcgcgcagcagggcgcgaaactcgtgctggcggcgcgcaggagcgagcgcctcagtcggctggccgcccagctcggcggcgccgaccgcgtgctgtgggacgccaccgacgtgacgaagcccgaagcgctccagcaactcgcggcgacggcgcgcgagcgtttcgggcacctcgacgtgctcgtcaacaacgcgggcatcatgccggtttcgctgatcgcgcaaggccgcgtcgacgactggaaccgcatgatcgacgtgaacatcaagggcgtgctgtacggcattcatgcggtgctgggcgccatgctggagcggggggtggggcacatcatcaatatttcgtcggtggcgggcctgagcgtcgggccgggcggcgcggtctattcggcgacgaagttcgccgtgcgcgcgatcagcgaggggctgcgccaggaatgcgcgggcaaggtgcgcgtcacctcgatctgtccgggactcgtggcgagcgagctgccggacagcatcacggtgcccgcattccgcgagcgcgcgcagaagctgttcgaaggggcgatgcctgccgacgcggtcgccgatgccatcgtctacgcgctcacccagcccgagcaggtcgcggtgaacgaaatcgtcgtgcggccgctgacccagagcttttga

SEQ ID NO: 94396 - protein, 244 aa, Burkholderia fungorum LB400
MNPIEDKVVMITGASSGIGEATARRLAQQGAKLVLAARRSERLSRLAAQLGGADRVLWDATDVTKPEALQQLAATARERFGHLDVLVNNAGIMPVSLIAQGRVDDWNRMIDVNIKGVLYGIHAVLGAMLERGVGHIINISSVAGLSVGPGGAVYSATKFAVRAISEGLRQECAGKVRVTSICPGLVASELPDSITVPAFRERAQKLFEGAMPADAVADAIVYALTQPEQVAVNEIVVRPLTQSF

SEQ ID NO: 94397 - DNA, 744 bp, Burkholderia fungorum LB400
  CDS (1)..(744)
atgcacgacatgaccagactgaatggaaagaccgctgtgatcacaggtggcgctaccggcatcggccgcgccgcggccaggcgcttcatcgaggagggcgccttcgtcttcatctacggccgccgacaggaagcgctcgatgccgctgtggccgagctcggccccaatgcccgcgcagtgaagggctcggtctcggatgaggccgacctcgaccgactctacgcggcggtgaaagccgaacgcggaaccctcgacatcgtcttcgccaatgcgggggcgggaagcccgcttgcgctcggcaagatcaccgcccagcacattgacgaaaccttcgacaccaatgtgaagggtacgattttcacggtccagaaggcgctgccgctaatgggccagggcggttcgataatcctgaccggatcgagcgccggcaccacgggcgccccgggaatgagcgcctacagcgcgagcaaggcggcagtgcgcaacctcgcgcggacctgggccgaggacctgaagggcaccggcatccgggtgaacgtgttgtcgcccggggcgacggcgaccgaactcgcgaaggcagcgctcggcgaagaaggccagaaggtctacgcggctatgactccgctccagcgcatggccgatccgtcggagatcggggccgtggccgcctttctcgcgtcgtcggacagcagcttcatgaccgccagcgaggtcgccgtcgacggtggcctggcgcaactctga

SEQ ID NO: 94398 - protein, 247 aa, Burkholderia fungorum LB400
MHDMTRLNGKTAVITGGATGIGRAAARRFIEEGAFVFIYGRRQEALDAAVAELGPNARAVKGSVSDEADLDRLYAAVKAERGTLDIVFANAGAGSPLALGKITAQHIDETFDTNVKGTIFTVQKALPLMGQGGSIILTGSSAGTTGAPGMSAYSASKAAVRNLARTWAEDLKGTGIRVNVLSPGATATELAKAALGEEGQKVYAAMTPLQRMADPSEIGAVAAFLASSDSSFMTASEVAVDGGLAQL

SEQ ID NO: 94399 - DNA, 738 bp, Enterococcus faecium
  CDS (1)..(738)
atgaatgatttatcagaaaaagtgattgtcatcatgggcgcttcaagcggaatcggtgaagcaacaacgaagctattagcagaaaaaggggctaaactagttatagctgcacgccgagaagatcgcctaaaagcaataaaagaatctttaccagaagctgagctatatattcaaacagcagatgtaagagattttgcacaagtccaagcagttatcgatttagcgatggaaaagttcggtcgaatcgatgtattgtacaataatgcaggaatcatgccaaccgctccattagttgaaggtcaccgtgatgaatggcaaaatatgcttgatatcaacatcatgggtgtgttaaatggaatttccgccgtacttccaatcatggaaaaacaaaaatctgggcatatcatttcaactgattctgtggcgggacatgttgtttatcctgattccgccgtttattgcggaacaaaatttgctgtccgtgcaatcatggaaggattacgtcaagagcaacggcaaaataacatcaaatctacgatcatctctccaggagctgttcaaactgaattatatcaaaccatcagcgacaaaaaggctgctcttgaacttcatgaagcgcaaaaagaatggggattgacctccgaagatatagcttctgctgtagcatttgcgatagaaacgccagaccggatgtctgtcagtaacatgattatccgtccgacgacacaggaagtataa

SEQ ID NO: 94400 - protein, 245 aa, Enterococcus faecium
MNDLSEKVIVIMGASSGIGEATTKLLAEKGAKLVIAARREDRLKAIKESLPEAELYIQTADVRDFAQVQAVIDLAMEKFGRIDVLYNNAGIMPTAPLVEGHRDEWQNMLDINIMGVLNGISAVLPIMEKQKSGHIISTDSVAGHVVYPDSAVYCGTKFAVRAIMEGLRQEQRQNNIKSTIISPGAVQTELYQTISDKKAALELHEAQKEWGLTSEDIASAVAFAIETPDRMSVSNMIIRPTTQEV

SEQ ID NO: 94401 - DNA, 759 bp, Microbulbifer degradans 2-40
  CDS (1)..(759)
atgccaaaaaccattttaattaccggcgcatcatcgggctttggcgaggcctgcgctaaaatttttgccaaacaaggcaacacactaattcttgttgcacggcgcaagcagctgctggatgaacttgccgataacttaggcaaacaatgcgacgtgtataccgcgcaagtcgatgtgagccagcccgcatctatagccacattttttgaacaattaccgagtaagcttggtccaatagacacactcatcaataacgccggtttggcgttgggcttagagagtgcagataaggcagatattaacgattgggaaaccatgataaacaccaactgcttaggcttggtacattttacccggcaggtattgcccagtatggttgccaataacttgggccacatagtaaacattggctctacagccggtaagtggccctaccctggcggcaatgtgtacggggcaaccaaagcgtttgtgcagcaatttagccgcaacttacgcgccgatctacttggtaaaaatattcgcgtaaccaatatcgacccaggtatggcagaaacggaattttctaacatacgctttaaaggcaacaacgaaaaagccgagcaggtttatcacaacgccaaacccttaaccgcacaagacatagccgaaacagtccagtgggtatgtaaccgccctgctcatgtgaatattaattcgctggaaataatgccggtttgtcaggcttggggtgggtgggagatagatcgtaattgctaa

SEQ ID NO: 94402 - protein, 252 aa, Microbulbifer degradans 2-40
MPKTILITGASSGFGEACAKIFAKQGNTLILVARRKQLLDELADNLGKQCDVYTAQVDVSQPASIATFFEQLPSKLGPIDTLINNAGLALGLESADKADINDWETMINTNCLGLVHFTRQVLPSMVANNLGHIVNIGSTAGKWPYPGGNVYGATKAFVQQFSRNLRADLLGKNIRVTNIDPGMAETEFSNIRFKGNNEKAEQVYHNAKPLTAQDIAETVQWVCNRPAHVNINSLEIMPVCQAWGGWEIDRNC

SEQ ID NO: 94403 - DNA, 732 bp, Pediococcus pentosaceus ATCC 25745
  CDS (1)..(732)
atgaataaaccattaattgttattactggtgctagctctggttttggagcagaaatagccaaaatttttaatcaggcaggttaccctgaattattactaggtcgccgagttgaaaagattcaagctttaccgcttaactttgaaaacgtcatgattgaaagcgtcgatgtaacagatcaagctcaatttaaaacagctattgaacatgctgaagctaaatttggaccagttgacttactcgttaacaacgctggggtgatgctattaggcaacgtgactacccaaagcccaaccgagtggcaaaccatgttggatactaatgttatgggcgttttaaatggaacccaaattattttacccagcatgttagagcgcgaacatggaaccatcattaatatgtcatccctagctggtaagaagaccttcgttaaccatgcggcttatgttgcttctaaattcggtgttcatagacttagcgaaactatccgagaagaagtttctggtaaaaatgtccgaatctcaatggttgccccaggcgctgctgaaactgaactcctcacccacgttactgaccaaaatgccttggtcgattatggcgaatggaaaaagagtatgggtggtatcacgatggatcccaaacatgttgctgaaagtgttaagttcatttatgatatgccacaagcggttaacatccgtgaattagcaatcgcagccactcgtcaagatagttaa

SEQ ID NO: 94404 - protein, 243 aa, Pediococcus pentosaceus ATCC 25745
MNKPLIVITGASSGFGAEIAKIFNQAGYPELLLGRRVEKIQALPLNFENVMIESVDVTDQAQFKTAIEHAEAKFGPVDLLVNNAGVMLLGNVTTQSPTEWQTMLDTNVMGVLNGTQIILPSMLEREHGTIINMSSLAGKKTFVNHAAYVASKFGVHRLSETIREEVSGKNVRISMVAPGAAETELLTHVTDQNALVDYGEWKKSMGGITMDPKHVAESVKFIYDMPQAVNIRELAIAATRQDS

SEQ ID NO: 94405 - DNA, 750 bp, Pediococcus pentosaceus ATCC 25745
  CDS (1)..(750)
atgagtaataagaataaagtagtaatcatcatgggggcttcgagtggaatcggagctgcgacagcagcaatgctagcgcaacaaggagctaagcttagcttggccgctcgtcgtctggatcgattacaagaaatccaagctcaatatcctgaggctgaaatcgaaattttcaaagccgatgtaaccaatgaagatgaagttcaagctgtaattgatggtacggttgctaagtttggtcggattgatgtgttatttaacaacgctggaattatgccagttaataatttaaatcaagttgctcaaaatgaatggcaacaaatgttagatattaatgttaaaggtgtgctaaatgggattggatcagctctacccatcatgcgtaaacaacaaagtggccatgtcattacaacttcttcggtattaggctatgaagttttaccgggttatgcggcttattcaggtactaagtatgcggtccgcgcgattatggaaggtcttcgacaagaagaacaccaaaataatattaaaactacggttattgctccaggtaccgtgaagactgaactatttaactcaatcaataatgaaaaaattcgtaatgaattgaaggatgctcaaaaattaccgggagctgaaatgacgggacttgatccagaagaaattgctcaagcagtggcctttgtgattgacaccccagctaatatggctgttaatgaaatggtaattcgtcctacaggtcaaaccgtttaa

SEQ ID NO: 94406 - protein, 249 aa, Pediococcus pentosaceus ATCC 25745
MSNKNKVVIIMGASSGIGAATAAMLAQQGAKLSLAARRLDRLQEIQAQYPEAEIEIFKADVTNEDEVQAVIDGTVAKFGRIDVLFNNAGIMPVNNLNQVAQNEWQQMLDINVKGVLNGIGSALPIMRKQQSGHVITTSSVLGYEVLPGYAAYSGTKYAVRAIMEGLRQEEHQNNIKTTVIAPGTVKTELFNSINNEKIRNELKDAQKLPGAEMTGLDPEEIAQAVAFVIDTPANMAVNEMVIRPTGQTV

SEQ ID NO: 94407 - DNA, 774 bp, Trichodesmium erythraeum IMS101
  CDS (1)..(774)
atgatatctgttgaaaataagatagttttaattacaggtgctagtagtggtattggtgaatcttgtgcccagatatttgctcaatcaggagctcaactaattttgctggctcgtcgccaagaaaaactagaaaaacttgctgaagtactaactaagaaataccaaactaaggtttatttattaaacttagatatacgcgatcgcctagcagttgaatcagccataaattctttacccgaaccttggaaaaagattgatattttgattaataatgctggtttaagtaggggtttaaataaactccatattggcgatttcaaggattgggaagaaatgattgatactaatgttaaaggattactctatattactcgttatatagtgccagaaatggtcagtcgaggtcggggtcatgtagttaatattggttctattgctggtcgtggagcatatcctaaaggtaatgtttattgtgcttctaaagctgctgttagggcaatttctgagggtttaaaacaggatttattaggaactcccatccgagtaactgaaattcaaccaggtttagtagaaacaaaatttagtgaagttagatttcatggagatacagaaaaagctaagaatgtttacaaaaacttgatgcctttgacaggagatgatatagcagatttagtacttttctgtgtgacgcgatcgcctcacgtcaatattagtgaacttttagtagtccccacagatcaagctaatgcaacaatggttcatcgacatcaataa

SEQ ID NO: 94408 - protein, 257 aa, Trichodesmium erythraeum IMS101
MISVENKIVLITGASSGIGESCAQIFAQSGAQLILLARRQEKLEKLAEVLTKKYQTKVYLLNLDIRDRLAVESAINSLPEPWKKIDILINNAGLSRGLNKLHIGDFKDWEEMIDTNVKGLLYITRYIVPEMVSRGRGHVVNIGSIAGRGAYPKGNVYCASKAAVRAISEGLKQDLLGTPIRVTEIQPGLVETKFSEVRFHGDTEKAKNVYKNLMPLTGDDIADLVLFCVTRSPHVNISELLVVPTDQANATMVHRHQ

SEQ ID NO: 94409 - DNA, 765 bp, Azotobacter vinelandii
  CDS (1)..(765)
atgagcgatgttgttttcatcacgggggcgacctccggcttcggccgcgccgccgcccgccgtttcgcccaggccggctggtcgctggtgctgacgggccggcgcttcgagcgcctgcaggtcctgcgggaagaactccagggcagggtgccggtgcacatcgccgcgctcgacgtgcgcgacgccgaggccgtgcgccaggtggtcgcggcgctgcccgagggcttccgccaagtccgggcgctgatcaacaacgccggcctggccctggccccgcagccggcgcagcaggtggcgctggaggactggcacaccgtgatcgacaccaacatcaccggcctggtcaacgtcacccacgcgctgctgccgaccctgatcgccagcggccagggcgccagcatcgtcaacctcggctcggtcgccggccactggccttatccgggcggccacgtctacggcgcgaccaaggccttcgtcgagcagttcggctacaacctgcgctgcgacctgctgggcaccggcgtgcgggtcaccgacatcgcgccgggcatggccgagaccgaattcaccctggtgcgcaccaagggcgaccaggccgcctccgagcggctctaccggggcaccacgccgctgaccgccgaggacatcgccgagcagatcttctacgtggcgagcctgccggcgcacatcaacatcaatcgcctggaaatcatgccggtacgccaggcttggtcgcccttcgccatcgaccgcgacccgcaatga

SEQ ID NO: 94410 - protein, 254 aa, Azotobacter vinelandii
MSDVVFITGATSGFGRAAARRFAQAGWSLVLTGRRFERLQVLREELQGRVPVHIAALDVRDAEAVRQVVAALPEGFRQVRALINNAGLALAPQPAQQVALEDWHTVIDTNITGLVNVTHALLPTLIASGQGASIVNLGSVAGHWPYPGGHVYGATKAFVEQFGYNLRCDLLGTGVRVTDIAPGMAETEFTLVRTKGDQAASERLYRGTTPLTAEDIAEQIFYVASLPAHININRLEIMPVRQAWSPFAIDRDPQ

SEQ ID NO: 94411 - DNA, 837 bp, Nostoc punctiforme PCC 73102
  CDS (1)..(837)
atgagcaaagtctggtttatcacaggcgctggcagtgggatcggaaccggaaccgccaaggcagcattgcagtccggtgaccgtgtagtcgcgactggccgaaacctcgataaagtgcgtaatgccttgcgcgatgttgcaagcgagaatcttgcatttgtccagttggacgtttccgacgaggtacaggcgaaaacagccatcgaggaggcggtgaatcggttcggtcgcatcgacgttttagttaacaatgcgggctacagcctgcttggtaattttgaagagatgaccacgaccgacatcgaacgccagttcgcgacaaacttctatggtgtggtgtacgtcatgcgtgccgtgctgccgattatgcgtcagcagcgatcgggccacatcatcaacattagctccgttgctggcgttgtcgggtttaagcactgtgctgcctacgctgcatcgaagttcgcggtcgaaggcatctcactgtcggtcgcggtcgaggtcgaggggttcggcatcaagatgacgctcgtcgaacctggcttctttcgcacggaccttctggacgaccagaatgtcagatggcccagcaacgccatcgaagactatgccgccgagggcaacgtccaggacacttggtcggtctacaacggcacgcagcagggtgacccggcaaagttgggcgatgctctggtcaaaatcgccgggatggagaatccgccgaagctgttcgttgccggaagtgatgcccttgcgacgatcgcgccggctgtcgaggaacggttgcaggcgacgcacgcccatgaagagctatcgaaatcaacggacggttcgttctag

SEQ ID NO: 94412 - protein, 278 aa, Nostoc punctiforme PCC 73102
MSKVWFITGAGSGIGTGTAKAALQSGDRVVATGRNLDKVRNALRDVASENLAFVQLDVSDEVQAKTAIEEAVNRFGRIDVLVNNAGYSLLGNFEEMTTTDIERQFATNFYGVVYVMRAVLPIMRQQRSGHIINISSVAGVVGFKHCAAYAASKFAVEGISLSVAVEVEGFGIKMTLVEPGFFRTDLLDDQNVRWPSNAIEDYAAEGNVQDTWSVYNGTQQGDPAKLGDALVKIAGMENPPKLFVAGSDALATIAPAVEERLQATHAHEELSKSTDGSF

SEQ ID NO: 94413 - DNA, 720 bp, Chloroflexus aurantiacus
  CDS (1)..(720)
atgaagctaaaggggcgcgttgcgattattactggcgcttcgagtggagtcggctatgctgctgcccgtctcttcgcccgtgagggggcgaccgttgtcgctgctgcccggcgacgtgatcgattggaacatttggtcagtatgattacatctgagggtcatcacgcctttgcaattccaacagatattaccgtttcagctcaggttcagcaactggttgacaccacggcccaaatgtttggtcgcatcgatattgtcttgaactgcgccggcaatatcgagaagatcgcgccgctcgaacagtttagtgacgccgaatggcaagatgtgatgaatacgaatctcaacggcgtcttttacctcatgcgggcagttgttccctatatgaagcgccagcgcagcggtacgattgtcaatctcggttcacgagttgggaaggttgggatggcaaatattgcaccgttctgtgcagcgaagtttgctctatcgggtctgtcacaggcgctcgctcaggagttgcgtccgtacaacgtcttcgtaacgaccgtgtattctggtatgatcaatgccgatattgcgccgctcaatcctgccgaagaactgcgcaagcgattgatgactgttgatgatgtcgcgcaggcactactgtgggtctgtaccttaccgccaagcctgcgggttgatgaactaccgattatgccacggacaattgatctgtga

SEQ ID NO: 94414 - protein, 239 aa, Chloroflexus aurantiacus
MKLKGRVAIITGASSGVGYAAARLFAREGATVVAAARRRDRLEHLVSMITSEGHHAFAIPTDITVSAQVQQLVDTTAQMFGRIDIVLNCAGNIEKIAPLEQFSDAEWQDVMNTNLNGVFYLMRAVVPYMKRQRSGTIVNLGSRVGKVGMANIAPFCAAKFALSGLSQALAQELRPYNVFVTTVYSGMINADIAPLNPAEELRKRLMTVDDVAQALLWVCTLPPSLRVDELPIMPRTIDL

SEQ ID NO: 94415 - DNA, 750 bp, Campylobacter upsaliensis RM3195
  CDS (1)..(750): transl_table=11
atgaaaaaagttgcttttatcacgggtgcgagttctggttttggagaggcttgtgtgaaagcctttatcaatgaggactttaaggtcgttgctctggcaagacgcaaggaaagattagataagcttaaagagctttataaagaacaaatttacacgcttaatcttgatgtaagaaagaaaaaagaactttttgaagctgtggctactctgcctagcgaatttcaaaacatttccgtgctttttaataacgccggactagccttaggacttgaggaatttgataaattaagccttgatgacattgacgctatggtcgatactaatgtcaaaggctttttatatgtagcaagagctgttataccgcttttaagaaggcaagaaaatgcttatatttttaatctcggttcaattgccgaaaatgtggcgtattttggtggtaatgtttattgcgggacaaaagcctttgtggggcagttttctagggcgttaagaaatgatttaagaggcacaaatattaaggttacaaacatagcgcccggactttgcaaaactgaatttagcgaagtgcgttttagaggagataaggctcaagcaaatgccgtttatgaagatactaaatttatcacggcagaagatattgctagggtggtgatgtccattatacacctcccacctcacatcaatgtcaataaaatcgaacttatgccagtaacgcaaagctgggcggggtcttttgtggaaaaagtgtaa

SEQ ID NO: 94416 - protein, 249 aa, Campylobacter upsaliensis RM3195
MKKVAFITGASSGFGEACVKAFINEDFKVVALARRKERLDKLKELYKEQIYTLNLDVRKKKELFEAVATLPSEFQNISVLFNNAGLALGLEEFDKLSLDDIDAMVDTNVKGFLYVARAVIPLLRRQENAYIFNLGSIAENVAYFGGNVYCGTKAFVGQFSRALRNDLRGTNIKVTNIAPGLCKTEFSEVRFRGDKAQANAVYEDTKFITAEDIARVVMSIIHLPPHINVNKIELMPVTQSWAGSFVEKV

SEQ ID NO: 94417 - DNA, 783 bp, Dictyostelium discoideum
  CDS (1)..(783)
atgtttagaaaaatctcaaacaaaattgttttaattactggtgcatcatcaggtattggtgaatcatgtgcaaaaatattccatcaaaatggtaaccatattattttatgtggtagaagagttgatagattaaataaattaagagatcaattaattgcaaacaattcaggtggtaaagttttagcatgtcaagttgatgtatcatcaatggaatcaattgataaaatgattaatgaattaccagaagatatgaaatcaattgatattttaattaataatgcaggattatcgttaggtatggattcagtttcagagattgatgcaaaaaatgatttagattctgtaattgatacaaatgttaaaggtgtattccgtgtaactagaaagatattaccaaatatgattcaaagaaactctggttacattttcaatgttagtagtattgcaggctcaatgttttacccaaatggtagtatttactgtgcctcgaaagctgctgtaaatgcattctcagatgtacttagaaaagaagttgttagtactaaaattcgtgtaactaatgtttgtccaggtctagtggaaactgaatttagtcttgtacgtttcaatggtgatgctgataaagcaaaaaaaccatacaatggtatcgtagcattaacacctgacgatattgctgataacatctattattgtgcctctagacctgaccatgtacaaattacaacaattgaaacaatggcaaataatcaagcatcaactagagatatttatagagaacaataa

SEQ ID NO: 94418 - protein, 260 aa, Dictyostelium discoideum
MFRKISNKIVLITGASSGIGESCAKIFHQNGNHIILCGRRVDRLNKLRDQLIANNSGGKVLACQVDVSSMESIDKMINELPEDMKSIDILINNAGLSLGMDSVSEIDAKNDLDSVIDTNVKGVFRVTRKILPNMIQRNSGYIFNVSSIAGSMFYPNGSIYCASKAAVNAFSDVLRKEVVSTKIRVTNVCPGLVETEFSLVRFNGDADKAKKPYNGIVALTPDDIADNIYYCASRPDHVQITTIETMANNQASTRDIYREQ

SEQ ID NO: 94419 - DNA, 768 bp, Halobacterium volcanii
  CDS (1)..(768): transl_table=11
ttgatgtcagaagaattcggttcggaactggacggaaaggtcgcaatcgtcaccggcgcgtcgtcgggcatcggcagcgcgacggccaagtccctcgcctctcgcggggccagcgtcgtcgtcgccgcccgccgcgaaggcgaactcgaagaactcgccgcaactatcgaagacgacggcggcgacgccctcgtcgtcccgacggacgtcaccgtcgacgacgacatcgacgccctcgtcgaggcgacgctcgacgagcacggtcgcatcgacattctcgtcaacaacgccggcctcatgccgcttgcacacatcggcgaggcggaccgcgagacgctccagacgaccatcgacgtgaaccttaccggtctcatcacgctcacccacgcggtcgtcccgacgatgatggaacaggaaagcggccacatcgtcaacctctcgtcggtcgtcggccggttcctccaggcgaacagttcgcactacaacgccgcgaaagcgggcgtcaagatgttcagcgactcgctgcgactcgacgtcgccgaagcgggcatccacgtctcgtcaatcgaacccggcgcggtcgacacggaactgctcgaccacatccccgacgaggaagtccaaaagaacgtcaaggactacgtcggcacgatggacgcgctcgcgcccgaagacatcgcgcggacgattacgttcgtcgtcacgcaaccggagcgcgtcgacatcaacgaagtcctcatccgccccctcgaccaggtccagccctga

SEQ ID NO: 94420 - protein, 255 aa, Halobacterium volcanii
MMSEEFGSELDGKVAIVTGASSGIGSATAKSLASRGASVVVAARREGELEELAATIEDDGGDALVVPTDVTVDDDIDALVEATLDEHGRIDILVNNAGLMPLAHIGEADRETLQTTIDVNLTGLITLTHAVVPTMMEQESGHIVNLSSVVGRFLQANSSHYNAAKAGVKMFSDSLRLDVAEAGIHVSSIEPGAVDTELLDHIPDEEVQKNVKDYVGTMDALAPEDIARTITFVVTQPERVDINEVLIRPLDQVQP

SEQ ID NO: 94421 - DNA, 744 bp, Streptomyces clavuligerus
  CDS (1)..(744): transl_table=11
atgccatccgcactccaggggaaagtcgcgctcatcacgggccgcgagctcgggcatcggcgagccacggcccgcgccctggcgcccgagggcgccgccgtggccatcgccgcgcgccgggtcgagaagctgcgcgccctgggtgacgagctgaccgccgccggggcgaaggtccatgtcctcgaactcgacgtcgccgaccggcagggggtggacgccgccgtcgcctccaccgtcgaggcgctgggcggcctcgacatcctcgtcaacaacgccgggatcatgctgctcggcccggtggaggacgccgacaccaccgactggacccggatgatcgacaccaatctcctgggcctgatgtacatgacccgggcggcccttccccatctgctgcgcagcaagggcaccgtggtgcagatgtcctcgatcgcgggccgggtgacagtccgcaacgcggccgtctaccaggccacgaagttcggtgtgaacgcgttcagcgagaccgtgcgccaggaggtcaccgagcgcggggtgcgggtcgtcgtcatcgagccgggcaccaccgacacggagctgcgcggccacatcacccacaccgccaccaaggagatgtacgagcagcggatcagccagatccgcaagctccaggcccaggacatcgcggaggcggtccgctacgccgtgaccgcgccgcaccacgcgaccgtccacgagatcttcatacgccccaccgaccaggtctga

SEQ ID NO: 94422 - protein, 247 aa, Streptomyces clavuligerus
MPSALQGKVALITGRELGHRRATARALAPEGAAVAIAARRVEKLRALGDELTAAGAKVHVLELDVADRQGVDAAVASTVEALGGLDILVNNAGIMLLGPVEDADTTDWTRMIDTNLLGLMYMTRAALPHLLRSKGTVVQMSSIAGRVTVRNAAVYQATKFGVNAFSETVRQEVTERGVRVVVIEPGTTDTELRGHITHTATKEMYEQRISQIRKLQAQDIAEAVRYAVTAPHHATVHEIFIRPTDQV

SEQ ID NO: 94423 - DNA, 738 bp, Listeria ivanovii
  CDS (1)..(738)
atgtctaatatcaaaggaaaagttattgtaattacaggagcaagtagtggtattggtcgagcaactgctctattgctatcgaaaaaaggagcgaaaattgtcttgggagcccgtcgtgaagatcgcttaaaaacaattgttaagacaattgttgataacggaggtgaagcaatttatgccgtgacagatgtcacaaagaaagaagaagtcgatgaattagttcgagtatcattagctacatttggtcaagttgatgttatgtttaacaacgcaggaattatgccattatctcatgtagaatcttttaaaactgatgaatgggataagatggtggacgtgaatatcaaaggtgttttacatgggttagcagccgttatgccaattatgcttgaagcaggcgatggtcagattatcacaacaggttcagtcgctagttataatgcagaacccacaggggttatttatgcaggaacaaaatttgctattcgtgcaattcatgaaggccttagaagggaacttgatggacgtatcaaacttaccctactggctcctggggtgacagatactgaattaggagaagatattacagaagaagacattataaacggacttaaagaaattagaaagttagctatttcacctgaaagtattgcagaagcagttttatttgccattaatcagccaagcaatattgatacatcaactattgttgtacggcaacgaggagggaacgcataa

SEQ ID NO: 94424 - protein, 245 aa, Listeria ivanovii
MSNIKGKVIVITGASSGIGRATALLLSKKGAKIVLGARREDRLKTIVKTIVDNGGEAIYAVTDVTKKEEVDELVRVSLATFGQVDVMFNNAGIMPLSHVESFKTDEWDKMVDVNIKGVLHGLAAVMPIMLEAGDGQIITTGSVASYNAEPTGVIYAGTKFAIRAIHEGLRRELDGRIKLTLLAPGVTDTELGEDITEEDIINGLKEIRKLAISPESIAEAVLFAINQPSNIDTSTIVVRQRGGNA

SEQ ID NO: 94425 - DNA, 768 bp, Mus musculus
  CDS (1)..(768)
atggagcggtggcgcgaccggctggcactggtgacgggagcctcggggggcatcggtgcggccgtggcccgggcattagtccagcagggactgaaggttgtgggttgtgcccgcaccgttggcaacatcgaggagctggctgctgaatgtaagagtgcaggctaccccgggactttgatcccctacagatgtgacctgtcaaatgaggaggacatcctctccatgttctcagctgtccgatcccagcacagtggcgtggatatctgcatcaacaatgccggcatggcccggcctgacaccctgctctcgggcagcaccagcggatggaaggacatgttcaatgtgaatgtgctggccctcagcatctgcactcgggaggcttatcagtccatgaaggagcggaacatagacgacgggcacatcattaacatcaacagcatgtgtggccaccgagtcccaccccagtctgtgatccatttctatagtgcgactaagtatgccgtcactgcactgacagagggactcaggcaagagcttctggaggcccagacccatatccgggccacgtgtatctctccaggcttggtagagacacagttcgccttcaaactccatgacaaggacccgggggaagcagctgccacctatgaacacataaagtgtctcagaccagaggacgtggctgaggctgtcatctacgttcttagcacacccccacatgttcaggttggtgacatccagatgaggcccacagagcaggtgacctag

SEQ ID NO: 94426 - protein, 255 aa, Mus musculus
MERWRDRLALVTGASGGIGAAVARALVQQGLKVVGCARTVGNIEELAAECKSAGYPGTLIPYRCDLSNEEDILSMFSAVRSQHSGVDICINNAGMARPDTLLSGSTSGWKDMFNVNVLALSICTREAYQSMKERNIDDGHIININSMCGHRVPPQSVIHFYSATKYAVTALTEGLRQELLEAQTHIRATCISPGLVETQFAFKLHDKDPGEAAATYEHIKCLRPEDVAEAVIYVLSTPPHVQVGDIQMRPTEQVT

SEQ ID NO: 94427 - DNA, 813 bp, Neurospora crassa
  CDS (1)..(813)
atgtcctcagcagtagccaagcgcctcgcgggcaagaccattgtcataaccggagcgtcctcaggaatcgggcgtagcacagccttcgagtttgcgcggaccgcgcccaaccacggcctcaagctgatcttgacggcccgccgcgtcgatgccctggagcagattgccaaggagatccgccaagaggttggcgagggcgtgcaagtgctgcctgtcaagctggacgtcagccagccggaggaggtcagggggtttgttgggaacttgcccgaggagtggagggatatccatgtgctggtcaataatgctggtctcgtaaaaggagctccctccatcgccgaagaagacatcaacgtcatgtttgccaccaacgtcaccggcctgatcaacatgacccaagccatcctgcccatcttcaaggcccgcggctccgagggtggttcgggagacattgtgaacatcggttctattgccgggagagaaccatacgcgggaggctccatctactgcgccaccaaggctgctgtgcgcagcttcaccgacgcgctgcgcaaggagctgatcgccacgcgcatccgtgtcatggagattgaccctggccaggtcgagaccgagttcagcgtggtgaggttctatggtgataagaacaaggctgatgccgtctatgccggtgtcgatcccttgacgcccgatgatatcgcagagatcgtggtgttcgtcgtaacacgacgggagaacgttgttgttgctgatacgttggtcttccctagccatcaggctggcgctggtattatgcaccgcaagtcgacatga

SEQ ID NO: 94428 - protein, 270 aa, Neurospora crassa
MSSAVAKRLAGKTIVITGASSGIGRSTAFEFARTAPNHGLKLILTARRVDALEQIAKEIRQEVGEGVQVLPVKLDVSQPEEVRGFVGNLPEEWRDIHVLVNNAGLVKGAPSIAEEDINVMFATNVTGLINMTQAILPIFKARGSEGGSGDIVNIGSIAGREPYAGGSIYCATKAAVRSFTDALRKELIATRIRVMEIDPGQVETEFSVVRFYGDKNKADAVYAGVDPLTPDDIAEIVVFVVTRRENVVVADTLVFPSHQAGAGIMHRKST

SEQ ID NO: 94429 - DNA, 744 bp, Drosophila melanogaster
  CDS (1)..(744)
atggaacgttggcataactgcgtagcagtggtgaccggagccagttcgggaatcggagcggcaatcacccgaaaactgatctccgctggcgtcatggtggttgccctggcccgtcgaatggaccgcttggagcaattgcgtgaggagctgccgcaggatcggcgatcgcgattgcgtataatgcagtgcgatgtttcggatgtgtcatccgtaaacgcggtctttgacgcggtgcagggggatctgggcaacgtggacattcttatcaataacgccggaaagctgtccggtggacagctgctgactatgtcggtagacactgtgcagcagatgctgcagacgaatgtaatgggcgtggtctactgcacccagcgcgcctttgaatcgatgcggcagcgccagtccaagggtcatgtggtgctcattaacagcattgtgggtcactacatctttaatcccctgcctggaagtcagcaggaactcaacatgtacccggccaccaagcacgcgatcaccgctcttaccgagctctttcgccaggagatgcgagatttcaagaccaaagtcaaggtcacgagcattagtccgggattggtggacactgagttagtgccgttggactacaaagggctgcctatgctacaggcggaggatgtggcaaatgccatcatgtatgttctgtcgacgcctccacatgtccaggtgcacgagctgaccatcaagcccttgggtgaacccttttag

SEQ ID NO: 94430 - protein, 247 aa, Drosophila melanogaster
MERWHNCVAVVTGASSGIGAAITRKLISAGVMVVALARRMDRLEQLREELPQDRRSRLRIMQCDVSDVSSVNAVFDAVQGDLGNVDILINNAGKLSGGQLLTMSVDTVQQMLQTNVMGVVYCTQRAFESMRQRQSKGHVVLINSIVGHYIFNPLPGSQQELNMYPATKHAITALTELFRQEMRDFKTKVKVTSISPGLVDTELVPLDYKGLPMLQAEDVANAIMYVLSTPPHVQVHELTIKPLGEPF

SEQ ID NO: 94431 - DNA, 783 bp, Homo sapiens
  CDS (1)..(783)
atggccaggcccggcatggagcggtggcgcgaccggctggcgctggtgacgggggcctcggggggcatcggcgcggccgtggcccgggccctggtccagcagggactgaaggtggtgggctgcgcccgcactgtgggcaacatcgaggagctggctgctgaatgtaagagtgcaggctaccccgggactttgatcccctacagatgtgacctatcaaatgaagaggacatcctctccatgttctcagctatccgttctcagcacagcggtgtagacatctgcatcaacaatgctggcttggcccggcctgacaccctgctctcaggcagcaccagtggttggaaggacatgttcaatgtgaacgtgctggccctcagcatctgcacacgggaagcctaccagtccatgaaggagcggaatgtggacgatgggcacatcattaacatcaatagcatgtctggccaccgagtgttacccctgtctgtgacccacttctatagtgccaccaagtatgccgtcactgcgctgacagagggactgaggcaagagcttcgggaggcccagacccacatccgagccacgtgcatctctccaggtgtggtggagacacaattcgccttcaaactccacgacaaggaccctgagaaggcagctgccacctatgagcaaatgaagtgtctcaaacccgaggatgtggccgaggctgttatctacgtcctcagcacccccgcacacatccagattggagacatccagatgaggcccacggagcaggtgacctag

SEQ ID NO: 94432 - protein, 260 aa, Homo sapiens
MARPGMERWRDRLALVTGASGGIGAAVARALVQQGLKVVGCARTVGNIEELAAECKSAGYPGTLIPYRCDLSNEEDILSMFSAIRSQHSGVDICINNAGLARPDTLLSGSTSGWKDMFNVNVLALSICTREAYQSMKERNVDDGHIININSMSGHRVLPLSVTHFYSATKYAVTALTEGLRQELREAQTHIRATCISPGVVETQFAFKLHDKDPEKAAATYEQMKCLKPEDVAEAVIYVLSTPAHIQIGDIQMRPTEQVT

SEQ ID NO: 94433 - DNA, 849 bp, Rhizobium sp
  CDS (1)..(849): transl_table=11
atgaaggtctggttcatcactggtgcatcccgcggcttcggcgcgctgatgaccaaagaagcactggcagccggcgacgccgtggtcgctaccgcccgcaattcaagcaccgtcgtcgagcagtttggcgataaccccaatcttctcgccgtcgcactcgacgtcacgaacgaagcccaggcgaaggacgcggccgcaaaggccatcgagcgcttcggccgcattgacatcctcgtcaacaatgccggttatggtctgctcggcgcagtcgaggaagcgacggcagaggaagttgagaagctctatgccaccaatgtcttcggattgctgaaggtcacgcgtgccgtactaccgtacatgcgccgccagcgtgctggtcatgttctgaatttctcgtctgtcggcggatacttcggttatcccggctggggcgtttacggttccaccaagttcgccgtcgaagggctttcggagtcacttgcggccgaactcaagccattcggcatcaaggtgacgatcgtcgagcccgggttcttccgcaccgattttctcgccgacaactcgctgtcggtcagtgcggctgcaatccccgactatgtcggcacgccggcaggcgacatgcgcacctttgcggcccaggcgaaccgttctcagccgggcaatccggtgaagcttgccgccgggatcgccaccctggtcaacgcggccaacccgccgctccgcatgcccttcggaagcgacacggtcgccgtgatcgaggagcagaatgccggtgtagccagggagcttgccgagtggcgcgaacttgcgctctccacggatttcccgaaggacgagatagccgcctga

SEQ ID NO: 94434 - protein, 282 aa, Rhizobium sp
MKVWFITGASRGFGALMTKEALAAGDAVVATARNSSTVVEQFGDNPNLLAVALDVTNEAQAKDAAAKAIERFGRIDILVNNAGYGLLGAVEEATAEEVEKLYATNVFGLLKVTRAVLPYMRRQRAGHVLNFSSVGGYFGYPGWGVYGSTKFAVEGLSESLAAELKPFGIKVTIVEPGFFRTDFLADNSLSVSAAAIPDYVGTPAGDMRTFAAQANRSQPGNPVKLAAGIATLVNAANPPLRMPFGSDTVAVIEEQNAGVARELAEWRELALSTDFPKDEIAA

SEQ ID NO: 94435 - DNA, 840 bp, Arabidopsis thaliana
  CDS (1)..(840)
atggagagtggcgatgagagtccggtggttctaattacgggatgttctcagggaggaattggtcacgcgctggcccgtgagttcactgagaagggatgtcgagtagtggcgacgagtcgatcacggagtacgatgacggatctggagcaagattcgaggttattcgtgaaggagcttgatgtgcaatcggaccagaatgtgagtaaggttttgtcggaggttattgataagttcggtaagatcgacgttcttgttaataacgccggagttcagtgcgttggacctctggcggagactccaatttccgccatggaaaacacattcaacaccaatgtttttggttccatgaggatgactcaagctgttgtaccacacatggtgtctaagaaaaagggaaagattgtcaacgttggaagtatcactgttatggcacctggtccatgggctggtgtctatacagctaccaaagctgctattcatgctcttaccgatactctgaggttggagcttcgtccgtttgggattgatgtcatcaatgttgtcccgggaggaataagaacaaacatagcaaactcagctgtggcaactttcaacaaaatgcctgagctgaaactatacaagccttatgaagaagctatcagagaaagggcgtttatatcacagaggatgaatccaactcctgcagaaacatttgccagagacactgtagccgcagtgctgaagaagaatccacccgcttggttctcgtcaggcaggtattcaaccctcatggcaggcatgtatcatatgcccttatggctcaaagattttttccagaagcaggttttaatgaagaagtga

SEQ ID NO: 94436 - protein, 279 aa, Arabidopsis thaliana
MESGDESPVVLITGCSQGGIGHALAREFTEKGCRVVATSRSRSTMTDLEQDSRLFVKELDVQSDQNVSKVLSEVIDKFGKIDVLVNNAGVQCVGPLAETPISAMENTFNTNVFGSMRMTQAVVPHMVSKKKGKIVNVGSITVMAPGPWAGVYTATKAAIHALTDTLRLELRPFGIDVINVVPGGIRTNIANSAVATFNKMPELKLYKPYEEAIRERAFISQRMNPTPAETFARDTVAAVLKKNPPAWFSSGRYSTLMAGMYHMPLWLKDFFQKQVLMKK

SEQ ID NO: 94437 - DNA, 810 bp, Mycobacterium smegmatis
  CDS (1)..(810): transl_table=11
atgcacaggggacgacgcatcgttgcaccgtcccgtaccccagaggaggcgttccttatgacaggcaagaggctcgccgacacggttgccctggtgaccggcgcatcgagcggcatcggatgggcgacggcccgtgccctcgccgccgaaggcgccaccgtggcggtcttcggccgtcgactcgcgcgactcgaagaactggtcgacgtgatcgaacgtgacggaggtcgagcgcacgcccacgaggtggacgtcaccgatggcgcgaccgtcgcgcggtccgtgcaagccatcgccgacgagttcggccgcatcgacatcttggtcaacaacgccgggttcctggccaacgcaccggccgtcgaagccgatctcgccgactggcaccgcaccatcgacgtgaacatcggtggcgttctgaacgtcacgcacgcagcactgcctctggtggtcagggccggcgagcgggagcgtggggtggccgacatcgtgaccgtcagctctgtcggaggcaggcgcgtcccaggaccgtcgagcaatgtctacgccgcgagcaagcacgccgtcggcgcgttcacggaggcgttacggcaagagttggcgaccaggcgtgttcgcgtcggggtggtggagcccggtgtggttcggaccgagatgacaaccggcggaagcaagggtgcccccgatgccacgaccggtgcgccccttgaccccgccgacatcgcatccgcgatcgtgtacatggtcacccggcccgcgcacgcggcggtcaacgagatcctcatccggcccaccgaacaagtgatctga

SEQ ID NO: 94438 - protein, 269 aa, Mycobacterium smegmatis
MHRGRRIVAPSRTPEEAFLMTGKRLADTVALVTGASSGIGWATARALAAEGATVAVFGRRLARLEELVDVIERDGGRAHAHEVDVTDGATVARSVQAIADEFGRIDILVNNAGFLANAPAVEADLADWHRTIDVNIGGVLNVTHAALPLVVRAGERERGVADIVTVSSVGGRRVPGPSSNVYAASKHAVGAFTEALRQELATRRVRVGVVEPGVVRTEMTTGGSKGAPDATTGAPLDPADIASAIVYMVTRPAHAAVNEILIRPTEQVI

SEQ ID NO: 94439 - DNA, 780 bp, Lactococcus lactis
  CDS (1)..(780): transl_table=11
atgttgtataatcagtatatcaaaaaaatactcttaaggagaaataaaatgtctaaaccacttattgttataacaggagcaagttcaggatttggtgctgaaattgcaaaattatttaatgctgatggattcccaatgttgcttttaggtcgtcgtacagataaaatcaaagccttgccccttgattttacgaatgtccttgtggaatctgtagatgtcacagataaaaaaacttttgaaaatgcaatttccaaagctgaagaaaaatatggcaaaactgatcttctagtcaataatgcaggtgtcatgttattaggaaatgttcttaatcaaaatccagcagaatggaaacaaatgatggatactaatgttttgggtgtccttaatggaatgcaaattgttcttccacaaatggttgaacgccaaggaggaacagtaattaacatgtcttctcttgctggtaaaaaaacttttaccaatcacgccgcttatgtcgcttcaaaatttggtgtccatggtttaagtgaaactatcagagaggaagtttctggtaaaaatgttcgaatttcacttgttgcacctggtgctgccgaaacagaattattgacacatgttactgacgaaagtgccctaaatgattataatctttggaaagaatcaatgggtggtacaacacttgctcctgaaagagtggcgcaaaccgtgaaattcatttatgatatgcctcaaacggtcaacatcagagaaattgatattgctgcaaccaatcaaaatgcttaa

SEQ ID NO: 94440 - protein, 259 aa, Lactococcus lactis
MLYNQYIKKILLRRNKMSKPLIVITGASSGFGAEIAKLFNADGFPMLLLGRRTDKIKALPLDFTNVLVESVDVTDKKTFENAISKAEEKYGKTDLLVNNAGVMLLGNVLNQNPAEWKQMMDTNVLGVLNGMQIVLPQMVERQGGTVINMSSLAGKKTFTNHAAYVASKFGVHGLSETIREEVSGKNVRISLVAPGAAETELLTHVTDESALNDYNLWKESMGGTTLAPERVAQTVKFIYDMPQTVNIREIDIAATNQNA

SEQ ID NO: 94441 - DNA, 753 bp, Escherichia coli
  CDS (1)..(753): transl_table=11
atgatgaatcactctgtgccctctatgaatactccccttaatggcaaagttgcagctatcactggcgctgcgtcaggtattggcctgcaatgtgcaaaaacgctgctcgatgcaggagcaaaggtagtattgattgaccgggaaggcgacaaactgcacaagattgtcgctgagttaggcgaaaacgcgtacgcgctgcaactcgatctcttcaataatcagcaagtcgataacatgctggcggacattatcgaactggcgggtgggctggatatttttcatgccaatgcaggcgcttatattggcggcccagtggctgaaggtgatccagatgtctgggatcgtgtgttaaatctgaatataaatgcggcgtttcgctgtgtccgtgcagtcctgccgcatatgattgcgcagaggtcgggcgatataatttttaccagttccatcgcgggcgtcgttccggttatctgggaaccgatctacaccgcgtccaaatttgccgttcaggcattcgtacacactacccgccgccaggtttctcaatatggcgtgcgtgtgggtgcggtgctgccaggaccagtagtcactgccctgcttgatgactggccaaaagccaaaatggaagaagccctggcaaatggtagcctgatgcaaccgattgaagtggcggaatcagtattgtttatggtgacccgctcgaaaaatgtcaccgtgcgagatttagtgatcctgcctggcagtgtcgatctgtaa

SEQ ID NO: 94442 - protein, 250 aa, Escherichia coli
MMNHSVPSMNTPLNGKVAAITGAASGIGLQCAKTLLDAGAKVVLIDREGDKLHKIVAELGENAYALQLDLFNNQQVDNMLADIIELAGGLDIFHANAGAYIGGPVAEGDPDVWDRVLNLNINAAFRCVRAVLPHMIAQRSGDIIFTSSIAGVVPVIWEPIYTASKFAVQAFVHTTRRQVSQYGVRVGAVLPGPVVTALLDDWPKAKMEEALANGSLMQPIEVAESVLFMVTRSKNVTVRDLVILPGSVDL

SEQ ID NO: 94443 - DNA, 783 bp, Streptococcus thermophilus
  CDS (1)..(783): transl_table=11
ttgaaatggaggatatcatgccaaaaacgtacttattataggagcaacctcaggcattggcgaacgtacggcgcgtgcctttgccagagaggggctaacctcatcttgacagggcgccgtgtagaacgcttagaagctctaaaagcagaatttgaagcgacctatcccaatcaaaaagtttggacctttgcactggatgttaccgatatggagatggtcaaggacgtttgccaagccattctcaaaagtgtgggtcaagtccatgtcttagtcaataatgcaggcctggcactaggcctaatagcttaccaagactacgaagagtgggacctgctgaccatgctcgacaccaatgtcaagggcttgatgatggtgacacgtcagattttgccgagtatggtagctaccaatgagggccatattatcaatatgggctctaaagcaggcatctatgcttatgcaggcgccgctgtttattcagcaaccaaagctgcagtgaaaacttttagtgacggattgcgtattgataccattgccacagatatcaaggtgacaaccattcagcccggtatcgttgagaccgacttttcacaagttcgctttcacggtgacaaggaggacaaggcagccaaggtttatcaaggtttggaagccctccaagcccaagatattgcggaggcagtcctctatgttaccaagcaaccacgacgcgttcagatttcagacatgaccatcatggctaaccaacaagccacagggtttacgattcataggggagagtaa

SEQ ID NO: 94444 - protein, 260 aa, Streptococcus thermophilus
MKWRISCQKRTYYRSNLRHWRTYGACLCQRGANLILTGRRVERLEALKAEFEATYPNQKVWTFALDVTDMEMVKDVCQAILKSVGQVHVLVNNAGLALGLIAYQDYEEWDLLTMLDTNVKGLMMVTRQILPSMVATNEGHIINMGSKAGIYAYAGAAVYSATKAAVKTFSDGLRIDTIATDIKVTTIQPGIVETDFSQVRFHGDKEDKAAKVYQGLEALQAQDIAEAVLYVTKQPRRVQISDMTIMANQQATGFTIHRGE

SEQ ID NO: 94445 - DNA, 747 bp, Paenibacillus popilliae
  CDS (1)..(747): transl_table=11
atggcaattgaaaacaaagtggttgttattacaggcgcaagttcaggtattggggaagctacagctaagctgttagctgagaagggtgcaaaagttgtacttggtgcaagacgtgaagagcatttagtaaaattagttgaagaaattaaatcgaatgggggtcaagcggcgtaccgcgtcacagatgttgttaatccagatgatagtcagcagcttgttcaactagctaaagacactttcggtggtgtcgatgtaatcttcttgaacgctggacttatgcctaattcaccactttccgaattaaaaactgacgagtggaacagtatggttgacgttaatattaaaggtgtattgaatggtatcgccgcagtattgccaacatttatatcgcaaaagtctggacatatcatcactaattcatcagtagctgggcttaaagcttacccaggcggtgcggtttatggcgcaacaaagtgggctgttcgcaatttaatggaagttttgcgtatggaatctgcccaagaaggtactaacatccgcacagcaactatttatccagcagcgattaacacggaattgttgggtacgattactgataagaatatttcagaaggtatgactgcgttgtacgaacaatatggtatttcacctgatcgagttgccaatattgttgcattcgcgattgatcagccagaagatacgaacgttaatgagtttacaattgggccaacaagtcaaccttggtaa

SEQ ID NO: 94446 - protein, 248 aa, Paenibacillus popilliae
MAIENKVVVITGASSGIGEATAKLLAEKGAKVVLGARREEHLVKLVEEIKSNGGQAAYRVTDVVNPDDSQQLVQLAKDTFGGVDVIFLNAGLMPNSPLSELKTDEWNSMVDVNIKGVLNGIAAVLPTFISQKSGHIITNSSVAGLKAYPGGAVYGATKWAVRNLMEVLRMESAQEGTNIRTATIYPAAINTELLGTITDKNISEGMTALYEQYGISPDRVANIVAFAIDQPEDTNVNEFTIGPTSQPW

SEQ ID NO: 94447 - DNA, 744 bp, Streptomyces clavuligerus
  CDS (1)..(744): transl_table=11
atgccatccgcactccaggggaaagtcgcgctcatcacgggcgcgagctcgggcatcggcgaggccacggcccgcgccctggccgccgagggcgccgccgtggccatcgccgcgcgccgggtcgagaagctgcgcgccctgggtgacgagctgaccgccgccggggcgaaggtccatgtcctcgaactcgacgtcgccgaccggcagggggtggacgccgccgtcgcctccaccgtcgaggcgctgggcggcctcgacatcctcgtcaacaacgccgggatcatgctgctcggcccggtggaggacgccgacaccaccgactggacccggatgatcgacaccaatctcctgggcctgatgtacatgacccgggcggcccttccccatctgctgcgcagcaagggcaccgtggtgcagatgtcctcgatcgcgggccgggtgaacgtccgcaacgcggccgtctaccaggccacgaagttcggtgtgaacgcgttcagcgagacgctgcgccaggaggtcaccgagcgcggggtgcgggtcgtcgtcatcgagccgggcaccaccgacacggagctgcgcggccacatcacccacaccgccaccaaggagatgtacgagcagcggatcagccagatccgcaagctccaggcccaggacatcgcggaggcggtccgctacgccgtgaccgcgccgcaccacgcgaccgtccacgagatcttcatacgccccaccgaccaggtctga

SEQ ID NO: 94448 - protein, 247 aa, Streptomyces clavuligerus
MPSALQGKVALITGASSGIGEATARALAAEGAAVAIAARRVEKLRALGDELTAAGAKVHVLELDVADRQGVDAAVASTVEALGGLDILVNNAGIMLLGPVEDADTTDWTRMIDTNLLGLMYMTRAALPHLLRSKGTVVQMSSIAGRVNVRNAAVYQATKFGVNAFSETLRQEVTERGVRVVVIEPGTTDTELRGHITHTATKEMYEQRISQIRKLQAQDIAEAVRYAVTAPHHATVHEIFIRPTDQV

SEQ ID NO: 94449 - DNA, 747 bp, Zymomonas mobilis
  CDS (1)..(747): transl_table=11
atgaaccagaatatccgcaataaaattgttgtcattacaggggctagcagtggtttaggcgctgaaacggcacggcatttgtcagatttgggggcaactgttgtgctgggtgcaaggcgagaggaacgcatcgcaacattagcgaattctatcgtcgctaagggtggtcaagccttggctatcaaaaccgatgtgactgaccgtgagtcggttaaaaatttggttgatacagctgtaaaaacctatgggcgggttgatgtccttctcaataacgccggtgtaatgcccctttccccgcttgagaaactacgcgtcgatgaatgggaattgatggttgatgttaatatcaaaggcgttctttatgggattgcagccgctctacctcatatgaaatcccaaaaatttggccatatcatcaatgtctcttcggttgccggtcacaaggttattgatgggggggcggtttattcggcgacaaaatttgccgttcgcgcgctttctgaaggattacgagccgaagtgaagtcctataatttacggacgaccatcatttcgccgggcgccgttcagtcggaattgattgatggtattcatgatgaagaatccgcgaaacaaatccgcgcaatagtcccagatatggcgatcggtgcggattcttttgcccgctgtgtggcctttgcgatcagccaacctgaaaatgtcgatattaatgaaattctgttccgaccgacaacacaggcattataa

SEQ ID NO: 94450 - protein, 248 aa, Zymomonas mobilis
MNQNIRNKIVVITGASSGLGAETARHLSDLGATVVLGARREERIATLANSIVAKGGQALAIKTDVTDRESVKNLVDTAVKTYGRVDVLLNNAGVMPLSPLEKLRVDEWELMVDVNIKGVLYGIAAALPHMKSQKFGHIINVSSVAGHKVIDGGAVYSATKFAVRALSEGLRAEVKSYNLRTTIISPGAVQSELIDGIHDEESAKQIRAIVPDMAIGADSFARCVAFAISQPENVDINEILFRPTTQAL

SEQ ID NO: 94451 - DNA, 735 bp, Escherichia coli; identical to SEQ ID NO: 62139
  CDS (1)..(735): transl_table=11

SEQ ID NO: 94452 - protein, 244 aa, Escherichia coli; identical to SEQ ID NO: 7021

SEQ ID NO: 94453 - DNA, 735 bp, Vibrio harveyi; identical to SEQ ID NO: 7108
  CDS (1)..(735): transl_table=11

SEQ ID NO: 94454 - protein, 244 aa, Vibrio harveyi; identical to SEQ ID NO: 7109

SEQ ID NO: 94455 - DNA, 750 bp, Agrobacterium tumefaciens
  CDS (1)..(750): transl_table=11
atgagcggaactatcttgatcaccggcgcgacatccggtttcggacaggccacggcgcagcgcttcgtcaaggaaggctggaaggtcatcggcacgggccggcgggcggaacggctggaggcgctttcggctgaactcggttccgcctttcatggcgtcgccttcgatatcaccgacgaggaggcgacaaaaaaggcgttggccggcttgcctgatggattcagggatatcgacattctcgtcaacaatgccggccttgcactcggcacggcgcccgcgccgcaggtgccgttgaaagactggcagaccatggtggacaccaacatcactggtctcctgaacgtcacccaccatctgctgccgacgctgatcgagcgcaagggtattgttatcaacctttcgtctgttgctgcgcactacccctatctgggcggcaatgtgtatggcggtaccaaagcgttcctgcggcaattctcgctcggcctgcgttccgacctgcatggcaagggcgtcagggtaacctcgatcgaaccgggcatgtgcgaaacggaattcacgctggtgcgcaccggcggcaatcaggaagcctcggataatctctacaagggcgtcaatccgatcacggcagacgatattgccaacaccatccactgggtcgcctcgcagcccaaacatatcaacatcaacagcctcgaactgatgccggtcaaccagtcctttgccggtttccaggtctatcgggaaagctga

SEQ ID NO: 94456 - protein, 249 aa, Agrobacterium tumefaciens
MSGTILITGATSGFGQATAQRFVKEGWKVIGTGRRAERLEALSAELGSAFHGVAFDITDEEATKKALAGLPDGFRDIDILVNNAGLALGTAPAPQVPLKDWQTMVDTNITGLLNVTHHLLPTLIERKGIVINLSSVAAHYPYLGGNVYGGTKAFLRQFSLGLRSDLHGKGVRVTSIEPGMCETEFTLVRTGGNQEASDNLYKGVNPITADDIANTIHWVASQPKHININSLELMPVNQSFAGFQVYRES

SEQ ID NO: 94457 - DNA, 747 bp, Salmonella typhi
  CDS (1)..(747): transl_table=11
atgatcgttttagtaactggagcaaccgcagggtttggcgagtgcattgcacgccgttttgttgagaatggacataaagtcattgccacgggacgtcgtcatgaacgcctgcaagcgttaaaagatgagcttggcgagaacgtattgaccgcccaactggacgtgcgcaaccgcgcggccatcgaagagatgatggcctctctgcctgcgcagtggcgcgatattgatgtgctggtcaataacgccggtctggcgctgggtcttgaaccggcgcataaagccagcgtagaagactgggaaactatgatcgatactaataataaaggcttaatttatatgacccgcgccgtgctgccaggaatggtcgaacgtaatcgcggtcatatcattaacatcggttcaaccgccggcagttggccttatgctggtggcaacgtctatggcgcgacgaaagcctttgtgcgccagtttagcctgaatttgcgcacggatttacacggcacggcggttcgcgtgaccgacattgaaccgggtctggttggcggcaccgagttttccagcgtccgtttcaaaggcgacgatgagaaagcgggtaaaacctacgaaaataccaccgcgctcacgccagaagacattaccgaagcggtatggtgggtggccacactccccgcgcatgtgaatattaataccgttgaaatgatgcctgttacccaatccttcgcagggctcagcgtccaccgtagctaa

SEQ ID NO: 94458 - protein, 248 aa, Salmonella typhi
MIVLVTGATAGFGECIARRFVENGHKVIATGRRHERLQALKDELGENVLTAQLDVRNRAAIEEMMASLPAQWRDIDVLVNNAGLALGLEPAHKASVEDWETMIDTNNKGLIYMTRAVLPGMVERNRGHIINIGSTAGSWPYAGGNVYGATKAFVRQFSLNLRTDLHGTAVRVTDIEPGLVGGTEFSSVRFKGDDEKAGKTYENTTALTPEDITEAVWWVATLPAHVNINTVEMMPVTQSFAGLSVHRS

SEQ ID NO: 94459 - DNA, 804 bp, Saccharomyces cerevisiae
  CDS (1)..(804)
atgtcccaaggtagaaaagctgcagaaagattggctaagaagactgtcctcattacaggtgcatctgctggtattggtaaggcgaccgcattagagtacttggaggcatccaatggtgatatgaaactgatcttggctgctagaagattagaaaagctcgaggaattgaagaagaccattgatcaagagtttccaaacgcaaaagttcatgtggcccagctggatatcactcaagcagaaaaaatcaagcccttcattgaaaacttgccacaagagttcaaggatattgacattctggtgaacaatgccggaaaggctcttggcagtgaccgtgtgggccagatcgcaacggaggatatccaggacgtgtttgacaccaacgtcacggctttaatcaatatcacacaagctgtactgcccatattccaagccaagaattcaggagatattgtaaatttgggttcaatcgctggcagagacgcatacccaacaggttctatctattgtgcctctaagtttgccgtgggggcgttcactgatagtttgagaaaggagctcatcaacactaaaattagagtcattctaattgcaccagggctagtcgagactgaattttcactagttagatacagaggtaacgaggaacaagccaagaatgtttacaaggatactaccccattgatggctgatgacgtggctgatctgatcgtctatgcaacttccagaaaacaaaatactgtaattgcagacactttaatctttccaacaaaccaagcgtcacctcatcatatcttccgtggataa

SEQ ID NO: 94460 - protein, 267 aa, Saccharomyces cerevisiae
MSQGRKAAERLAKKTVLITGASAGIGKATALEYLEASNGDMKLILAARRLEKLEELKKTIDQEFPNAKVHVAQLDITQAEKIKPFIENLPQEFKDIDILVNNAGKALGSDRVGQIATEDIQDVFDTNVTALINITQAVLPIFQAKNSGDIVNLGSIAGRDAYPTGSIYCASKFAVGAFTDSLRKELINTKIRVILIAPGLVETEFSLVRYRGNEEQAKNVYKDTTPLMADDVADLIVYATSRKQNTVIADTLIFPTNQASPHHIFRG

SEQ ID NO: 94461 - DNA, 717 bp, Bacillus subtilis
  CDS (1)..(717)
atgcaaagtttacaacataaaactgcactaatcacaggcggaggcagaggaattggccgcgctactgctctggcgcttgccaaagaaggcgtgaatatcgggttaattggccggacttccgctaatgtagaaaaagtggctgaagaagtcaaagcgcttggtgtaaaagctgcatttgctgctgcagatgtaaaagatgccgatcaggttaaccaagctgtagctcaagtgaaggaacagctcggtgatatcgatatcctcattaataatgccggcatcagcaaatttggcggtttcttagatctgtcagctgatgagtgggaaaatattattcaagtcaacctaatgggtgtgtaccatgtcactcgcgcggtgcttccggaaatgatcgaacgcaaagccggagacatcattaatatttcatctacagcgggccaaagaggagctgctgtaacaagtgcttacagcgcttctaaatttgccgttctcgggttaacagagtctcttatgcaagaagtgagaaaacataatatcagagtcagcgcgttaacgccgagcactgtcgctagtgatatgtctatcgaattgaacttaacagacggtaatcctgaaaaagttatgcagcctgaggatcttgctgagtacatggtggcacaactgaaattagatcctcgtattttcatcaaaacagcgggattatggtcaacaaatccttaa

SEQ ID NO: 94462 - protein, 238 aa, Bacillus subtilis
MQSLQHKTALITGGGRGIGRATALALAKEGVNIGLIGRTSANVEKVAEEVKALGVKAAFAAADVKDADQVNQAVAQVKEQLGDIDILINNAGISKFGGFLDLSADEWENIIQVNLMGVYHVTRAVLPEMIERKAGDIINISSTAGQRGAAVTSAYSASKFAVLGLTESLMQEVRKHNIRVSALTPSTVASDMSIELNLTDGNPEKVMQPEDLAEYMVAQLKLDPRIFIKTAGLWSTNP

SEQ ID NO: 94463 - DNA, 780 bp, Bacillus subtilis
  CDS (1)..(780): transl_table=11
gtgaaacatatagcgggaaaaaggatttggataaccggcgcttcaggagggcttggagaaagaatcgcatacttatgcgcggctgaaggagcccatgtcctgctgtcggctagacgcgaggatcgtttgatagaaatcaaaaggaaaataaccgaggaatggagcggacagtgtgagatttttcctctggatgtcggccgcctagaggatatcgcccgggtccgcgatcagatcggctcgattgatgtactgattaacaatgcaggcttcggtatatttgaaacggttttagactctacattggatgacatgaaagcgatgtttgatgtgaatgtcttcggcctgatcgcctgtacaaaagcggtgcttccgcaaatgcttgagcaaaaaaagggacatatcatcaatatcgcctctcaagcggggaaaatcgccacaccgaagtctagcctgtattccgcgaccaaacatgccgtgttaggttactcaaacgctttgcggatggagctttcgggaaccggcatttatgtgacaacagtcaacccgggcccgattcagacggactttttttccattgctgataaaggcggggactacgccaaaaatgtcggccgctggatgcttgatcctgatgacgtggcagctcaaattacagctgcaatttttacgaaaaagcgggagatcaatcttccgcgtttaatgaatgccggcactaagctgtatcagctgtttccagctcttgtagaaaagctggcaggacgcgcgctcatgaaaaaataa

SEQ ID NO: 94464 - protein, 259 aa, Bacillus subtilis
MKHIAGKRIWITGASGGLGERIAYLCAAEGAHVLLSARREDRLIEIKRKITEEWSGQCEIFPLDVGRLEDIARVRDQIGSIDVLINNAGFGIFETVLDSTLDDMKAMFDVNVFGLIACTKAVLPQMLEQKKGHIINIASQAGKIATPKSSLYSATKHAVLGYSNALRMELSGTGIYVTTVNPGPIQTDFFSIADKGGDYAKNVGRWMLDPDDVAAQITAAIFTKKREINLPRLMNAGTKLYQLFPALVEKLAGRALMKK

SEQ ID NO: 94465 - DNA, 25 bp, Primer
atgatcgttttagtaactggagcaa

SEQ ID NO: 94466 - DNA, 23 bp, Primer
ttactgacggtggacattcagtc

SEQ ID NO: 94467 - protein, 279 aa, consensus
  MISC_FEATURE (1)..(279): consensus for the disclosure of xaa see table XV
TGAXXGXGXXXAXXXXXXXXXXXXXXXXXXRXXXXLXXXXXXXXXXXXXXXXXXXXXXXXXXXDXXXXXXXXXXXXXXXXXXXXXXDXLXNNAGXXXXXXXXXXXXXXXXXXXXXXXNXXGXXXXXXXXXXXXXXXXXXXXXXXXXXXXXSXXGXXXXXXXXXXXXXXXXYXXXKXXXXXXXXXLXXXXXXXXXXXXXXXXXPGXXXXXXXXXXXXXXXXXXXXXXXXXXXXXXXXXXXXXXXXXXXXXXXXXXXXXXXXXXXXXXXXXXXXXXXXXXA

SEQ ID NO: 94468 - protein, 122 aa, consensus
  MISC_FEATURE (1)..(122): consensus for the disclosure of xaa see table XV
XXGXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXX

SEQ ID NO: 94469 - protein, 59 aa, consensus
  MISC_FEATURE (1)..(59): consensus for the disclosure of xaa see table XV
XXXXXSXXXXXXXXXXXXXXXXXXXXXXXKXXXXXXXXXXXXXXXXXXXXXXXXXXXPX

SEQ ID NO: 94470 - DNA, 351 bp, Escherichia coli; identical to SEQ ID NO: 59829
  CDS (1)..(351)

SEQ ID NO: 94471 - protein, 116 aa, Escherichia coli; identical to SEQ ID NO: 59830

SEQ ID NO: 94472 - DNA, 372 bp, Lactobacillus acidophilus NCFM; identical to SEQ ID NO: 59831
  CDS (1)..(372)

SEQ ID NO: 94473 - protein, 123 aa, Lactobacillus acidophilus NCFM; identical to SEQ ID NO: 59832

SEQ ID NO: 94474 - DNA, 348 bp, Borrelia burgdorferi B31; identical to SEQ ID NO: 59833
  CDS (1)..(348): transl_table=11

SEQ ID NO: 94475 - protein, 115 aa, Borrelia burgdorferi B31; identical to SEQ ID NO: 59834

SEQ ID NO: 94476 - DNA, 333 bp, Bacillus halodurans C-125; identical to SEQ ID NO: 59835
  CDS (1)..(333): transl_table=11

SEQ ID NO: 94477 - protein, 110 aa, Bacillus halodurans C-125; identical to SEQ ID NO: 59836

SEQ ID NO: 94478 - DNA, 330 bp, Bacillus halodurans C-125; identical to SEQ ID NO: 59837
  CDS (1)..(330): transl_table=11

SEQ ID NO: 94479 - protein, 109 aa, Bacillus halodurans C-125; identical to SEQ ID NO: 59838

SEQ ID NO: 94480 - DNA, 351 bp, Lactococcus lactis subsp. lactis Il1403; identical to SEQ ID NO: 59839
  CDS (1)..(351): transl_table=11

SEQ ID NO: 94481 - protein, 116 aa, Lactococcus lactis subsp. lactis Il1403; identical to SEQ ID NO: 59840

SEQ ID NO: 94482 - DNA, 336 bp, Streptococcus pyogenes M1 GAS; identical to SEQ ID NO: 59841
  CDS (1)..(336): transl_table=11

SEQ ID NO: 94483 - protein, 111 aa, Streptococcus pyogenes M1 GAS; identical to SEQ ID NO: 59842

SEQ ID NO: 94484 - DNA, 318 bp, Streptococcus pyogenes M1 GAS; identical to SEQ ID NO: 59843
  CDS (1)..(318): transl_table=11

SEQ ID NO: 94485 - protein, 105 aa, Streptococcus pyogenes M1 GAS; identical to SEQ ID NO: 59844

SEQ ID NO: 94486 - DNA, 321 bp, Streptococcus pyogenes M1 GAS; identical to SEQ ID NO: 59845
  CDS (1)..(321): transl_table=11

SEQ ID NO: 94487 - protein, 106 aa, Streptococcus pyogenes M1 GAS; identical to SEQ ID NO: 59846

SEQ ID NO: 94488 - DNA, 321 bp, Streptococcus pneumoniae TIGR4; identical to SEQ ID NO: 59847
  CDS (1)..(321): transl_table=11

SEQ ID NO: 94489 - protein, 106 aa, Streptococcus pneumoniae TIGR4; identical to SEQ ID NO: 59848

SEQ ID NO: 94490 - DNA, 315 bp, Streptococcus pneumoniae TIGR4; identical to SEQ ID NO: 59849
  CDS (1)..(315): transl_table=11

SEQ ID NO: 94491 - protein, 104 aa, Streptococcus pneumoniae TIGR4; identical to SEQ ID NO: 59850

SEQ ID NO: 94492 - DNA, 345 bp, Streptococcus pneumoniae TIGR4; identical to SEQ ID NO: 59851
  CDS (1)..(345): transl_table=11

SEQ ID NO: 94493 - protein, 114 aa, Streptococcus pneumoniae TIGR4; identical to SEQ ID NO: 59852

SEQ ID NO: 94494 - DNA, 327 bp, Streptococcus pneumoniae TIGR4; identical to SEQ ID NO: 59853
  CDS (1)..(327): transl_table=11

SEQ ID NO: 94495 - protein, 108 aa, Streptococcus pneumoniae TIGR4; identical to SEQ ID NO: 59854

SEQ ID NO: 94496 - DNA, 321 bp, Clostridium acetobutylicum ATCC 824; identical to SEQ ID NO: 59855
  CDS (1)..(321): transl_table=11

SEQ ID NO: 94497 - protein, 106 aa, Clostridium acetobutylicum ATCC 824; identical to SEQ ID NO: 59856

SEQ ID NO: 94498 - DNA, 315 bp, Clostridium acetobutylicum ATCC 824; identical to SEQ ID NO: 59857
  CDS (1)..(315): transl_table=11

SEQ ID NO: 94499 - protein, 104 aa, Clostridium acetobutylicum ATCC 824; identical to SEQ ID NO: 59858

SEQ ID NO: 94500 - DNA, 318 bp, Streptococcus pneumoniae R6; identical to SEQ ID NO: 59859
  CDS (1)..(318): transl_table=11

SEQ ID NO: 94501 - protein, 105 aa, Streptococcus pneumoniae R6; identical to SEQ ID NO: 59860

SEQ ID NO: 94502 - DNA, 333 bp, Bacillus subtilis subsp. subtilis str. 168; identical to SEQ ID NO: 59861
  CDS (1)..(333): transl_table=11

SEQ ID NO: 94503 - protein, 110 aa, Bacillus subtilis subsp. subtilis str. 168; identical to SEQ ID NO: 59862

SEQ ID NO: 94504 - DNA, 348 bp, Salmonella typhimurium LT2; identical to SEQ ID NO: 59863
  CDS (1)..(348): transl_table=11

SEQ ID NO: 94505 - protein, 115 aa, Salmonella typhimurium LT2; identical to SEQ ID NO: 59864

SEQ ID NO: 94506 - DNA, 330 bp, Listeria monocytogenes EGD-e; identical to SEQ ID NO: 59865
  CDS (1)..(330): transl_table=11

SEQ ID NO: 94507 - protein, 109 aa, Listeria monocytogenes EGD-e; identical to SEQ ID NO: 59866

SEQ ID NO: 94508 - DNA, 303 bp, Listeria monocytogenes EGD-e; identical to SEQ ID NO: 59867
  CDS (1)..(303): transl_table=11

SEQ ID NO: 94509 - protein, 100 aa, Listeria monocytogenes EGD-e; identical to SEQ ID NO: 59868

SEQ ID NO: 94510 - DNA, 303 bp, Listeria monocytogenes EGD-e; identical to SEQ ID NO: 59869
  CDS (1)..(303): transl_table=11

SEQ ID NO: 94511 - protein, 100 aa, Listeria monocytogenes EGD-e; identical to SEQ ID NO: 59870

SEQ ID NO: 94512 - DNA, 309 bp, Listeria monocytogenes EGD-e; identical to SEQ ID NO: 59871
  CDS (1)..(309): transl_table=11

SEQ ID NO: 94513 - protein, 102 aa, Listeria monocytogenes EGD-e; identical to SEQ ID NO: 59872

SEQ ID NO: 94514 - DNA, 354 bp, Listeria innocua Clip11262; identical to SEQ ID NO: 59873
  CDS (1)..(354): transl_table=11

SEQ ID NO: 94515 - protein, 117 aa, Listeria innocua Clip11262; identical to SEQ ID NO: 59874

SEQ ID NO: 94516 - DNA, 315 bp, Listeria innocua Clip11262; identical to SEQ ID NO: 59875
  CDS (1)..(315): transl_table=11

SEQ ID NO: 94517 - protein, 104 aa, Listeria innocua Clip11262; identical to SEQ ID NO: 59876

SEQ ID NO: 94518 - DNA, 312 bp, Clostridium perfringens str. 13; identical to SEQ ID NO: 59877
  CDS (1)..(312): transl_table=11

SEQ ID NO: 94519 - protein, 103 aa, Clostridium perfringens str. 13; identical to SEQ ID NO: 59878

SEQ ID NO: 94520 - DNA, 336 bp, Streptococcus pyogenes MGAS8232; identical to SEQ ID NO: 59879
  CDS (1)..(336): transl_table=11

SEQ ID NO: 94521 - protein, 111 aa, Streptococcus pyogenes MGAS8232; identical to SEQ ID NO: 59880

SEQ ID NO: 94522 - DNA, 333 bp, Thermoanaerobacter tengcongensis MB4; identical to SEQ ID NO: 59881
  CDS (1)..(333): transl_table=11

SEQ ID NO: 94523 - protein, 110 aa, Thermoanaerobacter tengcongensis MB4; identical to SEQ ID NO: 59882

SEQ ID NO: 94524 - DNA, 318 bp, Thermoanaerobacter tengcongensis MB4; identical to SEQ ID NO: 59883
  CDS (1)..(318): transl_table=11

SEQ ID NO: 94525 - protein, 105 aa, Thermoanaerobacter tengcongensis MB4; identical to SEQ ID NO: 59884

SEQ ID NO: 94526 - DNA, 348 bp, Yersinia pestis KIM; identical to SEQ ID NO: 59885
  CDS (1)..(348): transl_table=11

SEQ ID NO: 94527 - protein, 115 aa, Yersinia pestis KIM; identical to SEQ ID NO: 59886

SEQ ID NO: 94528 - DNA, 324 bp, Streptococcus agalactiae 2603V/R; identical to SEQ ID NO: 59887
  CDS (1)..(324): transl_table=11

SEQ ID NO: 94529 - protein, 107 aa, Streptococcus agalactiae 2603V/R; identical to SEQ ID NO: 59888

SEQ ID NO: 94530 - DNA, 336 bp, Oceanobacillus iheyensis HTE831; identical to SEQ ID NO: 59889
  CDS (1)..(336): transl_table=11

SEQ ID NO: 94531 - protein, 111 aa, Oceanobacillus iheyensis HTE831; identical to SEQ ID NO: 59890

SEQ ID NO: 94532 - DNA, 312 bp, Oceanobacillus iheyensis HTE831; identical to SEQ ID NO: 59891
  CDS (1)..(312): transl_table=11

SEQ ID NO: 94533 - protein, 103 aa, Oceanobacillus iheyensis HTE831; identical to SEQ ID NO: 59892

SEQ ID NO: 94534 - DNA, 312 bp, Streptococcus mutans UA159; identical to SEQ ID NO: 59893
  CDS (1)..(312): transl_table=11

SEQ ID NO: 94535 - protein, 103 aa, Streptococcus mutans UA159; identical to SEQ ID NO: 59894

SEQ ID NO: 94536 - DNA, 309 bp, Vibrio vulnificus CMCP6; identical to SEQ ID NO: 59895
  CDS (1)..(309): transl_table=11

SEQ ID NO: 94537 - protein, 102 aa, Vibrio vulnificus CMCP6; identical to SEQ ID NO: 59896

SEQ ID NO: 94538 - DNA, 315 bp, Staphylococcus epidermidis ATCC 12228; identical to SEQ ID NO: 59897
  CDS (1)..(315): transl_table=11

SEQ ID NO: 94539 - protein, 104 aa, Staphylococcus epidermidis ATCC 12228; identical to SEQ ID NO: 59898

SEQ ID NO: 94540 - DNA, 339 bp, Lactobacillus plantarum WCFS1; identical to SEQ ID NO: 59899
  CDS (1)..(339): transl_table=11

SEQ ID NO: 94541 - protein, 112 aa, Lactobacillus plantarum WCFS1; identical to SEQ ID NO: 59900

SEQ ID NO: 94542 - DNA, 348 bp, Lactobacillus plantarum WCFS1; identical to SEQ ID NO: 59901
  CDS (1)..(348): transl_table=11

SEQ ID NO: 94543 - protein, 115 aa, Lactobacillus plantarum WCFS1; identical to SEQ ID NO: 59902

SEQ ID NO: 94544 - DNA, 312 bp, Vibrio parahaemolyticus RIMD 2210633; identical to SEQ ID NO: 59903
  CDS (1)..(312): transl_table=11

SEQ ID NO: 94545 - protein, 103 aa, Vibrio parahaemolyticus RIMD 2210633; identical to SEQ ID NO: 59904

SEQ ID NO: 94546 - DNA, 336 bp, Streptococcus pyogenes SSI-1; identical to SEQ ID NO: 59905
  CDS (1)..(336): transl_table=11

SEQ ID NO: 94547 - protein, 111 aa, Streptococcus pyogenes SSI-1; identical to SEQ ID NO: 59906

SEQ ID NO: 94548 - DNA, 321 bp, Enterococcus faecalis V583; identical to SEQ ID NO: 59907
  CDS (1)..(321): transl_table=11

SEQ ID NO: 94549 - protein, 106 aa, Enterococcus faecalis V583; identical to SEQ ID NO: 59908

SEQ ID NO: 94550 - DNA, 324 bp, Bacillus cereus ATCC 14579; identical to SEQ ID NO: 59909
  CDS (1)..(324): transl_table=11

SEQ ID NO: 94551 - protein, 107 aa, Bacillus cereus ATCC 14579; identical to SEQ ID NO: 59910

SEQ ID NO: 94552 - DNA, 318 bp, Bacillus cereus ATCC 14579; identical to SEQ ID NO: 59911
  CDS (1)..(318): transl_table=11

SEQ ID NO: 94553 - protein, 105 aa, Bacillus cereus ATCC 14579; identical to SEQ ID NO: 59912

SEQ ID NO: 94554 - DNA, 360 bp, Photorhabdus luminescens subsp. laumondii TTO1; identical to SEQ ID NO: 59913
  CDS (1)..(360): transl_table=11

SEQ ID NO: 94555 - protein, 119 aa, Photorhabdus luminescens subsp. laumondii TTO1; identical to SEQ ID NO: 59914

SEQ ID NO: 94556 - DNA, 327 bp, Lactobacillus johnsonii NCC 533; identical to SEQ ID NO: 59915
  CDS (1)..(327): transl_table=11

SEQ ID NO: 94557 - protein, 108 aa, Lactobacillus johnsonii NCC 533; identical to SEQ ID NO: 59916

SEQ ID NO: 94558 - DNA, 321 bp, Bacillus cereus ATCC 10987; identical to SEQ ID NO: 59917
  CDS (1)..(321): transl_table=11

SEQ ID NO: 94559 - protein, 106 aa, Bacillus cereus ATCC 10987; identical to SEQ ID NO: 59918

SEQ ID NO: 94560 - DNA, 351 bp, Listeria monocytogenes str. 4b F2365; identical to SEQ ID NO: 59919
  CDS (1)..(351): transl_table=11

SEQ ID NO: 94561 - protein, 116 aa, Listeria monocytogenes str. 4b F2365; identical to SEQ ID NO: 59920

SEQ ID NO: 94562 - DNA, 351 bp, Listeria monocytogenes str. 4b F2365; identical to SEQ ID NO: 59921
  CDS (1)..(351): transl_table=11

SEQ ID NO: 94563 - protein, 116 aa, Listeria monocytogenes str. 4b F2365; identical to SEQ ID NO: 59922

SEQ ID NO: 94564 - DNA, 309 bp, Listeria monocytogenes str. 4b F2365; identical to SEQ ID NO: 59923
  CDS (1)..(309): transl_table=11

SEQ ID NO: 94565 - protein, 102 aa, Listeria monocytogenes str. 4b F2365; identical to SEQ ID NO: 59924

SEQ ID NO: 94566 - DNA, 309 bp, Listeria monocytogenes str. 4b F2365; identical to SEQ ID NO: 59925
  CDS (1)..(309): transl_table=11

SEQ ID NO: 94567 - protein, 102 aa, Listeria monocytogenes str. 4b F2365; identical to SEQ ID NO: 59926

SEQ ID NO: 94568 - DNA, 321 bp, Bacillus thuringiensis serovar konkukian str. 97-27; identical to SEQ ID NO: 59927
  CDS (1)..(321): transl_table=11

SEQ ID NO: 94569 - protein, 106 aa, Bacillus thuringiensis serovar konkukian str. 97-27; identical to SEQ ID NO: 59928

SEQ ID NO: 94570 - DNA, 309 bp, Erwinia carotovora subsp. atroseptica SCRI1043; identical to SEQ ID NO: 59929
  CDS (1)..(309)

SEQ ID NO: 94571 - protein, 102 aa, Erwinia carotovora subsp. atroseptica SCRI1043; identical to SEQ ID NO: 59930

SEQ ID NO: 94572 - DNA, 324 bp, Erwinia carotovora subsp. atroseptica SCRI1043; identical to SEQ ID NO: 59931
  CDS (1)..(324)

SEQ ID NO: 94573 - protein, 107 aa, Erwinia carotovora subsp. atroseptica SCRI1043; identical to SEQ ID NO: 59932

SEQ ID NO: 94574 - DNA, 345 bp, Erwinia carotovora subsp. atroseptica SCRI1043; identical to SEQ ID NO: 59933
  CDS (1)..(345)

SEQ ID NO: 94575 - protein, 114 aa, Erwinia carotovora subsp. atroseptica SCRI1043; identical to SEQ ID NO: 59934

SEQ ID NO: 94576 - DNA, 348 bp, Erwinia carotovora subsp. atroseptica SCRI1043; identical to SEQ ID NO: 59935
  CDS (1)..(348)

SEQ ID NO: 94577 - protein, 115 aa, Erwinia carotovora subsp. atroseptica SCRI1043; identical to SEQ ID NO: 59936

SEQ ID NO: 94578 - DNA, 321 bp, Propionibacterium acnes KPA171202; identical to SEQ ID NO: 59937
  CDS (1)..(321): transl_table=11

SEQ ID NO: 94579 - protein, 106 aa, Propionibacterium acnes KPA171202; identical to SEQ ID NO: 59938

SEQ ID NO: 94580 - DNA, 348 bp, Borrelia garinii PBi; identical to SEQ ID NO: 59939
  CDS (1)..(348): transl_table=11

SEQ ID NO: 94581 - protein, 115 aa, Borrelia garinii PBi; identical to SEQ ID NO: 59940

SEQ ID NO: 94582 - DNA, 348 bp, Symbiobacterium thermophilum IAM 14863; identical to SEQ ID NO: 59941
  CDS (1)..(348): transl_table=11

SEQ ID NO: 94583 - protein, 115 aa, Symbiobacterium thermophilum IAM 14863; identical to SEQ ID NO: 59942

SEQ ID NO: 94584 - DNA, 342 bp, Bacillus licheniformis ATCC 14580; identical to SEQ ID NO: 59943
  CDS (1)..(342): transl_table=11

SEQ ID NO: 94585 - protein, 113 aa, Bacillus licheniformis ATCC 14580; identical to SEQ ID NO: 59944

SEQ ID NO: 94586 - DNA, 324 bp, Bacillus cereus ZK; identical to SEQ ID NO: 59945
  CDS (1)..(324): transl_table=11

SEQ ID NO: 94587 - protein, 107 aa, Bacillus cereus ZK; identical to SEQ ID NO: 59946

SEQ ID NO: 94588 - DNA, 333 bp, Bacillus licheniformis ATCC 14580; identical to SEQ ID NO: 59947
  CDS (1)..(333): transl_table=11

SEQ ID NO: 94589 - protein, 110 aa, Bacillus licheniformis ATCC 14580; identical to SEQ ID NO: 59948

SEQ ID NO: 94590 - DNA, 330 bp, Bacillus licheniformis ATCC 14580; identical to SEQ ID NO: 59949
  CDS (1)..(330): transl_table=11

SEQ ID NO: 94591 - protein, 109 aa, Bacillus licheniformis ATCC 14580; identical to SEQ ID NO: 59950

SEQ ID NO: 94592 - DNA, 339 bp, Photobacterium profundum SS9; identical to SEQ ID NO: 59951
  CDS (1)..(339): transl_table=11

SEQ ID NO: 94593 - protein, 112 aa, Photobacterium profundum SS9; identical to SEQ ID NO: 59952

SEQ ID NO: 94594 - DNA, 312 bp, Photobacterium profundum SS9; identical to SEQ ID NO: 59953
  CDS (1)..(312): transl_table=11

SEQ ID NO: 94595 - protein, 103 aa, Photobacterium profundum SS9; identical to SEQ ID NO: 59954

SEQ ID NO: 94596 - DNA, 333 bp, Geobacillus kaustophilus HTA426; identical to SEQ ID NO: 59955
  CDS (1)..(333): transl_table=11

SEQ ID NO: 94597 - protein, 110 aa, Geobacillus kaustophilus HTA426; identical to SEQ ID NO: 59956

SEQ ID NO: 94598 - DNA, 336 bp, Bacillus clausii KSM-K16; identical to SEQ ID NO: 59957
  CDS (1)..(336): transl_table=11

SEQ ID NO: 94599 - protein, 111 aa, Bacillus clausii KSM-K16; identical to SEQ ID NO: 59958

SEQ ID NO: 94600 - DNA, 357 bp, Lactobacillus gasseri; identical to SEQ ID NO: 59959
  CDS (1)..(357)

SEQ ID NO: 94601 - protein, 118 aa, Lactobacillus gasseri; identical to SEQ ID NO: 59960

SEQ ID NO: 94602 - DNA, 360 bp, Lactobacillus gasseri; identical to SEQ ID NO: 59961
  CDS (1)..(360)

SEQ ID NO: 94603 - protein, 119 aa, Lactobacillus gasseri; identical to SEQ ID NO: 59962

SEQ ID NO: 94604 - DNA, 336 bp, Leuconostoc mesenteroides subsp. mesenteroides ATCC 8293; identical to SEQ ID NO: 59963
  CDS (1)..(336)

SEQ ID NO: 94605 - protein, 111 aa, Leuconostoc mesenteroides subsp. mesenteroides ATCC 8293; identical to SEQ ID NO: 59964

SEQ ID NO: 94606 - DNA, 360 bp, Leuconostoc mesenteroides subsp. mesenteroides ATCC 8293; identical to SEQ ID NO: 59965
  CDS (1)..(360)

SEQ ID NO: 94607 - protein, 119 aa, Leuconostoc mesenteroides subsp. mesenteroides ATCC 8293; identical to SEQ ID NO: 59966

SEQ ID NO: 94608 - DNA, 309 bp, Haemophilus somnus 2336; identical to SEQ ID NO: 59967
  CDS (1)..(309)

SEQ ID NO: 94609 - protein, 102 aa, Haemophilus somnus 2336; identical to SEQ ID NO: 59968

SEQ ID NO: 94610 - DNA, 315 bp, Listeria monocytogenes str. 1/2a F6854; identical to SEQ ID NO: 59969
  CDS (1)..(315): transl_table=11

SEQ ID NO: 94611 - protein, 104 aa, Listeria monocytogenes str. 1/2a F6854; identical to SEQ ID NO: 59970

SEQ ID NO: 94612 - DNA, 321 bp, Bacillus cereus G9241; identical to SEQ ID NO: 59971
  CDS (1)..(321): transl_table=11

SEQ ID NO: 94613 - protein, 106 aa, Bacillus cereus G9241; identical to SEQ ID NO: 59972

SEQ ID NO: 94614 - DNA, 324 bp, Bacillus cereus G9241; identical to SEQ ID NO: 59973
  CDS (1)..(324): transl_table=11

SEQ ID NO: 94615 - protein, 107 aa, Bacillus cereus G9241; identical to SEQ ID NO: 59974

SEQ ID NO: 94616 - DNA, 333 bp, Enterococcus faecium; identical to SEQ ID NO: 59975
  CDS (1)..(333)

SEQ ID NO: 94617 - protein, 110 aa, Enterococcus faecium; identical to SEQ ID NO: 59976

SEQ ID NO: 94618 - DNA, 318 bp, Enterococcus faecium; identical to SEQ ID NO: 59977
  CDS (1)..(318)

SEQ ID NO: 94619 - protein, 105 aa, Enterococcus faecium; identical to SEQ ID NO: 59978

SEQ ID NO: 94620 - DNA, 441 bp, Enterococcus faecium; identical to SEQ ID NO: 59979
  CDS (121)..(441)

SEQ ID NO: 94621 - protein, 106 aa, Enterococcus faecium; identical to SEQ ID NO: 59980

SEQ ID NO: 94622 - DNA, 327 bp, Enterococcus faecium; identical to SEQ ID NO: 59981
  CDS (1)..(327)

SEQ ID NO: 94623 - protein, 108 aa, Enterococcus faecium; identical to SEQ ID NO: 59982

SEQ ID NO: 94624 - DNA, 312 bp, Enterococcus faecium; identical to SEQ ID NO: 59983
  CDS (1)..(312)

SEQ ID NO: 94625 - protein, 103 aa, Enterococcus faecium; identical to SEQ ID NO: 59984

SEQ ID NO: 94626 - DNA, 336 bp, Oenococcus oeni PSU-1; identical to SEQ ID NO: 59985
  CDS (1)..(336)

SEQ ID NO: 94627 - protein, 111 aa, Oenococcus oeni PSU-1; identical to SEQ ID NO: 59986

SEQ ID NO: 94628 - DNA, 324 bp, Oenococcus oeni PSU-1; identical to SEQ ID NO: 59987
  CDS (1)..(324)

SEQ ID NO: 94629 - protein, 107 aa, Oenococcus oeni PSU-1; identical to SEQ ID NO: 59988

SEQ ID NO: 94630 - DNA, 351 bp, Pediococcus pentosaceus ATCC 25745; identical to SEQ ID NO: 59989
  CDS (1)..(351)

SEQ ID NO: 94631 - protein, 116 aa, Pediococcus pentosaceus ATCC 25745; identical to SEQ ID NO: 59990

SEQ ID NO: 94632 - DNA, 324 bp, Pediococcus pentosaceus ATCC 25745; identical to SEQ ID NO: 59991
  CDS (1)..(324)

SEQ ID NO: 94633 - protein, 107 aa, Pediococcus pentosaceus ATCC 25745; identical to SEQ ID NO: 59992

SEQ ID NO: 94634 - DNA, 315 bp, Streptococcus suis 89/1591; identical to SEQ ID NO: 59993
  CDS (1)..(315)

SEQ ID NO: 94635 - protein, 104 aa, Streptococcus suis 89/1591; identical to SEQ ID NO: 59994

SEQ ID NO: 94636 - DNA, 315 bp, Streptococcus suis 89/1591; identical to SEQ ID NO: 59995
  CDS (1)..(315)

SEQ ID NO: 94637 - protein, 104 aa, Streptococcus suis 89/1591; identical to SEQ ID NO: 59996

SEQ ID NO: 94638 - DNA, 324 bp, Streptococcus suis 89/1591; identical to SEQ ID NO: 59997
  CDS (1)..(324)

SEQ ID NO: 94639 - protein, 107 aa, Streptococcus suis 89/1591; identical to SEQ ID NO: 59998

SEQ ID NO: 94640 - DNA, 318 bp, Streptococcus suis 89/1591; identical to SEQ ID NO: 59999
  CDS (1)..(318)

SEQ ID NO: 94641 - protein, 105 aa, Streptococcus suis 89/1591; identical to SEQ ID NO: 60000

SEQ ID NO: 94642 - DNA, 336 bp, Streptococcus pyogenes M49 591; identical to SEQ ID NO: 60001
  CDS (1)..(336)

SEQ ID NO: 94643 - protein, 111 aa, Streptococcus pyogenes M49 591; identical to SEQ ID NO: 60002

SEQ ID NO: 94644 - DNA, 327 bp, Pectobacterium carotovorum; identical to SEQ ID NO: 60003
  CDS (1)..(327): transl_table=11

SEQ ID NO: 94645 - protein, 108 aa, Pectobacterium carotovorum; identical to SEQ ID NO: 60004

SEQ ID NO: 94646 - DNA, 333 bp, Bacillus pumilus; identical to SEQ ID NO: 60005
  CDS (1)..(333): transl_table=11

SEQ ID NO: 94647 - protein, 110 aa, Bacillus pumilus; identical to SEQ ID NO: 60006

SEQ ID NO: 94648 - DNA, 327 bp, Bacillus stearothermophilus; identical to SEQ ID NO: 60007
  CDS (1)..(327): transl_table=11

SEQ ID NO: 94649 - protein, 108 aa, Bacillus stearothermophilus; identical to SEQ ID NO: 60008

SEQ ID NO: 94650 - DNA, 333 bp, Bacillus subtilis; identical to SEQ ID NO: 60009
  CDS (1)..(333): transl_table=11

SEQ ID NO: 94651 - protein, 110 aa, Bacillus subtilis; identical to SEQ ID NO: 60010

SEQ ID NO: 94652 - DNA, 339 bp, Lactobacillus casei; identical to SEQ ID NO: 60011
  CDS (1)..(339): transl_table=11

SEQ ID NO: 94653 - protein, 112 aa, Lactobacillus casei; identical to SEQ ID NO: 60012

SEQ ID NO: 94654 - DNA, 318 bp, Lactococcus lactis; identical to SEQ ID NO: 60013
  CDS (1)..(318): transl_table=11

SEQ ID NO: 94655 - protein, 105 aa, Lactococcus lactis; identical to SEQ ID NO: 60014

SEQ ID NO: 94656 - DNA, 312 bp, Staphylococcus aureus; identical to SEQ ID NO: 60015
  CDS (1)..(312): transl_table=11

SEQ ID NO: 94657 - protein, 103 aa, Staphylococcus aureus; identical to SEQ ID NO: 60016

SEQ ID NO: 94658 - DNA, 315 bp, Streptococcus mutans; identical to SEQ ID NO: 60017
  CDS (1)..(315): transl_table=11

SEQ ID NO: 94659 - protein, 104 aa, Streptococcus mutans; identical to SEQ ID NO: 60018

SEQ ID NO: 94660 - DNA, 24 bp, Primer
atgatggatctcgataacattccc

SEQ ID NO: 94661 - DNA, 25 bp, Primer
ttatgccttcagtttttcatgaagc

SEQ ID NO: 94662 - protein, 68 aa, consensus; identical to SEQ ID NO: 60021
  MISC_FEATURE (1)..(68): consensus for the disclosure of xaa see table XV

SEQ ID NO: 94663 - protein, 88 aa, consensus; identical to SEQ ID NO: 60022
  MISC_FEATURE (1)..(88): consensus for the disclosure of xaa see table XV

SEQ ID NO: 94664 - DNA, 1419 bp, Escherichia coli; identical to SEQ ID NO: 87878
  CDS (1)..(1419)

SEQ ID NO: 94665 - protein, 472 aa, Escherichia coli; identical to SEQ ID NO: 87879

SEQ ID NO: 94666 - DNA, 1428 bp, Salmonella typhi; identical to SEQ ID NO: 87880
  CDS (1)..(1428): transl_table=11

SEQ ID NO: 94667 - protein, 475 aa, Salmonella typhi; identical to SEQ ID NO: 87881

SEQ ID NO: 94668 - DNA, 1158 bp, Streptococcus pneumoniae bacteriophage MM1; identical to SEQ ID NO: 87882
  CDS (1)..(1158): transl_table=11

SEQ ID NO: 94669 - protein, 385 aa, Streptococcus pneumoniae bacteriophage MM1; identical to SEQ ID NO: 87883

SEQ ID NO: 94670 - DNA, 1068 bp, Helicobacter pylori 26695; identical to SEQ ID NO: 87884
  CDS (1)..(1068): transl_table=11

SEQ ID NO: 94671 - protein, 355 aa, Helicobacter pylori 26695; identical to SEQ ID NO: 87885

SEQ ID NO: 94672 - DNA, 981 bp, Bacillus halodurans C-125; identical to SEQ ID NO: 87886
  CDS (1)..(981): transl_table=11

SEQ ID NO: 94673 - protein, 326 aa, Bacillus halodurans C-125; identical to SEQ ID NO: 87887

SEQ ID NO: 94674 - DNA, 1014 bp, Neisseria meningitidis MC58; identical to SEQ ID NO: 87888
  CDS (1)..(1014): transl_table=11

SEQ ID NO: 94675 - protein, 337 aa, Neisseria meningitidis MC58; identical to SEQ ID NO: 87889

SEQ ID NO: 94676 - DNA, 1236 bp, Neisseria meningitidis Z2491; identical to SEQ ID NO: 87890
  CDS (1)..(1236): transl_table=11

SEQ ID NO: 94677 - protein, 411 aa, Neisseria meningitidis Z2491; identical to SEQ ID NO: 87891

SEQ ID NO: 94678 - DNA, 978 bp, Sulfolobus solfataricus P2; identical to SEQ ID NO: 87892
  CDS (1)..(978): transl_table=11

SEQ ID NO: 94679 - protein, 325 aa, Sulfolobus solfataricus P2; identical to SEQ ID NO: 87893

SEQ ID NO: 94680 - DNA, 1224 bp, Streptococcus pneumoniae TIGR4; identical to SEQ ID NO: 87894
  CDS (1)..(1224): transl_table=11

SEQ ID NO: 94681 - protein, 407 aa, Streptococcus pneumoniae TIGR4; identical to SEQ ID NO: 87895

SEQ ID NO: 94682 - DNA, 945 bp, Clostridium acetobutylicum ATCC 824; identical to SEQ ID NO: 87896
  CDS (1)..(945): transl_table=11

SEQ ID NO: 94683 - protein, 314 aa, Clostridium acetobutylicum ATCC 824; identical to SEQ ID NO: 87897

SEQ ID NO: 94684 - DNA, 1248 bp, Clostridium acetobutylicum ATCC 824; identical to SEQ ID NO: 87898
  CDS (1)..(1248): transl_table=11

SEQ ID NO: 94685 - protein, 415 aa, Clostridium acetobutylicum ATCC 824; identical to SEQ ID NO: 87899

SEQ ID NO: 94686 - DNA, 1125 bp, Caulobacter crescentus CB15; identical to SEQ ID NO: 87900
  CDS (1)..(1125): transl_table=11

SEQ ID NO: 94687 - protein, 374 aa, Caulobacter crescentus CB15; identical to SEQ ID NO: 87901

SEQ ID NO: 94688 - DNA, 945 bp, Pyrobaculum aerophilum str. IM2; identical to SEQ ID NO: 87902
  CDS (1)..(945): transl_table=11

SEQ ID NO: 94689 - protein, 314 aa, Pyrobaculum aerophilum str. IM2; identical to SEQ ID NO: 87903

SEQ ID NO: 94690 - DNA, 1272 bp, Methanosarcina mazei Go1; identical to SEQ ID NO: 87904
  CDS (1)..(1272): transl_table=11

SEQ ID NO: 94691 - protein, 423 aa, Methanosarcina mazei Go1; identical to SEQ ID NO: 87905

SEQ ID NO: 94692 - DNA, 1113 bp, Oceanobacillus iheyensis HTE831; identical to SEQ ID NO: 87906
  CDS (1)..(1113): transl_table=11

SEQ ID NO: 94693 - protein, 370 aa, Oceanobacillus iheyensis HTE831; identical to SEQ ID NO: 87907

SEQ ID NO: 94694 - DNA, 1353 bp, Streptococcus agalactiae NEM316; identical to SEQ ID NO: 87908
  CDS (1)..(1353): transl_table=11

SEQ ID NO: 94695 - protein, 450 aa, Streptococcus agalactiae NEM316; identical to SEQ ID NO: 87909

SEQ ID NO: 94696 - DNA, 1431 bp, Salmonella enterica subsp. enterica serovar Typhi Ty2; identical to SEQ ID NO: 87910
  CDS (1)..(1431): transl_table=11

SEQ ID NO: 94697 - protein, 476 aa, Salmonella enterica subsp. enterica serovar Typhi Ty2; identical to SEQ ID NO: 87911

SEQ ID NO: 94698 - DNA, 1437 bp, Photorhabdus luminescens subsp. laumondii TTO1; identical to SEQ ID NO: 87912
  CDS (1)..(1437): transl_table=11

SEQ ID NO: 94699 - protein, 478 aa, Photorhabdus luminescens subsp. laumondii TTO1; identical to SEQ ID NO: 87913

SEQ ID NO: 94700 - DNA, 1428 bp, Serratia marcescens; identical to SEQ ID NO: 87914
  CDS (1)..(1428): transl_table=11

SEQ ID NO: 94701 - protein, 475 aa, Serratia marcescens; identical to SEQ ID NO: 87915

SEQ ID NO: 94702 - DNA, 1077 bp, Desulfovibrio vulgaris subsp. vulgaris str. Hildenborough; identical to SEQ ID NO: 87916
  CDS (1)..(1077): transl_table=11

SEQ ID NO: 94703 - protein, 358 aa, Desulfovibrio vulgaris subsp. vulgaris str. Hildenborough; identical to SEQ ID NO: 87917

SEQ ID NO: 94704 - DNA, 1122 bp, Bacillus thuringiensis serovar konkukian str. 97-27; identical to SEQ ID NO: 87918
  CDS (1)..(1122): transl_table=11

SEQ ID NO: 94705 - protein, 373 aa, Bacillus thuringiensis serovar konkukian str. 97-27; identical to SEQ ID NO: 87919

SEQ ID NO: 94706 - DNA, 1227 bp, Streptococcus pyogenes MGAS10394; identical to SEQ ID NO: 87920
  CDS (1)..(1227): transl_table=11

SEQ ID NO: 94707 - protein, 408 aa, Streptococcus pyogenes MGAS10394; identical to SEQ ID NO: 87921

SEQ ID NO: 94708 - DNA, 1251 bp, Legionella pneumophila subsp. pneumophila str. Philadelphia 1; identical to SEQ ID NO: 87922
  CDS (1)..(1251): transl_table=11

SEQ ID NO: 94709 - protein, 416 aa, Legionella pneumophila subsp. pneumophila str. Philadelphia 1; identical to SEQ ID NO: 87923

SEQ ID NO: 94710 - DNA, 1296 bp, Bacteroides fragilis YCH46; identical to SEQ ID NO: 87924
  CDS (1)..(1296): transl_table=11

SEQ ID NO: 94711 - protein, 431 aa, Bacteroides fragilis YCH46; identical to SEQ ID NO: 87925

SEQ ID NO: 94712 - DNA, 1251 bp, Mycoplasma hyopneumoniae 232; identical to SEQ ID NO: 87926
  CDS (1)..(1251): transl_table=4

SEQ ID NO: 94713 - protein, 416 aa, Mycoplasma hyopneumoniae 232; identical to SEQ ID NO: 87927

SEQ ID NO: 94714 - DNA, 963 bp, Legionella pneumophila str. Paris; identical to SEQ ID NO: 87928
  CDS (1)..(963): transl_table=11

SEQ ID NO: 94715 - protein, 320 aa, Legionella pneumophila str. Paris; identical to SEQ ID NO: 87929

SEQ ID NO: 94716 - DNA, 1254 bp, Legionella pneumophila str. Lens; identical to SEQ ID NO: 87930
  CDS (1)..(1254): transl_table=11

SEQ ID NO: 94717 - protein, 417 aa, Legionella pneumophila str. Lens; identical to SEQ ID NO: 87931

SEQ ID NO: 94718 - DNA, 1260 bp, Idiomarina loihiensis L2TR; identical to SEQ ID NO: 87932
  CDS (1)..(1260): transl_table=11

SEQ ID NO: 94719 - protein, 419 aa, Idiomarina loihiensis L2TR; identical to SEQ ID NO: 87933

SEQ ID NO: 94720 - DNA, 1275 bp, Synechococcus elongatus PCC 6301; identical to SEQ ID NO: 87934
  CDS (1)..(1275): transl_table=11

SEQ ID NO: 94721 - protein, 424 aa, Synechococcus elongatus PCC 6301; identical to SEQ ID NO: 87935

SEQ ID NO: 94722 - DNA, 1125 bp, Neisseria gonorrhoeae FA 1090; identical to SEQ ID NO: 87936
  CDS (1)..(1125): transl_table=11

SEQ ID NO: 94723 - protein, 374 aa, Neisseria gonorrhoeae FA 1090; identical to SEQ ID NO: 87937

SEQ ID NO: 94724 - DNA, 1026 bp, Neisseria gonorrhoeae FA 1090; identical to SEQ ID NO: 87938
  CDS (1)..(1026): transl_table=11

SEQ ID NO: 94725 - protein, 341 aa, Neisseria gonorrhoeae FA 1090; identical to SEQ ID NO: 87939

SEQ ID NO: 94726 - DNA, 948 bp, Neisseria gonorrhoeae FA 1090; identical to SEQ ID NO: 87940
  CDS (1)..(948): transl_table=11

SEQ ID NO: 94727 - protein, 315 aa, Neisseria gonorrhoeae FA 1090; identical to SEQ ID NO: 87941

SEQ ID NO: 94728 - DNA, 996 bp, Nostoc punctiforme PCC 73102; identical to SEQ ID NO: 87942
  CDS (1)..(996)

SEQ ID NO: 94729 - protein, 331 aa, Nostoc punctiforme PCC 73102; identical to SEQ ID NO: 87943

SEQ ID NO: 94730 - DNA, 948 bp, Bifidobacterium longum DJO10A; identical to SEQ ID NO: 87944
  CDS (1)..(948)

SEQ ID NO: 94731 - protein, 315 aa, Bifidobacterium longum DJO10A; identical to SEQ ID NO: 87945

SEQ ID NO: 94732 - DNA, 1227 bp, Haemophilus somnus 2336; identical to SEQ ID NO: 87946
  CDS (1)..(1227)

SEQ ID NO: 94733 - protein, 408 aa, Haemophilus somnus 2336; identical to SEQ ID NO: 87947

SEQ ID NO: 94734 - DNA, 1188 bp, Haemophilus influenzae R2846; identical to SEQ ID NO: 87948
  CDS (1)..(1188)

SEQ ID NO: 94735 - protein, 395 aa, Haemophilus influenzae R2846; identical to SEQ ID NO: 87949

SEQ ID NO: 94736 - DNA, 1308 bp, Crocosphaera watsonii WH 8501; identical to SEQ ID NO: 87950
  CDS (1)..(1308)

SEQ ID NO: 94737 - protein, 435 aa, Crocosphaera watsonii WH 8501; identical to SEQ ID NO: 87951

SEQ ID NO: 94738 - DNA, 1263 bp, Crocosphaera watsonii WH 8501; identical to SEQ ID NO: 87952
  CDS (1)..(1263)

SEQ ID NO: 94739 - protein, 420 aa, Crocosphaera watsonii WH 8501; identical to SEQ ID NO: 87953

SEQ ID NO: 94740 - DNA, 1020 bp, Crocosphaera watsonii WH 8501; identical to SEQ ID NO: 87954
  CDS (1)..(1020)

SEQ ID NO: 94741 - protein, 339 aa, Crocosphaera watsonii WH 8501; identical to SEQ ID NO: 87955

SEQ ID NO: 94742 - DNA, 1119 bp, Haemophilus somnus 2336; identical to SEQ ID NO: 87956
  CDS (1)..(1119)

SEQ ID NO: 94743 - protein, 372 aa, Haemophilus somnus 2336; identical to SEQ ID NO: 87957

SEQ ID NO: 94744 - DNA, 1155 bp, Burkholderia cepacia R1808; identical to SEQ ID NO: 87958
  CDS (1)..(1155)

SEQ ID NO: 94745 - protein, 384 aa, Burkholderia cepacia R1808; identical to SEQ ID NO: 87959

SEQ ID NO: 94746 - DNA, 1422 bp, Rubrivivax gelatinosus PM1; identical to SEQ ID NO: 87960
  CDS (1)..(1422)

SEQ ID NO: 94747 - protein, 473 aa, Rubrivivax gelatinosus PM1; identical to SEQ ID NO: 87961

SEQ ID NO: 94748 - DNA, 1128 bp, Burkholderia fungorum LB400; identical to SEQ ID NO: 87962
  CDS (1)..(1128)

SEQ ID NO: 94749 - protein, 375 aa, Burkholderia fungorum LB400; identical to SEQ ID NO: 87963

SEQ ID NO: 94750 - DNA, 1143 bp, Enterococcus faecium; identical to SEQ ID NO: 87964
  CDS (1)..(1143)

SEQ ID NO: 94751 - protein, 380 aa, Enterococcus faecium; identical to SEQ ID NO: 87965

SEQ ID NO: 94752 - DNA, 1161 bp, Ferroplasma acidarmanus; identical to SEQ ID NO: 87966
  CDS (1)..(1161)

SEQ ID NO: 94753 - protein, 386 aa, Ferroplasma acidarmanus; identical to SEQ ID NO: 87967

SEQ ID NO: 94754 - DNA, 1005 bp, Clostridium thermocellum ATCC 27405; identical to SEQ ID NO: 87968
  CDS (1)..(1005)

SEQ ID NO: 94755 - protein, 334 aa, Clostridium thermocellum ATCC 27405; identical to SEQ ID NO: 87969

SEQ ID NO: 94756 - DNA, 1452 bp, Clostridium thermocellum ATCC 27405; identical to SEQ ID NO: 87970
  CDS (1)..(1452)

SEQ ID NO: 94757 - protein, 483 aa, Clostridium thermocellum ATCC 27405; identical to SEQ ID NO: 87971

SEQ ID NO: 94758 - DNA, 1266 bp, Trichodesmium erythraeum IMS101; identical to SEQ ID NO: 87972
  CDS (1)..(1266)

SEQ ID NO: 94759 - protein, 421 aa, Trichodesmium erythraeum IMS101; identical to SEQ ID NO: 87973

SEQ ID NO: 94760 - DNA, 1014 bp, Trichodesmium erythraeum IMS101; identical to SEQ ID NO: 87974
  CDS (1)..(1014)

SEQ ID NO: 94761 - protein, 337 aa, Trichodesmium erythraeum IMS101; identical to SEQ ID NO: 87975

SEQ ID NO: 94762 - DNA, 957 bp, Xylella fastidiosa Dixon; identical to SEQ ID NO: 87976
  CDS (1)..(957)

SEQ ID NO: 94763 - protein, 318 aa, Xylella fastidiosa Dixon; identical to SEQ ID NO: 87977

SEQ ID NO: 94764 - DNA, 981 bp, Campylobacter upsaliensis RM3195; identical to SEQ ID NO: 87978
  CDS (1)..(981): transl_table=11

SEQ ID NO: 94765 - protein, 326 aa, Campylobacter upsaliensis RM3195; identical to SEQ ID NO: 87979

SEQ ID NO: 94766 - DNA, 948 bp, Campylobacter upsaliensis RM3195; identical to SEQ ID NO: 87980
  CDS (1)..(948): transl_table=11

SEQ ID NO: 94767 - protein, 315 aa, Campylobacter upsaliensis RM3195; identical to SEQ ID NO: 87981

SEQ ID NO: 94768 - DNA, 1032 bp, Flavobacterium aquatile; identical to SEQ ID NO: 87982
  CDS (1)..(1032): transl_table=11

SEQ ID NO: 94769 - protein, 343 aa, Flavobacterium aquatile; identical to SEQ ID NO: 87983

SEQ ID NO: 94770 - DNA, 1140 bp, Salmonella enteritidis; identical to SEQ ID NO: 87984
  CDS (1)..(1140): transl_table=11

SEQ ID NO: 94771 - protein, 379 aa, Salmonella enteritidis; identical to SEQ ID NO: 87985

SEQ ID NO: 94772 - DNA, 981 bp, Bacteriophage phi; identical to SEQ ID NO: 87986
  CDS (1)..(981): transl_table=11

SEQ ID NO: 94773 - protein, 326 aa, Bacteriophage phi; identical to SEQ ID NO: 87987

SEQ ID NO: 94774 - DNA, 1026 bp, Neisseria gonorrhoeae; identical to SEQ ID NO: 87988
  CDS (1)..(1026): transl_table=11

SEQ ID NO: 94775 - protein, 341 aa, Neisseria gonorrhoeae; identical to SEQ ID NO: 87989

SEQ ID NO: 94776 - DNA, 1359 bp, Streptococcus pneumoniae; identical to SEQ ID NO: 87990
  CDS (1)..(1359): transl_table=11

SEQ ID NO: 94777 - protein, 452 aa, Streptococcus pneumoniae; identical to SEQ ID NO: 87991

SEQ ID NO: 94778 - DNA, 969 bp, Haemophilus influenzae; identical to SEQ ID NO: 87992
  CDS (1)..(969): transl_table=11

SEQ ID NO: 94779 - protein, 322 aa, Haemophilus influenzae; identical to SEQ ID NO: 87993

SEQ ID NO: 94780 - DNA, 1332 bp, Acidiphilium facilis; identical to SEQ ID NO: 87994
  CDS (1)..(1332): transl_table=11

SEQ ID NO: 94781 - protein, 443 aa, Acidiphilium facilis; identical to SEQ ID NO: 87995

SEQ ID NO: 94782 - DNA, 1092 bp, Escherichia coli; identical to SEQ ID NO: 87996
  CDS (1)..(1092): transl_table=11

SEQ ID NO: 94783 - protein, 363 aa, Escherichia coli; identical to SEQ ID NO: 87997

SEQ ID NO: 94784 - DNA, 933 bp, Escherichia coli; identical to SEQ ID NO: 87998
  CDS (1)..(933): transl_table=11

SEQ ID NO: 94785 - protein, 310 aa, Escherichia coli; identical to SEQ ID NO: 87999

SEQ ID NO: 94786 - DNA, 945 bp, Escherichia coli; identical to SEQ ID NO: 88000
  CDS (1)..(945): transl_table=11

SEQ ID NO: 94787 - protein, 314 aa, Escherichia coli; identical to SEQ ID NO: 88001

SEQ ID NO: 94788 - DNA, 1206 bp, Bacteroides sp; identical to SEQ ID NO: 88002
  CDS (1)..(1206): transl_table=11

SEQ ID NO: 94789 - protein, 401 aa, Bacteroides sp; identical to SEQ ID NO: 88003

SEQ ID NO: 94790 - DNA, 1086 bp, Helicobacter pylori; identical to SEQ ID NO: 88004
  CDS (1)..(1086): transl_table=11

SEQ ID NO: 94791 - protein, 361 aa, Helicobacter pylori; identical to SEQ ID NO: 88005

SEQ ID NO: 94792 - DNA, 951 bp, Streptococcus thermophilus; identical to SEQ ID NO: 88006
  CDS (1)..(951): transl_table=11

SEQ ID NO: 94793 - protein, 316 aa, Streptococcus thermophilus; identical to SEQ ID NO: 88007

SEQ ID NO: 94794 - DNA, 1212 bp, Brevibacterium epidermidis; identical to SEQ ID NO: 88008
  CDS (1)..(1212): transl_table=11

SEQ ID NO: 94795 - protein, 403 aa, Brevibacterium epidermidis; identical to SEQ ID NO: 88009

SEQ ID NO: 94796 - DNA, 954 bp, Neisseria gonorrhoeae; identical to SEQ ID NO: 88010
  CDS (1)..(954): transl_table=11

SEQ ID NO: 94797 - protein, 317 aa, Neisseria gonorrhoeae; identical to SEQ ID NO: 88011

SEQ ID NO: 94798 - DNA, 948 bp, Bacillus sp; identical to SEQ ID NO: 88012
  CDS (1)..(948): transl_table=11

SEQ ID NO: 94799 - protein, 315 aa, Bacillus sp; identical to SEQ ID NO: 88013

SEQ ID NO: 94800 - DNA, 1230 bp, Bacillus subtilis; identical to SEQ ID NO: 88014
  CDS (1)..(1230): transl_table=11

SEQ ID NO: 94801 - protein, 409 aa, Bacillus subtilis; identical to SEQ ID NO: 88015

SEQ ID NO: 94802 - DNA, 1263 bp, Herpetosiphon aurantiacus; identical to SEQ ID NO: 88016
  CDS (1)..(1263): transl_table=11

SEQ ID NO: 94803 - protein, 420 aa, Herpetosiphon aurantiacus; identical to SEQ ID NO: 88017

SEQ ID NO: 94804 - DNA, 1056 bp, Dactylococcopsis salina; identical to SEQ ID NO: 88018
  CDS (1)..(1056): transl_table=11

SEQ ID NO: 94805 - protein, 351 aa, Dactylococcopsis salina; identical to SEQ ID NO: 88019

SEQ ID NO: 94806 - DNA, 1434 bp, Escherichia coli; identical to SEQ ID NO: 88020
  CDS (1)..(1434): transl_table=11

SEQ ID NO: 94807 - protein, 477 aa, Escherichia coli; identical to SEQ ID NO: 88021

SEQ ID NO: 94808 - DNA, 1254 bp, Escherichia coli; identical to SEQ ID NO: 88022
  CDS (1)..(1254): transl_table=11

SEQ ID NO: 94809 - protein, 417 aa, Escherichia coli; identical to SEQ ID NO: 88023

SEQ ID NO: 94810 - DNA, 1035 bp, Fusobacterium nucleatum; identical to SEQ ID NO: 88024
  CDS (1)..(1035): transl_table=11

SEQ ID NO: 94811 - protein, 344 aa, Fusobacterium nucleatum; identical to SEQ ID NO: 88025

SEQ ID NO: 94812 - DNA, 957 bp, Haemophilus aegyptius; identical to SEQ ID NO: 88026
  CDS (1)..(957): transl_table=11

SEQ ID NO: 94813 - protein, 318 aa, Haemophilus aegyptius; identical to SEQ ID NO: 88027

SEQ ID NO: 94814 - DNA, 1077 bp, Haemophilus parainfluenzae; identical to SEQ ID NO: 88028
  CDS (1)..(1077): transl_table=11

SEQ ID NO: 94815 - protein, 358 aa, Haemophilus parainfluenzae; identical to SEQ ID NO: 88029

SEQ ID NO: 94816 - DNA, 993 bp, Haemophilus aegyptius; identical to SEQ ID NO: 88030
  CDS (1)..(993): transl_table=11

SEQ ID NO: 94817 - protein, 330 aa, Haemophilus aegyptius; identical to SEQ ID NO: 88031

SEQ ID NO: 94818 - DNA, 993 bp, Methanobacterium thermoformicicum; identical to SEQ ID NO: 88032
  CDS (1)..(993): transl_table=11

SEQ ID NO: 94819 - protein, 330 aa, Methanobacterium thermoformicicum; identical to SEQ ID NO: 88033

SEQ ID NO: 94820 - DNA, 1257 bp, Moraxella sp; identical to SEQ ID NO: 88034
  CDS (1)..(1257): transl_table=11

SEQ ID NO: 94821 - protein, 418 aa, Moraxella sp; identical to SEQ ID NO: 88035

SEQ ID NO: 94822 - DNA, 1251 bp, Psychrobacter sp; identical to SEQ ID NO: 88036
  CDS (1)..(1251): transl_table=11

SEQ ID NO: 94823 - protein, 416 aa, Psychrobacter sp; identical to SEQ ID NO: 88037

SEQ ID NO: 94824 - DNA, 993 bp, Neisseria gonorrhoeae; identical to SEQ ID NO: 88038
  CDS (1)..(993)

SEQ ID NO: 94825 - protein, 330 aa, Neisseria gonorrhoeae; identical to SEQ ID NO: 88039

SEQ ID NO: 94826 - DNA, 1293 bp, Staphylococcus aureus; identical to SEQ ID NO: 88040
  CDS (1)..(1293): transl_table=11

SEQ ID NO: 94827 - protein, 430 aa, Staphylococcus aureus; identical to SEQ ID NO: 88041

SEQ ID NO: 94828 - DNA, 1170 bp, Lactococcus lactis; identical to SEQ ID NO: 88042
  CDS (1)..(1170): transl_table=11

SEQ ID NO: 94829 - protein, 389 aa, Lactococcus lactis; identical to SEQ ID NO: 88043

SEQ ID NO: 94830 - DNA, 25 bp, Primer
atgcaggaaaatatatcagtaaccg

SEQ ID NO: 94831 - DNA, 23 bp, Primer
ttatcgtgaacgtcggccatgtt

SEQ ID NO: 94832 - protein, 613 aa, consensus; identical to SEQ ID NO: 88046
  MISC_FEATURE (1)..(613): consensus for the disclosure of xaa see table XV

SEQ ID NO: 94833 - protein, 16 aa, consensus
  MISC_FEATURE (1)..(16): consensus for the disclosure of xaa see table XV
XXXXXXXPCXXXXXXX

SEQ ID NO: 94834 - protein, 82 aa, consensus; identical to SEQ ID NO: 88048
  MISC_FEATURE (1)..(82): consensus for the disclosure of xaa see table XV

SEQ ID NO: 94835 - DNA, 1992 bp, Escherichia coli; identical to SEQ ID NO: 78675
  CDS (1)..(1992)

SEQ ID NO: 94836 - protein, 663 aa, Escherichia coli; identical to SEQ ID NO: 78676

SEQ ID NO: 94837 - DNA, 2079 bp, Escherichia coli O157:H7; identical to SEQ ID NO: 78677
  CDS (1)..(2079): transl_table=11

SEQ ID NO: 94838 - protein, 692 aa, Escherichia coli O157:H7; identical to SEQ ID NO: 78678

SEQ ID NO: 94839 - DNA, 2079 bp, Shigella flexneri 2a str. 301; identical to SEQ ID NO: 78679
  CDS (1)..(2079): transl_table=11

SEQ ID NO: 94840 - protein, 692 aa, Shigella flexneri 2a str. 301; identical to SEQ ID NO: 78680

SEQ ID NO: 94841 - DNA, 2079 bp, Salmonella enterica subsp. enterica serovar Typhi Ty2; identical to SEQ ID NO: 78681
  CDS (1)..(2079): transl_table=11

SEQ ID NO: 94842 - protein, 692 aa, Salmonella enterica subsp. enterica serovar Typhi Ty2; identical to SEQ ID NO: 78682

SEQ ID NO: 94843 - DNA, 1980 bp, Erwinia carotovora subsp. atroseptica SCRI1043; identical to SEQ ID NO: 78683
  CDS (1)..(1980)

SEQ ID NO: 94844 - protein, 659 aa, Erwinia carotovora subsp. atroseptica SCRI1043; identical to SEQ ID NO: 78684

SEQ ID NO: 94845 - DNA, 2079 bp, Salmonella enterica subsp. enterica serovar Paratypi A str. ATCC; identical to SEQ ID NO: 78685
  CDS (1)..(2079): transl_table=11

SEQ ID NO: 94846 - protein, 692 aa, Salmonella enterica subsp. enterica serovar Paratypi A str. ATCC; identical to SEQ ID NO: 78686

SEQ ID NO: 94847 - DNA, 2202 bp, Rhodospirillum rubrum; identical to SEQ ID NO: 78687
  CDS (1)..(2202)

SEQ ID NO: 94848 - protein, 733 aa, Rhodospirillum rubrum; identical to SEQ ID NO: 78688

SEQ ID NO: 94849 - DNA, 2073 bp, Enterobacter aerogenes; identical to SEQ ID NO: 78689
  CDS (1)..(2073): transl_table=11

SEQ ID NO: 94850 - protein, 690 aa, Enterobacter aerogenes; identical to SEQ ID NO: 78690

SEQ ID NO: 94851 - DNA, 2073 bp, Klebsiella oxytoca; identical to SEQ ID NO: 78691
  CDS (1)..(2073): transl_table=11

SEQ ID NO: 94852 - protein, 690 aa, Klebsiella oxytoca; identical to SEQ ID NO: 78692

SEQ ID NO: 94853 - DNA, 22 bp, Primer
atgtttgccccgccacaaggaa

SEQ ID NO: 94854 - DNA, 22 bp, Primer
ttacaacacctcgcgaaccgag

SEQ ID NO: 94855 - protein, 710 aa, consensus; identical to SEQ ID NO: 78695
  MISC_FEATURE (1)..(710): consensus for the disclosure of xaa see table XV

SEQ ID NO: 94856 - protein, 44 aa, consensus; identical to SEQ ID NO: 78696
  MISC_FEATURE (1)..(44): consensus for the disclosure of xaa see table XV

SEQ ID NO: 94857 - protein, 65 aa, consensus; identical to SEQ ID NO: 78697
  MISC_FEATURE (1)..(65): consensus for the disclosure of xaa see table XV

SEQ ID NO: 94858 - protein, 128 aa, consensus; identical to SEQ ID NO: 78698
  MISC_FEATURE (1)..(128): consensus for the disclosure of xaa see table XV

SEQ ID NO: 94859 - protein, 105 aa, consensus; identical to SEQ ID NO: 78699
  MISC_FEATURE (1)..(105): consensus for the disclosure of xaa see table XV

SEQ ID NO: 94860 - protein, 47 aa, consensus; identical to SEQ ID NO: 78700
  MISC_FEATURE (1)..(47): consensus for the disclosure of xaa see table XV

SEQ ID NO: 94861 - DNA, 966 bp, Escherichia coli
  CDS (1)..(966)
atgcgcatcggacaatatcagctcagaaatcgcctgatcgcagcgcccatggctggcattacagacagaccttttcggacgttgtgctacgagatgggagccggattgacagtatccgagatgatgtcttctaacccacaggtttgggaaagcgacaaatctcgtttacggatggtgcacattgatgaacccggtattcgcaccgtgcaaattgctggtagcgatccgaaagaaatggcagatgcagcacgtattaacgtggaaagcggtgcccagattattgatatcaatatgggttgcccggctaaaaaagtgaatcgcaagctcgcaggttcagccctcttgcagtacccggatgtcgttaaatcgatccttaccgaggtcgtcaatgcagtggacgttcctgttaccctgaaaattcgcactggctgggcaccggaacaccgtaactgcgaagagattgcccaactggctgaagactgtggcattcaggctctgaccattcatggccgtacacgcgcctgtttgttcaatggagaagctgagtacgacagtattcgggcagttaagcagaaagtttccattccggttatcgcgaatggtgacattactgacccgcttaaagccagagctgtgctcgactatacaggggcggatgccctgatgataggccgcgcagctcagggaagaccctggatctttcgggaaatccagcattatctggacactggggagttgctgcccccgctgcctttggcagaggttaagcgcttgctttgcgcgcacgttcgggaactgcatgacttttatggtccggcaaaagggtaccgaattgcacgtaaacacgtttcctggtatctccaggaacacgctccaaatgaccagtttcggcgcacattcaacgccattgaggatgccagcgaacagctggaggcgttggaggcatacttcgaaaattttgcgtaa

SEQ ID NO: 94862 - protein, 321 aa, Escherichia coli
MRIGQYQLRNRLIAAPMAGITDRPFRTLCYEMGAGLTVSEMMSSNPQVWESDKSRLRMVHIDEPGIRTVQIAGSDPKEMADAARINVESGAQIIDINMGCPAKKVNRKLAGSALLQYPDVVKSILTEVVNAVDVPVTLKIRTGWAPEHRNCEEIAQLAEDCGIQALTIHGRTRACLFNGEAEYDSIRAVKQKVSIPVIANGDITDPLKARAVLDYTGADALMIGRAAQGRPWIFREIQHYLDTGELLPPLPLAEVKRLLCAHVRELHDFYGPAKGYRIARKHVSWYLQEHAPNDQFRRTFNAIEDASEQLEALEAYFENFA

SEQ ID NO: 94863 - DNA, 927 bp, Xenopus tropicalis
  CDS (1)..(927)
atgaaatatgtaacacaaaatacactggatttatttcattctgatcacttagtgcgaatatgtgcgcctatggttcgatattcaaagctggccttcaggacactggtgagaaagtatgactgtgatttatgttatacaccaatgatcattgcagctgattttgtcaaatctgtgaaagcgagggacagcgaatttacaacaaaccaaggtgatcgtccacttatagttcagtttgctgcaaaagaagcacaggttttagcagatgctgcaagccttgtttctccatttgccagtggaatagacctcaactgtggctgtcctcagaggtgggcaatggctgaaggctatggagcttgcttgataaataaccctgagttggttagtgatatggtcaaacaagtacgcaatcaagttggtgatccagggtttactatatctattaagatcaggatccatgcagacatttcaagaacagttgatctctgccgaaaggccgaagcagctggtgtatcatggattacagtacatggacgaactcatgatgaaagacatcagccagtacactatgatgcaataaaaagcattaaagaaagcttgtctatacctgttgttgccaatggagatgttaaaagtctaaaagaagcagagaatattcgtgagataacgggggcagatggtgtaatggctgccagggggcttctagctaatcctgccatgtttgcagggtatgaagaaactccactggcctgtatacaagactggattgacattacactggaacatgggaccccttttacatgtttgcatcatcatttgatatatatgatggaaaggataacgtcaaaacaagagaagagagtttttaatgtcttatctagcacatctgctgttttagattatttaagagatcattacggaatacaatag

SEQ ID NO: 94864 - protein, 308 aa, Xenopus tropicalis
MKYVTQNTLDLFHSDHLVRICAPMVRYSKLAFRTLVRKYDCDLCYTPMIIAADFVKSVKARDSEFTTNQGDRPLIVQFAAKEAQVLADAASLVSPFASGIDLNCGCPQRWAMAEGYGACLINNPELVSDMVKQVRNQVGDPGFTISIKIRIHADISRTVDLCRKAEAAGVSWITVHGRTHDERHQPVHYDAIKSIKESLSIPVVANGDVKSLKEAENIREITGADGVMAARGLLANPAMFAGYEETPLACIQDWIDITLEHGTPFTCLHHHLIYMMERITSKQEKRVFNVLSSTSAVLDYLRDHYGIQ

SEQ ID NO: 94865 - DNA, 1482 bp, Homo sapiens
  CDS (1)..(1482)
atgattttgaatagcctctctctgtgttaccataataagctaatcctggccccaatggttcgggtagggactcttccaatgaggctgctggccctggattatggagcggacattgtttactgtgaggagctgatcgacctcaagatgattcagtgcaagagagttgttaatgaggtgctcagcacagtggactttgtcgcccctgatgatcgagttgtcttccgcacctgtgaaagagagcagaacagggtggtcttccagatggggacttcagacgcagagcgagcccttgctgtggccaggcttgtagaaaatgatgtggctggtattgatgtcaacatgggctgtccaaaacaatattccaccaagggaggaatgggagctgccctgctgtcagaccctgacaagattgagaagatcctcagcactcttgttaaagggacacgcagacctgtgacctgcaagattcgcatcctgccatcgctagaagataccctgagccttgtgaagcggatagagaggactggcattgctgccatcgcagttcatgggaggaagcgggaggagcgacctcagcatcctgtcagctgtgaagtcatcaaagccattgctgataccctctccattcctgtcatagccaacggaggatctcatgaccacatccaacagtattcggacatagaggactttcgacaagccacggcagcctcttccgtgatggtggcccgagcagccatgtggaacccatctatcttcctcaaggagggtctgcggcccctggaggaggtcatgcagaaatacatcagatacgcggtgcagtatgacaaccactacaccaacaccaagtactgcttgtgccagatgctacgagaacagctggagtcgccccagggaaggttgctccatgctgcccagtcttcccgggaaatttgtgaggcctttggccttggtgccttctatgaggagaccacacaggagctggatgcccagcaggccaggctctcagccaagacttcagagcagacaggggagccagctgaagatacctctggtgtcattaagatggctgtcaagtttgaccggagagcatacccagcccagatcacccctaagatgtgcctactagagtggtgccggagggagaagttggcacagcctgtgtatgaaacggttcaacgccctctagatcgcctgttctcctctattgtcaccgttgctgaacaaaagtatcagtctaccttgtgggacaagtccaagaaactggcggagcaggctgcagccatcgtctgtctgcggagccagggcctccctgagggtcggctgggtgaggagagcccttccttgcacaagcgaaagagggaggctcctgaccaagaccctgggggccccagagctcaggagctagcacaacctggggatctgtgcaagaagccctttgtggccttgggaagtggtgaagaaagccccctggaaggctggtga

SEQ ID NO: 94866 - protein, 493 aa, Homo sapiens
MILNSLSLCYHNKLILAPMVRVGTLPMRLLALDYGADIVYCEELIDLKMIQCKRVVNEVLSTVDFVAPDDRVVFRTCEREQNRVVFQMGTSDAERALAVARLVENDVAGIDVNMGCPKQYSTKGGMGAALLSDPDKIEKILSTLVKGTRRPVTCKIRILPSLEDTLSLVKRIERTGIAAIAVHGRKREERPQHPVSCEVIKAIADTLSIPVIANGGSHDHIQQYSDIEDFRQATAASSVMVARAAMWNPSIFLKEGLRPLEEVMQKYIRYAVQYDNHYTNTKYCLCQMLREQLESPQGRLLHAAQSSREICEAFGLGAFYEETTQELDAQQARLSAKTSEQTGEPAEDTSGVIKMAVKFDRRAYPAQITPKMCLLEWCRREKLAQPVYETVQRPLDRLFSSIVTVAEQKYQSTLWDKSKKLAEQAAAIVCLRSQGLPEGRLGEESPSLHKRKREAPDQDPGGPRAQELAQPGDLCKKPFVALGSGEESPLEGW

SEQ ID NO: 94867 - DNA, 975 bp, Mus musculus
  CDS (1)..(975)
atgagaagtgactccttaccaaccacaatatgtcaagaaagaaaaaaagacccgatagaaatgtttcattctggacagctggtaaaagtctgtgccccgatggttcgatattcaaagttagcttttagaacattagtaagaaaatactcttgtgacctgtgttacacaccaatgataattgctgctgattttgtcagatctataaaagccagagacagtgaatttaccacaaaccaaggtgattgcccgttgattgttcagtttgctgctaatgatgcaagacttttatctgatgctgccctgctagtctgtccctatgcaaatggaatagatattaactgtggttgccctcagaggtgggcgatggcggacggttatggagcttgcttgatcaacaagccagagcttgttcacgatatggtgagacaagtgagaaatcgggtggaaagcccaaggttttcagtttccattaagataaggatccacgatgacctggcaagaaccatagatctttgccggaaggctgaagcaacaggagtgtcctggattacagttcatggaaggacagttgaagaaagacaccagccagtccactacgatgccattaaaatgataaaggaaaatgtgtctatacccatagttgctaatggagacataagaagcttaaaagaagcagaaaatgtgtggcagatgactgggacagatggtgtgatggttgcaagaggacttttaacaaacccagctatgtttgctggatatgaagaaaccccactgaaatgtatctgggactgggttgacatctctcttgaacttggaactccttttatgtgcttccatcagcatctgatgtacatgatggaaaagataacgtcaaggcaggagaagagagtatttaatgccttgtcaagcacatcagcagtcctggactaccttacggaccattatggtgatgagtcgctttctaaatctttgtag

SEQ ID NO: 94868 - protein, 324 aa, Mus musculus
MRSDSLPTTICQERKKDPIEMFHSGQLVKVCAPMVRYSKLAFRTLVRKYSCDLCYTPMIIAADFVRSIKARDSEFTTNQGDCPLIVQFAANDARLLSDAALLVCPYANGIDINCGCPQRWAMADGYGACLINKPELVHDMVRQVRNRVESPRFSVSIKIRIHDDLARTIDLCRKAEATGVSWITVHGRTVEERHQPVHYDAIKMIKENVSIPIVANGDIRSLKEAENVWQMTGTDGVMVARGLLTNPAMFAGYEETPLKCIWDWVDISLELGTPFMCFHQHLMYMMEKITSRQEKRVFNALSSTSAVLDYLTDHYGDESLSKSL

SEQ ID NO: 94869 - DNA, 1560 bp, Arabidopsis thaliana
  CDS (1)..(1560)
atggaaacgagaatagaactgaagaagaaaatttccgagattttcaaagactttatgacagtaatcacgcagcttgaagaactagggaatgctgcaaacaactttcttctacggtttcagcaaggactaagttttcttcaacgccctccaatagttacttcgtccaagttgattgagaacattatcaagaagaatgaaacaaggcggcttaaatcatatatcgaggcaggatgtattaatatccatgatgctgcacaaagcacaagagcttatgtgaatgttgcagccaaaaacttgttgattgagctggaacgtctcactgatgaggccgcccttgcaattgagtctgccacacagctagataaagactcaagtgatggattgcaacaagtaacatgtgatgaggagaacgagactgtacaattacctcaaggacctgaagttacagagtacgctgcacttattgcagttatttacagtatgatgaagcagaactatgttatgcaggataagattgtgagatcgcttagtttgaagtcatcatctggtgagctagagacttacagtctgatgtggtcattgcgccccggcgtcttcgaatttttcgtggctacgtttgacggtgccacgaagaagaagaagacgaagatggattatcagaacaagcttgttcttgctcccatggttcgtgtgggaacgctctctttcaggatgttggcggcggaatacggcgccgatatcacatacggtgaagagattattgatcataagcttgttaaatgcgaacgccgactcaatgttgcttctgggacatctgagtttgtggagaaaggaacagataatgtagtctttagcacatgtgatgaagaaaaaagtagggttgtttttcagatgggaacttctgatgctgttagggctctaaaggcttctgagattgtgtgtaatgacgttgcaactattgatattaatatgggttgccccaaggcattctctatccaaggtggaatgggtgctgctttgttaagtaaacccgagctaattcatgatattttggcaacacttaagaggaacttagacgtaccggttacttgcaagattcgtctattaaaatcaccagcagatactgttgaattggctaggagaatcgagaaacttggtgtaccagctcttgctgtacatgggaggaaaattgcagacaggccaagagatcctgctaaatgggatgagattgcagatgtggtggcagcattatccattcccgtcattgcaaatggcgatgttttagaatatgatgatttttctcgcattaaaaccgcaacaggcgctgcatcagttatggttgcaagaggagctatgtggaatgcttcaattttctctccaaaaggaaaatcacactgggaagatgtgaaaaagaaataccttagaaagagcatcttgtggaataacgatgttaagagcacgaaatacacgataaaggagatgatagcgcatcattcttgtcttgaactaccggaagggaagtctatcaacaaagcagacactttagaagatttagcgtaa

SEQ ID NO: 94870 - protein, 519 aa, Arabidopsis thaliana
METRIELKKKISEIFKDFMTVITQLEELGNAANNFLLRFQQGLSFLQRPPIVTSSKLIENIIKKNETRRLKSYIEAGCINIHDAAQSTRAYVNVAAKNLLIELERLTDEAALAIESATQLDKDSSDGLQQVTCDEENETVQLPQGPEVTEYAALIAVIYSMMKQNYVMQDKIVRSLSLKSSSGELETYSLMWSLRPGVFEFFVATFDGATKKKKTKMDYQNKLVLAPMVRVGTLSFRMLAAEYGADITYGEEIIDHKLVKCERRLNVASGTSEFVEKGTDNVVFSTCDEEKSRVVFQMGTSDAVRALKASEIVCNDVATIDINMGCPKAFSIQGGMGAALLSKPELIHDILATLKRNLDVPVTCKIRLLKSPADTVELARRIEKLGVPALAVHGRKIADRPRDPAKWDEIADVVAALSIPVIANGDVLEYDDFSRIKTATGAASVMVARGAMWNASIFSPKGKSHWEDVKKKYLRKSILWNNDVKSTKYTIKEMIAHHSCLELPEGKSINKADTLEDLA

SEQ ID NO: 94871 - DNA, 2103 bp, Arabidopsis thaliana
  CDS (1)..(2103)
atgtcagatgtaatagcggagcacgcggtggatactagtgttgaaggagatgcaaaggctgcgttaccggttcaatcgacgaaacagttctctgtgtatgaagcgacttcggaagagcttatagaacgatcaatggctcctattaagaaggagttcctttgtcctcctcctccaagccgttccgtgaagcaaaatgatgccgccgatgttagggcgcctcaatcgggtttggttcaggagaagaaatctaaacgacaactgaaacgggaacgccgcgaggtattgattcgaatcacatcggtgcttcaatctacgatcaatctctgtccgcaggttgcgagaacagaagacgttgattcatgtcagtataaagacaagtgccggtttaatcatgatattgaggctttcaaggctcagaaggcagatgatatagaggggcaatgcccatttgtggcctctggaatgaagtgtgcatatggtttatcatgtagattcttaggcagtcacagagatattactggtaattcagatgacaaggaaaaatcagagatgaacttttttaacaaagagacacagaggcttctgtggaaaaataagatgacttttacaaacgcagatgcgaaacttaagtccctcggtctgttgggacatgccaaaaaaagcaatgctgccgaggaaattaccgcagaaaaaactcaaaatggtatgaacggcactcaagcaactgaagtagcggttgactcagctgtcagttctgagcatacatcagaaatgatacaagatgttgatattcctggaccattagaaactgaggaagttcgtcccatgaaaaaggcaaaatctgaggaccaaaagaattctaaaactggagatgttggtggagtttatgatggcgtgaaattggaagaggaaacgaaaaagaatgggtatcctacttcaaaagctaacgtagaagatgaggatagcatcaaaattgttgaaactgatagtagtctaaagttgcaccctcgagaaaagaaaaagctaattgattttagggataagttgtaccttgcacccttaacaaccgtgggcaatcttcccttccgaagactttgtaaagtgttgggagcagatgtgacttgtggtgagatggctatgtgcacaaatcttttgcagggccaagcttctgaatgggctctgcttagacgacattcatcggaagatctgtttggtgttcagatttgcggttcttatcctgacacggtgtcgcgcgtagttgaacttatagaccgagaatgcactgttgatttcatagatatcaacatgggttgcccgatagatatggttgtcaacaaaagtgctggttcagctcttctcaacaaaccattacggatgaagaacatcgtggaagtctcttcttccattgttgaaacacctatcactatcaaggtacgaacagcattctttgagggtaagaaccggatagattctttaattgcagatatcggaaactggggagccactgcagtgactattcatgggcggtcaagacagcaacgttatagcaagtctgcagattgggactatatataccagtgtaccaaaaacgctactactaacctacaggttataggaaatggagatgtgtactcatatttagactggaacaaacacaagtctgactgtcctgagttgtctagctgcatgattgctcgtggagcactgatcaagccttggatctttactgaaattaaagagcaacggcattgggacattacctctggagaaagacttaacatcatgaaggacttcgtacgttttggtcttcaacattggggatccgacacgaaaggagttgagacaactaggcatttcttgctggagtggctaagctacacatttaggtacatacctgtcggtttgcttgatgtgatcccgcagcaaatcaactggcgtccgccttcatactttggtcgtgatgatctcgagacactcatgatgtctgaatctgcgggtgactgggtgcggatatcggaaatgctgcttggaaaggttccggagggcttcacatttgcccccaagcacaaatccaacgcatatgacagagctgaaaacggctga

SEQ ID NO: 94872 - protein, 700 aa, Arabidopsis thaliana
MSDVIAEHAVDTSVEGDAKAALPVQSTKQFSVYEATSEELIERSMAPIKKEFLCPPPPSRSVKQNDAADVRAPQSGLVQEKKSKRQLKRERREVLIRITSVLQSTINLCPQVARTEDVDSCQYKDKCRFNHDIEAFKAQKADDIEGQCPFVASGMKCAYGLSCRFLGSHRDITGNSDDKEKSEMNFFNKETQRLLWKNKMTFTNADAKLKSLGLLGHAKKSNAAEEITAEKTQNGMNGTQATEVAVDSAVSSEHTSEMIQDVDIPGPLETEEVRPMKKAKSEDQKNSKTGDVGGVYDGVKLEEETKKNGYPTSKANVEDEDSIKIVETDSSLKLHPREKKKLIDFRDKLYLAPLTTVGNLPFRRLCKVLGADVTCGEMAMCTNLLQGQASEWALLRRHSSEDLFGVQICGSYPDTVSRVVELIDRECTVDFIDINMGCPIDMVVNKSAGSALLNKPLRMKNIVEVSSSIVETPITIKVRTAFFEGKNRIDSLIADIGNWGATAVTIHGRSRQQRYSKSADWDYIYQCTKNATTNLQVIGNGDVYSYLDWNKHKSDCPELSSCMIARGALIKPWIFTEIKEQRHWDITSGERLNIMKDFVRFGLQHWGSDTKGVETTRHFLLEWLSYTFRYIPVGLLDVIPQQINWRPPSYFGRDDLETLMMSESAGDWVRISEMLLGKVPEGFTFAPKHKSNAYDRAENG

SEQ ID NO: 94873 - DNA, 1272 bp, Arabidopsis thaliana
  CDS (1)..(1272)
atgaaactaaatctctcgaatctcagatttctacgtacccgaaaatcgttaatctcccagacgcgagcaatgactcaaaatccggatccaaaacctgatccatcgcaggttctagacgatatcctctgttcggagcagcgtgatgggcagattgaggaaacagtcgacacagcgccggcgagcttgggctctccaagtcgggtcttaagcattgatactagagtagagagagcttgggcacactggaaaaaactgggtagacccaagtatatcgttgctccaatggttgataactctgagcttccgtttagattgctctgccagaaatacggagctcaggctgcttatactccgatgttgcattctaggatcttcaccgagactgagaagtatagaaatcaggagttcaccacctgtaaggaggacaggccattgtttgtgcagttctgtgctaatgatcctgatacgttattggaagctgcaaagagagtcgaaccttactgcgactatgttgatatcaatttagggtgtcctcagcgtatagcgaggcgaggaaattatggtgcattcttgatggataatcttcctttggtgaaatcacttgttgaaaagttagctcagaacctcaatgttcctgtctcctgtaaaatccggatcttcccgaacctggaagatacactcaagtacgccaagatgctagaagatgctggttgctcgctcctagctgttcacgggcgaacaagagatgagaaagacgggaagaaatttagagctgattggagcgcaatcaaggaagtgaaaaacgctatgagaatccctgtcttagcgaatgggaatgtaagatgcatcgaagatgtcgataactgcatcaaagagacgggtgttgaaggtgttctctctgcggagacgcttcttgaaaacccggcggcctttgctgggtttagaacagctgaatgggcaaaagataacgaagaagagggattcgtcgatggagggttagaccagggagatttagttgttgagtatttaaagctgtgtgagaagcatccggttccatggaggatgattcgatctcacgttcataagatgttgggagaatggtttagaattcatccacaagttagagagcaacttaatgctcaaaacatattgacgtttgagtttctatacggacttgtggatcagctaagagagcttggaggaagagttccactctacaagaaaaagaagatagatactctgactccacaagactctccacaaagggtttag

SEQ ID NO: 94874 - protein, 423 aa, Arabidopsis thaliana
MKLNLSNLRFLRTRKSLISQTRAMTQNPDPKPDPSQVLDDILCSEQRDGQIEETVDTAPASLGSPSRVLSIDTRVERAWAHWKKLGRPKYIVAPMVDNSELPFRLLCQKYGAQAAYTPMLHSRIFTETEKYRNQEFTTCKEDRPLFVQFCANDPDTLLEAAKRVEPYCDYVDINLGCPQRIARRGNYGAFLMDNLPLVKSLVEKLAQNLNVPVSCKIRIFPNLEDTLKYAKMLEDAGCSLLAVHGRTRDEKDGKKFRADWSAIKEVKNAMRIPVLANGNVRCIEDVDNCIKETGVEGVLSAETLLENPAAFAGFRTAEWAKDNEEEGFVDGGLDQGDLVVEYLKLCEKHPVPWRMIRSHVHKMLGEWFRIHPQVREQLNAQNILTFEFLYGLVDQLRELGGRVPLYKKKKIDTLTPQDSPQRV

SEQ ID NO: 94875 - DNA, 921 bp, Thermotoga maritima MSB8
  CDS (1)..(921): transl_table=11
atggaggttaaagtcggtcttgcgccgatggctggatacactgattcagcattccgcactctggctttcgaatggggtgcggattttgctttctctgaaatggtgagtgcaaagggttttctcatgaactctcaaaaaacagaagaactcttaccacaaccacatgaaagaaacgtggcggtccagatctttggaagcgaaccgaacgaactttctgaggcagcgaggattctctctgaaaagtacaagtggatagatttgaacgctggttgccctgtgagaaaagttgtaaaaaaaggagcaggcggagctttgttgaaagatttgagacattttcgatacattgtgagggagctcagaaagagtgtttctggcaaattttctgtgaaaactcgccttggatgggagaaaaatgaagtcgaggagatatatcgaatactcgttgaggaaggggtggatgaggtattcattcacacgagaacggtggttcagagtttcactgggagggctgaatggaaggcgttgagtgttctggaaaagagaattcctacctttgtgagtggtgatatcttcactccagaagacgccaagagggctctggaagaaagcggatgtgatggtcttctggtagcgagaggtgctataggaagaccttggattttcaaacagataaaggatttcctccgaagcggaaagtactctgaaccgtcccgggaagagattcttagaacgttcgaaagacatctcgagctgttgataaagacgaagggtgaaagaaaagcggttgtggaaatgagaaagtttctggcaggttatacaaaggatctgaaaggcgcaaggagattcagagagaaagttatgaaaatagaagaagttcaaattttaaaagagatgttttataatttcatcaaggaggtgtga

SEQ ID NO: 94876 - protein, 306 aa, Thermotoga maritima MSB8
MEVKVGLAPMAGYTDSAFRTLAFEWGADFAFSEMVSAKGFLMNSQKTEELLPQPHERNVAVQIFGSEPNELSEAARILSEKYKWIDLNAGCPVRKVVKKGAGGALLKDLRHFRYIVRELRKSVSGKFSVKTRLGWEKNEVEEIYRILVEEGVDEVFIHTRTVVQSFTGRAEWKALSVLEKRIPTFVSGDIFTPEDAKRALEESGCDGLLVARGAIGRPWIFKQIKDFLRSGKYSEPSREEILRTFERHLELLIKTKGERKAVVEMRKFLAGYTKDLKGARRFREKVMKIEEVQILKEMFYNFIKEV

SEQ ID NO: 94877 - DNA, 1005 bp, Bacillus halodurans C-125
  CDS (1)..(1005): transl_table=11
atgcttaaaattggtccaatcgaaatgaaaaatcaagtggtcttagcaccgatggcaggggtatgtaaccctgcgtttcgtttgattgccaaggagtttggagcaggactagtctgtgcagaaatggtgagcgataaagccattcttcataaaaacgaaaagtcattgagcatgctgtatgtagatgagcgggaaaaaccgttgagtttgcaaatttttggcggagaaaaggaaacccttgtcgaagcggccaagttcgtggataagaacacaaatgccgatattattgacatcaatatggggtgtccagtgccgaaaattacaaaatgtgatgcgggtgctcgttggttacttgatccaaacaaaatttatgatatggtttcagccgttgttgatgaggtcgataaacctgttacggttaagatgcggatcggttgggatgaagagcatatctatgcagtcgaaaatgctcaagcagttgaacgtgcaggtggtgcagcggttgctgtccacggacggacgcgtgtgcaaatgtacgaaggaacagctgactggaatatcattcgtgaagtcaaacaagccgtaggtattcccgttattggaaacggggatgtgaagacgccgcaagatgcgaagcgcatgcttgatgaaattggtgttgatggagtgatgatcgggcgtgcagcactagggaacccttggatgctttatcggacgatccattacttggaaacaggggagttgctcccagatcctacgccgcgtgagaaaatggatgtatgcatgattcatttggatcgcctgattaagcttaaaggcgaaaacgtagcggtccgtgaaatgagaaagcatgctgcttggtatttgaaaggcttgcgcgggaatgggaaaatccgcgatcaaattaatcaatttgaaactcgggaggatgtatcctcaaccctttatgcctatattgaagagttagaggcaaaaatggccgagaaaagtgcgagtgtggtttga

SEQ ID NO: 94878 - protein, 334 aa, Bacillus halodurans C-125
MLKIGPIEMKNQVVLAPMAGVCNPAFRLIAKEFGAGLVCAEMVSDKAILHKNEKSLSMLYVDEREKPLSLQIFGGEKETLVEAAKFVDKNTNADIIDINMGCPVPKITKCDAGARWLLDPNKIYDMVSAVVDEVDKPVTVKMRIGWDEEHIYAVENAQAVERAGGAAVAVHGRTRVQMYEGTADWNIIREVKQAVGIPVIGNGDVKTPQDAKRMLDEIGVDGVMIGRAALGNPWMLYRTIHYLETGELLPDPTPREKMDVCMIHLDRLIKLKGENVAVREMRKHAAWYLKGLRGNGKIRDQINQFETREDVSSTLYAYIEELEAKMAEKSASVV

SEQ ID NO: 94879 - DNA, 1005 bp, Pasteurella multocida subsp. multocida str. Pm70
  CDS (1)..(1005): transl_table=11
atgacagtgcggataggttcttatcagcttaaaaatcgcatttttcttgctcctatggctggcatcactgaccaaccatttcggcgaatctgcactcattatggggcaggtttaactttttctgaaatgatgtcaacgaatccgcaagtctggcataccgaaaaatcgaaactgcgcttggctcatcatcaagaagcaggaattaatgctgtgcaaatagctggttgtgatcccgatgagatggcgaaagctgctcaaatcaatgtagaatatggggcagaaattattgatatcaatatgggctgcccagccaaaaaagtgaatcgtaaaatggcgggctctgcgctgttacaatatcctgatttggtcaaacaaattcttaataaagttgtgaaatctgttactgtaccagtgacattaaagataagaacaggctgggataaagacaaccgaaattgtttagaaatcgctaaaattgcagagcaatgtggtattcaagcactgaccatccacggacgaacaaggagttgtatgtttgagggggaggctgaatatgacaatatcaaggcggtcaaagagcaactttctattccgattattgccaatggcgatattacttccgctgaaaaagcaaagtatgttcttgattataccaacgcagatgcaataatgatcggacgtggttcattaggcaatccgtggcttttccgagttatggaaagcttaattgaaaaagactcgattgttttagagccaagtttaaacgagaaatgtaatgtgattttacagcatatccaagaactgcatcaattttatggtgtggagaaaggatgtcgtattgcacgtaaacacgttgcttggtatttacagggaatccaacctaatcccgtttttagacaggcttttaatgcaattactgatcccaaagaacaattaattgctttagaaggtttttttaatttgattctgatggataaagaaaaaaatgttagaacaacaacgtaa

SEQ ID NO: 94880 - protein, 334 aa, Pasteurella multocida subsp. multocida str. Pm70
MTVRIGSYQLKNRIFLAPMAGITDQPFRRICTHYGAGLTFSEMMSTNPQVWHTEKSKLRLAHHQEAGINAVQIAGCDPDEMAKAAQINVEYGAEIIDINMGCPAKKVNRKMAGSALLQYPDLVKQILNKVVKSVTVPVTLKIRTGWDKDNRNCLEIAKIAEQCGIQALTIHGRTRSCMFEGEAEYDNIKAVKEQLSIPIIANGDITSAEKAKYVLDYTNADAIMIGRGSLGNPWLFRVMESLIEKDSIVLEPSLNEKCNVILQHIQELHQFYGVEKGCRIARKHVAWYLQGIQPNPVFRQAFNAITDPKEQLIALEGFFNLILMDKEKNVRTTT

SEQ ID NO: 94881 - DNA, 1005 bp, Lactococcus lactis subsp. lactis Il1403
  CDS (1)..(1005): transl_table=11
atgactatggacaaaatttacaacgaatcgtggaaaattggcgatatcgaaataaaaaataaaattgtgttagcaccaatggccggaattacgaataaagcttttctgactactgctaaagaatttggagctggacttgttgtaactgaaatgatttctgataaaggaattgaacatcgcaacaaaaagactttggaaatgatggattttgaaggggtccctcatccactctcaatgcaaatttttgggggtgaagtagatactctggttgaagcagccaaatttgttgaagcaaatactgttgctgatattattgatatcaatatgggttgcccagtacccaaagtcactaaaaacgaagccggttctcgtcttttgcttgatcctgataaagtttatgatgtggtctctgctgtttctaaagctatttcaagaccactaacagtgaaaatccgaattggttgggatgacgaccacctttttgcagttgaaaatgctaaagcgattgaagcgggaggcggagcggctgtttctatgcatgcacgaaccaaagcacaagcttatacaggaaatgctcaagaaaattggcactggctcaaaaaattgaccgaaaatgtcaatattccggtcatcggaaatggcgatgtcaagactcctgaagacgcgaaacgcatgattgatgaaacaggcgtcactgcggtcatgatgggaagagcagcccttggaaacccttggattcttcatcgtaccgagcattatctacgaacaggtgaactattgcctgaaccaacagttgcgggaaaaatggaaattgcaaaacttcacttggcacgtctcgtcgaattaaaaggtgataatcttgctagccgagaatttcgtcagcacgcagcatattacctaaaaggagcttctcgtgcagcaaaagtaaaagttgctgtcaatcaagcagaatcacaagcagaaattatcactattctcgataattttgtgaatggaatcaaataa

SEQ ID NO: 94882 - protein, 334 aa, Lactococcus lactis subsp. lactis Il1403
MTMDKIYNESWKIGDIEIKNKIVLAPMAGITNKAFLTTAKEFGAGLVVTEMISDKGIEHRNKKTLEMMDFEGVPHPLSMQIFGGEVDTLVEAAKFVEANTVADIIDINMGCPVPKVTKNEAGSRLLLDPDKVYDVVSAVSKAISRPLTVKIRIGWDDDHLFAVENAKAIEAGGGAAVSMHARTKAQAYTGNAQENWHWLKKLTENVNIPVIGNGDVKTPEDAKRMIDETGVTAVMMGRAALGNPWILHRTEHYLRTGELLPEPTVAGKMEIAKLHLARLVELKGDNLASREFRQHAAYYLKGASRAAKVKVAVNQAESQAEIITILDNFVNGIK

SEQ ID NO: 94883 - DNA, 1011 bp, Neisseria meningitidis MC58
  CDS (1)..(1011): transl_table=11
atgcacatcggcggctattttatcgacaaccccatcgcacttgcgccgatggcgggcattaccgacaaaccgttccgccgactttgccgagattttggcgcaggttgggcggtgtgcgaaatgctgaccagcgacccgacgctcagaaatactagaaaaaccttgcaccgcagcgattttgccgatgaaggcggcattgttgccgtgcagattgccggaagcgatccgcagcagatggcggatgccgcgcgttacaacgtcagccttggggcgcagcttatcgacatcaacatgggctgtcccgctaaaaaagtctgcaatgtccaagccggtagcgcgctgatgcagaacgagccgctggttgccgccattttggaagccgtcgtccgtgcggcaggcgtacccgttaccctcaaaacccgtttgggttggcacgacgaccatcaaaacctgcccgtcatcgccaaaatcgccgaagattgcggcatcgccgcccttgccgtccacggacgcacgcgtacgcaaatgtacaaaggcgaagcgcgttacgaactcatcgccgaaaccaaatgccgtctgaacatcccggtctgggtcaacggcgacattacttcgccgcaaaaagcccaagccgtcctcaaacaaaccgccgccgacggcattatgatagggcgcggcgcgcaaggcaggccgtggttcttccgcgatttgaaacattatgccgaacacggtgttttgccgcctgccttgagtttggcagaatgcgccgccgctattttgaaccacatccgcgccatacacgcgttttacggcgacaccgccggtgtgcgcatcgcacgcaaacacataggctggtacatcgacgaaatgcccgacggcgaacagacacgtcgtgaaatcaaccgcttggacagtgcggcggcgcaatacgacatgcttgcaggttatcttgaaagacttgccgaaaaaaccgacagttgggcgtgcgcctaccgcccaaatgccttctga

SEQ ID NO: 94884 - protein, 336 aa, Neisseria meningitidis MC58
MHIGGYFIDNPIALAPMAGITDKPFRRLCRDFGAGWAVCEMLTSDPTLRNTRKTLHRSDFADEGGIVAVQIAGSDPQQMADAARYNVSLGAQLIDINMGCPAKKVCNVQAGSALMQNEPLVAAILEAVVRAAGVPVTLKTRLGWHDDHQNLPVIAKIAEDCGIAALAVHGRTRTQMYKGEARYELIAETKCRLNIPVWVNGDITSPQKAQAVLKQTAADGIMIGRGAQGRPWFFRDLKHYAEHGVLPPALSLAECAAAILNHIRAIHAFYGDTAGVRIARKHIGWYIDEMPDGEQTRREINRLDSAAAQYDMLAGYLERLAEKTDSWACAYRPNAF

SEQ ID NO: 94885 - DNA, 1221 bp, Deinococcus radiodurans R1
  CDS (1)..(1221): transl_table=11
atgggtcaaacaggctccctgggcaagaaaccgggctccagccccaggggaacagcgcgggagagttcgcaaataacaaattctgcgctgaacaatccgaagatagcgcaccgccctcgcccctgcgaccggcttgtcagccgcgccgtttcaggctcccttcatccggcccgcagcgctcaggcgctattcttaaccgttatgactgcctacgccgcttcgtcctccgctgctccggctaccggcgggttctacgctgagcgtctaagccgccccggtgcggtgctggccccgatggccggctacagcgacgcgccgatgcgccagctcgccgccgagcagggggcgctgtggacggtgagcgaaatgatcagcgcccgtgggctggtgctgggcagcgagcaggagtcgctcagtctgggccgcccctaccccggcgagcagggccgggcggtgcagctcttcggcgccgaccccgacgtgcttgccgacgcggtgggcaaggccgaagcgtggtttgcgcccgccgctatcgacctcaacctcggctgcccggtgcccaaggtgcgcggcaagggcggggcgtgcctcttgcagacccccgaagtcgcctacgaactcgtgcgggcgatgcggcaggccaccgggctcgacgtgagcgccaaaattcgcctcggctgggacgagaaccgcagcgtggaaatcgcgcagggactcgaagcggcgggcgccgccgtcgtgacggtgcatggccgcaccagtgcccagcgttacaccggcaacgccgactgggacgcgattgggcgggtggcgcaggccgtgcggattccggtgatcggcagcggcgacgtgctgagcccggtgcaggcccgcgagcggatgcagcagagcggagtggccgccgtgatgatcggacgcggcgccgtcggcaacccctggatgttccgggccatcgccagcggcgaggagacgctgccccccgcccaggaacgcgcccgcaccgcgctgcggcacgcggagttgcagcacgacttctacaccacgccgcaccgccgtgacccttcgcggctgcacgtggcgagcatgcgcccgctgcgcaaggtgctgcccaagtacctgcccgaccagcccgacctgcacccggcgctgcatcaggtggagactctggacgacgtgcgggcggcactcgtgcccttgctggccgaatcgctgcgcagttga

SEQ ID NO: 94886 - protein, 406 aa, Deinococcus radiodurans R1
MGQTGSLGKKPGSSPRGTARESSQITNSALNNPKIAHRPRPCDRLVSRAVSGSLHPARSAQALFLTVMTAYAASSSAAPATGGFYAERLSRPGAVLAPMAGYSDAPMRQLAAEQGALWTVSEMISARGLVLGSEQESLSLGRPYPGEQGRAVQLFGADPDVLADAVGKAEAWFAPAAIDLNLGCPVPKVRGKGGACLLQTPEVAYELVRAMRQATGLDVSAKIRLGWDENRSVEIAQGLEAAGAAVVTVHGRTSAQRYTGNADWDAIGRVAQAVRIPVIGSGDVLSPVQARERMQQSGVAAVMIGRGAVGNPWMFRAIASGEETLPPAQERARTALRHAELQHDFYTTPHRRDPSRLHVASMRPLRKVLPKYLPDQPDLHPALHQVETLDDVRAALVPLLAESLRS

SEQ ID NO: 94887 - DNA, 1005 bp, Chlamydia muridarum Nigg
  CDS (1)..(1005): transl_table=11
atggcttctccagtatttataaaaaaccttccccttaggtcccagatagtttacgcccctcttgcaggattttctgattacccctatcgccgtatgtcggccctatatcaccctgcattgatgttctgcgaaatgatcaaaatggaaggtctgcactactgtcctaaacgtacgttgcgcttgttagatttctcagaatctatgcgccctatcggaggccagctctgcggtagccgacctgatcttgcaggagaatctgcaaaaattttagagggattaggcttcgatctcatcgatttgaattgtggatgtcctacagatcgcatcaccaaagatggaagtggctctgggatgctcaaaacccctcaattaatcgggaaagtagttgagagtattgtagaagctgtttctgttcctgtaacagtaaaaatccgttctggatgggatttcgaacacatcaatgtcgaagaaaccgttcatattattaaagaaagcggcgcaagcgctgtctttgtacatggaagaactcgctctcaaggatatcaaggccccagcaatttggagtttattgcacgagcaaagcgagctgctggagagcactttccagtatttggaaatggagatgtcttttctcctgaagcagctaaaacaatgttagaaactactcactgtgatggagtccttgtcgctcgcggtacaatgggagctccttggattggaaaacaaatagaagattacttaaccacagggacctattcttccccatccttctccatgagaaagcaagcgtttgtacagcacctacagtggatagaagaatactaccaaagcgaagaaaagctcttaacagatacccgcaaactgtgtggtcactacttaattctttccccaagagttcgttctttacgcgctagcctagctaaagcttcctcatcacaagaagtttatcagcttataaacgattttgaagaatctgcagaaggagaagaatcctctcctgaatag

SEQ ID NO: 94888 - protein, 334 aa, Chlamydia muridarum Nigg
MASPVFIKNLPLRSQIVYAPLAGFSDYPYRRMSALYHPALMFCEMIKMEGLHYCPKRTLRLLDFSESMRPIGGQLCGSRPDLAGESAKILEGLGFDLIDLNCGCPTDRITKDGSGSGMLKTPQLIGKVVESIVEAVSVPVTVKIRSGWDFEHINVEETVHIIKESGASAVFVHGRTRSQGYQGPSNLEFIARAKRAAGEHFPVFGNGDVFSPEAAKTMLETTHCDGVLVARGTMGAPWIGKQIEDYLTTGTYSSPSFSMRKQAFVQHLQWIEEYYQSEEKLLTDTRKLCGHYLILSPRVRSLRASLAKASSSQEVYQLINDFEESAEGEESSPE

SEQ ID NO: 94889 - DNA, 966 bp, Clostridium acetobutylicum ATCC 824
  CDS (1)..(966): transl_table=11
atgaaggtaggtaatcttagttttgaaggaaatgtgtttttagcaccgatggcaggagtaacagatatagtatttagaaagatatgtaaaggtatgggagcagatcttacatatacggaaatggtaagtgcaaaagctctttactatggaagtgaaaatacagaagaactcatgaagatatcagatgaagaagagtatgctgcagttcaaatgtttgggagtgaaccagatataatggcaaaggcatgtgaaaaattcaatgaagatgataaaatttgcattatagatataaacatgggatgccctgctcataaaatagttaaaaatggtgaaggatctgcacttatgaaaagccctaagctagcatatgagattgtaaaagcagttaaaaaagcttccaataaacctgtaaccgtaaagtttagaaaaggtttcgatgaagataatataaatgctgtagaatttgctaaggtaatagaggatgcaggagcagacatgataacagtccatggaagaacaagagctcagatgtatgaaggaaaagcggattgggatataataaaggcggtcaaaaaatcagttagtatacctgtaataggaaatggagatatagtatcaggagaagatgctgttagaatgttagaatatactaattgtgatggtgtgatggttgctagagctgcaatgggaaatccatggatatttagagagataaaagctgcgattaattcaacgcaaatcataaaacctactccagttgaaaaattagatatgtgtatatttcactataaagaagcagtaaaatattatggtgaaaaaaaagcagtacgtgaaatgcgaaaaaatatagcatggtacataaaatcactaaaaaattgtacagatataaaatgtttaataaattcagaggaaagcagtgatgaggttattggtattcttgagcagtatagaaaagattttctttaa

SEQ ID NO: 94890 - protein, 321 aa, Clostridium acetobutylicum ATCC 824
MKVGNLSFEGNVFLAPMAGVTDIVFRKICKGMGADLTYTEMVSAKALYYGSENTEELMKISDEEEYAAVQMFGSEPDIMAKACEKFNEDDKICIIDINMGCPAHKIVKNGEGSALMKSPKLAYEIVKAVKKASNKPVTVKFRKGFDEDNINAVEFAKVIEDAGADMITVHGRTRAQMYEGKADWDIIKAVKKSVSIPVIGNGDIVSGEDAVRMLEYTNCDGVMVARAAMGNPWIFREIKAAINSTQIIKPTPVEKLDMCIFHYKEAVKYYGEKKAVREMRKNIAWYIKSLKNCTDIKCLINSEESSDEVIGILEQYRKDFL

SEQ ID NO: 94891 - DNA, 1011 bp, Streptococcus pneumoniae R6
  CDS (1)..(1011): transl_table=11
ttgatgaaaaggacctggaggaactcattcgtgacaaatcttaatacaccttttatgattggcaatattgagattcccaatcgtaccgttttagcgcctatggctggcgtgaccaactcagcctttcgtaccatcgcaaaagagctcggagctggactcgttgtaatggaaatggtctctgacaagggaatccaatacaacaacgaaaaaaccctgcatatgcttcatatcgatgagggcgaaaaccctgtctctatccaactttttggtagcgatgaagacagcctagcacgcgcagcagaattcatccaagaaaacaccaagaccgatatcgtcgatatcaacatgggctgccctgtcaacaaaatcgtgaagaacgaagctggagctatgtggctcaaggatcctgacaagatctactctatcatcaacaaggtccagtctgtccttgatatcccacttactgtcaaaatgcgtaccggctgggcggacccatctctggcagtagaaaatgccctcgctgctgaggctgcaggtgtttctgccctcgccatgcatggccgtacccgtgaacaaatgtatactggccacgcagaccttgagaccctttacaaggttgcccaagctctaaccaagattccattcatcgccaacggtgatatccgtactgtccaagaagccaagcaacgcatcgaagaagttggtgctgacgcagtcatgattggccgagctgccatgggaaatccttacctcttcaaccaaatcaaccattactttgaaacaggagaaatcctacctgatttgacctttgaagacaagatgaagatcgcctacgaacacttgaaacgattgattaacctcaaaggagaaaacgtcgcagttcgtgaattccgcggcctcgctcctcactatctccgtggaacatctggcgctgccaaactccgtggagccatttcgcaagctagcaccctagcagagattgaagccctcttgcaattggagaaggcttaa

SEQ ID NO: 94892 - protein, 336 aa, Streptococcus pneumoniae R6
MMKRTWRNSFVTNLNTPFMIGNIEIPNRTVLAPMAGVTNSAFRTIAKELGAGLVVMEMVSDKGIQYNNEKTLHMLHIDEGENPVSIQLFGSDEDSLARAAEFIQENTKTDIVDINMGCPVNKIVKNEAGAMWLKDPDKIYSIINKVQSVLDIPLTVKMRTGWADPSLAVENALAAEAAGVSALAMHGRTREQMYTGHADLETLYKVAQALTKIPFIANGDIRTVQEAKQRIEEVGADAVMIGRAAMGNPYLFNQINHYFETGEILPDLTFEDKMKIAYEHLKRLINLKGENVAVREFRGLAPHYLRGTSGAAKLRGAISQASTLAEIEALLQLEKA

SEQ ID NO: 94893 - DNA, 948 bp, Caulobacter crescentus CB15
  CDS (1)..(948): transl_table=11
atgaccggcgtgtcggatctgcccttcagagaaacggcctcggcgcttggcgcgccctatgtggccaccgaaatggttgcgagcgccgagttcgccaaagggcgtcctgacgtcgtgcgccgcgccgccgtcggcgagggcttgccgctcacggtcatccagttggtggggcgcgacgtcgactttatggcgcagggcgcacgcatggcccaggaggccggcgcggagatcatcgacctgaactttggttgcccggccaaggaagtcgccgctggcgcggcctgcggctcggctctgatgcgtgagcctgacctcgccgaagccctcgtcgcggcggccgtagaggccgtggatgttccggtgacggtcaagatgcggctgggctgggatatcgattgcctgaacgcccctgacatcgcgcggcgcgccgaagccgctggcgccaaggccgtcacggtgcatgggcgcacgcgcaaccagttctacaagggcgtcgcggattggacggcggtggcggcggtcaagcaggctgtctctgttccggtccttgtgaatggcgatatcgtcgacggtgaaaccgcgcgtcaggcgctggagcagtccggcgccgacggcgtgatgatcggccgtggcgtctatggccgcccctggatcgcgggcgcgatcgaggcggcgctggagggacgcggcttccaggagccggaggcggaagagcgtctggccatcgccatcacccacttccgacggagcctgtcgttctatggcgagcggctgggcttgaagatgttccgcaagcatctggcgtcgtacatcgaggctgcgccttggccggaaaccgccgaagcgcgaagggctgcgcgcgccagtctctgtcgccttgaagatcccgccgctgtggaaagcgccctccgtacgctttggctagccgaggggaggcaagccgcatga

SEQ ID NO: 94894 - protein, 315 aa, Caulobacter crescentus CB15
MTGVSDLPFRETASALGAPYVATEMVASAEFAKGRPDVVRRAAVGEGLPLTVIQLVGRDVDFMAQGARMAQEAGAEIIDLNFGCPAKEVAAGAACGSALMREPDLAEALVAAAVEAVDVPVTVKMRLGWDIDCLNAPDIARRAEAAGAKAVTVHGRTRNQFYKGVADWTAVAAVKQAVSVPVLVNGDIVDGETARQALEQSGADGVMIGRGVYGRPWIAGAIEAALEGRGFQEPEAEERLAIAITHFRRSLSFYGERLGLKMFRKHLASYIEAAPWPETAEARRAARASLCRLEDPAAVESALRTLWLAEGRQAA

SEQ ID NO: 94895 - DNA, 1008 bp, Chlamydophila pneumoniae AR39
  CDS (1)..(1008): transl_table=11
atggctgctccaatatttataaaaaatattttacttcgttcctctatagtctatgctcctctagcgggattttcagattatccctaccgttgcatgtccgcattgtatcaaccagggttgatgttttgtgaaatggtgaaagtagaagggatactctacgctcctgagcgtacttcgaagcttctagattataatgagaacatgcgtcccataggagcgcagttgtgcggtagtaatccagaaactagtggggaggccgctaaaattttagaaggccttggtttcgaccttatagacctaaattgtggatgtcctacagataaaatcaccaaagatggcagtgggtcaggtcttttgaagacgccagagcttattgggaggattttagataaaatcatcaatagcgtttccattcctgtaacagtaaaaattcgctcgggttgggatatggaacatatcaacgtagaggatacggtacgtattatacgtgatgctggagctagcgcagtttttgttcacgggagaactcgtgctcagggataccacggtcctagcaagcaagagtatatttctagagccaaggctgctgcaggaaaagaattcccagtttttggtaacggagatattttttctccagaagctgcgcaagcaatgctaactacaggatgtgatggtgttctggtagctcgaggaaccttgggagccccttggattggaaaacaaatccaagactatctcactacaggaagctatgagaaaattccctttatcaaaaggaaagctgcgtttctggagcatatgcgcctagtagaagactattatcaaagcgaaacgaagttcctttcagaaacacgtaaattatgtggccactacctaatttccgcggctaaggtgcgttttcttcgttcgtctctagcaaaagcgacatcctaccaagaagtctaccagcttgtgaatgattacgaagaagccgacgactcgtcattagagacctttgttaaatgctga

SEQ ID NO: 94896 - protein, 335 aa, Chlamydophila pneumoniae AR39
MAAPIFIKNILLRSSIVYAPLAGFSDYPYRCMSALYQPGLMFCEMVKVEGILYAPERTSKLLDYNENMRPIGAQLCGSNPETSGEAAKILEGLGFDLIDLNCGCPTDKITKDGSGSGLLKTPELIGRILDKIINSVSIPVTVKIRSGWDMEHINVEDTVRIIRDAGASAVFVHGRTRAQGYHGPSKQEYISRAKAAAGKEFPVFGNGDIFSPEAAQAMLTTGCDGVLVARGTLGAPWIGKQIQDYLTTGSYEKIPFIKRKAAFLEHMRLVEDYYQSETKFLSETRKLCGHYLISAAKVRFLRSSLAKATSYQEVYQLVNDYEEADDSSLETFVKC

SEQ ID NO: 94897 - DNA, 996 bp, Listeria innocua Clip11262
  CDS (1)..(996): transl_table=11
atgtttaaaatcggtaacgtagaaattaagaaccaagtagttgtggcgccaatggccggtatatccaattccgcatttcgtctaacagtcaaagaattcggagcaggcctagtttgctgtgaaatgattagtgacaaaggaatcgcataccgtaatgctaaaacacttgatatgctatatattgatgaaaaagaaaaaccactaagcttacaaatttttggtggtgagaaagaaacgcttgtggaggctgcgaaatttgtggctgaaaacactacagcagatattattgatattaatatgggctgccctgtaaacaaaattatcaaatgtgaagctggagcaaaatggttacttgatccaaataaagtttatgatatggtagctgctgttgtggatgctgttgataaacctgtaacagttaaaatgcgtatcggttgggacgaagaacatgtctttgctatcgaaaatgctctcgcggctgaacgtgcaggcgctgcagctgttgcaatgcatggtcgtactcgtgtccaaatgtacgaaggtagtgcaaactgggatgtgcttagagatgtaaaacgcgagctaaaaatcccgttcatggcaaatggtgacgtaagaacacctgaagatgccaaacggatcctagaacatacaggagctgatggcgtaatgatcggccgtgctgcacttggaaacccgtggatgatttacagaactgtgaaattcttggaaacaggagaactactaccagaaccagaaccacgcgaaaaaatggaaacagctatgcttcacttaaaccgtttagtcgaattaaaaggtgaaaacattgctgtacgcgaatttagacaacacgcagcatactatttaaaaggagctcgcggtagtacccgtgcaaaagtagctgctaaccaagcgacaaaacaatcagaaatggaagcaattttaaatgaatttgttcttcaatacgaagaaaaagcattagcaaaacaagattaa

SEQ ID NO: 94898 - protein, 331 aa, Listeria innocua Clip11262
MFKIGNVEIKNQVVVAPMAGISNSAFRLTVKEFGAGLVCCEMISDKGIAYRNAKTLDMLYIDEKEKPLSLQIFGGEKETLVEAAKFVAENTTADIIDINMGCPVNKIIKCEAGAKWLLDPNKVYDMVAAVVDAVDKPVTVKMRIGWDEEHVFAIENALAAERAGAAAVAMHGRTRVQMYEGSANWDVLRDVKRELKIPFMANGDVRTPEDAKRILEHTGADGVMIGRAALGNPWMIYRTVKFLETGELLPEPEPREKMETAMLHLNRLVELKGENIAVREFRQHAAYYLKGARGSTRAKVAANQATKQSEMEAILNEFVLQYEEKALAKQD

SEQ ID NO: 94899 - DNA, 1017 bp, Agrobacterium tumefaciens str. C58
  CDS (1)..(1017): transl_table=11
atgaaagatcatcatttgcctcttccggagttgtcagaaccgttcagcatcggctcagtcacgatccgtaatcgtgcggtgctggcgcccatgtcaggtgtgacggatctgcctttccggcagctggcctggcgttacggcgcaggtctggtcgtgacggaaatggtcgccagccgcgaactcgtcgctaacaggggcgaatcctgggcacggctgaaaaatgccggcatggttccgcatatggtgcagcttgccgggcgcgaagcgcattttatggccgaggccgcgaagattgctgctgacaacggtgctggcatcatcgacatcaatatgggttgtccggccaagaaggtgacgggcggttattccggctcggctttgatgcgcgatcccgatcatgccctgtcgctgatcgaggcgacggttggcgcggttgatgtgccggtaacgctgaagatgcggctcggctgggacgaaaacagcatcaacgcgccggaaattgcccgccgtgccgaggcggcaggcgtgcagctcatcaccattcatggtcgtacccgcatgcagttttatgaaggacgggcggattgggacgccatccgcgccgtgcgcgaggtgatttccgtgccgctgatcgccaatggtgacgtggaaacggccgaggatgcgcgcgaaatcctgcgtcgctccggtgcggatgccgtcatggtcggccgcggcgcgcaggggcagccttggctgccggctgtgctcgccggacattcagcgccgcaacgcgccgatattcccactatcgccgttgaacattacgagatgatgctggaattttatggaagggaagccggtctgcggcatgcccgtaaacatctgggctggtatctcgaccgttccgctcccgacatcgccacgccggaaaaggctcaaatcatgacatcgcgtgacacgggggaggtggcggatctgcttcgctccgccctgagcgaaaatgcgggcgaagaagccgcaaggaaggccgcatga

SEQ ID NO: 94900 - protein, 338 aa, Agrobacterium tumefaciens str. C58
MKDHHLPLPELSEPFSIGSVTIRNRAVLAPMSGVTDLPFRQLAWRYGAGLVVTEMVASRELVANRGESWARLKNAGMVPHMVQLAGREAHFMAEAAKIAADNGAGIIDINMGCPAKKVTGGYSGSALMRDPDHALSLIEATVGAVDVPVTLKMRLGWDENSINAPEIARRAEAAGVQLITIHGRTRMQFYEGRADWDAIRAVREVISVPLIANGDVETAEDAREILRRSGADAVMVGRGAQGQPWLPAVLAGHSAPQRADIPTIAVEHYEMMLEFYGREAGLRHARKHLGWYLDRSAPDIATPEKAQIMTSRDTGEVADLLRSALSENAGEEAARKAA

SEQ ID NO: 94901 - DNA, 1002 bp, Brucella melitensis 16M
  CDS (1)..(1002): transl_table=11
ttggtgacttccctcgatcaacctttgaatattcgcggtgtgatgctcaagaaccgcgtttttcttgcgccgatgtccggtgtttccgatctcccgtttcgcaagcgcgcggctgaggccggtgcgggtatggtcgtgtccgaaatggtggcgagtgcggagctgtgcaaccggcacagggaaagtctgttgcgcctttccggcgaggggctgggaacgcatgtggtgcagcttgcaggacgcgaggcgcgctggatgggggaggctgcaaaaatcgccgaaggcgagggtacggatatcattgatatcaatatgggctgccctgcgaaaaaggtgacgggcggctattccggttcggcgctgatgcgcaatctcgatcatgccatgacactggttgaggccacggttgcggcggtgaaagtacctgtcacgctgaagatgcgacttggctgggatgaaaacagcatcaatgcgccggagcttgccaggcgcgccgaagatgcgggtatcgccatggtgacggtgcatggccgcacgcgctgccagttttatgaaggcactgcagactgggatgcgatccatgcggtgcgcgatgcggtgagaatcccgcttgtcgccaatggagatgtctcatcgcgcgccgatgccgaggaaattctgcgccgctcgggggctgacgctgtaatggtgggacgtgcctcctatgggcagccatggctggcgggagcgatcgcgggaagtgatttcgcaccgcgtgatgcaaatggaattcttgattatattataagacattacgaagatatgctcgaccattatggcagcaaaataggcattcgtcacgcccgcaagcatctgggctggtatatggatcgccatgccgggcgcgccttcacgccggcagacaaggcggaactcatgacgttgacggatcgggctgcagtggttgaaaccctccggcgaatattcctgcgcgatgtcgatccgctgcgaaaggttgcctga

SEQ ID NO: 94902 - protein, 333 aa, Brucella melitensis 16M
MVTSLDQPLNIRGVMLKNRVFLAPMSGVSDLPFRKRAAEAGAGMVVSEMVASAELCNRHRESLLRLSGEGLGTHVVQLAGREARWMGEAAKIAEGEGTDIIDINMGCPAKKVTGGYSGSALMRNLDHAMTLVEATVAAVKVPVTLKMRLGWDENSINAPELARRAEDAGIAMVTVHGRTRCQFYEGTADWDAIHAVRDAVRIPLVANGDVSSRADAEEILRRSGADAVMVGRASYGQPWLAGAIAGSDFAPRDANGILDYIIRHYEDMLDHYGSKIGIRHARKHLGWYMDRHAGRAFTPADKAELMTLTDRAAVVETLRRIFLRDVDPLRKVA

SEQ ID NO: 94903 - DNA, 981 bp, Clostridium perfringens str. 13
  CDS (1)..(981): transl_table=11
atgaaaatatcaaacatagttttagaaaataatgttttcttagcacctatggcaggggttacagatatatcttttaggggattatgtaaagagatgggggcaggaattgtttgcactgaaatggttagtgcaaaggcattgtactatgggagtgaaaatacaaaagaattaatgagaattgcggatgaagaaaaaccggtatcttgtcagatgtttggaaatgatccagagataatggcttatgtcactgagaagcattttaatacaaatgatgatatatgtataatagatgtgaatatgggatgtcctgcacctaagatagtaaaaaatggtgaaggttcagccttaatgaaaaatcctaaattagcttatgagatcatgagtagcataaaaaaagttgcaacaaagcctgtaacagttaagtttagaatgggttttgatgaagaaaatataaatgctgttgagtttgctaaaatcatggaagaagcaggagtagatgccattgctgtacatggaagaactagggctcaaatgtatgaaggaaaagctaactgggatataataagacaagtaaaggaagcagttaatattcctgttataggaaatggagatgtatttactgcggaggatgctttaagtcttaaaaatcaaactaactgtgatggaattatggttgcaagaggaagtatgggaaacccatggatcttcaagcaaatagttcagaagttaaatggagaagaggtttatatgcctactccagaagaaaaaatagatatgtgtataagacactataatttatcacttaaatatgatggagagtataaggctgtaagagaaatgagaaaacatgcagcttggtatataaaaggattaaataattgtactgaagttaagaataggcttaatttagaagcagatccagagaagattatgggtatccttaatgagtataaagaatatttaatgaaaaatgatttataa

SEQ ID NO: 94904 - protein, 326 aa, Clostridium perfringens str. 13
MKISNIVLENNVFLAPMAGVTDISFRGLCKEMGAGIVCTEMVSAKALYYGSENTKELMRIADEEKPVSCQMFGNDPEIMAYVTEKHFNTNDDICIIDVNMGCPAPKIVKNGEGSALMKNPKLAYEIMSSIKKVATKPVTVKFRMGFDEENINAVEFAKIMEEAGVDAIAVHGRTRAQMYEGKANWDIIRQVKEAVNIPVIGNGDVFTAEDALSLKNQTNCDGIMVARGSMGNPWIFKQIVQKLNGEEVYMPTPEEKIDMCIRHYNLSLKYDGEYKAVREMRKHAAWYIKGLNNCTEVKNRLNLEADPEKIMGILNEYKEYLMKNDL

SEQ ID NO: 94905 - DNA, 1146 bp, Corynebacterium glutamicum ATCC 13032
  CDS (1)..(1146): transl_table=11
gtgactttaaaaatcggcccctttgaccttgcctcccctgtggttctagcccccatggctggtgtaaccaacgttgctttccgcacgctgtgccgtgaacaggaaatgcaacgcacgggaacaatctcggggctgtacgtctgtgaaatggtgactgcgcgtgctcttgttgagcgcaatgagaaaaccatgcacatgaccaccttcgcgccggatgaaaatccccgaagcttgcagctgtacacggttgacccgaagtacacctacgaagcggcgaagatgatcgttgatgaaaacttggcggatcatattgatatgaactttggctgcccggttccaaaggtcacgcgccggggtggcggttctgcgattccttacaagcgccgtttgtttgaaaacatcgtttccgcggctgtgaaggctacggaaggcacggacattccggtgacggtgaagttccgcgttggtattgatgatgagcaccatactcacttggatgctggacgcattgctgtcgacgccggcgcgaagtccgtagcgcttcacgcccgcactgcggcgcagcgctattccggtgaggctgattggaacgagatcgcgcgcctgaaggagcatttggcagataccggcatcccagttttgggcaatggcgatattttcgcggcatccgatgcaacgcgcatgatggagcaaactggctgcgatggcgtcgtggttgggcgtggttgcctgggcaggccttggctctttgctgagctgtctgctgctgttcgtggagaagaaatcccagaggagcctaccttcggcgaagttacccaaatcatcctgcgccacgcagaactcctcatgcagcatgatggcgaaaccaaggggctgcgcgatctgcgtaagcacatgggttggtacctgcgcggtttccctgttggcggcgaattccgctccaatctggccaaggtttccacctatgtggagcttgaggatctcctagcaccatgggctgactccaccgccaaggcagaggacgcggaaggtgcacgaggtcgacagggcgctcctgcaaaggtggcacttccagatggctggttggacgatcctgaggatgccactgttcctaaaggcgcagaaatggaaaactccggagggtag

SEQ ID NO: 94906 - protein, 381 aa, Corynebacterium glutamicum ATCC 13032
MTLKIGPFDLASPVVLAPMAGVTNVAFRTLCREQEMQRTGTISGLYVCEMVTARALVERNEKTMHMTTFAPDENPRSLQLYTVDPKYTYEAAKMIVDENLADHIDMNFGCPVPKVTRRGGGSAIPYKRRLFENIVSAAVKATEGTDIPVTVKFRVGIDDEHHTHLDAGRIAVDAGAKSVALHARTAAQRYSGEADWNEIARLKEHLADTGIPVLGNGDIFAASDATRMMEQTGCDGVVVGRGCLGRPWLFAELSAAVRGEEIPEEPTFGEVTQIILRHAELLMQHDGETKGLRDLRKHMGWYLRGFPVGGEFRSNLAKVSTYVELEDLLAPWADSTAKAEDAEGARGRQGAPAKVALPDGWLDDPEDATVPKGAEMENSGG

SEQ ID NO: 94907 - DNA, 924 bp, Fusobacterium nucleatum subsp. nucleatum ATCC 25586
  CDS (1)..(924): transl_table=11
atgaaaaaaatttatatagctcctattgcaggagtaacagattatacatttagagggatacttgaagattttaaacctgatttaatatttacagaaatggtaagtgtaaatgcactttcagttctaaatgataagactatttcaaaaattttaaaattaagagagggaaacgcagtccaaatttttggtgaagatattgaaaaaataaaggcaagtgtaaagtatatagagaacttaggtgtaaaacatattaacttaaattgtggttgtcctatgaaaaaaatagtaaattgtggatatggagcagctttggttaaggaaccagaaaaaataaaaaaaatattatctgaaataaaatcagttttaaataatgatacaaaattatctgtaaaaattagaataggatataaagagccagaaaattatattcaaattggaaaaatagcagaagaacttggttgtgaccacatcactgtacatggaagaacaagagagcaattgtattcaggaaaagcagattggaaatatattaaagaggttaaagataatatttctataccagttataggaaatggagatatttttacaggagaagatgctctggaaaaaatattttattcaaatgttgatggagttatgttggcaagaggaatttttggaaatccttggcttattagagatattagagaaattttagaatatggtgaaattaaaactcctacaacaaaaacagataaaataaatatggcaatagagcatttaaaaagaataagagttgataatgacaataaatttgtttttgatgtgagaaaatatatttcttggtatttaaaaggaattgaaaattgtgcagaagcaaagagaaaaataaatattattagtgattatgatgaaattataaaaatattagaagaaatgctttaa

SEQ ID NO: 94908 - protein, 307 aa, Fusobacterium nucleatum subsp. nucleatum ATCC 25586
MKKIYIAPIAGVTDYTFRGILEDFKPDLIFTEMVSVNALSVLNDKTISKILKLREGNAVQIFGEDIEKIKASVKYIENLGVKHINLNCGCPMKKIVNCGYGAALVKEPEKIKKILSEIKSVLNNDTKLSVKIRIGYKEPENYIQIGKIAEELGCDHITVHGRTREQLYSGKADWKYIKEVKDNISIPVIGNGDIFTGEDALEKIFYSNVDGVMLARGIFGNPWLIRDIREILEYGEIKTPTTKTDKINMAIEHLKRIRVDNDNKFVFDVRKYISWYLKGIENCAEAKRKINIISDYDEIIKILEEML

SEQ ID NO: 94909 - DNA, 1815 bp, Drosophila melanogaster
  CDS (1)..(1815)
atggattccggtatttgctacatcaaaccagaatacctggtaactgaagccgatggcggcagtgctgcagctaacaccgaaaacagcgacacaaacaaaagaaaacgcgaggacggtggagaagtggaagccggtgaaaaaaagaaatgggataaaaaggaacgcaaacgcggacagaacaagaaccgcccagttttcaaggacgagcggtactcgcatctgtgccactcgctgatcgatggaaccggtggagaaccttgttccctggccaactgtcgctatgtccacgacctggacgcctacttggccgccaagggagaagatttgggccctgaatgttatgtgtacaccaccaagggctactgtgcccgcggtgtgagttgtcgctttgcaaaggcccacactgatgaacagggcaggaacctcaaaagggaggactacgatgaaaatgctcctccaaccacatgcaatggcgtcagttcagaactccaagtgcgtctacgaaaacatgaatatgacttcagtcggagcaaggagcttattaaaatggctgaaaagctgagggatgcccgaaaactaaaggaacaacaggagaaggaaaagaatccgtctgaagagactggagaaaaacaacctagtgaaaccaccgagatattagatgcagaaaaacagacggatactaagagtaaaccaactgccactggttgtgcaattgatgattccgctatcggcagagatgctgaccataagcccgccgtggatttccgcgagaaactcgtgttgtcgccactgaccacgttgggcaatttgcctttccgccggatctgcaaggaattcggtgcagacatcacctgtggcgagatggcctgcgctcagcctctcctgaagggtatgggccaggagtgggccctgaccaagcgacaccagagcgaagatgtctttggagtccagctatgcggaaataatcccaacatgctcaaccaggcggcgcaggttattcatgagacggcccaggtggacttcattgatcttaatattggctgcccgatagatctgatctaccagcaaggcggtggcagtgcgctgatgcgacgaaccaatatcttggagctgacagtgcggagttgtgcagccctgtcggaccgcctgcccttcaccgtgaagatgcgcaccggcatctatgcagacaagagcgtagcgcacgaacttcttccgcttgttgaagagtggggtgcctcggcggtgaccctgcacgggcgatccagggagcagcgctacactaaacacgccaactgggcttacatcgaggagtgtgccgccaaggcaaagtgcatgccggtgatcggcaatggcgacatactcagctacgaggattacatggagcgaaggacgctggcgcctcacgtttgctccgtaatgattggacgcggcgcgttaataaagccctggatattccaagagataaaggagaaacaggcctggtccccatcgtccgggcaacgctacgagatgttgcaaaagttctgcaactacggactggagcactggggctcagacaccaagggcgtggagaccactcgccgattcctcctcgaatggcagtccttcttgtaccgatacatacccgaggctttgcagaccgcaccgccgcaaaagatcaacgctcgaccgcaaaagtaccgcggacgcgacgaaatggagacccttatgagttccggcaacgcagctgactgggtaaagcttagtgaatcgctgctgggtcgagtgcccgaaggcttcacctttgtacccaagcacaaggcgaatgccttctag

SEQ ID NO: 94910 - protein, 604 aa, Drosophila melanogaster
MDSGICYIKPEYLVTEADGGSAAANTENSDTNKRKREDGGEVEAGEKKKWDKKERKRGQNKNRPVFKDERYSHLCHSLIDGTGGEPCSLANCRYVHDLDAYLAAKGEDLGPECYVYTTKGYCARGVSCRFAKAHTDEQGRNLKREDYDENAPPTTCNGVSSELQVRLRKHEYDFSRSKELIKMAEKLRDARKLKEQQEKEKNPSEETGEKQPSETTEILDAEKQTDTKSKPTATGCAIDDSAIGRDADHKPAVDFREKLVLSPLTTLGNLPFRRICKEFGADITCGEMACAQPLLKGMGQEWALTKRHQSEDVFGVQLCGNNPNMLNQAAQVIHETAQVDFIDLNIGCPIDLIYQQGGGSALMRRTNILELTVRSCAALSDRLPFTVKMRTGIYADKSVAHELLPLVEEWGASAVTLHGRSREQRYTKHANWAYIEECAAKAKCMPVIGNGDILSYEDYMERRTLAPHVCSVMIGRGALIKPWIFQEIKEKQAWSPSSGQRYEMLQKFCNYGLEHWGSDTKGVETTRRFLLEWQSFLYRYIPEALQTAPPQKINARPQKYRGRDEMETLMSSGNAADWVKLSESLLGRVPEGFTFVPKHKANAF

SEQ ID NO: 94911 - DNA, 972 bp, Methanosarcina acetivorans C2A
  CDS (1)..(972): transl_table=11
atgaaacttaaaaaactaaaaattggcaggaccgaacttcccggaaatcttcttcttgcacccatggcagatgtaacaaatctggctttcagactgctttgcaggcaggatggagctgacctggcctacacagagatgatcaatgcagatgccctgctcaatgaaagcaggaaatcttttattaaagggctgaattctcctgaagacaggccttttggggttcagcttgtgggaagctgccctaagaaacttagggaagctgcactttttgttgaagaagagtatgaacctgaggtcatagacattaacatgggctgtcctgcaaaatgtatcacaggggctggttgcggctcggctctcctcaattctccggaacttgtccgtaaaataatctcagaacttgcggatgccctgaatactccggtcagcgcaaagatccgcctcctcggaaaggaggaaaaaacccttgaaattgcctgcctgatagaaaaggcaggagcatctgcccttaccgtgcacggtaggacagccgcacagatgtactcgggcaatgcgaaccttatggggataaaagcagtcaaaaatgagctttcgatccctgtgattgcaaacggggacatcaaggacgaggaatctgcaaaaaaaactctggagctgacaggctgcgacggacttatgatagggcgcgcagcaatgggaaacccttttatttttagaaggatcaggcactacctggaaaccggtgagaaacttgaggttgagagacaggccagacaacttgaagattttgaaaaatatatttcccttcttgagaaacacaacctgctttcatccataaacctcaggatgcacgcacactggtttactaaaggactgcatggctcgcggcacgtcagagaaaaaattaatagtctgaaagatgggaaggccataactgaactgatgagaagttcctgtcaggaaaaatattaa

SEQ ID NO: 94912 - protein, 323 aa, Methanosarcina acetivorans C2A
MKLKKLKIGRTELPGNLLLAPMADVTNLAFRLLCRQDGADLAYTEMINADALLNESRKSFIKGLNSPEDRPFGVQLVGSCPKKLREAALFVEEEYEPEVIDINMGCPAKCITGAGCGSALLNSPELVRKIISELADALNTPVSAKIRLLGKEEKTLEIACLIEKAGASALTVHGRTAAQMYSGNANLMGIKAVKNELSIPVIANGDIKDEESAKKTLELTGCDGLMIGRAAMGNPFIFRRIRHYLETGEKLEVERQARQLEDFEKYISLLEKHNLLSSINLRMHAHWFTKGLHGSRHVREKINSLKDGKAITELMRSSCQEKY

SEQ ID NO: 94913 - DNA, 969 bp, Thermoanaerobacter tengcongensis MB4
  CDS (1)..(969): transl_table=11
ttgaaaataggggatgtagttttagaaaataacgtatttttatcacctatggcaggagttacagataagccgttcagattgatatgtcaggaaatgggtgcaggacttacttatactgaaatggtaagcgctaaagggctttactatgggagtgaaaatacaaaggcacttttggatattgacgatggggaaaaagtagccattcagatatttggctctgaccccgagattatgggagagattgcaagaaggttgaatgaaagcaaagcgttaatcattgatataaacatgggatgccctactccaaagatagtaaaaaatggagatggagcagctttaatgttaaaaccggatttggctgaaaaagtgatggaggcggtggtaaaggcttcatataaaccagtaactgtaaaaataagaaaaggatggaatgataataatgtaaatgcagtagagattgcacaaattgctgagagagtaggcattaaagctgtagcggtacacgggaggacaagagaacagttttattcaggaaaagctgactgggagataattaaaaaagtcaaggaaagcgtaaagatacctgtaataggcaatggagatatatttacgccagaagatgcaaaaagaatgcttgatgaaacaggttgcgatgccgtaatgattgggagaggagcccagggcaatccgtggatatttaaaaggactgtccattatcttaaaacgggtgaacttttgcctgaacctacaataaaggaaaaagtagaccttatgataaggcatcttactatgatggttgagtataaaggtgaaagaacaggtgtggtagaaatgagaaagcacatcgcttggtatttaaaaggccttccaggcagtgcacgaatgagagaagcagtatttaaaatggaaagttataaagaaataaaagaatttttagaaggtattcctaaaatttacgaaaaagggtaa

SEQ ID NO: 94914 - protein, 322 aa, Thermoanaerobacter tengcongensis MB4
MKIGDVVLENNVFLSPMAGVTDKPFRLICQEMGAGLTYTEMVSAKGLYYGSENTKALLDIDDGEKVAIQIFGSDPEIMGEIARRLNESKALIIDINMGCPTPKIVKNGDGAALMLKPDLAEKVMEAVVKASYKPVTVKIRKGWNDNNVNAVEIAQIAERVGIKAVAVHGRTREQFYSGKADWEIIKKVKESVKIPVIGNGDIFTPEDAKRMLDETGCDAVMIGRGAQGNPWIFKRTVHYLKTGELLPEPTIKEKVDLMIRHLTMMVEYKGERTGVVEMRKHIAWYLKGLPGSARMREAVFKMESYKEIKEFLEGIPKIYEKG

SEQ ID NO: 94915 - DNA, 1059 bp, Chlorobium tepidum TLS
  CDS (1)..(1059): transl_table=11
atggaacaaagcgccatgcgcatcggaaccatcgacatcgaccgcccgatcattctcgcgcccatggaggatgtgaccgatcgggccttccggcagctctgcaagcagcacggggcggatatcgtctataccgagttcatcagcgcggaggcactgcggcgcggcgtggagaaatcgattcgcaagatcactgtggccgaccacgaacggccggttgcggtgcagattttcggcaacacggtcgagtcgatggtcgaggcggcggcgattgccgagacgtacgagccggattacctcgacatcaactttggctgtccggtgaaaaaggttgccggtcgcggcgccggagctgcgctgctgaaggagccggaaaagctttcggagatcgcctcggcagtggtcaacgcggtctcgctgccggtgacggccaagacccgtatcggctgggatcacgactcgatcaacatcaccgacactgtgcggcggctcgaagatgcgggtatccgggcggtggcggtgcatgggcggacgcgcagcgatatgtacaaggggcgggccgactggggacgcatcgccgaagcgaagcaggcgtgcagcattccggtgatcgctaatggcgacgtctggctgccggaagacgcggtggccatgttcgagcgcaccggtgcggatggcatcatgatcgggcgcggctcgatcggcaaccccttcattttcgagcaggcgaaaagtcttgtcaaagagggcgtgcgcctttcggctccgtcctatcgtcagcggattcaggctgctgtcgatcatcttcggctttcactggagtacaagggcgagaaatacggtgtgcttgagatgcgccgccactactcgacttatctgaaaggacttcccggtgtttcgaaagtgcgcaacctgctggtgcgcgaacccgatccggcggtgatcgtcgaattgctccgggagttcgaggctgcgtgcgaagcgctcgaccgcgaggggcttctgaaggaggggggtgaaaacctgaacgatcactcgcccagactgattctcaattactaa

SEQ ID NO: 94916 - protein, 352 aa, Chlorobium tepidum TLS
MEQSAMRIGTIDIDRPIILAPMEDVTDRAFRQLCKQHGADIVYTEFISAEALRRGVEKSIRKITVADHERPVAVQIFGNTVESMVEAAAIAETYEPDYLDINFGCPVKKVAGRGAGAALLKEPEKLSEIASAVVNAVSLPVTAKTRIGWDHDSINITDTVRRLEDAGIRAVAVHGRTRSDMYKGRADWGRIAEAKQACSIPVIANGDVWLPEDAVAMFERTGADGIMIGRGSIGNPFIFEQAKSLVKEGVRLSAPSYRQRIQAAVDHLRLSLEYKGEKYGVLEMRRHYSTYLKGLPGVSKVRNLLVREPDPAVIVELLREFEAACEALDREGLLKEGGENLNDHSPRLILNY

SEQ ID NO: 94917 - DNA, 1044 bp, Thermosynechococcus elongatus BP-1
  CDS (1)..(1044): transl_table=11
atgaagacgccaaccctgtcagcagcgctcaaagcccgtttagccacgccattgcagattggctctgttacggtcaatagtcgggtattgcagtcccctttggcaggtgtgacagacctcgtctttcgccgcttggtgcgccgctatgcccctgagtcgatgatgtacaccgagatggtcagtgcttcggggctgcattatctgaaaacattaccccggattatggaagtagatgccaatgagcatcccattagtattcagctttttgactgtcggcctgattttttagcagaagctgcgataaaggcagtggctgaaggggcggataccgtggacatcaatatgggctgccccgtgaacaaaatcacgaagaatggcggtggttcttccctgctgcgggatgtgcaaacggcagtagccattgtgcgtacggtctcaaaggcagtgcctgtgccagtcacggtgaaaactcgcattggctggagcgatgaggaaatcaatatccttgactttgccaaggcgatggaagatgctggcgcagcaatgattacggttcatgggcgtacccgtgcccagggctttaatggcccagcccgctgggagtggattgcgcgggtgaaggagcgcgtcagtattcccgtgattgccaatggcgatattttctcggtagaggcggccgtccgctgtttggagcaaaccggcgccgatggggtgatgtgctcgcggggaacgatgggatatcccttcttggtgggagaaattgatcactttttgaaaacgggggaattgcggccggcgccaacggtggttgagcgtctgcaatgtgcgcgggatcatctgattgccctctgggagtacaaaggggaacgggggattcgccaagcgcgcaagcatttgacgtggtatgccaagggctttgccgatgcagcagaactgcgcagtgaattgtgtcgcattgaaaccctagaggctggtttagctctcctcgatagagcaattgagcgcttacgaatggcctccgaaaccgaggcgatcgcggcctaa

SEQ ID NO: 94918 - protein, 347 aa, Thermosynechococcus elongatus BP-1
MKTPTLSAALKARLATPLQIGSVTVNSRVLQSPLAGVTDLVFRRLVRRYAPESMMYTEMVSASGLHYLKTLPRIMEVDANEHPISIQLFDCRPDFLAEAAIKAVAEGADTVDINMGCPVNKITKNGGGSSLLRDVQTAVAIVRTVSKAVPVPVTVKTRIGWSDEEINILDFAKAMEDAGAAMITVHGRTRAQGFNGPARWEWIARVKERVSIPVIANGDIFSVEAAVRCLEQTGADGVMCSRGTMGYPFLVGEIDHFLKTGELRPAPTVVERLQCARDHLIALWEYKGERGIRQARKHLTWYAKGFADAAELRSELCRIETLEAGLALLDRAIERLRMASETEAIAA

SEQ ID NO: 94919 - DNA, 1245 bp, Bifidobacterium longum NCC2705
  CDS (1)..(1245): transl_table=11
atggcacaatccgaatccgaaacagtgctcaccgagcatcacgagaccgacaacctcgacccacgtacggacgcgccggcgcgccccgggaccccggtgcatatcgccccggtccaactcggcaacatcaccgtgccgaccccggtggtgctctcgccgatggcgggagtgaccaactggcccttccgcgtgatttgcgaggaatatggtcccgatggactctacgtggccgagatgatcaccgctcgagccctcgtggcgcataacccgaaagcactgcgcctctgtcatttcgccaaaagcgaaaaaatccgttcactgcagttgtacggcgtgaacccctccatcaccgaacaggcggcgaaaatcgtggtcgacggcaacatggccgaccatgtggatctgaacttcggttgcccggtgcccaaggtcactcgtcgaggcggtggttcggccttgccttggaaaaccgacattttcactgagctattacagcgcgtggtcgccgtatgcgagccggcgggcatccccgtcaccgcgaagatccgcgtcggcatcgaccataaccatgagaccttcctcgaagccggacacatcgcgcaggaggagggctgcaaggccgtaaccctgcatgcccgtaccaccgccgaatactatggcggtcattccgactggtcccgcatcggcgagctcaaggaacacctcaacattccggtattcggcaatggcgatatctggggtgccgaggatgcgctcgaaatggtgcgcgagaccggctgcgacggtgtggccatcggccgcggatgccagggccggccgtggctgttcgccaacatcaaaaacgccttcgagggcaatcccgaacggctcaacccgaatctgggcgaggtctgccgcgtgattcaccgtcatgccgagctgcttaccgagttttatgagggcgatgagatgatggccgtccacgatctgcgcaagcacatcgcctggtatctgaaaggattcccggtgggcggctccacccgcaaggcctttatggaatgcgagagcctggccgatgtggaccgcgagatcggcaagctcgacccgactatcgaatacccgccacgcgtggtcgacaaaccgcgcggccgcgtgcgtttcgccaagaaggtgcacttgccgtatggctggttggaatcgcgtaccaccacccacgaagagcgtgaggcgctcttcggtgacgacccaatggacgccagttactga

SEQ ID NO: 94920 - protein, 414 aa, Bifidobacterium longum NCC2705
MAQSESETVLTEHHETDNLDPRTDAPARPGTPVHIAPVQLGNITVPTPVVLSPMAGVTNWPFRVICEEYGPDGLYVAEMITARALVAHNPKALRLCHFAKSEKIRSLQLYGVNPSITEQAAKIVVDGNMADHVDLNFGCPVPKVTRRGGGSALPWKTDIFTELLQRVVAVCEPAGIPVTAKIRVGIDHNHETFLEAGHIAQEEGCKAVTLHARTTAEYYGGHSDWSRIGELKEHLNIPVFGNGDIWGAEDALEMVRETGCDGVAIGRGCQGRPWLFANIKNAFEGNPERLNPNLGEVCRVIHRHAELLTEFYEGDEMMAVHDLRKHIAWYLKGFPVGGSTRKAFMECESLADVDREIGKLDPTIEYPPRVVDKPRGRVRFAKKVHLPYGWLESRTTTHEEREALFGDDPMDASY

SEQ ID NO: 94921 - DNA, 1002 bp, Brucella suis 1330
  CDS (1)..(1002): transl_table=11
ttggtgacttccctcgatcaacctttgaatattcgcggtgtgatgctcaagaaccgcgtttttcttgcgccgatgtccggtgtttccgatctcccgtttcgcaagcgcgcggctgaggccggtgcgggtatggtcgtgtccgaaatggtggcgagtgcggagctgtgcaaccggcacagggaaagtctgttgcgcctttccggcgaggggctgggaacgcatgtggtgcagcttgcaggacgcgaggcgcgctggatgggggaggctgcaaaaatcgccgaaggcgagggtgcggatatcattgatatcaatatgggctgccttgcgaaaaaggtgacgggcggctattccggttcggcgctgatgcgcaatctcgatcatgccatgacactggttgaggccacggttgcggcggtgaaagtacctgtcacgctgaagatgcgacttggctgggatgaaaacagcatcaatgcgccggagcttgccaggcgcgccgaagatgcgggtatcgccatggtgacggtgcatggccgcacgcgctgccagttttatgaaggcactgcagactgggatgcgatccatgcggtgcgcgatgcggtgagaatcccgcttgtcgccaatggagatgtctcatcgcgcgccgatgccgaggaaattctgcgccgctcgggggctgacgctgtaatggtgggacgtgcctcctatgggcagccatggctggcgggagcgatcgcgggaagtgatttcgcaccgcgtgatgcaaatggaattcttgattatattataagacattacgaagatatgctcgaccattatggcagcaaaataggcattcgtcacgcccgcgagcatctgggctggtatatggatcgccatgccgggcgcgccttcacgccggcagacaaggcggaactcatgacgttgacggatcgggctgcagtggttgaaaccctccggcgaatattcctgcgcgatgtcgatccgctgcgaaaggttgcctga

SEQ ID NO: 94922 - protein, 333 aa, Brucella suis 1330
MVTSLDQPLNIRGVMLKNRVFLAPMSGVSDLPFRKRAAEAGAGMVVSEMVASAELCNRHRESLLRLSGEGLGTHVVQLAGREARWMGEAAKIAEGEGADIIDINMGCLAKKVTGGYSGSALMRNLDHAMTLVEATVAAVKVPVTLKMRLGWDENSINAPELARRAEDAGIAMVTVHGRTRCQFYEGTADWDAIHAVRDAVRIPLVANGDVSSRADAEEILRRSGADAVMVGRASYGQPWLAGAIAGSDFAPRDANGILDYIIRHYEDMLDHYGSKIGIRHAREHLGWYMDRHAGRAFTPADKAELMTLTDRAAVVETLRRIFLRDVDPLRKVA

SEQ ID NO: 94923 - DNA, 1116 bp, Bradyrhizobium japonicum USDA 110
  CDS (1)..(1116)
atgacgcttgactgcacaagaattgtgcgcaagataggtcatggcaggtgcgatgaggccctgcgagtgaatgagaccactgtgaccggctcggcaggatcaggctccaagcccttgaaaataggcgatattgaggtcgccaccccggtcttcctggcaccgatgtcgggagtgactgactcgcccgtccggcggttggtcgccgagcttggggcaggtctggtggtgtccgaaatgaccgccagcgatgagctcgccaacggccaccggatgtcccggttgcgctgcgaagcgaccggaatcggtccgcacgtggtgcagctcgccggctgcgaggcgcactggatggccgaaggcgcccggatcgccgaagcggaaggcgccgatatcatcgacatcaatatgggctgtccggcccgccacgtcacgggcggccagtccggctcggccctgatgcgcgatctcgaccacgctgtcggcctgatcgatgcgacgatcgcggcggtgaaggtgccggtgacgctgaagatgcggctcggctgggacgaccgcagccgcaatgcgccggaactggcgcggcgcgcggaagccgcgggtatcaagctcgtgaccgtgcatggccgcacccgctgccagttctacaagggcgaggccgattgggatgcgatccgcaccgtgcgcgaggcgatctcgattccgctcatcgtcaacggcgacatcacctcgtacgagaaggcgctcgcggcgctcgaatcctccggcgccgacgccgtgatgatcggccgcggcgcacagggccagccctggctgcccggccagatcggccggcgcctgaagggcggggcggcggaagccacgccgtcgctcgcgacgcaactccattatgtccgcacgctttatgaaggcgtgtgcgcgctctacggcctgcgcgtcggtctcaagcatgcccgcaagcatctcggctgggcgctcgacgtcgccgccgatgcgagccgcgcgccggtcgagaagctgaaatcctggcgccggacaattctgacgtccgaagatccccgcctcgtccaccagtcactgcaagatgccttcgacgacttcgcatggagcgctgctgcatga

SEQ ID NO: 94924 - protein, 371 aa, Bradyrhizobium japonicum USDA 110
MTLDCTRIVRKIGHGRCDEALRVNETTVTGSAGSGSKPLKIGDIEVATPVFLAPMSGVTDSPVRRLVAELGAGLVVSEMTASDELANGHRMSRLRCEATGIGPHVVQLAGCEAHWMAEGARIAEAEGADIIDINMGCPARHVTGGQSGSALMRDLDHAVGLIDATIAAVKVPVTLKMRLGWDDRSRNAPELARRAEAAGIKLVTVHGRTRCQFYKGEADWDAIRTVREAISIPLIVNGDITSYEKALAALESSGADAVMIGRGAQGQPWLPGQIGRRLKGGAAEATPSLATQLHYVRTLYEGVCALYGLRVGLKHARKHLGWALDVAADASRAPVEKLKSWRRTILTSEDPRLVHQSLQDAFDDFAWSAAA

SEQ ID NO: 94925 - DNA, 969 bp, Clostridium tetani E88
  CDS (1)..(969): transl_table=11
atgaaaatatctagactagaactgaaagggaacgtttttttagccccactagcaggggttacagatttagcttttagaggtttatgtaaaagaatgggatgtactcttgtatatacggaaatggtaagcgcaaaggctcttttttatgacagtgacaaaaccaaagatatgttacgcttttctaaagaagaattacctatagcagtacagatatttggcaaggaaccagatattatggcaaatgtagtggaaaaatattttaatagtaacgataatgtatgtttgatagatataaatatgggatgtccagctcctaaaattgtaaagaatggagaaggatcagctctaatgaaaaatccaaaattggcatcagatattgtagagagcataaaaaaagtttctactaaaccagttacagtaaagtttaggaagggatttgataatgataatataaatgctttagaatttgctaaaataatggagaattcaggtgcagatgctttaaccatacatggtaggacaagagaacaaatgtatcaaggaaaagcagattgggaaatcataaagaaagttaaagaaagtgttaagataccagtaataggcaatggagatgtatttacaggtgaagacgcaataaatatgattgaaagtactaattgtgatggtgtaatggtagctagaggagctctaggaaacccatggatatttaatcaaataagtgaagcattaaaaggacaacagatattagaaccttctccagatgagatattggaggtttgtatagaacattttaaaagggctttatattattatgatgaaaaaaaagcagtaagagaaatgagaaaacatataggttggtatataaaaggattaaaaaattgtagcaaagtaaaagatactataaataaagaagtagataaggataaggtattaaatatattagaagaatatagaaaagaatttgtataa

SEQ ID NO: 94926 - protein, 322 aa, Clostridium tetani E88
MKISRLELKGNVFLAPLAGVTDLAFRGLCKRMGCTLVYTEMVSAKALFYDSDKTKDMLRFSKEELPIAVQIFGKEPDIMANVVEKYFNSNDNVCLIDINMGCPAPKIVKNGEGSALMKNPKLASDIVESIKKVSTKPVTVKFRKGFDNDNINALEFAKIMENSGADALTIHGRTREQMYQGKADWEIIKKVKESVKIPVIGNGDVFTGEDAINMIESTNCDGVMVARGALGNPWIFNQISEALKGQQILEPSPDEILEVCIEHFKRALYYYDEKKAVREMRKHIGWYIKGLKNCSKVKDTINKEVDKDKVLNILEEYRKEFV

SEQ ID NO: 94927 - DNA, 999 bp, Enterococcus faecalis V583
  CDS (1)..(999): transl_table=11
atgtggaaaattggagacgttgaaatccccaaccgtgttgtcgtagctccgatggcgggtattagtaacgccgcttttcgtgtgactgtaaaagaatttggcgcaggattagtcgtttgtgaaatgattagtgacaaaggaattaaattaagaaacaaaaaaaccttagaaatgctatatattgatgagcgggaatatcctttaagtgtacaaatttttggtggagataaagaaacattagtggaagctgctaagtttgtggaagaaaatacgcaagcggcgattattgatattaacatgggctgccctgtcaataaaataattaaagctgaagctggtgcgaaatggttgctggatccgaataaagtgcatgagatggttcacgcagtctcttcggcagtttctttgccggtcactgtaaaaatgcgaacaggctgggatgaagatcatctatatgctgtagacaacgctttggctgccgaacaagcaggggcttcggcaattgctatgcatggtcggacacgtgtccaaatgtatgaagggacagccaactgggacgttttaaaggaagtgaaaaagcatttaaccattccttttatgggaaatggcgatgtcaaaacgcctgaagatgctaaacgcatgttagaatatgttggagcggatggtgtgatgattggtcgagctgctttgggcaatccttggatgattcaacggacgaaagaatacttggaaacgggtgaattgatgcctgagccttcaccagctgaaaaaattaacattgcaaaagttcatttacaacgattagtggatttaaaaggtgaaaaaattgcggtccgtgagtttcgccaacatgcttcttactatctaaaaggaatctcgcgagcagccaaagtgaaagttgcgattaaccaagtcgaaacacaacaagcagttgtcgatttacttgatgcctttgtagaaaagatttccaaagttgctgtaactactatagaagaataa

SEQ ID NO: 94928 - protein, 332 aa, Enterococcus faecalis V583
MWKIGDVEIPNRVVVAPMAGISNAAFRVTVKEFGAGLVVCEMISDKGIKLRNKKTLEMLYIDEREYPLSVQIFGGDKETLVEAAKFVEENTQAAIIDINMGCPVNKIIKAEAGAKWLLDPNKVHEMVHAVSSAVSLPVTVKMRTGWDEDHLYAVDNALAAEQAGASAIAMHGRTRVQMYEGTANWDVLKEVKKHLTIPFMGNGDVKTPEDAKRMLEYVGADGVMIGRAALGNPWMIQRTKEYLETGELMPEPSPAEKINIAKVHLQRLVDLKGEKIAVREFRQHASYYLKGISRAAKVKVAINQVETQQAVVDLLDAFVEKISKVAVTTIEE

SEQ ID NO: 94929 - DNA, 1014 bp, Nitrosomonas europaea ATCC 19718
  CDS (1)..(1014): transl_table=11
atgcaaattggctcctatacgctcaagaataaattgatcgttgctcccatggcaggggtcaccgatcggccctttcggcaactgtgcaaacggatgggcgctgcgatggcggtttccgaaatggtttccagtaactcgctgttatatggatcggaaaaaacccggcgccgtgcctgtcacgacggagaggtaaaaccggtttcagtgcagattgcaggcgcagatccggttatgatggcacaagccgcgcgtcataatgcggatcagggtgccgaaatcatcgatatcaacatgggttgtcccgccaaaaaaatctgcaatgtcatggcgggatctgctttgctgaaagacgaaaatctggtcagcaggatacttgatgccgtagtgcaggccgtggatattccggtaactctgaagatcagaaccggttgggatacacagcacaaaaatgcaattaccgttgcgcgtattgcggaaagtgcaggcatacaggcgctggccatacatggccgtacgcgcgcctgtgcttaccgggggcaggcagaatatgacacgatcgctgcagtcaagacttcgatcagaattcccatcattgccaatggcgacatcactacaccggaaaaagcctgggcggtactcgaatataccggtgccgatgctgtcatgatcggtcgtgccgcccagggaaaaccttggattttccgcgaaactgatcattatctgacgacaggcagctttctgcctccccctgaggtagctgaaattcagcgtgtcctgatcgatcacctgtacgagttgtatcatttttacggtgaatactcgggtgtgcgaatagcgcgtaagcatatttcctggtacacacgcgggcttgccggttctgctgctttccgtcatgccatgaaccgattggcgacagttgaagaacagctggcagctacacagcagttttttgcagagctggccgatcagggccgcacgcttacttatatcgacgaagaggtcatcgaagcatga

SEQ ID NO: 94930 - protein, 337 aa, Nitrosomonas europaea ATCC 19718
MQIGSYTLKNKLIVAPMAGVTDRPFRQLCKRMGAAMAVSEMVSSNSLLYGSEKTRRRACHDGEVKPVSVQIAGADPVMMAQAARHNADQGAEIIDINMGCPAKKICNVMAGSALLKDENLVSRILDAVVQAVDIPVTLKIRTGWDTQHKNAITVARIAESAGIQALAIHGRTRACAYRGQAEYDTIAAVKTSIRIPIIANGDITTPEKAWAVLEYTGADAVMIGRAAQGKPWIFRETDHYLTTGSFLPPPEVAEIQRVLIDHLYELYHFYGEYSGVRIARKHISWYTRGLAGSAAFRHAMNRLATVEEQLAATQQFFAELADQGRTLTYIDEEVIEA

SEQ ID NO: 94931 - DNA, 975 bp, Bacillus anthracis str. Ames
  CDS (1)..(975): transl_table=11
atgaaaaatccggttgtattagcaccgatggcgggagtgtgtaactctgcattccgtttgacagtaaaagaattcggtgcaggactagtttgtgccgaaatggtaagtgataaagcgatactattgaataataaaagaacattagatatgttatatatcgatgagagagaaaagccattaagtttacaaatttttggtggagagaaagaaacccttgtagatgctgcgaaatacgtagatcaatatacgacagcagacatcattgatattaatatgggctgtccagtaccgaaaatcgttaagtgtgatgcaggagcaaagtggcttttagacccaaataaaatatatgaaatggtagcggcagttgtagatgctgtagaaaaaccagttacagttaaaatgcgtattggttgggatgaggatcatattttcgcaatcgagaatgcgaaagctgttgagcgtgctggtggacaagtggtagcagttcatggacgtacaagagtacaaatgtatgaaggaaaagcggattgggatattattaaacaagtaaagcaagctgtaaatatcccggttatcggaaatggtgatgtcgcaacgccacaagatgcaaagcgtatgcttgatgaaattggtgtagatggtgttatgattggccgcgctgcccttggagatccttggatgatttatcgtacggtaaagtatttagagacaggtgaattaatgccggaaccgacagtacgtgagaaaattgacgtatgtatgttgcatctagatcgtctaatcgatttaaagaacgaaagtgtcgctgtaagagagatgagaaagcatgcagcttggtatttaaaaggtattcgtggtaatgcaaatgtacgtaatggtataaatgcttgtaatacgcgtgaagaccttgcaaatgtattaggtgtatttgtagaagaagtggaagcgaaacaacaaacaattcacgttggttaa

SEQ ID NO: 94932 - protein, 324 aa, Bacillus anthracis str. Ames
MKNPVVLAPMAGVCNSAFRLTVKEFGAGLVCAEMVSDKAILLNNKRTLDMLYIDEREKPLSLQIFGGEKETLVDAAKYVDQYTTADIIDINMGCPVPKIVKCDAGAKWLLDPNKIYEMVAAVVDAVEKPVTVKMRIGWDEDHIFAIENAKAVERAGGQVVAVHGRTRVQMYEGKADWDIIKQVKQAVNIPVIGNGDVATPQDAKRMLDEIGVDGVMIGRAALGDPWMIYRTVKYLETGELMPEPTVREKIDVCMLHLDRLIDLKNESVAVREMRKHAAWYLKGIRGNANVRNGINACNTREDLANVLGVFVEEVEAKQQTIHVG

SEQ ID NO: 94933 - DNA, 1170 bp, Mycobacterium bovis AF2122/97
  CDS (1)..(1170): transl_table=11
atgagcaggaggcgggcaatccaacccagcccggcgttgcgcatcggcccgatcgagctcgccagcccggttgtgctggctccgatggccggtgtgacgaacgtcgcattccgggcgctgtgtcgtcagctggaacagtcgaaggtcggcacggtcagcggactgtatgtctgcgagatggtgaccgcacgtgcgctcatcgagcggcacccggtcaccatgcacatgacaacgttctccgcggacgaatcaccacgctcgctgcagctgtacaccgtcgatccggacaccacgtatgcggccgctcggatgatcgctggcgaagggttagccgatcacatcgacatgaatttcggctgcccagtgcccaaagtcaccaagcgcggctgcggggcggcgctaccgttcaaacggcggctattcggtcagatcgtggccgcggctgtgcgcgccaccgaaggcaccgatataccggtgacggtcaagtttcgcattggcatcgatgacgcccaccacacacatctggatgccggccgcatcgctgaggccgaaggagccgctgcggtcgcgctgcacgcccgtaccgcggcacaacgctattccggcaccgccgactgggaacagatcgcccggctcaagcagcatgtccggacgattccggtgctcggcaacggcgacatctacgatgccggcgacgcactggccatgatgtccaccaccggctgtgacggcgtggtcatcggccgtggctgcctgggccgtccctggctatttgccgagttgtccgcggctttcaccggcagcccggcccccaccccacccacgctcggcgaagtcgccgacatcatccgccgtcacggcaccttgctggccgcacacttcggcgaggacaagggcatgcgcgatatccgcaagcacatcgcctggtatctacatggcttcccggcgggctccgcgctccggcgggcgttagcaatggtcaagacgctcgacgagctcgactgcctgctggaccggttggacggcacggtaccgttcccggactccgcgactggcgcccggggccggcagggttcccccgcccgggtggcccttcccgacggctggctaaccgaccccgacgactgccgagtgccggaaggggcggacgccatggggtcgggtggctga

SEQ ID NO: 94934 - protein, 389 aa, Mycobacterium bovis AF2122/97
MSRRRAIQPSPALRIGPIELASPVVLAPMAGVTNVAFRALCRQLEQSKVGTVSGLYVCEMVTARALIERHPVTMHMTTFSADESPRSLQLYTVDPDTTYAAARMIAGEGLADHIDMNFGCPVPKVTKRGCGAALPFKRRLFGQIVAAAVRATEGTDIPVTVKFRIGIDDAHHTHLDAGRIAEAEGAAAVALHARTAAQRYSGTADWEQIARLKQHVRTIPVLGNGDIYDAGDALAMMSTTGCDGVVIGRGCLGRPWLFAELSAAFTGSPAPTPPTLGEVADIIRRHGTLLAAHFGEDKGMRDIRKHIAWYLHGFPAGSALRRALAMVKTLDELDCLLDRLDGTVPFPDSATGARGRQGSPARVALPDGWLTDPDDCRVPEGADAMGSGG

SEQ ID NO: 94935 - DNA, 987 bp, Helicobacter hepaticus ATCC 51449
  CDS (1)..(987): transl_table=11
atgatagaatttaataatctccttatgctcgcccctctcgcaggatacacagatttgccttttcgcagtgtggtaaaaagttttggtgtggatataacagtgagtgaaatgataagctctcacgctcttgtttataataatgcccgcacacttaaaatgattgaaaaatcccccgaagagcaaccttatagcgtgcaaatttcaggttcaaaagaagaagtgattaaaaaagcagtagagattttaaatgcacaaggaggcattgatgtcattgatttaaattgtggttgtcctgccccaaaggtagcaaatcacggcaatggcagcggtttgctcaaagaccttcatcttcttgttaaaattgctaatctcattaaagatagggctactacaccttatacgagcctcaaagtgcgcttgggttttgataaaaagattcctaatgaaatagcacaagctcttaaagatgtgcgttcagattttgtcgtagtgcatgggagaacgcgtgcagatggttataaaaaagagcgtattgattatgatgctattgctcatattaagcaacatatatcaatgcctcttattgctaatggcgagattgatagcgtggataaggctcaaaaagtcttctctcacacgggagcaaatggtgtaatgataggcagagcagctattacttcgccgtggattttttggcagattaaaaatcacacacacgatattccacctattgtcaaaaaagagcttattttgaagcattttaaaaaaatggtagaattttatggtgagcgtggggcgattatgtttcgtaagaatctccacgcctatgctaaaggacacgaaggggcaagtgtgtttagaaatgttattaataatgtgagtgatgttcctagcattatgcggcatatagaggagttttttgcgtgtaatgaagtcataacgcataagtttccccagcttgtgcatttaaataaaaggacaagctag

SEQ ID NO: 94936 - protein, 328 aa, Helicobacter hepaticus ATCC 51449
MIEFNNLLMLAPLAGYTDLPFRSVVKSFGVDITVSEMISSHALVYNNARTLKMIEKSPEEQPYSVQISGSKEEVIKKAVEILNAQGGIDVIDLNCGCPAPKVANHGNGSGLLKDLHLLVKIANLIKDRATTPYTSLKVRLGFDKKIPNEIAQALKDVRSDFVVVHGRTRADGYKKERIDYDAIAHIKQHISMPLIANGEIDSVDKAQKVFSHTGANGVMIGRAAITSPWIFWQIKNHTHDIPPIVKKELILKHFKKMVEFYGERGAIMFRKNLHAYAKGHEGASVFRNVINNVSDVPSIMRHIEEFFACNEVITHKFPQLVHLNKRTS

SEQ ID NO: 94937 - DNA, 1125 bp, Rhodopirellula baltica SH 1
  CDS (1)..(1125): transl_table=11
atgaactccccagcctctgaaacgaccgtttgcagcgaaactcctgccgctcccatctcgaccactccatacgaatggaacgaattgtccctgggcaatgtgcggatcggttttcctgtcgtccaagccgctctttcggggtacagcgatttgccgatgcgtgtgatcgcgcggcggcacagcgccagctacacaatttgcgaagtgatgctggatcaattccttctgtcgctgaccaaacgcgaaaagacgcggcactttctggacatcgcggacgaagagcatcccgtcggcgggcagttgatgggggcggagccggagcagttttccgccggagcgttgaagctggtcgaggccggatttgacgtcatcgatgtgaactttggatgcccggtcaaaaaggtgttgggacgatgccgcggcggattccacttgtctcagcccgctgtggcgatcgagattctccgtcggacgcgagacgtggtgccggaccacattccagtgacggtcaagatgcgacgcgggatggatgacactcccgaatcacgcgaacagtttttcgagattcttgatggtgcgatcgacgccgggttggctggcgtgaccgtgcatggccgaacggtgatgcagcgttacatcggcccgagtcgctgggcgtttttgaaagaggtcaagcagcacgttggcgatcggttgaagatcctcggcagcggcgatctgttcgcggccgtcgatggtttggagatgatgcgtcaaaccggaatcgacggtgtcacgatcgctcgcggagccatcggcaacccttggatcttccaacaatcgagagcactcgcggccggcgaacccttgccaccaccgccgacgattgccgagcaagccgcggtgatgcgggaacactttgcgttgtgcgaagagacttacacggtcgagcgtgccccgttgctgatgcgaaagttctgcatcaagtattcgcaaagccatccagattatcgtgaagttcgaatggcgttcacgcgtttgcgaactcgcgaggaattcgaagcggcactggaacagcattactcggccgacggaccgggccagaatgtgccccgcgaattgcacggttcgcaagaggagtgttga

SEQ ID NO: 94938 - protein, 374 aa, Rhodopirellula baltica SH 1
MNSPASETTVCSETPAAPISTTPYEWNELSLGNVRIGFPVVQAALSGYSDLPMRVIARRHSASYTICEVMLDQFLLSLTKREKTRHFLDIADEEHPVGGQLMGAEPEQFSAGALKLVEAGFDVIDVNFGCPVKKVLGRCRGGFHLSQPAVAIEILRRTRDVVPDHIPVTVKMRRGMDDTPESREQFFEILDGAIDAGLAGVTVHGRTVMQRYIGPSRWAFLKEVKQHVGDRLKILGSGDLFAAVDGLEMMRQTGIDGVTIARGAIGNPWIFQQSRALAAGEPLPPPPTIAEQAAVMREHFALCEETYTVERAPLLMRKFCIKYSQSHPDYREVRMAFTRLRTREEFEAALEQHYSADGPGQNVPRELHGSQEEC

SEQ ID NO: 94939 - DNA, 1095 bp, Rhodopirellula baltica SH 1
  CDS (1)..(1095): transl_table=11
atgattgagaaagacgccacgccagtatccgcccccacgcgaaccgtgccgccgcttcggattggtgatttggtcattgacccgccgattttgcaggcacccatggctgggttcaccaacgctgcgtttcgccacattgtacgtcaatttggcggtgccgggctgttggcgaccgaaatggtcaacgctcgtgggttcgtttggctggacgaaaatgaagccgagcaccccgatcgattgtggggggtggcggatgaaccccggccgctggcggttcaaatttgggacaacgatccggagaccatggccaaggtcggtcgccggttggcggaagagtatcgcgtcagcgtggttgatatcaattttgggtgcccggttcggcaagtcactgaaaaggctcacagcggaagctacttgctgcgggaacccaaccggatgcacgcgatcatttcgcgattggttcaggtttgtgccccgacgccggtgacggcgaaaatccgcttggggtgcagtcgcgaaaatatcaactgcaacgagatcgctcgggtggtcgaggaggctggtgcggcggcgctcaccgtgcatggtcggacggcagcggacatgttccgaggcaatgcggattgggaacggatcagcgagatcaaatcgcaccttcgcaacattccgttgatcggaaacggtgatttggatagtgcggagaaagtggtcgctgcattcgatcagtacgatgtcgatgcggtcatgatcgctcgcgcgtgcctggggcggccatggttgtttgcccaagccgccgcggcgctgcgaggcgaaccgatcccgcccgagccgactttgccggagcagcgcgatgtgatgctgaagcattatcaattggtggtggaccgctttggcgacgaaaagggaaccgtactgatgcggaagtacgcgtgttgctacgcccaaggcaagcacggagcccgttatttccggactcacgttgccaaggtttccacgccggaggaatttcactcggttgtcgaagagtatttcccgctgcacgatcccaaggcagcgaaggacaccgagagtgtttcgagcgctgcgggttcgtag

SEQ ID NO: 94940 - protein, 364 aa, Rhodopirellula baltica SH 1
MIEKDATPVSAPTRTVPPLRIGDLVIDPPILQAPMAGFTNAAFRHIVRQFGGAGLLATEMVNARGFVWLDENEAEHPDRLWGVADEPRPLAVQIWDNDPETMAKVGRRLAEEYRVSVVDINFGCPVRQVTEKAHSGSYLLREPNRMHAIISRLVQVCAPTPVTAKIRLGCSRENINCNEIARVVEEAGAAALTVHGRTAADMFRGNADWERISEIKSHLRNIPLIGNGDLDSAEKVVAAFDQYDVDAVMIARACLGRPWLFAQAAAALRGEPIPPEPTLPEQRDVMLKHYQLVVDRFGDEKGTVLMRKYACCYAQGKHGARYFRTHVAKVSTPEEFHSVVEEYFPLHDPKAAKDTESVSSAAGS

SEQ ID NO: 94941 - DNA, 1032 bp, Bordetella bronchiseptica RB50
  CDS (1)..(1032)
atgcgcatgcgcatcggtccctggtcccttcccaacaacgttctggtcgccccgatggccggggtgacggatcgtccctaccgccagctctgcaagcggctgggggcgggctatgcggtctcggaaatggccgcgagcaacccgcggctgtgggacagcgtcaagacctcgcgccgcttgaaccatgagggcgagatagacccgatttcggtgcagatcgccggcgctgaccccacgatgatggcggaagccgccgctttcaatgtcgccaagggcgcccgcatcatcgacatcaacatgggctgcccggtcaagaaggtgtgcaacgtggcgtccggctcggcgctgctgcgccacgaagacctgatcgtccgcatcctggaggccgtggtggcagcctgcgcgccgctgggcgtgccggtgacgctcaagacccgcaccggctgggaccgcgagcaccgcaacgccttgcgggtgggccgcctggccgaacaggcgggcatcgccgccctgaccctgcatggccgcacccgcgccgacctgtacaccggacaggccgagtacgacacgatacgggccgtcaaggccgaactgaagattcccgttatcgccaacggcgatatcgattcgcccgagaaagcgcgccaggtcctggattacactggcgccgacgccgtcatgatcggccgggccgcgcaggggcgtccctggatattccgggagatcgaccactacctgcgcaccggcgccaggctggcgccgccgtcgtacggcgagatgcgcgacctgctgctcgaacacctggacgaccactaccgcttctatggcgaacacaccggcgtacgcacggcgcgcaagcacataggctggtacctggacgacctgccgggcgcagccgcgttctgcgcccgcatgaaccagatcgacaacacgcgcgagcaatggcgcgcggtggccgactggttcgacaccattttgcgcgagggccgcgaccagcaggcctttgtggcgcaacccctgctggcggcatga

SEQ ID NO: 94942 - protein, 343 aa, Bordetella bronchiseptica RB50
MRMRIGPWSLPNNVLVAPMAGVTDRPYRQLCKRLGAGYAVSEMAASNPRLWDSVKTSRRLNHEGEIDPISVQIAGADPTMMAEAAAFNVAKGARIIDINMGCPVKKVCNVASGSALLRHEDLIVRILEAVVAACAPLGVPVTLKTRTGWDREHRNALRVGRLAEQAGIAALTLHGRTRADLYTGQAEYDTIRAVKAELKIPVIANGDIDSPEKARQVLDYTGADAVMIGRAAQGRPWIFREIDHYLRTGARLAPPSYGEMRDLLLEHLDDHYRFYGEHTGVRTARKHIGWYLDDLPGAAAFCARMNQIDNTREQWRAVADWFDTILREGRDQQAFVAQPLLAA

SEQ ID NO: 94943 - DNA, 1023 bp, Prochlorococcus marinus subsp. pastoris str. CCMP1986
  CDS (1)..(1023): transl_table=11
gtggatttttacataatgtcttcaattataaaattaagaggcaaaggtgtatcgagaataataaatagtaaagtaatgttgtctcctctcgcaggagttaccgataaaatatttagaaaattagtaagaaaatgggctccagaatctttactatttacagaaatgattaatgcgacaagtcttaaacatggatatggcactcagaaaataaaacaacttgaattagaaaaaggtcctataggtgtgcagatatttgataataggccctttgctgtttcagaggctgcaaaattggcagaagattcaggtgcatttctaattgatataaatatgggctgtccagtaaaaaaaatctcaagaaaagggggtggaagtgccttaattaatgatcgcttattagctattgaattagtaaaaagagtttcaaatgctgtaaaagtacctgttacagtcaaaacaaggcttggttgggaaaataaagaagagaatatagaggaatttctattaagtcttcaagatgcaggagctgaaatgataaccttacatggaagaactcgaaaagaaggcttttcaggtaaagcagactgggaaatgattggaaaaattaaagagcttttagaaataccagtaattgcaaatggagatattaagaatcctaaggacgcttataattgcttaaaaaaaacaaatgctgatggtttaatgattgggagaggcatacttggttctccctggaaaataggagaaatagattatgcagttaaagaaattaaaggttttgaagaaccaaatattgaagaaaaattgttattgattattgaacatttggatgaacttataaaagaaaagggcagtcatggtttattaatagccagaaaacatatttcatggacttgtaaaaattttccagaagctacaagtcttcgaaataaattagtaagagcaatagacgccaatgaggttaaagaattaataaataaagcgattaaaactttaaattatgaaaaaaaaatattaacctga

SEQ ID NO: 94944 - protein, 340 aa, Prochlorococcus marinus subsp. pastoris str. CCMP1986
MDFYIMSSIIKLRGKGVSRIINSKVMLSPLAGVTDKIFRKLVRKWAPESLLFTEMINATSLKHGYGTQKIKQLELEKGPIGVQIFDNRPFAVSEAAKLAEDSGAFLIDINMGCPVKKISRKGGGSALINDRLLAIELVKRVSNAVKVPVTVKTRLGWENKEENIEEFLLSLQDAGAEMITLHGRTRKEGFSGKADWEMIGKIKELLEIPVIANGDIKNPKDAYNCLKKTNADGLMIGRGILGSPWKIGEIDYAVKEIKGFEEPNIEEKLLLIIEHLDELIKEKGSHGLLIARKHISWTCKNFPEATSLRNKLVRAIDANEVKELINKAIKTLNYEKKILT

SEQ ID NO: 94945 - DNA, 1011 bp, Prochlorococcus marinus str. MIT 9313
  CDS (1)..(1011): transl_table=11
gtgcctgaactcagcctgcccggcaggggaacaacaagggcactgcgctgcagagtgctgcaatcgccccttgcaggcgtgagtgatcagatcttccgaagcctggttcggcgctgggcgccagatgcattgttattcacggaaatggtcaatgccaccagcctggagctgggccacggcctacagaaaatcaacgaactcgccaatgaagccgggcccattggcgtgcaattgttcgatcaccgcccagaagcgatggccgatgctgcacaacgagcagaggctgctggtgccttcctgatcgacatcaacatgggctgtcctgtgcgcaagattgcacgcaagggcggcggctctggtctgatccgtgacccacaactggcggcaaaaatcgtgagcactgttgctgcagcggtcaaaatcccagtcaccgtgaagacaaggctgggctggtgtggcagcgatgcaaaaccaattgaatggtgccaatcactcgagcaggccggcgcccagatgttgacattgcatgctcgaactcgagagcaaggcttcaaaggctcagctgattggcacgccatcgctgccgtcaaaagcgcactgcaaatccccgtgattgccaatggcgatgtcaagagcgacatagatgccaagcgctgcctagcgatcactggagccgatggcgtgatggtgggcagaggctcgctgggagcgccatggcttgtgggccaaatcgatgcagcactatccggccgcccagtgcctgcaacgcctggagcagcagagcgactcaccattgctcgtgaacaacttgaagcgctggttcaagcaaagggggaacatggcctcttgattgcccgtaaacacatgggatggacttgtagcggcttccccggcgcatcaaaactgcgccatgccctgatgcgtgcaccaacgccaatggatgccatatcactgttagagcaagccagcgcagaactactaacggcatggccagaagcgaccaacgcctaa

SEQ ID NO: 94946 - protein, 336 aa, Prochlorococcus marinus str. MIT 9313
MPELSLPGRGTTRALRCRVLQSPLAGVSDQIFRSLVRRWAPDALLFTEMVNATSLELGHGLQKINELANEAGPIGVQLFDHRPEAMADAAQRAEAAGAFLIDINMGCPVRKIARKGGGSGLIRDPQLAAKIVSTVAAAVKIPVTVKTRLGWCGSDAKPIEWCQSLEQAGAQMLTLHARTREQGFKGSADWHAIAAVKSALQIPVIANGDVKSDIDAKRCLAITGADGVMVGRGSLGAPWLVGQIDAALSGRPVPATPGAAERLTIAREQLEALVQAKGEHGLLIARKHMGWTCSGFPGASKLRHALMRAPTPMDAISLLEQASAELLTAWPEATNA

SEQ ID NO: 94947 - DNA, 1002 bp, Synechococcus sp. WH 8102
  CDS (1)..(1002): transl_table=11
atggtgaccatgctcgcctccactccgctgcagctttccgggtccggcacggcgcggcggctggagtgccgcgtgctgcagtcccccctggccggcgtaagcgaccgtgtcttccgtcatctggtgcgccgctgggctccggatgccctgctgttcacagagatggtgaatgccaccagccttgagcttggcttcgggcgcggcaaggtgaaggaactcggcgacgaacagggcccgatcggggtgcagctgttcgatcaccgcccggatgccatggccgatgcagcccgccgagccgaagacgcaggagcattcctgatcgacatcaacatggggtgcccggtgcgcaagattgcccgtaaaggcggcggatcaggactgatccgcgacccccacctcgccagccggatcatcgaagccgtggcaaacgccgtgcggttgcccgtcacggtgaagacacgactcggctggtgcggcagtgacgccgcccctcagacctggtgccggcagttgcaggaagccggtgcgcaactgctcaccctgcacggccggacccgcgagcaggggttcaaaggcaaggcggactgggctgctatcgccgccgttaagcaggccctcaccattccggtgatcgcgaacggagacatcaatactcccgaggatgcccagcgctgcctggcccagacaggcgccgacggcgtcatggtgggtcgcggaaccatgggagccccctggctggtagggcagatcgatgcggcactcaagggcctgccgattccagccacccctggccccgcagcccgcctgaccctggcccgggagcagctgctggcgctggtggaagcccgcggtgaacacggcctgttgatcgcccgaaagcacatgggctggacctgcaccggctttcccggagctccgcagctgcgtcatgccttgatgcgcgctcccaccccagaggacgccctagcgttattggagaaccaacgtctggccctggagtga

SEQ ID NO: 94948 - protein, 333 aa, Synechococcus sp. WH 8102
MVTMLASTPLQLSGSGTARRLECRVLQSPLAGVSDRVFRHLVRRWAPDALLFTEMVNATSLELGFGRGKVKELGDEQGPIGVQLFDHRPDAMADAARRAEDAGAFLIDINMGCPVRKIARKGGGSGLIRDPHLASRIIEAVANAVRLPVTVKTRLGWCGSDAAPQTWCRQLQEAGAQLLTLHGRTREQGFKGKADWAAIAAVKQALTIPVIANGDINTPEDAQRCLAQTGADGVMVGRGTMGAPWLVGQIDAALKGLPIPATPGPAARLTLAREQLLALVEARGEHGLLIARKHMGWTCTGFPGAPQLRHALMRAPTPEDALALLENQRLALE

SEQ ID NO: 94949 - DNA, 1059 bp, Chromobacterium violaceum ATCC 12472
  CDS (1)..(1059): transl_table=11
atgcagataggaccgcaccaactgaaaaaccggctgatcgtggcaccgatggccggggtgacggacaggcccttccgcatgctgtgcaaacggctgggggcggggatggccgtttccgagatgatcaccgccaacaaggcgctgtggaccacgcccaagacgctgcgccgcgccaatcatgaaggcgaggtcgagcccatcgtggtgcagatcgccggcggcgagccgcagatgctggccgacgcggccaggctgaacgtcgagcacggcgcccagatcatcgacatcaatatgggctgtccggcgaagaaggtgtgcaacgtggccgccggttcggcgctgctgcgcgacctggacaacgtcggccgcatcctggaagcggtggtgaaggcggtggacgtgccggtgacgctgaagacccgcaccggctggagccgcgaggtgaaaacggcgctggcggtggcgaagatggcggaagacgccggcatcgccgctttggcgctgcacggccgcacccgcgaggacatgtaccgcggcgacgccgagtacgacacgatacgcgcggtcaagcaggcggtgtccatcccggtggtggcgaacggcgacatcgattctccgcagaaggcgcgccacgtgctcgactataccggcgccgacgcgatcatgataggccgcgcggcgcaggggcggccgtggatcttccgcgagatccagcattacctggaaaccgggatcgaattgccgccgccgatggtgggcgagatccgcgagctgatgctgggccatctggacgagctttacggtttttacggcgagtattcgggctgccgcatcgcccgcaagcacatcgcctggtacaccaaggggctggcgggcggcaacgccttccgccaacagatgtacaagctggaaagcaccgacgagcagcggcgcgcggtgggtgagtatttctcccgactgagcgacgccggcgatcgtctaagctatgtagtcgaggatgaggacaagttggaccgcgacggcggcgccgtggcggagggcgaggcctgcggcgcttga

SEQ ID NO: 94950 - protein, 352 aa, Chromobacterium violaceum ATCC 12472
MQIGPHQLKNRLIVAPMAGVTDRPFRMLCKRLGAGMAVSEMITANKALWTTPKTLRRANHEGEVEPIVVQIAGGEPQMLADAARLNVEHGAQIIDINMGCPAKKVCNVAAGSALLRDLDNVGRILEAVVKAVDVPVTLKTRTGWSREVKTALAVAKMAEDAGIAALALHGRTREDMYRGDAEYDTIRAVKQAVSIPVVANGDIDSPQKARHVLDYTGADAIMIGRAAQGRPWIFREIQHYLETGIELPPPMVGEIRELMLGHLDELYGFYGEYSGCRIARKHIAWYTKGLAGGNAFRQQMYKLESTDEQRRAVGEYFSRLSDAGDRLSYVVEDEDKLDRDGGAVAEGEACGA

SEQ ID NO: 94951 - DNA, 948 bp, Chromobacterium violaceum ATCC 12472
  CDS (1)..(948): transl_table=11
atgaagctggtgcttgccccgatggagggcctggttgacgatgtgatgcgcgatgtgctgactcgcgtgggcggcatcgatctttgcgtgaccgagttcgtgcgcgtcacctccgtgctgctgcccacccgcaccttcatgcgtttggcgccggagctcgaccatcagggcaagacccgggccggcgtgccggtgcgggtgcagttgctgggctccgatgtttcctgtctggccgagaatggcgccaaggcggctagcttgggcgcgccgggcgtggacctgaatttcggctgtccggcgcccactgtcaaccgccaccgcggcggcgcggttttgctgaacgagccggaactgctgaaccagatcgtcgccgcggttcgccgcgcggtgccgccggaagtgccggtgacggccaagatgcgcttgggcttcgaggataaaagccgggcgctggagtgcgcgcaggcgatagccagcgccggcgccgacgaattgaccgtccacggccgcaccaaggtggagggctacaagccgccggcgcattgggactggatcgcccggatccgggaaagcgtgacgattccggtcacggccaacggcgaggtatggacgctggccgattaccgcgcgatccgggaggagagcggctgcgacacagtgatgatagggcgcggcctggtggcctgcccggatctggcgctcaggattgcggaaggtgggccggccgaacccatgtcctggggcgaaatgatgccttgggtgctggacttcttccgtctgtgccggcaaaagtcaggagaagagcgttatccggcagccaggctcaagcaatggctgggtctgctcaagcgcacctggccagaggccgagcgtttgtttgaaacggtaaggcgcgagcaagaggctgaaaagattgagaatattctgattgcaagacgggataagtaa

SEQ ID NO: 94952 - protein, 315 aa, Chromobacterium violaceum ATCC 12472
MKLVLAPMEGLVDDVMRDVLTRVGGIDLCVTEFVRVTSVLLPTRTFMRLAPELDHQGKTRAGVPVRVQLLGSDVSCLAENGAKAASLGAPGVDLNFGCPAPTVNRHRGGAVLLNEPELLNQIVAAVRRAVPPEVPVTAKMRLGFEDKSRALECAQAIASAGADELTVHGRTKVEGYKPPAHWDWIARIRESVTIPVTANGEVWTLADYRAIREESGCDTVMIGRGLVACPDLALRIAEGGPAEPMSWGEMMPWVLDFFRLCRQKSGEERYPAARLKQWLGLLKRTWPEAERLFETVRREQEAEKIENILIARRDK

SEQ ID NO: 94953 - DNA, 1002 bp, Porphyromonas gingivalis W83
  CDS (1)..(1002): transl_table=11
atgaaaataggtgccatagacctcggggtagagcctttgctactcgctccgatggaggatgtgacggatgtagccttccggatcatgtgcaagcagttcggtgccgatctggtttattccgaatttctcagtgccgatgccctgattcgtcaagtagccggcacattccgaaaaatggccatagatgaatcggaacgcccgatggctgtacagatatacggacgggatgtggcttcgatggtagaggctgcccgactatgcgaatcggccggtccgaatctgatcgatctgaacttcggatgtccggtcaaacgggtagcagggaaaggtgccggcagcggaatgctccgcaatatcccacttatgatagagataacgcgtgaggtagtcaaggcggtgaagttgccggtaacggtgaaaacgcggcttggctgggacaatgacagcaagatcatagtagacctggccgaacagctccaagactgtggcattgcagccctgaccatacatggtcgtacacgcgcccaaatgtacacggggacggctgactggacgctgatcggagaagtgaagaacaatccgagaatgcaaatccccattatcggaaacggagacgtgaccactccgcaagaagcccgacgagcctttgacgtatatggcgtggatgccgtaatggtaggcagggcttctatcggacaaccatggatattcgaggatatgaagcatttccttcgtacgggagaaacgttgccttcgcgtccgttttcctattatatggacatactccgccgtcagacgttgaacaacatccgaaaactggacgaacggcgaggtatcctccatacacgcagacatattgcagccagccccatattcaaagggattccaaacttcaaacccatgcgcgtggccatgcttcgtgccacgacacaggaggagcttttcgctcttatggacgaggtggagaagatgataggatcggctgattcagcggcggtatag

SEQ ID NO: 94954 - protein, 333 aa, Porphyromonas gingivalis W83
MKIGAIDLGVEPLLLAPMEDVTDVAFRIMCKQFGADLVYSEFLSADALIRQVAGTFRKMAIDESERPMAVQIYGRDVASMVEAARLCESAGPNLIDLNFGCPVKRVAGKGAGSGMLRNIPLMIEITREVVKAVKLPVTVKTRLGWDNDSKIIVDLAEQLQDCGIAALTIHGRTRAQMYTGTADWTLIGEVKNNPRMQIPIIGNGDVTTPQEARRAFDVYGVDAVMVGRASIGQPWIFEDMKHFLRTGETLPSRPFSYYMDILRRQTLNNIRKLDERRGILHTRRHIAASPIFKGIPNFKPMRVAMLRATTQEELFALMDEVEKMIGSADSAAV

SEQ ID NO: 94955 - DNA, 1041 bp, Wolinella succinogenes DSM 1740
  CDS (1)..(1041): transl_table=11
gtgccccctcgtgggcactctaaattttttgctataatcgcgcccaaaatccacccccaaaataaagaatcgatgcaacacccaaaatctctctcgttcaaaaatcttctcatgctagcccctttggctggctacaccgacctcccttttagaagcgtggccaaaagctttggcgcggatatcaccgtgagcgaaatgatcagcgtccatgcgctggcctacaagaatcggcgcactgccaaaatggtcgaaaaagcccccaacgagaatccctacagtgttcagattgcgggaaatcacctcgatatcatccaaagggcagtcgaggttcttaacgcctttgaaggaatcgacatcctcgacttaaatggcggctgtcccgcccccaaggtctcaggacatgggagtggaagctcgctccttaaggatttggataagatggtagagattttgcgtctcatcaaaaaaaccaccacgattccctacaccagcgtcaaagtgagaatcggttttgagaccaaaatccccgccgagatcgcccatgctctcaatgacgcccccattgattttgtcgtggtgcatgggcgcaccaagagcgatggctacaaaaaagagcgaatcgattatgattccattgcactcatgaaaaaaatcctcaaagtccctttgatcgccaatggagagatcgattccttttccaaagcccaagaggtgctcgcccacacgggtgcggatggtctcatgatcgggcgggcggccgtggccaagccttggatttttcgccaaatcaaggagggaatccacgaggccgatttggagctcagaagggcggtggcgttggaacattttgataaaaccatcgcctttagaggagagtttggcgcggtgatgtttcgcaagaatctccatgcctattccaaaggcctcgctggtgcgagcgattttcgcgacaaggtcaatcacctcacctctccagtactcatgcgcgaagcgatagaagaattctttttggcttcacaagttttagaatcttttggataa

SEQ ID NO: 94956 - protein, 346 aa, Wolinella succinogenes DSM 1740
MPPRGHSKFFAIIAPKIHPQNKESMQHPKSLSFKNLLMLAPLAGYTDLPFRSVAKSFGADITVSEMISVHALAYKNRRTAKMVEKAPNENPYSVQIAGNHLDIIQRAVEVLNAFEGIDILDLNGGCPAPKVSGHGSGSSLLKDLDKMVEILRLIKKTTTIPYTSVKVRIGFETKIPAEIAHALNDAPIDFVVVHGRTKSDGYKKERIDYDSIALMKKILKVPLIANGEIDSFSKAQEVLAHTGADGLMIGRAAVAKPWIFRQIKEGIHEADLELRRAVALEHFDKTIAFRGEFGAVMFRKNLHAYSKGLAGASDFRDKVNHLTSPVLMREAIEEFFLASQVLESFG

SEQ ID NO: 94957 - DNA, 1029 bp, Gloeobacter violaceus PCC 7421
  CDS (1)..(1029): transl_table=11
atggaactgtccgccacccaccgggcacgcctcgcttcacccctcaccatcggttcgcaccgcttcgccagccgcgtgctccaatcgcccctggccggggtgaccgacaaggcgtttcggcaactggtgcgccgctatgcgccgcactcgctgttgtacaccgagatggtgagcgcttcggggctgcactacagccgctcgctgccccagatcatggacatcgcgccgggcgagacgcccatcggcatccagctgttcgattgccgccccgactttctggcggaggcggcgcgcgtcgccgaggcccagggtgccgatgtgatcgacatcaacatgggttgcccggtcaacaagatcaccaaaaacggcggcggctcctcgctcctgcgcgatccggccaccgcggccaaaatcgtcgccgtagtcgcggcggcggtaagcctgccggtcaccgtcaagacgcgcctgggctggagcgacggggagatcaatatcctcgaatttgcgcgcctgatgcaagaaagcggcgcccagatgctcacggtccacgcccgcacccgcgcccagagtttcgaaggcaccgcccgctgggagtggatagcccgggtcaaagcgcaactggccatcccagtcatcgccaacggcgacatcttctcaatcgacgcggcgattcgctgtctggagttgaccggagcggacggcgtcatgtgcgcgcgcggcacgatgggggctccgcacttggtgggtcagatcgatcactatttgcgcaccggcgagcgactacccgatccgacaccccgcgcgcgcctggagatggcctgtgtccatctccacttgctttttgactatctcggagcgccgggggtacgccgggcgcgcaagcacatgggctggtacgtgcgcgactttcccggagcggcggctttgcgcgcccaactgatgtgcattgagactgtacccgagggagaaaggctgctgaacgaggccatcgagcgtctggaagcgaagccggtattgagtgcaaattag

SEQ ID NO: 94958 - protein, 342 aa, Gloeobacter violaceus PCC 7421
MELSATHRARLASPLTIGSHRFASRVLQSPLAGVTDKAFRQLVRRYAPHSLLYTEMVSASGLHYSRSLPQIMDIAPGETPIGIQLFDCRPDFLAEAARVAEAQGADVIDINMGCPVNKITKNGGGSSLLRDPATAAKIVAVVAAAVSLPVTVKTRLGWSDGEINILEFARLMQESGAQMLTVHARTRAQSFEGTARWEWIARVKAQLAIPVIANGDIFSIDAAIRCLELTGADGVMCARGTMGAPHLVGQIDHYLRTGERLPDPTPRARLEMACVHLHLLFDYLGAPGVRRARKHMGWYVRDFPGAAALRAQLMCIETVPEGERLLNEAIERLEAKPVLSAN

SEQ ID NO: 94959 - DNA, 933 bp, Photorhabdus luminescens subsp. laumondii TTO1
  CDS (1)..(933): transl_table=11
atgcgggttttactggctccgatggaaggtgtgctggactctttggttagggaacttctgagtgaaatcaatgagtacgatttgtgcattacggaatttttacgggttgtcgatagcctgttgccggtaaaatctttttatcgactttgtcctgaattacgtaaccaaagccggacaccatccggcacattggtacggattcagcttttgggtcaatatccacagtggctggcggaaaatgcggcacgagcgattgaattaggatcctatggggttgatttaaattgcggttgcccgtcaaaaacggtcaatggtagcggtggcggagcaacgttgctaaaagatcctgaactgatttatcagggagcgaaagcgatacgtgaagcggtacctgctcatttgcctgtgacggttaaggttcgcttgggttgggatagcggtgatcggcaatttgaaattgccgatgcggtacaacaggcgggtgcgacggaaatgacagttcatgggcgaaccaaagagcatggttaccgagcggagcgtattaactggcaagcgattggtgaaattcgtcaacgtctctctattccggttatcgctaacggtgaaatttgggattggcaaagtgcgcagaattgccagagtgtgacaggctgcgatgcggtcatgattgggcggggtgcgcttcacgttcctaatttgagccgagtggtgaaatataacgaaccaaaaatgtgctggcaggacgttgttcaactattgcaaaaatatatccgattggaaaagcagggtgataccgggcaatatcatgttgctcggattaaacagtggcttggttatttgcgtaaagaatatgaagaagcaacaatgctgtttgaagagataagaaagttaaaaacatctgctgatatagcgcatgtgatctctttggtatga

SEQ ID NO: 94960 - protein, 310 aa, Photorhabdus luminescens subsp. laumondii TTO1
MRVLLAPMEGVLDSLVRELLSEINEYDLCITEFLRVVDSLLPVKSFYRLCPELRNQSRTPSGTLVRIQLLGQYPQWLAENAARAIELGSYGVDLNCGCPSKTVNGSGGGATLLKDPELIYQGAKAIREAVPAHLPVTVKVRLGWDSGDRQFEIADAVQQAGATEMTVHGRTKEHGYRAERINWQAIGEIRQRLSIPVIANGEIWDWQSAQNCQSVTGCDAVMIGRGALHVPNLSRVVKYNEPKMCWQDVVQLLQKYIRLEKQGDTGQYHVARIKQWLGYLRKEYEEATMLFEEIRKLKTSADIAHVISLV

SEQ ID NO: 94961 - DNA, 966 bp, Photorhabdus luminescens subsp. laumondii TTO1
  CDS (1)..(966): transl_table=11
atgcgtatcggacaataccagctgaaaaactgtcttattgcggccccaatggctggcataactgaccgcccgtttcggtcactatgttacaaaatgggtgcaggtatgacagtatcggaaatgctttcttccaaccctcaggtctggaagacagacaaatcccggctacgtatggttcacagtgacgaaccgggaattcgttccgtgcaaattgctggaagtgatcccgatgaaatggcagcggcagcgaagatcaacgtcgctaatggtgctcagatcattgatatcaacatggggtgtccagccaagaaagtgaatcgtaagctagcaggttcggctttactacgttacccagaattggtcgaaaagatcctttctgccgttgtaaacgcagtagatgttcctgttacgctaaaaattcgcactggatggtcgccagaagaacgaaactgtgtaaagattgcccaattggccgagcattgtggtatccaagctctggcgatccacggcaggactcgttcctgtttgtttaacggagaggcagagtacgacaatattcggacagttaagcagactgttgccatcccggttattgccaatggcgacattactgacccgcttaaagccagagcagtgcttgaatacaccggggctgatgccctgatgataggccgcgctgctcagggaagaccctggatcttccgggaaatccagcactatctggcaacaggagaactgctgtcaccgatgccgattggcgaagtgcagcatttaatgaacgagcatatacaggaattgcacgacttttatggtccaagcaaaggagcccgtatcgcacgtaagcatgtatcctggtatctccgggagcatgctcctgatgaccagttccggcgcacattcaacaccatagaggatgccagcgaacagctggaggtgttgggggcatatttcgaaaattttgcgtaa

SEQ ID NO: 94962 - protein, 321 aa, Photorhabdus luminescens subsp. laumondii TTO1
MRIGQYQLKNCLIAAPMAGITDRPFRSLCYKMGAGMTVSEMLSSNPQVWKTDKSRLRMVHSDEPGIRSVQIAGSDPDEMAAAAKINVANGAQIIDINMGCPAKKVNRKLAGSALLRYPELVEKILSAVVNAVDVPVTLKIRTGWSPEERNCVKIAQLAEHCGIQALAIHGRTRSCLFNGEAEYDNIRTVKQTVAIPVIANGDITDPLKARAVLEYTGADALMIGRAAQGRPWIFREIQHYLATGELLSPMPIGEVQHLMNEHIQELHDFYGPSKGARIARKHVSWYLREHAPDDQFRRTFNTIEDASEQLEVLGAYFENFA

SEQ ID NO: 94963 - DNA, 996 bp, Rhodopseudomonas palustris CGA009
  CDS (1)..(996): transl_table=11
atgcagcccaatcagccacatcgcttctccgtcgcgccgatgatggattggaccgacagtcattgtcgcgtcttccatcggctgctgacccggcgcggcctgctctacaccgagatggtcaccaccggagcggtgatccacggtgaccggcagcggctgctcggcttcgacgcaagtgagcacccggtggcgctgcagctcggcggctccaatccgaatgacctcgcgacctccgcgaagatcggcgaggatttcggttacgacgagatcaacatcaacgtcggctgcccgtcggatcgggtgaaggagggccggttcggcgcctgcctgatggcggagcccgagctggttgccgaaggcgtcgccgcaatgaagcgtgccgtctctgtgccggtgacggtgaagtgccggatcgggatcgacgatcaggatccggaagtcgcgctcgatgcgctggcgcgggcggtggtcgccgccggtgccgatgcgctgatcgtgcacgcccgcaaggcttggctgaacgggctgtcgccgaaggagaaccgccatatcccgccgctcgattacgatcgggtgtatcggctgaagcaggcgatgccgcaggtgccgatcatcatcaacggcggcatcggcagcatcgcggaagccaagcggcatctcgagcacgtcgacggcgtaatgctcggccgcgccgcctatcaggagccgtggcggctgctggaggtcgatccggagctgtacggcgaaacggcgccctatccctcgatgaaggaggcgctcgaagcgctgatcccgtacatcgagcgccagcttgcgcagggcctgcggctgcacgcgattacccgccacgtcatcggcgcctatcagggcgtccccggcgcgcgcgccttccgccgctatctgtccgaattcggcgtcaaacccgatgccgatgccagcgtgctgttgaaagcgatggtcgcggtgacggagcgggcggagatcgcggccgcctga

SEQ ID NO: 94964 - protein, 331 aa, Rhodopseudomonas palustris CGA009
MQPNQPHRFSVAPMMDWTDSHCRVFHRLLTRRGLLYTEMVTTGAVIHGDRQRLLGFDASEHPVALQLGGSNPNDLATSAKIGEDFGYDEININVGCPSDRVKEGRFGACLMAEPELVAEGVAAMKRAVSVPVTVKCRIGIDDQDPEVALDALARAVVAAGADALIVHARKAWLNGLSPKENRHIPPLDYDRVYRLKQAMPQVPIIINGGIGSIAEAKRHLEHVDGVMLGRAAYQEPWRLLEVDPELYGETAPYPSMKEALEALIPYIERQLAQGLRLHAITRHVIGAYQGVPGARAFRRYLSEFGVKPDADASVLLKAMVAVTERAEIAAA

SEQ ID NO: 94965 - DNA, 1002 bp, Rhodopseudomonas palustris CGA009
  CDS (1)..(1002): transl_table=11
ttgaggattggcaatattgcggtgcctgatccggtgttcttggcgccgatgacaggcattaccgatgtgccgttccgccggcaagtcgcggagctgggggccggtctggtggtgtcggagatgactgccagcgaagatctggtggccggccggcggatgtcggtccgtcgctgcgacaaggtcggccaagggccgcacgtcgtccagcttgccggctgcgaggcgcgctggatggcggagggcgcgcggatcgcggaagccggcggcgccgacatcatcgacatcaacatgggctgcccggcgcggcacgtcaccggcggtctgtccggttcggcgctgatgcgcgaccttgatcacgcgctgacgctgatcgaagcaacgatcggcgcggtgcgggtgccggtgacgctgaagatgcggctcggctgggacgatcgttcgcgcaacgcgccggagctggcgcggcgtgcgcaggacgccggtgttcagcttgtcacggttcacggccgcacccggcagcagttctacaagggcgaagccgattgggacgcggtgcgcgccgtcagggatgcgatctcgattccgctggtggtcaatggtgatatcacctgccacgccagcgcggtcgaagcgctgaagcgctccggtgccgatgcagtgatgatcggtcgcggcgcgcaggggcggccgtggctgccggggcaggtcggccgccagctcaccacgggaaaagccgagggtgagccgtcgttgaccatgcagcgcgattacttgcgcacgctctatgacgacatcctggcgctgtacggcgtcaagatcgggctgcgtcatgcccgcaagcacctcggctggtcgctcgaggtcgccgcctcaaccgccggcgcctcgccggacgttctgaagagctggcgcgccgtcattctgaccgaagagaatccggcccgcgtgcaccgtgcgctcgccgatgcctacgaagaattcgcctggagggccgccgcatga

SEQ ID NO: 94966 - protein, 333 aa, Rhodopseudomonas palustris CGA009
MRIGNIAVPDPVFLAPMTGITDVPFRRQVAELGAGLVVSEMTASEDLVAGRRMSVRRCDKVGQGPHVVQLAGCEARWMAEGARIAEAGGADIIDINMGCPARHVTGGLSGSALMRDLDHALTLIEATIGAVRVPVTLKMRLGWDDRSRNAPELARRAQDAGVQLVTVHGRTRQQFYKGEADWDAVRAVRDAISIPLVVNGDITCHASAVEALKRSGADAVMIGRGAQGRPWLPGQVGRQLTTGKAEGEPSLTMQRDYLRTLYDDILALYGVKIGLRHARKHLGWSLEVAASTAGASPDVLKSWRAVILTEENPARVHRALADAYEEFAWRAAA

SEQ ID NO: 94967 - DNA, 978 bp, Geobacter sulfurreducens PCA
  CDS (1)..(978): transl_table=11
atgatccgttctcttaccataggctccctgaccctgggaaacaatctcatcctcgcccccatggccgggataaccaaccttcccttccgcctcctggcccgcgaacagggggcaggtctctgcttcaccgagatggtgagcgtgaacggccttgtccgggaaggtaaaaagagtttcgaactcctgcggagcgtgccgggggatcgccccctcggcatccagcttttcggggacgacccggacgtcatgggccgggtggcggccactgtggacggatacggggacctcatcgacatcaacatgggatgccccgtgaagaaggtggtggggaccggcgccgggagcgccctcatgcgtgagccggacaaggtgcgggccattgtcagggccgtccggcgagccacgcggctgccgctgaccgtgaagatcaggagcgggtggagctgcgaagatgccaactttatccagattgcccggattgccgaggaagagggatgcaatgcagttacgctccatccccggagcagggcacagatgttcgaaggcacggccgactggacgaagctcgccgaactgaagcaggccgtcgccataccggtcatcggcagcggcgacctcttcagcgcggccgacgtggccgccatgctcgaccggaccggctgcgacggggtcatgatcgcccgaggtgctctgggaaatccgtggatcttcaggcaggccctggacctgatggccggacgcgagccggcggcggcctccccggccgaacggttggcggtggcccggaggcatctggccctgttcacggaaatggccggcgaacgggtagccgcgagagagatgcgcaagcacctggggtggtactcccacggactccccggtgcggcacagttccggaaggaaatcaacgagattgagggcaatggcgccctgatggaagcagtgagccgctttttcacggctgtgggggcgccatga

SEQ ID NO: 94968 - protein, 325 aa, Geobacter sulfurreducens PCA
MIRSLTIGSLTLGNNLILAPMAGITNLPFRLLAREQGAGLCFTEMVSVNGLVREGKKSFELLRSVPGDRPLGIQLFGDDPDVMGRVAATVDGYGDLIDINMGCPVKKVVGTGAGSALMREPDKVRAIVRAVRRATRLPLTVKIRSGWSCEDANFIQIARIAEEEGCNAVTLHPRSRAQMFEGTADWTKLAELKQAVAIPVIGSGDLFSAADVAAMLDRTGCDGVMIARGALGNPWIFRQALDLMAGREPAAASPAERLAVARRHLALFTEMAGERVAAREMRKHLGWYSHGLPGAAQFRKEINEIEGNGALMEAVSRFFTAVGAP

SEQ ID NO: 94969 - DNA, 1134 bp, Mycobacterium avium subsp. paratuberculosis str. k10
  CDS (1)..(1134): transl_table=11
ttgcgtatcggccccatcgagctggccagcccggtggtgctggctcccatggccggggtcaccaacgtcgcgtttcgcaccctgtgccgtgagctggagcgggagctggtcgggacggtcagcggactctacgtctacgaaatggtgacggcacgcgcgctcgtcgagcggcacccggccaccatgcacatgatcacgttcgcccccgacgagtcgccgcggtcgctgcagctctacactgtcgacccggccaccacctacgcggcggccaagatgatcgccgacgagggcctcgccgatcacatcgacatgaacttcggctgcccggtgcccaaggtcaccaagcgcggcggcggctcggcgctgccctacaaacgacgcctgttcgggcagatcgtcgccgcggcggtgcgcgccacgcagggcaccgagataccggtgaccgtcaagttccgcatcggtatcgacgacgagcaccacacgcatctggatgccgggcgcatcgccgaggccgagggtgccgcggcggtcgcgctgcacgcccgcaccgcggcgcagcggtattccggcaccgcggactgggaacagatcgccctgctcaagcagcaggtgcgcaccattccggtgctgggcaacggcgacatctacgacgccagcgacgcgctgaccatgatggccgccaccgggtgcgacggcgtggtcatcggccgcggctgtctgggccggccgtggctgttcgccgagctgtcggccgcgttcaccggcagcccgccgcccacgccgcccaccctggggcaggtggccgacatcgtgcgccggcacgggcggctgctggccgcccacttcggcgaggacaagggcatgcgcgacatccgcaagcacatcgcctggtacctgcacggcttcccggccggttccgagctgcggcgcgcgctggcgatggtcaagacgctcgacgagctggaccgcctgctcgaccggttggacggctcggtgccgttcccggacgaggcgaccgggccccgggggcggcagggttcacccgcccgggtggtgctgccggagggctggctcgacgacccggacgactgcacggtgccggccggcgccgacatcatgcactccggcggctga

SEQ ID NO: 94970 - protein, 377 aa, Mycobacterium avium subsp. paratuberculosis str. k10
MRIGPIELASPVVLAPMAGVTNVAFRTLCRELERELVGTVSGLYVYEMVTARALVERHPATMHMITFAPDESPRSLQLYTVDPATTYAAAKMIADEGLADHIDMNFGCPVPKVTKRGGGSALPYKRRLFGQIVAAAVRATQGTEIPVTVKFRIGIDDEHHTHLDAGRIAEAEGAAAVALHARTAAQRYSGTADWEQIALLKQQVRTIPVLGNGDIYDASDALTMMAATGCDGVVIGRGCLGRPWLFAELSAAFTGSPPPTPPTLGQVADIVRRHGRLLAAHFGEDKGMRDIRKHIAWYLHGFPAGSELRRALAMVKTLDELDRLLDRLDGSVPFPDEATGPRGRQGSPARVVLPEGWLDDPDDCTVPAGADIMHSGG

SEQ ID NO: 94971 - DNA, 1008 bp, Lactobacillus johnsonii NCC 533
  CDS (1)..(1008): transl_table=11
gtgaaaaacgatagttggaaaattagggatgttgaaattcctaatcgtgtagtagttgcaccgatggctggaatttcaaatgctgctttccgagtagtatgtaaagaatttggtgcaggcctagtagtgtgtgaaatgatttcagatcatggaattatttatcgcaataaaaagaccttggaaatgttaacggttgatcctcgtgaacatccaatgagtattcaaatttttggtggtagtgaggaaactttagttgaagctgctcattatgttgatactcatacagcagctgatattatcaatattaatatgggttgtcctgtaccaaaggtaacaaaaactgatgccggagctcgttggctattagatccaaataagatctatcaaatggtccatgcagttgttcgtaatgtaagtaaaccagttactgttaaaatgagaacaggctgggatcaaaaacatatttttgctgttgaaaatgctttagctgctcaagaagcaggtgctagtgctgttgctatgcatggccggactagaaagcaaatgtacatgggcgaagctgactgggaaactttgaaggatgtagcagatgctttgactattccttttgttggtaatggggatgttactactcctgaaaaggcaaaagcaatgttagaagatgttggagcagatgcagtgatggttggtagagcggctttagggaatccatggattattaaagatatggttcactatttggataccggagagaaactacgtccacaaactgttgaagaaaaagtagaaactgctaaagatcaattaaatagattgattgatttaaagggagaaaaaattgctgttcccgaatttagaagacaagcagcttattatttaaaaggaattccccgttcagctcgaacccgtgctaaaataaatgatgtttggacgaaaaaagaagtttttgacttgttagatgattttgtggaaaaatatgaagcgagacaaaagcaaattaaccaataa

SEQ ID NO: 94972 - protein, 335 aa, Lactobacillus johnsonii NCC 533
MKNDSWKIRDVEIPNRVVVAPMAGISNAAFRVVCKEFGAGLVVCEMISDHGIIYRNKKTLEMLTVDPREHPMSIQIFGGSEETLVEAAHYVDTHTAADIININMGCPVPKVTKTDAGARWLLDPNKIYQMVHAVVRNVSKPVTVKMRTGWDQKHIFAVENALAAQEAGASAVAMHGRTRKQMYMGEADWETLKDVADALTIPFVGNGDVTTPEKAKAMLEDVGADAVMVGRAALGNPWIIKDMVHYLDTGEKLRPQTVEEKVETAKDQLNRLIDLKGEKIAVPEFRRQAAYYLKGIPRSARTRAKINDVWTKKEVFDLLDDFVEKYEARQKQINQ

SEQ ID NO: 94973 - DNA, 963 bp, Wolbachia endosymbiont of Drosophila melanogaster
  CDS (1)..(963): transl_table=11
atgcccctccaaataggaaatttgacaattgattctccagttattttagctccaatgtctggagtgactgattatccgtttagaagtattgtgaagaaacttggtgcaagtttgttagtttcagagatgatcgcaagcagagctatgattatgcaaactcgccagagtttgcaaaaagcaaaagtcgatgcattaactgctgtgcagcttgctgggtgtgagccagatgttatggcggaggctgcaaaattaaacgaggacatgggagcaaaaattatagacataaactttggttgccctgttaaaaaagttgtaaacggttatgcaggatcagcgctaatgcgtgatgagaaaaaagccgctgagataattgaagctgtggtcaaagcagtgaatatgccagttacggtaaaaatgcgcactggatggaacgatgaaaatcgcaatgccccgagacttgcgaaaattgccgaagacttaggagcaaaaatgatcactgtgcatggaagaacaagagcgcagctttataatggtcaagcagattggaaattcgttagaaatgttaaagagcaagtgaaaattccagttatagtaaatggcgatattaaaaatttaaatgatattcagaatgctctcaaagaatctggagcagacggagtgatgataggtcgtggtgcctacggtaaaccttggctgattaatcaagcaatgaactttctcagtggaagtgaaacttctgagccaacagcttcagagagattaagcatcatactcgagcattacgacaatattcttgagtactatggaaatgacacaggaataaagatggcccgcaaacacataggttggtacagtagcgggcttcaaggctcatctgaatttcgtgtgagagtaaataacatgacagatagcacagaagtgaaagaaaatattattggcttttttggtcaagagacacactag

SEQ ID NO: 94974 - protein, 320 aa, Wolbachia endosymbiont of Drosophila melanogaster
MPLQIGNLTIDSPVILAPMSGVTDYPFRSIVKKLGASLLVSEMIASRAMIMQTRQSLQKAKVDALTAVQLAGCEPDVMAEAAKLNEDMGAKIIDINFGCPVKKVVNGYAGSALMRDEKKAAEIIEAVVKAVNMPVTVKMRTGWNDENRNAPRLAKIAEDLGAKMITVHGRTRAQLYNGQADWKFVRNVKEQVKIPVIVNGDIKNLNDIQNALKESGADGVMIGRGAYGKPWLINQAMNFLSGSETSEPTASERLSIILEHYDNILEYYGNDTGIKMARKHIGWYSSGLQGSSEFRVRVNNMTDSTEVKENIIGFFGQETH

SEQ ID NO: 94975 - DNA, 1014 bp, Bdellovibrio bacteriovorus HD100
  CDS (1)..(1014): transl_table=11
atgaatccagttgaagccttaaagacaaatccctttgtccttgcccctatggccgggatcacggatcacgcttttcgcacctttatcaaaaaactagatgccagtgttgtcgtcaccgaacttgtcagtgccagcggtattgaatacaagtccgatcgcactttgaagctgatgagctttgatgaatctcagcgccccatcggcatccagctttttggtgaagagcccgagatcgtggcgcgtgccgctcaggtggccgaggccgatggctgtgactttgtggatctgaactttggttgtcctgttccgaaagtcgtgaagaagggggcgggttccgccattctgaaagacccggcggccgtgcaaaagatggtttccaccgtcaaagcggcaattaaaattcctctgacaatcaagatccgcacgggctgggatgcgaattcccgcaacgccactgagatttgtaatattgcctacaacgaaggggtttcctgggttgcgatccatggtcgtacccgcgctcagtcctataccggacttgcggactgggacttcatcgcagatgtaaaagccaataccaagattcccattcttggaaacggagacatcctcactcctcgtcaggccaacttaagactgcagcagtccggttgtgacggggtgatgatcggccggggatgccttaaaaacccgtttatcttcatggacgccctgtccttgtggcgaggcgagccgattaaggacgtgaagagggattatgtgagtctgttccagggtctgcaaaaagagatcgtggcgcattgtgatgagcacatcaccgggatccagctcagaaagtttgcagcttggttctcaacagggtattctggagcggctcaattccgtaagaatctattccagtccaaaagcaatgacgagatcatggccttagcgaatgagtttttcgcaagtattggaaatgtagaacaagaagataccagtcaggaagatttcttaatgggcggtcacggttaa

SEQ ID NO: 94976 - protein, 337 aa, Bdellovibrio bacteriovorus HD100
MNPVEALKTNPFVLAPMAGITDHAFRTFIKKLDASVVVTELVSASGIEYKSDRTLKLMSFDESQRPIGIQLFGEEPEIVARAAQVAEADGCDFVDLNFGCPVPKVVKKGAGSAILKDPAAVQKMVSTVKAAIKIPLTIKIRTGWDANSRNATEICNIAYNEGVSWVAIHGRTRAQSYTGLADWDFIADVKANTKIPILGNGDILTPRQANLRLQQSGCDGVMIGRGCLKNPFIFMDALSLWRGEPIKDVKRDYVSLFQGLQKEIVAHCDEHITGIQLRKFAAWFSTGYSGAAQFRKNLFQSKSNDEIMALANEFFASIGNVEQEDTSQEDFLMGGHG

SEQ ID NO: 94977 - DNA, 972 bp, Bdellovibrio bacteriovorus HD100
  CDS (1)..(972): transl_table=11
atgaaactgtttctggctccgatggaaggcgttgtcgactgggtgatgcgtgatactctcacgcgtctgggcggcattgatcagtgcgtgaccgaatttttgcgtgtcaccgaccgtctgcatccggaaagtgttttctataaaaactgccccgaactgaaaaccggatcgcgcacccgctggggcacgccggtgtttgtgcagcttttgggaggccaggccgaacctttggctttgaatgcccagcgcgcagtgaaactgggcgccctaggtgtggatcttaatttcggctgcccggcaaaaaccgtgaatcgtcatgatggcggcgcgagccttttgaaatcctgcgatcgcgtgtttaacattgtcgacactgttcgcaaggctgttcccgcggatgttccagtgacggcgaaaatccgtctgggctttgacgatccgaccaagtgtctggaaatcgcccaggccgtggaagaagccaatgccacctggctgacggttcactgccgcaccaaaactgatggttataaaccaccggcttactgggactggatcccgaagatcaaagaaaagaccaaaataaagcttatcgccaacggtgaaatctggaatgtggcggacttcaaccgctgcgtggaagtcacccagtgcgaagactatatgatcggccgcggagtcatgagcaatccgttcatctttagccagatcaaacaaagcctgaatcaacagcccgtggaagacatgagctgggaacgcgcccgccccctgctgccgcagttctttgaatccagcactttgtacatcaacgactactttgccgtgtcccgctccaaacaatggctcaaagccctgtccctgaaaaatcaggaagccaaggcgatctttgatgaaatcaaggttcttaaaaaaccaacagagttcaaagccaaactgcacgccttgtgcggtgtcgatcacttgagcgaaggatag

SEQ ID NO: 94978 - protein, 323 aa, Bdellovibrio bacteriovorus HD100
MKLFLAPMEGVVDWVMRDTLTRLGGIDQCVTEFLRVTDRLHPESVFYKNCPELKTGSRTRWGTPVFVQLLGGQAEPLALNAQRAVKLGALGVDLNFGCPAKTVNRHDGGASLLKSCDRVFNIVDTVRKAVPADVPVTAKIRLGFDDPTKCLEIAQAVEEANATWLTVHCRTKTDGYKPPAYWDWIPKIKEKTKIKLIANGEIWNVADFNRCVEVTQCEDYMIGRGVMSNPFIFSQIKQSLNQQPVEDMSWERARPLLPQFFESSTLYINDYFAVSRSKQWLKALSLKNQEAKAIFDEIKVLKKPTEFKAKLHALCGVDHLSEG

SEQ ID NO: 94979 - DNA, 975 bp, Mycoplasma mycoides subsp. mycoides SC str. PG1
  CDS (1)..(975): transl_table=4
atgaaaatcagagacatacaaattgatggtaaagtagttcaaggaccaatggctggtgttagcaatgaagcttttagaataatttcaaaacagcatggagctagtttagtttatgctgaaatggtttctgttgctggtatggttcatgataataaaaaaactcttaatatgttaaatgttaataaaattgaatatccaatgagtatgcaaatatttggtaatgatgttgacgaatttataaaagcaactcaatgaattgaaaaaaatgttgattgtgacattatagatttaaatttaggttgtccagcaccaaaggttgcaatacgttctcagagtggctcagctttattaaaaaccccagaattaatttatgaaattgttaagaatgttgttaataatactaataaaccagtaactgcaaaaattagattaggttgagataaaaatagcgttaatgctgttgaagttgctaaattaattgaaaaagcaggagctagtgcaattgctgttcacgctagaactagaaatgatttttacactggtcatgctgattgagaaaaaatcaaagaagtaaaacaagctgtgagtattcctgtaattggaaatggtgatgttattgatgctaaatcagctaaaaaaatgctagatgaaactgggtgtgatgctgtaatggtatcaagagcttgtcaaggaaatccttgaatttttgatcaaattaactattatttaaaaacaggaaaagaattagaaaaacctagttttgaagaatgaaagacaacagttttacaacatttagatttattagtaaaattaaaaactaaacaatttgctattaaagaatttagaaagcatttaacttgatatttagatgttttaaataacaagcaactaactaaaattctaaaagaaaaggctaataaaatagagactattaaagatgtagaagatattatcaaggagtataaagaagaataa

SEQ ID NO: 94980 - protein, 324 aa, Mycoplasma mycoides subsp. mycoides SC str. PG1
MKIRDIQIDGKVVQGPMAGVSNEAFRIISKQHGASLVYAEMVSVAGMVHDNKKTLNMLNVNKIEYPMSMQIFGNDVDEFIKATQWIEKNVDCDIIDLNLGCPAPKVAIRSQSGSALLKTPELIYEIVKNVVNNTNKPVTAKIRLGWDKNSVNAVEVAKLIEKAGASAIAVHARTRNDFYTGHADWEKIKEVKQAVSIPVIGNGDVIDAKSAKKMLDETGCDAVMVSRACQGNPWIFDQINYYLKTGKELEKPSFEEWKTTVLQHLDLLVKLKTKQFAIKEFRKHLTWYLDVLNNKQLTKILKEKANKIETIKDVEDIIKEYKEE

SEQ ID NO: 94981 - DNA, 1338 bp, Anopheles gambiae str. PEST
  CDS (1)..(1338)
atgtcgccgcggtacgtcgtggccccgatggtggacgctagcgagctttggcggctgctgagccgccggcacggcgcacagctctgctactcgcccatgttccacagcagctgcttcaccaaggatccgaagtatcggaaggattcgctgcaaacctgcccggaagaccggccgctgattatacagttctgcggcaacgatccgaagataatgctggaggcggccctgctcgcccaggatcactgcgacgcgatcgatatcaatctcggctgcccgcaggccatcgccaagcgcggccactacggtgccttcctgcaggacgaatgggagctgctgcgggagatcgtaagcacgctgcatcgccatttggccatcccggtcacgtgcaagatacgcatcttcgaggatatggcgaaaacgattcgctacgcccgaatgctgcaggacgccggcgcccagatgctgaccgtgcacgggcggacccgcgaccagaagggcccgctgaccgggctggccgactggaagtacgtgcgggtgctgcggcagcagctgagcataccgatcttctcgaacggcaacatcatgtcggtgcacgacgtcgagcggtgcatcgccgagacgggcgtcaacggggtgatgacggcggagggcaacctgcacaatccggccctgttcgagggcgtgaatccgaccgcctggagcatggcgcacgagtatctggatctggtcgagcagtacccggccccgatatcgtacatccgggggcatctgttcaagctgtttcatcatctgatgcacttgaaatcgaatgccgccctgcgggagaagcttgccggcagccactcggtcgccgagttccgcaccgtcgtaacgcagctcgagcaaaacaccgccaccgaaaatggacaacaaccttcccctccccacccacccaaactggaccaaaatctgcacctgcccccatggctctgccagccgtacattcgcgctccgcccgaggtgcaccggcagaagctggaggaagcgcaccggctggcgaacgatccgacgcgcgaaaagcgccagttctttgacgcccatgggaatgaaatttcacgcaaacggatgaaaaagatgcgccgcgtgcagcgtcgccccaagaacaagaaccgtgcgcagcagcgagaacaacatcgtacggatgaatatttcgctcgcggaagcgaacggccggcggcgacgggtatgaaatgcgagcaccgtttatgccggacgtgctgcaagggcaaatgctaccgggagaaccgcgattgcgcagggcacaaaatacgcatcaagtcgaggcgcgagaaggcgtag

SEQ ID NO: 94982 - protein, 445 aa, Anopheles gambiae str. PEST
MSPRYVVAPMVDASELWRLLSRRHGAQLCYSPMFHSSCFTKDPKYRKDSLQTCPEDRPLIIQFCGNDPKIMLEAALLAQDHCDAIDINLGCPQAIAKRGHYGAFLQDEWELLREIVSTLHRHLAIPVTCKIRIFEDMAKTIRYARMLQDAGAQMLTVHGRTRDQKGPLTGLADWKYVRVLRQQLSIPIFSNGNIMSVHDVERCIAETGVNGVMTAEGNLHNPALFEGVNPTAWSMAHEYLDLVEQYPAPISYIRGHLFKLFHHLMHLKSNAALREKLAGSHSVAEFRTVVTQLEQNTATENGQQPSPPHPPKLDQNLHLPPWLCQPYIRAPPEVHRQKLEEAHRLANDPTREKRQFFDAHGNEISRKRMKKMRRVQRRPKNKNRAQQREQHRTDEYFARGSERPAATGMKCEHRLCRTCCKGKCYRENRDCAGHKIRIKSRREKA

SEQ ID NO: 94983 - DNA, 1998 bp, Kluyveromyces lactis NRRL Y-1140
  CDS (1)..(1998)
atggatccaagtcaaccacaggtcaagagaccagctagttcagatgaacagccgtcggctaagaaaacggatactgccacttccaaaggtatcgctcatttgaaaccagaatttatcttgttcaatgatcaaaatggtagttccaggcctatggcaggcgagtataacgacgaagaagagtccacgtcttctcgtcttgaatctcaaccggcaaatcaaataaagggtaagaaacaaaacagtaagaagaaaagaggtcaaaacaagaaccgtgataacagacaagtgagagaacagcacgctctttgttcgaaatttgtcactaacgtcgatgctacctgttcttttgatactaagtgtaggtacgtgcatgatgtgagagagtacttgtctaagaaagcccctgagattaaaaccgagtttttccccatatgtccagtttggcaatctttgggacattgtcccatgggttacaaatgttgtttcctttcctcgcattgtaatatggagactctggaattaaaagatctgtacgaggtggatgagaggaaaaagctttatgaggctaaccatgagatcaatcacatagacggtgaaaggaagtatgatctaattaagagaagattctcattcacgaagagcgattatatattagagattattgatgccatgcaacaagagaatagagatttaatgaacacttcaaagggttctgaaacaactacagatgctaatgctggtgaagacgctaatgatgaaaaggtctcatttcaagcaactgaaaaacaaaaccaactaacggagaaaagagaaagacaacgtgaactgtatttgaaatatcacgataccaggtttttcgcacaggagaagagaaagctagatttgcatcataagaagatcgtctctcccttgactaccgtcggtaacttgccttaccgtcgtctaatgcggaaattaggagcagacgtgacttattctgaaatggctttggctgttcccttgattcaaggtacaaattcagaatgggcactaccgaaggcccattgctcagagtttcctgggtttggtgttcaaattgcatgttcaaaaacttggcaagctgcaaaggctgcagaagcacttgctgctaacgtcactggagttagcgaaataaatctaaacagtggttgcccgattgatcttttatacagacaaggtagcggaagcgcattactagataatcctgccagaatgatccgttgtttgaatggtatgaactatgtttcgaacgacatacctgtcaccgtgaagatccgtactggtactagagaaggccatccaattgcattatctatcactaagagattagtgcttgaaacggacgttgcagctatcactttgcatggtagaaccagacaacaaagatacactaaatctgccgattgggactatgtcggagaggtagctaatgcggtaaggacatacgaagcagaaagacaagagaacaagaatctaagagatggccagaagattcaatttgttggtaacggtgattgtaacaactgggaagattggtacaaacatcttgaaaataaaaacatggatagtgtgatggttgctcgtggtgcactaattaagccatggatcttcgaagaagtcgatgcccagcaatacatggataaaagttctaaggaaagattggaaattttgaaagactattgtaaatttgcaatggatcattggggtactgaccagtatggtatctctcaatgtcgtagattcttctgtgaatttatgtcattcttccacagatatgttccaatgggtatttgtgaaagataccccgttctactaaacgaaagaccaccaaattggaaaggccgtgatgatctagaaacattgttaggctccactgactctaacgactggctcaaattatccgaaatgttctttggtaaagtgaacgatgaattcgttttcactccaaaacataaaagtaattcatttgcaactaactaa

SEQ ID NO: 94984 - protein, 665 aa, Kluyveromyces lactis NRRL Y-1140
MDPSQPQVKRPASSDEQPSAKKTDTATSKGIAHLKPEFILFNDQNGSSRPMAGEYNDEEESTSSRLESQPANQIKGKKQNSKKKRGQNKNRDNRQVREQHALCSKFVTNVDATCSFDTKCRYVHDVREYLSKKAPEIKTEFFPICPVWQSLGHCPMGYKCCFLSSHCNMETLELKDLYEVDERKKLYEANHEINHIDGERKYDLIKRRFSFTKSDYILEIIDAMQQENRDLMNTSKGSETTTDANAGEDANDEKVSFQATEKQNQLTEKRERQRELYLKYHDTRFFAQEKRKLDLHHKKIVSPLTTVGNLPYRRLMRKLGADVTYSEMALAVPLIQGTNSEWALPKAHCSEFPGFGVQIACSKTWQAAKAAEALAANVTGVSEINLNSGCPIDLLYRQGSGSALLDNPARMIRCLNGMNYVSNDIPVTVKIRTGTREGHPIALSITKRLVLETDVAAITLHGRTRQQRYTKSADWDYVGEVANAVRTYEAERQENKNLRDGQKIQFVGNGDCNNWEDWYKHLENKNMDSVMVARGALIKPWIFEEVDAQQYMDKSSKERLEILKDYCKFAMDHWGTDQYGISQCRRFFCEFMSFFHRYVPMGICERYPVLLNERPPNWKGRDDLETLLGSTDSNDWLKLSEMFFGKVNDEFVFTPKHKSNSFATN

SEQ ID NO: 94985 - DNA, 2058 bp, Oryza sativa (japonica cultivar-group)
  CDS (1)..(2058)
atggccgccaccgccgccgccgccgccgcggcgcctcccgccgacccgccggactcctccccggccgcttcctcccctccgaggcccagcccggaggagctggtcgcccgtgcagtggcccccgtcaagcccgccttcctccgcccgcccctgtccgcgacgccccccaaggatgagggcaaggccaacggcggcggcgcggtggtcgcggagaagaagtccaagcgccagctcaagcgcgagcgcaagcaggaacagaaatcttcatcacatctttgtatcgaagtagggaaaagtggaaatgtgagctcttgcaaatatggtgattcttgccgtttcagccatgacatagatgcctatttggctcagaaaccagctgaccttgagggcacgtgcccatttaccaatctggaccagttgtgtccatatggactaacttgtcgatttttgggtacacataaggacatccatgcagcttctggaaatctttcagagaaacatgagataaatgctttaaacaaagacattcaaaagctcttatggaagaacaaatataagttccccaaggccagtgcacagatcaagcttcttggtcttaaggaagtcattaagagcaaaccggatgctgcaaatgatgataagaaggttaatcatgataatctagacgggaatgatgatgaaaataaagaacctctttgcaatcctcctgtaaatgcggaatgtgattctactttgtgtgaagaattggatagatcagagggagaacctttgattgataactcaattccatgtgttgaaccaaggccaacaaagaagtcaaaggttgaaagtgatgaaattgacaaacatggagcgggtactctcaacactaacacagaatctgaagatcctaatttgagtaatggattggaaccctcaaataactcaagttcttgtagaactgacctaatcacaacacctcatttacgtgaaaagaagataatagattttcgggagaagttgtaccttgctcccttgactactgtcgggaatctgccttttcggagactctgcaaaaccttgggagctgatattacttgtggagaaatggccatgtgcacaaatcttttacagggacaagcttcagagtgggctttgctgcgacggcattcatcagaggatttgtttggggtgcaaatttgtggagcctatccagatacagtagcacgaaccgttgaacttgtggataacgaatgttcagttgatttcatagacataaatatggggtgcccaattgatattgttgtcaacaaaggtgctggatcatcattgctaacaaaacctatgaggatcaaaagtattgtacaagcagcatccactgttactgaaaaacctttaactgttaaggtaagaactgctttctttgagggaaggaaccgtgctgattctatagtttccgacatctatgactggggtgcgtcagccataacagtacatggtcgatcccggcaacagcgctacagcaaacttgctgattgggattatatttaccagtgtgcccagaaagcccctgaccagttgcatgtcgttggaaatggtgatgtattctcttttactgactggaacaaacatgtttcaggctgctctaaaatatcgacaagcatgattgctcgaggtgcactcataaagccttggatatttactgaggttaaagaacaaaggcactgggatattacatctggcgagagattcaatattcttaaagattttgtgagttttggtctggaacactggggttccgattccaaaggtgttgaaacaacacgctattttttactagaatggctaagctacacctgccgctacataccggttggcctgttggatgtgatcccgcaacgtttgaactggaggcccccaagctactgtggccgtgatgatcttgaaaccctaatgatctctgattcagcagctgactggatcaggatctcagagatgttgcttggcaaagttccagaagggtttacgtttacacccaagcacaaatccaatgcttatgatcgagctgaaaacggctaa

SEQ ID NO: 94986 - protein, 685 aa, Oryza sativa (japonica cultivar-group)
MAATAAAAAAAPPADPPDSSPAASSPPRPSPEELVARAVAPVKPAFLRPPLSATPPKDEGKANGGGAVVAEKKSKRQLKRERKQEQKSSSHLCIEVGKSGNVSSCKYGDSCRFSHDIDAYLAQKPADLEGTCPFTNLDQLCPYGLTCRFLGTHKDIHAASGNLSEKHEINALNKDIQKLLWKNKYKFPKASAQIKLLGLKEVIKSKPDAANDDKKVNHDNLDGNDDENKEPLCNPPVNAECDSTLCEELDRSEGEPLIDNSIPCVEPRPTKKSKVESDEIDKHGAGTLNTNTESEDPNLSNGLEPSNNSSSCRTDLITTPHLREKKIIDFREKLYLAPLTTVGNLPFRRLCKTLGADITCGEMAMCTNLLQGQASEWALLRRHSSEDLFGVQICGAYPDTVARTVELVDNECSVDFIDINMGCPIDIVVNKGAGSSLLTKPMRIKSIVQAASTVTEKPLTVKVRTAFFEGRNRADSIVSDIYDWGASAITVHGRSRQQRYSKLADWDYIYQCAQKAPDQLHVVGNGDVFSFTDWNKHVSGCSKISTSMIARGALIKPWIFTEVKEQRHWDITSGERFNILKDFVSFGLEHWGSDSKGVETTRYFLLEWLSYTCRYIPVGLLDVIPQRLNWRPPSYCGRDDLETLMISDSAADWIRISEMLLGKVPEGFTFTPKHKSNAYDRAENG

SEQ ID NO: 94987 - DNA, 960 bp, Oryza sativa (japonica cultivar-group)
  CDS (1)..(960)
atggagtaccgcgacaagctggtgctcgcgcccatggttcgcgtgggtaccctgccgtttaggctactggctgctgaatatggtgctgatatcacttacggagaagaaataatagatcataagtttttgaagtgtgaacgtgttacaaatgaatctcttggtactactgattttttggagagagggactgatactgtagtattccgtacttgcccacaagaaagggatagggttgtattccaaatgggaacatctgatgctgtgagggcactgaaagctgctcagcttgtgtgtaacgatgttgctgctatagatatcaacatgggttgtcccaaatctttctctcttagtggtggaatgggagccgcattactctccaaacctgagcttattcatgatattttgaccacattgcggaggaacttggacactaccgtgacatgtaaaatccgtcttctgaacacacgccaggacactgtggagttggctcgccgagttgagaagattggtgttccagcccttgctgtccatggaagaaaggtcaaagacagaccaagagatcctgctaagtgggatgagattgcagatgttgtgtctgcactgtcaattccagttatagctaatggagatgtatttgaatatgaggattttaaaagaattaaagatgctacaggtgccgcttctgtaatggttgccagaggtgccatgtggaatgcctcaattttttgtcccaaaggaaaaacaccttgggaggatgtcaaaagagagtacgtgagaaagagtattttgtgggacaatgatttgaagagcacaaaacaaaccataaaagaaatgataatgcactattcttgccttgaattccctgaaggaaaaggtgtgaacaagtgtgatacaatagctgatttagcgaaactatatggggaagagtactacaatttcgttctttcaaataggaattga

SEQ ID NO: 94988 - protein, 319 aa, Oryza sativa (japonica cultivar-group)
MEYRDKLVLAPMVRVGTLPFRLLAAEYGADITYGEEIIDHKFLKCERVTNESLGTTDFLERGTDTVVFRTCPQERDRVVFQMGTSDAVRALKAAQLVCNDVAAIDINMGCPKSFSLSGGMGAALLSKPELIHDILTTLRRNLDTTVTCKIRLLNTRQDTVELARRVEKIGVPALAVHGRKVKDRPRDPAKWDEIADVVSALSIPVIANGDVFEYEDFKRIKDATGAASVMVARGAMWNASIFCPKGKTPWEDVKREYVRKSILWDNDLKSTKQTIKEMIMHYSCLEFPEGKGVNKCDTIADLAKLYGEEYYNFVLSNRN

SEQ ID NO: 94989 - DNA, 1044 bp, Leptospira interrogans serovar Copenhageni str. Fiocruz L1-130
  CDS (1)..(1044): transl_table=11
atgttagagaaatacggtaaaattccaaaacgatacccggtttcgttggctcccatgatggattggaccgatcgacattttagatattttttaagactgatttctaaacatacgtttttatacacggaaatggtccataccggagccgtacttcacggtgatcgtcgcaaacttctatcctacagccctgaagaattacctcttgcaattcaactaggaggaagcgatccgaaagcacttgcagaatcttgtaagatcggagaagactatggatataccgaaatcaatttgaacgtaggttgtccaagtgatcgtgtaagagaaggaaacttcggcgcctgtttgatggaaactccggaaaaggttgctgaattgacgtttgcaatggacacttccgtttcaattcctataaccgtaaaatgtagaattggaattccaggtaaggaaacttttgaagacctatgtaaatttatagaatgtgttcgccaaacgggtgttcaacgatttatcgttcatgcaagaatcgcgattttaggaggacttacccccgcacagaatcgtcaggttcctcctttacattatacgtacgttgaatctttaaagaaggaatttccggatcttttgatagaaatcaatggaggaatacggactattacttcaattcgggaaagactagaaaaaaacgatggagtgatgatcggaagagccgcatacgaaactccttatctcttttcggaagtagattctttgttttttggggaaaatttacctcctttaagtaggagagaaattttgcttagaatgaaggattatatagaagaagtaatcttaaaagagaaaaacggaaaaccacaccacgcacttagacatatgttagggttgtttcacggagaaaaaggagctcgcagttttagaaaaattcttacggaaggaatgtattccggttattcgaaggatcttttatccaaagccattcaagaaatttctaatgattctttagatatagtttcgtctaacgcgtatctgtataaatctggttcgtaa

SEQ ID NO: 94990 - protein, 347 aa, Leptospira interrogans serovar Copenhageni str. Fiocruz L1-130
MLEKYGKIPKRYPVSLAPMMDWTDRHFRYFLRLISKHTFLYTEMVHTGAVLHGDRRKLLSYSPEELPLAIQLGGSDPKALAESCKIGEDYGYTEINLNVGCPSDRVREGNFGACLMETPEKVAELTFAMDTSVSIPITVKCRIGIPGKETFEDLCKFIECVRQTGVQRFIVHARIAILGGLTPAQNRQVPPLHYTYVESLKKEFPDLLIEINGGIRTITSIRERLEKNDGVMIGRAAYETPYLFSEVDSLFFGENLPPLSRREILLRMKDYIEEVILKEKNGKPHHALRHMLGLFHGEKGARSFRKILTEGMYSGYSKDLLSKAIQEISNDSLDIVSSNAYLYKSGS

SEQ ID NO: 94991 - DNA, 1029 bp, Thermus thermophilus HB27
  CDS (1)..(1029): transl_table=11
gtgcttgacccgaggctttccgtggcccccatggtggaccgcaccgaccggcacttccgctttctggtgcggcaggtgagcctgggggtgaggctctacacggagatgaccgtggaccaggcggtgctgaggggaaaccgggagcgcctcctcgccttccggcccgaggagcaccccatcgccctccagcttgcgggttccgacccaaagagcctggcggaggcggcgaggatcggcgaggccttcggctacgacgagatcaacctcaacctgggctgcccctcggagaaggcccaggaaggggggtacggggcctgcctcctcttggacctcgcgcgggtgcaagagatcctgaaggccatgggggaggccgtccgcgtccccgtgacggtgaagatgcgcctgggcctcgaggggaaggagacctaccgggggcttgcccaaagcgtggaggccatggcggaggcgggggtcaaggtcttcgtggtccacgcgaggagcgccctcctcgccctctccacaaaggcgaaccgcgagatcccccccttgcgccacgactgggtccaccggcttaaaagagactttccccagctcaccttcgtcaccaacggggggataaggagcctggaggaggccctcttccacctgaagcgggtggacggggtgatgctggggcgggcggtctacgaggaccccttcgtcctggaggaggcggaccggagggtctttggccttccccgccgtccaagccgcctcgaggtggcccggaggatgcgggcctacctggaggaggaggtcctaaagggcacgcccccttgggcggtcctgaggcacatgctcaacctcttccggggaaggcccaaggggaggctctggcggaggcttttgagcgagggccgctcccttcaggccctggaccaggccctacggcttatggaggaagaggtaggcgaggagggcgaaaaggagaagccaggcccaagggggcaaagggaagcggcgcctgggcttgcccgtgagggggtctaa

SEQ ID NO: 94992 - protein, 342 aa, Thermus thermophilus HB27
MLDPRLSVAPMVDRTDRHFRFLVRQVSLGVRLYTEMTVDQAVLRGNRERLLAFRPEEHPIALQLAGSDPKSLAEAARIGEAFGYDEINLNLGCPSEKAQEGGYGACLLLDLARVQEILKAMGEAVRVPVTVKMRLGLEGKETYRGLAQSVEAMAEAGVKVFVVHARSALLALSTKANREIPPLRHDWVHRLKRDFPQLTFVTNGGIRSLEEALFHLKRVDGVMLGRAVYEDPFVLEEADRRVFGLPRRPSRLEVARRMRAYLEEEVLKGTPPWAVLRHMLNLFRGRPKGRLWRRLLSEGRSLQALDQALRLMEEEVGEEGEKEKPGPRGQREAAPGLAREGV

SEQ ID NO: 94993 - DNA, 1260 bp, Desulfovibrio vulgaris subsp. vulgaris str. Hildenborough
  CDS (1)..(1260): transl_table=11
atgagcgaaacgctgcccatatcccccgacgccccgtggctggccccgctggcgggctattccgacctgtccttccggctgctgtgccgtgaggctggggccgccgtgtgctgcaccgaaatggtcagcgccaaggggctcatctactgcagccccggtacccgcgacctgcttgccaccacgccggaggacgcacctctggtggtgcagcttttcggctgcgaccccgacatcatggtacgcgccatggagcccttgctcgaacaggggttccggtggttcgacctcaacatgggctgctccgtgcccaaggtggtgaagaccggttgcggggctgccatgctgcgtgacgtgccgcaggcgcttgccgtggcccgcgccatgctgcgtaccgcaggcgcggggcgggtgggtttcaagttcaggcttggctgggacgtaggtcaggaggtatgggccgaccttgggcgcgctctcgccgacctcggtgcggggtgggtgacgctgcatccgcgttatgcccgtcagggcttctccggcgaggcacggtggagcgcgctgggtgagcttgtacgggccgtttccgtgcctgtcatcgccagcggcgacctcttcactgctgccgatggcgtccgctgcctgcgtgagacgggcgtggcatcggtgatgtacgcgcgtggtgcgttgaacgaccccggagtgttccatgcgcatcgcgaacgtgtcgccggaaggcccgaccccggctatacgccgcaacggttgcgggcactcatcacccgccatgccgaacttgcacggcaatatgcgccgggacgctcggccctgctcaagatgcgcaccttcgtgccccgctatgtgcggcatctgccgggagcgcgggcgttgcgccagcatctcgcctcatgcttcgagtgggagatgctggatgaactgctggccacctttttcgcggacgtgcccacctgtccggtcacgccggaaggacggggcggtaacgcggacgccatgtccgaatgtgtgaccggtgctgcggaacactctggttgcaggacgcactcggacatgtccggccatgtagctggcagcgcgtcctctgaagacccttccgatggcccctcccgttaccccgcaggagaatccgccatgacgtccggcgaggagtccgccacggcggcgggcacggcaggtcgtggcccggaggtctcttccacgtgttgtacggggcgcgcacagcaacccacggagtcagacgcatga

SEQ ID NO: 94994 - protein, 419 aa, Desulfovibrio vulgaris subsp. vulgaris str. Hildenborough
MSETLPISPDAPWLAPLAGYSDLSFRLLCREAGAAVCCTEMVSAKGLIYCSPGTRDLLATTPEDAPLVVQLFGCDPDIMVRAMEPLLEQGFRWFDLNMGCSVPKVVKTGCGAAMLRDVPQALAVARAMLRTAGAGRVGFKFRLGWDVGQEVWADLGRALADLGAGWVTLHPRYARQGFSGEARWSALGELVRAVSVPVIASGDLFTAADGVRCLRETGVASVMYARGALNDPGVFHAHRERVAGRPDPGYTPQRLRALITRHAELARQYAPGRSALLKMRTFVPRYVRHLPGARALRQHLASCFEWEMLDELLATFFADVPTCPVTPEGRGGNADAMSECVTGAAEHSGCRTHSDMSGHVAGSASSEDPSDGPSRYPAGESAMTSGEESATAAGTAGRGPEVSSTCCTGRAQQPTESDA

SEQ ID NO: 94995 - DNA, 933 bp, Acinetobacter sp. ADP1
  CDS (1)..(933): transl_table=11
ttgaaacttattcttgcaccaatggaaggcttgaccgatccaatcatgcgtgatgttcttacgcatgtcggaagtttcgactggtgcgttacagagtttattcgtgtgactgatagcgtattgcctgatcatgtttattacacctactgccctgagcttaaaaataacggtaaaactgctgctggtacgccagttcatgttcagtttttagggaacaatcccgatatgctggctgccaatgccgaaaaagtggtggctttgggcgcaccagcgattgatctgaattttggctgccctgcaaaaaccgtaaaccgacatcgtggtggctcaatcctacttgatgagcctgatgtcgtgcatctactcgtaaaagctgtgcgtgatgccgtacctgcacatatcccagtgtctgcaaaaatgcgtctgggttatctcgatgaaaatcacaccatggacaatgcttatgcaatacaggaagctggtgcaaactggttgacggttcatgcgcggaccaaagcagatggttatacgccgcctgcatattgggaaaaaatacagccgattaaagatgccttaagcatcaatgtgattgccaatggtgaaatctggaccaatcaagatgcaaaagcctgtcagcagcaatctggctgtgaagatttgatgattggccgtggtgcagtcaccacgcctgaccttactctgtgcatccgtcaaaatgtggatgaagccttaatgaattgggccgctttgattgaactacaacagcgctttttaaatggtgaatataaaacagaaattggcatgattggccgttataaacaatggctaggtatgatgaccaaagcctatcctgaagccaaacagctttgggatgagattaaacgcatcaaaaacctagacgaaattttattgaaacttggtcgctcatcataa

SEQ ID NO: 94996 - protein, 310 aa, Acinetobacter sp. ADP1
MKLILAPMEGLTDPIMRDVLTHVGSFDWCVTEFIRVTDSVLPDHVYYTYCPELKNNGKTAAGTPVHVQFLGNNPDMLAANAEKVVALGAPAIDLNFGCPAKTVNRHRGGSILLDEPDVVHLLVKAVRDAVPAHIPVSAKMRLGYLDENHTMDNAYAIQEAGANWLTVHARTKADGYTPPAYWEKIQPIKDALSINVIANGEIWTNQDAKACQQQSGCEDLMIGRGAVTTPDLTLCIRQNVDEALMNWAALIELQQRFLNGEYKTEIGMIGRYKQWLGMMTKAYPEAKQLWDEIKRIKNLDEILLKLGRSS

SEQ ID NO: 94997 - DNA, 1026 bp, Acinetobacter sp. ADP1
  CDS (1)..(1026): transl_table=11
atgtatattgggtcttatcaactgtcaaataatttaattgtagctcctatggcgggagtgacagatcgcccgttccgtacactgtgtaaatattttggtgcagggcatgcggtaagtgaaatgatgaccgcagataagactttaagaatgagtaaaaaaagcctgtatcgggccaattttgatggagaactcgcaccgatttcagcacaaattgcaggttctgacccagagcaactcgctgaagctgcacgctatcaggtcgcaaatggcgcccagattgtggatatcaacatgggctgtcctgccaaaaaagtctgtaacaagcttgctggttctgcacttttacaagatgaagacttggttgctcgtattctggatgcagtagttgcagcggtggatgttcctgtgacgctaaaaacccgtttaggtttcttaaatgggcaggaaaatattcttagagttgccaagcaagctgagcagtctggtattgctgcactggcactccatggtcgtacacgtgaagacatgtatttaagtactgcgcgttatgatttgatcaaacaggtgaaatcgattttaactattcctgtgattgcaaatggggatatcgacagtccgcaaaaagccaaatatgttttggattatacaggtgctgacgccattatgattggtcgtgctgcgcaaggacgcccttggatttttcgtgaaattgcacattatttgaaaacaggcgagcatctggctgcacctgatattgcagaagtgaaagaggttttactgggacatttgtccgagttatataggttttatggtgaatattcaggatgtcgaatcgctcgaaaacacattgcctggtacaccaaaggtctgcattcaagcaatgagtttcgtcaaaacatgtatcaagtggaaagtacggctgaacaagctcgcctagttgaagcttatttcaatcatttattgatgcaaggccagttaatgagcgatgttcagaccgaacacgtcgatttgttgtcgattaaataa

SEQ ID NO: 94998 - protein, 341 aa, Acinetobacter sp. ADP1
MYIGSYQLSNNLIVAPMAGVTDRPFRTLCKYFGAGHAVSEMMTADKTLRMSKKSLYRANFDGELAPISAQIAGSDPEQLAEAARYQVANGAQIVDINMGCPAKKVCNKLAGSALLQDEDLVARILDAVVAAVDVPVTLKTRLGFLNGQENILRVAKQAEQSGIAALALHGRTREDMYLSTARYDLIKQVKSILTIPVIANGDIDSPQKAKYVLDYTGADAIMIGRAAQGRPWIFREIAHYLKTGEHLAAPDIAEVKEVLLGHLSELYRFYGEYSGCRIARKHIAWYTKGLHSSNEFRQNMYQVESTAEQARLVEAYFNHLLMQGQLMSDVQTEHVDLLSIK

SEQ ID NO: 94999 - DNA, 966 bp, Erwinia carotovora subsp. atroseptica SCRI1043
  CDS (1)..(966)
atgcacattggacaatttcagctaaccaatcgtttgatagcagccccaatggctggtattagcgatcgcccatttagagcactctgtcatgcgatgggcgctggaatgaccgtgtctgaaatgctgtcttccaatccggaagtctggcgttcagacaagtcgcgtttgcgaatggtacatagtgatgaaccgggtatcagggccgtgcagattgccggttgtgaccccgatgagatggcggcggcagcgagaatcaacgctgattccggcgcgcagatcatcgacatcaatatgggctgcccagcgaagaaggtgaaccgcaagatggcaggatctgcgttattgcagtatccggatttggtcaaacagatcctctctacggtagtgaaagcggtagacgtaccggtaacactgaagatccgtaccggttgggcaccagagcaccgcaactgtgtagaaattgccaaattggctgaagactgtggcatccaggcgttaactattcacggacgcactcgtgcgtgcctgttcaatggtttcgccgaatacgacagcattcgggcagttaagcaggccgtttccattcctattattgcgaatggcgacattacagacccgcataaagccagagcggttcttgactacactggggctgacgccctgatgataggacgagccgctcagggaagaccctggatctttcgggaaatccagcattatctggacacaggggagttgctggcaccactgcctttggtagaggtcaagcgcttgttgatcgagcacatacgggaattgcacgacttttatggtccaggcaagggatttcgtatcgctcgtaagcacgtatcctggtatatccaggagcacgccccaaacgaccagtttaggcgcacattcaacgccattgaggatgccagcgagcagctggaggcgttgaaggcatattttgaaaatcttgcgtaa

SEQ ID NO: 95000 - protein, 321 aa, Erwinia carotovora subsp. atroseptica SCRI1043
MHIGQFQLTNRLIAAPMAGISDRPFRALCHAMGAGMTVSEMLSSNPEVWRSDKSRLRMVHSDEPGIRAVQIAGCDPDEMAAAARINADSGAQIIDINMGCPAKKVNRKMAGSALLQYPDLVKQILSTVVKAVDVPVTLKIRTGWAPEHRNCVEIAKLAEDCGIQALTIHGRTRACLFNGFAEYDSIRAVKQAVSIPIIANGDITDPHKARAVLDYTGADALMIGRAAQGRPWIFREIQHYLDTGELLAPLPLVEVKRLLIEHIRELHDFYGPGKGFRIARKHVSWYIQEHAPNDQFRRTFNAIEDASEQLEALKAYFENLA

SEQ ID NO: 95001 - DNA, 933 bp, Erwinia carotovora subsp. atroseptica SCRI1043
  CDS (1)..(933)
atgcgtgttctgcttgccccgatggaaggggttctcgactcactagtgcgagagctgctgactgaagtaaacgattatgatttgtgcatcaccgagtttttacgcgtggtggatcagtgcctgccggttaaatccttttatcgcctttgccccgagctagagcatgctagccgtacgccgtccggcacactggtgcgcgtgcaactgctggggcaatatccgcagtggctggcggagaacgcagcgcgggcggttgaactgggctcgtatggtgtcgatctcaactgtggctgcccgtcaaagctggtgaacggcagcggaggcggcgcgacactgttaaaagatccggaactgatttatcagggtgcaaaagccatgcgtgaggcggtgccagcgcatttaccggtcacggtgaaaatacgtttggggtgggattccggtgctcgccagtttgaaattgccgatgcggtgcagcaggcgggtgccagcgagttggccgtgcatggtcgcacgaaagaagatggctacaaggctgagtgcattaactggcaggcgatcggggaaatccgccagcggttgcagattccggtgattgccaacggcgaaatctgggactggcagagtgcgcaggattgtatggcgacaacgggctgtgacgcgatcatgctcgggcggggcgcgctgaatgtgccgaacctgagccgcgtgattaaatataacgaaccgcgtatgccgtggcctgaggttatgttactgctacaaaaatatgtgcgactggaaaagcagggcgatacggggatgtatcatgtcgcacgcatcaaacagtggcttggctatttgcgtaaagagtacgacgatgctaccgagttattcagcgagatacgcacgttgaagacctcaacggaaatcgcacgtgtgattggtgagctatag

SEQ ID NO: 95002 - protein, 310 aa, Erwinia carotovora subsp. atroseptica SCRI1043
MRVLLAPMEGVLDSLVRELLTEVNDYDLCITEFLRVVDQCLPVKSFYRLCPELEHASRTPSGTLVRVQLLGQYPQWLAENAARAVELGSYGVDLNCGCPSKLVNGSGGGATLLKDPELIYQGAKAMREAVPAHLPVTVKIRLGWDSGARQFEIADAVQQAGASELAVHGRTKEDGYKAECINWQAIGEIRQRLQIPVIANGEIWDWQSAQDCMATTGCDAIMLGRGALNVPNLSRVIKYNEPRMPWPEVMLLLQKYVRLEKQGDTGMYHVARIKQWLGYLRKEYDDATELFSEIRTLKTSTEIARVIGEL

SEQ ID NO: 95003 - DNA, 978 bp, Mesoplasma florum L1
  CDS (1)..(978): transl_table=4
atgaaaataggaaatgtagaaataaaaggtaaattagttcaagggccaatggctggtgtatctaatccaccatttagattaatatcaaaagaaaaaggtgctgatttagtttgtgctgaaatggtttctgtagaaggaatgacacataacaacaaaaaaacatttagcatgttagcagttgaaaaaaaagaacacccaatgagtatgcaaatttttgggaatgatgttgaatcatttattgtggcgacaaagtgaattgatgaaaatgttgattgtgacattatagatttaaacattggttgtcctgcaccaaaagtagctgttagatcagcgagtggatcaagtttattaaagacaccggaattaatatatgacattgtaaaagcagttgttgaaaatacatcaaagccagttactgcaaaaattagattaggttgagataaagaaagtgttaatgctgttgaagtttctaaattaattgaaaaagcaggagctagcggaattactgttcatggaagaacaagaagtgaattttattcaggccatgcagattgagaaaaaataaaagaagttaaagaagctgtaaatattccagttattggtaatggtgatgttattgacgggccaagcgcaaaagcaatgttagaattaactggttgtgatggagtaatgatttcaagaggatgccaaggtaatccttgaatttttagagaaattgcacactttttagagacaggtgaagaattagataagccaagttttgcagaatgaaaagaaacagtattgaagcatgctaaaatgttaatagattataaacaagacgaaggtagtgcaattagagaatttagaaaacatttaacttgatattttgcagcattgccaaaaacagaaattttaaatcagttaaaagaagaagcaaataagattaacacatttagtgatttagaaaatattatagaaaagtataaagaggtataa

SEQ ID NO: 95004 - protein, 325 aa, Mesoplasma florum L1
MKIGNVEIKGKLVQGPMAGVSNPPFRLISKEKGADLVCAEMVSVEGMTHNNKKTFSMLAVEKKEHPMSMQIFGNDVESFIVATKWIDENVDCDIIDLNIGCPAPKVAVRSASGSSLLKTPELIYDIVKAVVENTSKPVTAKIRLGWDKESVNAVEVSKLIEKAGASGITVHGRTRSEFYSGHADWEKIKEVKEAVNIPVIGNGDVIDGPSAKAMLELTGCDGVMISRGCQGNPWIFREIAHFLETGEELDKPSFAEWKETVLKHAKMLIDYKQDEGSAIREFRKHLTWYFAALPKTEILNQLKEEANKINTFSDLENIIEKYKEV

SEQ ID NO: 95005 - DNA, 1236 bp, Propionibacterium acnes KPA171202
  CDS (1)..(1236): transl_table=11
gtggcaatgcgggtcgtgatttctcgttgtgccactggcgctggcacgacggtttctgctcaaccggattgccacgcttaccatgggctggtgttttccgatcccctgaccttgatcgcgccctctggtggcaccgtttcggtagataccccggtggtgctggcccccatggccggcgttaccaatgccgcattccgccagctttgtgccgaacaaggtgcgggcctgtatgtctgcgaaatgatcacgtcgcgtggcctggtttacggggaccacaagacccacggcatgcttgcctttgccgagtgtgaagatgtccggtccgttcagctctatggcgtcgacccgggaatggtgggcgaggcgacatcgatcctgtgcgagaagtacggagtcaatcacgtcgaccttaatttcggctgtccagtgcccaaggtcacccgcaagggtggtgggggagtcctgccgtggaagctcgaccggtttgcggccgtggtttctgcggctgtccaggccggtgacgcccatggggtcccggtcaccgtcaagactcggatcggcattgaccccgagcacatcacctacattgattcagcccgggctgcggtcgattccggcgccgctgcggtgtgtttgcacgctcgcactgtcgccgaggcctacgctgggcactcccactgggatgccattggcgagcttgtcaagaccgtcgatgtccccgtcattggaaacggtgacatctgggaggccagcgacgcaatggccatggtcgggcaaacgggttgtgccggcgtcgaggttggtcgtggttgtctcggtcgtccgtggctgttccgtgacttggccgatgccttcgccggtcgtgacaccaccaccttgccgaccttgggtgaagtgtgcgccatgatccgtcgccatgccgaactgttggtgaaatatcagggaatgcatggtctggtggacatgcgcaaacatatggcttggtaccttaagggattccccgtaggtggggaaacccgtcatgttctcggccagatttccagtttcgacgaactcgattccttgttggccacccttgaccacgacgcccctttcccagttaaggagcttggcaaggcccgtggtcgtcagggcgccccgcggcgaaaggtcgtcatgccgcacggatggctggacactcacacccttgacgacgatgatctgtccgctgctgagatcgacgcttccgggggatga

SEQ ID NO: 95006 - protein, 411 aa, Propionibacterium acnes KPA171202
MAMRVVISRCATGAGTTVSAQPDCHAYHGLVFSDPLTLIAPSGGTVSVDTPVVLAPMAGVTNAAFRQLCAEQGAGLYVCEMITSRGLVYGDHKTHGMLAFAECEDVRSVQLYGVDPGMVGEATSILCEKYGVNHVDLNFGCPVPKVTRKGGGGVLPWKLDRFAAVVSAAVQAGDAHGVPVTVKTRIGIDPEHITYIDSARAAVDSGAAAVCLHARTVAEAYAGHSHWDAIGELVKTVDVPVIGNGDIWEASDAMAMVGQTGCAGVEVGRGCLGRPWLFRDLADAFAGRDTTTLPTLGEVCAMIRRHAELLVKYQGMHGLVDMRKHMAWYLKGFPVGGETRHVLGQISSFDELDSLLATLDHDAPFPVKELGKARGRQGAPRRKVVMPHGWLDTHTLDDDDLSAAEIDASGG

SEQ ID NO: 95007 - DNA, 978 bp, Streptococcus pyogenes MGAS10394
  CDS (1)..(978): transl_table=11
atgataaagcttaattcttcctttaggattggtgatgtggaaatccctcaccgcactgtccttgctcccatggctggtgtgaccaattctgtctttcgtaccatcgccaaagaatttggtgctggtttggtggttatggaaatgatttccgaaaaagggcttctttacaacaatgaaaagaccctccatatgctccatattgatgaaaatgagcaccctatgtccattcaattatttggtggtgacgcagaagggttgaaacgtgcagctgatttcattcaaaccaataccaaggccgatattgttgatattaatatgggctgccctgttaataaagttgtcaaaaacgaggctggtgccaagtggctccgtgaccctgataagatttaccacattgtcaaggaagtcacgtctgttttagatattccactgactgtcaaaatgcgtacaggttgggcggatagttcacttgctgttgaaaatgccctcgcggctgagtcggcaggtgtatctgctcttgccatgcacggtcgtacccgtgaacaaatgtatacaggaacctgcgaccatgacacattagcccgagtttctaaggctatcactaagattccctttattggaaatggggacgtgcgttcggtgcaagacgccaaatttatgattgaagaaatcggtgtagatgccgtgatgattggccgcgcagccatgaacaatccttaccttttcactcaaatcaatcatttttttgagactggacaagaattgccagatcttccttttgccaaaaaattagacatcgccaaagaccacctcaaacgcctgattaacctcaaaggtgaaaccattgctgttcgggaatttcggggcttagcgccacactatcttcgcggaacagcaggtgctgccaaagttcgtggtgctgtttcacgcgctgagactctagctgaggttgaagccatcttcgaaacagtacgctaa

SEQ ID NO: 95008 - protein, 325 aa, Streptococcus pyogenes MGAS10394
MIKLNSSFRIGDVEIPHRTVLAPMAGVTNSVFRTIAKEFGAGLVVMEMISEKGLLYNNEKTLHMLHIDENEHPMSIQLFGGDAEGLKRAADFIQTNTKADIVDINMGCPVNKVVKNEAGAKWLRDPDKIYHIVKEVTSVLDIPLTVKMRTGWADSSLAVENALAAESAGVSALAMHGRTREQMYTGTCDHDTLARVSKAITKIPFIGNGDVRSVQDAKFMIEEIGVDAVMIGRAAMNNPYLFTQINHFFETGQELPDLPFAKKLDIAKDHLKRLINLKGETIAVREFRGLAPHYLRGTAGAAKVRGAVSRAETLAEVEAIFETVR

SEQ ID NO: 95009 - DNA, 1227 bp, Leifsonia xyli subsp. xyli str. CTCB07
  CDS (1)..(1227): transl_table=11
atgctcaccactactctcactccccgcgccactctccgcggcgacacaccctcggctggcactgcggcgaagctggccatcggaccgctcgcgctcgacgtgccggtcgtgctcgcgcccatggccgggataacgaacaccgcattccggcggctgtgtcgcgagttcggcgccggtctgtatgtgagcgagatgatcacctcgcgggcgctcgtggagcgcacccctgaatcgctgcggctgatcgcccatcacgagtcggagacgccgcgcagcatccagctctacggggtggacccaaaaacggtgcgcgaggcggtcacgctgctggttgcggaagaccgcgccgaccacatcgacctcaacttcggctgcccggtccccaaagtcacgcgcaagggcgggggagcggcgctgccgtggaagctcgggctgttccgcgagatcgtggagggcgcggtcgcggccgcgggggacatccccctcaccgtcaagatgcgcaagggcatcgacagcgaccacctgacctacctcgaagcggcgagggccgccgagggcgcgggcgtggcctcgatcgcgttgcacgcccgcacagcggccgagttctactcggggcacgcggactggccggcgatccgcacgctcaaggagacgatcaccggcacgccggtgatcggcaacggcgatatctggtcggcggcagacgccgtccgcatggtcgaggagacgggatgcgacggcgtggtggtcggccgcggctgcctcggccggccctggctgttcggagacctggctgccgctttcaaagcccgggccggtgagctgagcgcggacgaagcggccgcggcgcaggcgcatccggccctcggagaggtcgcggccaccttccggcggcacgccgagctgctggtcgagttcttcgacagcgaggagcgcggctgccgcgacatccggaaacatgtcgcctggtacttcaagggctatccggtcggcggcgacctgcgggccagcctcgccaccgtggaaacgctggcgcatctcgatgaccttctcgcgacactggacgcagaccaggagtatccgggggcggcagcggaaggccagcgcgggcgcgccggatcccccaagcgtccggcgctgccggagtgctggctgaagagccgggagctcgacgtcgaaggccgattcgaactctccgaggcggaggcacacaacagtggtggatag

SEQ ID NO: 95010 - protein, 408 aa, Leifsonia xyli subsp. xyli str. CTCB07
MLTTTLTPRATLRGDTPSAGTAAKLAIGPLALDVPVVLAPMAGITNTAFRRLCREFGAGLYVSEMITSRALVERTPESLRLIAHHESETPRSIQLYGVDPKTVREAVTLLVAEDRADHIDLNFGCPVPKVTRKGGGAALPWKLGLFREIVEGAVAAAGDIPLTVKMRKGIDSDHLTYLEAARAAEGAGVASIALHARTAAEFYSGHADWPAIRTLKETITGTPVIGNGDIWSAADAVRMVEETGCDGVVVGRGCLGRPWLFGDLAAAFKARAGELSADEAAAAQAHPALGEVAATFRRHAELLVEFFDSEERGCRDIRKHVAWYFKGYPVGGDLRASLATVETLAHLDDLLATLDADQEYPGAAAEGQRGRAGSPKRPALPECWLKSRELDVEGRFELSEAEAHNSGG

SEQ ID NO: 95011 - DNA, 1065 bp, Desulfotalea psychrophila LSv54
  CDS (1)..(1065): transl_table=11
ttgatatgggactgcttgcctcttgggtttaaggttgtcagggtgttgttcaaaccgtttcaaaatgagatttgtatgaaattaacgtttttgcagagggatggcgaggggcgactcgcagcgcctcctctctctcttgctcccatggttggcctgagtcattcagctctgcgctctctgatagctgatcttggtggttgtggtcttttttatacggagatgcttgccgccaggcgacttccccatgaaaatccggcagtatcctcctatttgcatactactccctgtgagcggccacttatatatcagctttttattgcggatgttaagtatgtagctccggccctggataagatccatcgtcttggtggtgatggtgtcgatattaatttgggttgtccggctccctccgtacgtcgtggtggggcgggggcagctctggctgaagactgggatcgggttagagatatagtttcctctgcccgccggcatacggatttgactctctcggctaaaatccgggtgggccatgtcggcaaggaggcgcatcttcttgatttttgtaagatgcttgaggccgagggtgttgatctacttgccgtgcatgcccgctatcatggggaaaaattttgtcgaaagcctcgttggcagttgctggctccgatctgtgagcagcttgatattcccatctttgccaatggtggtatcttttcggtggatgatgcccgcagatgtttggagctctccggtgctgctgggcttatgcttggccgaggtgcggtggagaggccttggctctttaatgaaatagccagggaggtctatggcctggatctacccgtggcggaatcccggccggttgagatctattttcgctttgtccagaaaatggtagaaatttttgctcccgaaaggcaactcggtcgaattaaagaatttacccactatatagcaaaaaatcaccaatttggccatcaccttgcttctgccgtgcaaaagagtcatactgtagaggaagcagtgcaggcagcggaagatttttatggtatttcaagggacatatag

SEQ ID NO: 95012 - protein, 354 aa, Desulfotalea psychrophila LSv54
MIWDCLPLGFKVVRVLFKPFQNEICMKLTFLQRDGEGRLAAPPLSLAPMVGLSHSALRSLIADLGGCGLFYTEMLAARRLPHENPAVSSYLHTTPCERPLIYQLFIADVKYVAPALDKIHRLGGDGVDINLGCPAPSVRRGGAGAALAEDWDRVRDIVSSARRHTDLTLSAKIRVGHVGKEAHLLDFCKMLEAEGVDLLAVHARYHGEKFCRKPRWQLLAPICEQLDIPIFANGGIFSVDDARRCLELSGAAGLMLGRGAVERPWLFNEIAREVYGLDLPVAESRPVEIYFRFVQKMVEIFAPERQLGRIKEFTHYIAKNHQFGHHLASAVQKSHTVEEAVQAAEDFYGISRDI

SEQ ID NO: 95013 - DNA, 987 bp, Desulfotalea psychrophila LSv54
  CDS (1)..(987): transl_table=11
atgtttaccattggccccaatcagttttcttcaccctttgtcctggccccacttgcaggttacacagatctctccttccgacttctctgccatcaatttggggcagactataccgtctctgaaatgattagctgtcatggacttttttataaccaacagagaaccctggaaatgcttgcctcactaccggaagaacgtcctgtctccttccaactctttggggcggagccagatatcatggccaaggcaactctgatactcaatgattttcagcctgatatgattgacataaatatgggctgtccggttcgtaaggtcaccaaaaaaggtgcaggcgcggcccttatgtccaccccggaacttgcctacgatgtcatccgctcggtggttgacaataccgacatccctgtaaccgtaaaatttcgggcaggggtgagcagcacagaactgaacggtgtagagtttggccttatgacagagagggcaggagccgccgccgtagccgttcacggccgaacacgggctcaggcatttagcggagtggccgatcgaggtatcatcaaagaggtcaaagaggccctctccattcccgtcataggaaatggagatatcttatcctaccaggatggtttggatatgatggctgaaacaggttgtgatggggtcatggtcgggcgaggtgcgctcggcaatccatgggtcttccaggctagtggcaagccggcaaacatccatggccttgctgcaggcgccctgcagcacctgctcctcatggaaagattcaaccccgtagagcgcgtccttggccttatcaagaaccatatgagcaaatacttcaaggatatgccgggaagctcaaggctccgcacagctatctttaccgcatcatcctttttagaactgaagggaatgatcaccgaactgagcaatcccgaaagagctcactcccttataactgacattgagcaaaaatatgaaatttcgtaa

SEQ ID NO: 95014 - protein, 328 aa, Desulfotalea psychrophila LSv54
MFTIGPNQFSSPFVLAPLAGYTDLSFRLLCHQFGADYTVSEMISCHGLFYNQQRTLEMLASLPEERPVSFQLFGAEPDIMAKATLILNDFQPDMIDINMGCPVRKVTKKGAGAALMSTPELAYDVIRSVVDNTDIPVTVKFRAGVSSTELNGVEFGLMTERAGAAAVAVHGRTRAQAFSGVADRGIIKEVKEALSIPVIGNGDILSYQDGLDMMAETGCDGVMVGRGALGNPWVFQASGKPANIHGLAAGALQHLLLMERFNPVERVLGLIKNHMSKYFKDMPGSSRLRTAIFTASSFLELKGMITELSNPERAHSLITDIEQKYEIS

SEQ ID NO: 95015 - DNA, 984 bp, Rickettsia typhi str. Wilmington
  CDS (1)..(984): transl_table=11
atgattaaaatcggtaatatagaactttcttcaaatgtgatccttgctccaatgtctaatattacggacttggaatttagaaaattggtaaaaagatttggtgcaggtcttgtagtttctgaaatgatagcaagtagagcgatgattatgaaatctaggcaatcaatgcaaaaatgcgctatcatgcatgacgatccaacaagtgcatgtgtgcagttagcaggctgtgagccggatgtaatagctgacgctgctaaaatgaatgaggatatgggagcaaaaattatcgatcttaattttggttgtccagcgaaaaaggtagtaggcggttatgcaggttcagctttaatgcgagacgagaggttagcgaccaagattttcgaagcgactgttaaagcggttaagattccagtaacggttaaaatgcgtatgggctgggatgataatacgaaaaatgctccgactttagctgtcattgctgccagctcaggtgttcagatggttaccgttcacggtagaaccagatgccagttttattctggtaatgctaattgggattttatacgagtagttaaagaagcggtaaaaattccagttattgctaatggtgatataactaattttgcaaaagcaaaagaagcattacaaaaatccggggcagatggtattatggttggtagaggagtgtatggaaagccttggcttatttcacaaattgcatattatcttaaaactggtaaagaaaaacctgctccctctatagcggagcagctagatataataataaagcattatgatgcaataattgattattatggcaaatctgttggtgtacctattgcacgtaagcatattatttggtatagtagtgggttgccgagttctgctgagtttagatgtgctgttaatttgatgaatgatcctatagctgtaaaagagaaaattgcagaattttatatgagcgttatggatgcaaataaatga

SEQ ID NO: 95016 - protein, 327 aa, Rickettsia typhi str. Wilmington
MIKIGNIELSSNVILAPMSNITDLEFRKLVKRFGAGLVVSEMIASRAMIMKSRQSMQKCAIMHDDPTSACVQLAGCEPDVIADAAKMNEDMGAKIIDLNFGCPAKKVVGGYAGSALMRDERLATKIFEATVKAVKIPVTVKMRMGWDDNTKNAPTLAVIAASSGVQMVTVHGRTRCQFYSGNANWDFIRVVKEAVKIPVIANGDITNFAKAKEALQKSGADGIMVGRGVYGKPWLISQIAYYLKTGKEKPAPSIAEQLDIIIKHYDAIIDYYGKSVGVPIARKHIIWYSSGLPSSAEFRCAVNLMNDPIAVKEKIAEFYMSVMDANK

SEQ ID NO: 95017 - DNA, 1038 bp, Symbiobacterium thermophilum IAM 14863
  CDS (1)..(1038): transl_table=11
gtgaaagggttgtccgaaccgctcctgaagccgatccgcctaggcggtctgaccatcgagcgtccgctggccctggcgcccatggccggcgtcaccaactggccctttcgccgcctctgcaaggagcacggctgcggcctggtggtcactgagttcgtcagcgacaaggcgctcctgtacgacagcaagcgcacccgggagatgatccggctgctgccggacgagcggcccgcgggggtacagctctttggcgcggaccccgacacgatggcgcgggcggcggcgcgcgtcgtggagctggagcagccggacctgatcgacatcaacatgggctgcccggcgccgaaggtgaccaagggccggggtggctcctccctgctgaaggagcctgaactggcccaggagatcgtgcgccgggtggtgcaggccgtcgcaccaacaccggtgacggtgaagatgcgcatcggctgggactcccgctcgatcaacgccgtggaggtcgcgaagcgggtggaggaggccggtgcgcggatgatcacggtgcatggccgcaccaaggagcagcattactccggccgggccgactggggcgtgatcgccgcggtcgcccgggccgtatcgatccccgtgctgggcaacggcgacatcgcggaccccagggaggccgaggcgcggctgcgcacgtccggggtcgcaggtctcgcggtggggcggggcgcgctcgggaacccctggatcttcagccgcaccctacattacctggagacgggcgagcttctgccggagccgggggtccgggagcgggtggagaccgcgctccgccacctggatctgatgattgagtacaagggcgagttcctggccgtccgggagatgcgcaagcacgccgcctggtatctgaaagggctccacgggtccgccggggtccgggcggcggtcaacgaggcggagcgcgcagacgacctgcgcgccctcctcctgggttacctggaccgcatggaggccgtcgcagcggaaaacgtcagactgttaagttga

SEQ ID NO: 95018 - protein, 345 aa, Symbiobacterium thermophilum IAM 14863
MKGLSEPLLKPIRLGGLTIERPLALAPMAGVTNWPFRRLCKEHGCGLVVTEFVSDKALLYDSKRTREMIRLLPDERPAGVQLFGADPDTMARAAARVVELEQPDLIDINMGCPAPKVTKGRGGSSLLKEPELAQEIVRRVVQAVAPTPVTVKMRIGWDSRSINAVEVAKRVEEAGARMITVHGRTKEQHYSGRADWGVIAAVARAVSIPVLGNGDIADPREAEARLRTSGVAGLAVGRGALGNPWIFSRTLHYLETGELLPEPGVRERVETALRHLDLMIEYKGEFLAVREMRKHAAWYLKGLHGSAGVRAAVNEAERADDLRALLLGYLDRMEAVAAENVRLLS

SEQ ID NO: 95019 - DNA, 999 bp, Bacillus cereus ZK
  CDS (1)..(999): transl_table=11
gtgttaaaaatcgcaaatattgagatgaaaaatccggttgtattagcaccgatggcgggagtgtgtaactctgcattccgtttgacagtaaaagaattcggtgcaggcctagtttgtgccgaaatggtaagtgataaagcgatactattgaataataaaagaacattagatatgttatatatcgatgagagagaaaagccattaagtttacaaatttttggtggagagaaagaaacccttgtagatgctgcgaaatacgtagatcaatatacgacagcggacatcattgatattaatatggggtgtccagtaccgaaaatcgttaagtgtgatgcaggagcaaagtggcttttagacccaaataaaatatatgaaatggtagcggcagttgtagatgctgtagaaaaaccagttacagttaaaatgcgtattggttgggatgaggatcatattttcgcaatcgagaatgcgaaagctgttgagcgtgctggtggacaagcggtagcagttcatggacgtacaagagtacaaatgtatgaaggaaaagcggattgggatattattaaacaagtaaagcaagctgtaaatatcccggttatcggaaatggtgatgtcgcaacgccacaagatgcaaagcgtatgcttgatgaaattggtgtagatggtgttatgattggccgcgctgcccttggagatccttggatgatttatcgtacggtaaagtatttagagacaggtgaattaatgccggaaccgacagtacgtgagaaaattgacgtatgtatgttgcatctagatcgtctaatcgatttaaagaacgaaagtgttgctgtaagagagatgagaaagcatgcagcttggtatttaaaaggtattcgtggtaatgcaaatgtacgtaatggtataaatgcttgtaatacgcgtgaagaccttgcaagtgtattaggtgtatttgtagaagaagtggaagcgaaacaacaaacaattcacgttggttaa

SEQ ID NO: 95020 - protein, 332 aa, Bacillus cereus ZK
MLKIANIEMKNPVVLAPMAGVCNSAFRLTVKEFGAGLVCAEMVSDKAILLNNKRTLDMLYIDEREKPLSLQIFGGEKETLVDAAKYVDQYTTADIIDINMGCPVPKIVKCDAGAKWLLDPNKIYEMVAAVVDAVEKPVTVKMRIGWDEDHIFAIENAKAVERAGGQAVAVHGRTRVQMYEGKADWDIIKQVKQAVNIPVIGNGDVATPQDAKRMLDEIGVDGVMIGRAALGDPWMIYRTVKYLETGELMPEPTVREKIDVCMLHLDRLIDLKNESVAVREMRKHAAWYLKGIRGNANVRNGINACNTREDLASVLGVFVEEVEAKQQTIHVG

SEQ ID NO: 95021 - DNA, 1026 bp, Mannheimia succiniciproducens MBEL55E
  CDS (1)..(1026): transl_table=11
ttgccgtatacagggcgaggaagggtgttatctactttaaggggaatagaaaaggtgcgaattggttcttatcaactgaaaaatcgcattttgctggctccgatggcaggtattaccgaccaaccgtttcgaaaattatgtgcggcctatggtgccggacttacgttttcagaaatgatgtcaactaatccgcaagtttggcatacggaaaaatcccgtttacgcttggctcatcaccaagctgcaggaattaatgcagttcagattgcaggttctgatccgaaagaaatagcgaaagcagcacaaattaatgtggattacggcgccgaaattattgatattaatatgggatgcccggccaagaaagtaaaccgtaaaatggcaggttccgccctattgcaatatcccgatttagtgcgtcaaattcttgaacatgttgttaacgcagttagtgtcccggtgacgttaaaaatacggacgggttggaataaagaacatcgaaactgtgttgaaatcgcaaaaatagcagaacaaagcggtattcaggcattaactattcatggacgtactcgtgaatgcttatttgaggggaatgccgaatacgacaatattaaagcggtaaaacgacaggtatcaattcctgttattgcaaacggagatataacatcagcggaaaaagctaaatccgtacttgaatatacgggggcggatgcggtaatgattggacgtggagcattaggtaatccctggttatttaaatcggtggaaagcctagttgaaacaggttcaatagtttttgaaccaagtctggacgaaaagtgcggtgtaattttgcaacatattcaatcgcttcatcaattttacggtgaagaaaaaggatatcgcattgcacgcaaacacgtcgcttggtatttgcaaggaattcaacctagttccaattttaaacagacttttaatgcaataacagaaccacaagaacagttaattgcattggaagagttttttaattcaattcgcaatggataa

SEQ ID NO: 95022 - protein, 341 aa, Mannheimia succiniciproducens MBEL55E
MPYTGRGRVLSTLRGIEKVRIGSYQLKNRILLAPMAGITDQPFRKLCAAYGAGLTFSEMMSTNPQVWHTEKSRLRLAHHQAAGINAVQIAGSDPKEIAKAAQINVDYGAEIIDINMGCPAKKVNRKMAGSALLQYPDLVRQILEHVVNAVSVPVTLKIRTGWNKEHRNCVEIAKIAEQSGIQALTIHGRTRECLFEGNAEYDNIKAVKRQVSIPVIANGDITSAEKAKSVLEYTGADAVMIGRGALGNPWLFKSVESLVETGSIVFEPSLDEKCGVILQHIQSLHQFYGEEKGYRIARKHVAWYLQGIQPSSNFKQTFNAITEPQEQLIALEEFFNSIRNG

SEQ ID NO: 95023 - DNA, 936 bp, Mannheimia succiniciproducens MBEL55E
  CDS (1)..(936): transl_table=11
atgcgtgttattttagctcctatgcaaggcgtgctggacgcttttgtgcgccaactgcttactgaagtcaatgattacgatctctgtatttccgaattcgtgcgagtagttgaccaactgctaccggaaaaagtgttttatcgcctttgccccgaactgaaaaatgccggcaaaacaaccaccggcacgcctatacgagtccaacttctcggtcaatttcccgaatggctggcggaaaatgcggtgcgcgccgttgaattagggtctttcggcgtcgatcttaactgcggttgtccgtcaaaaacggtaaacggcagtcatggcggcgcctctttattaaaacaaccggaattaatttatcaggcgacccgagccattcgaaccgccgtacctaaacatttgccggtcagcgtaaaagtgcgcctgggctgggattccgccgacttcgcctttgatattgccgatgccgttcaacaaggcggggcgaatgaaatcactattcacggacgaacaaaggccgacggttacaaagcggaacgaatcaactgggaaaaaatcggtgaattgcgccgaaaactcgctattccggtaattgccaacggtgaaatctggaactggcaagacggacaaaattgccttgcggtaacgggatgcgaagatttaatgattgggcgcggtgcgttaaatattcctaatttaagccgggtggtcaaacgtaacgaagaaaaattgccgtggcataaagtgatacggattttgcaaaaatacgctcatttagaaaatattcatgacacaggtttttatcatgtggctcgcattaaacaatggctgcaatatttaaaaaaagaatatccgcaggctactatgctgtttgactatattaaaacctgtcataatgcggacgaattacgaataaaaatggaacacttacaatga

SEQ ID NO: 95024 - protein, 311 aa, Mannheimia succiniciproducens MBEL55E
MRVILAPMQGVLDAFVRQLLTEVNDYDLCISEFVRVVDQLLPEKVFYRLCPELKNAGKTTTGTPIRVQLLGQFPEWLAENAVRAVELGSFGVDLNCGCPSKTVNGSHGGASLLKQPELIYQATRAIRTAVPKHLPVSVKVRLGWDSADFAFDIADAVQQGGANEITIHGRTKADGYKAERINWEKIGELRRKLAIPVIANGEIWNWQDGQNCLAVTGCEDLMIGRGALNIPNLSRVVKRNEEKLPWHKVIRILQKYAHLENIHDTGFYHVARIKQWLQYLKKEYPQATMLFDYIKTCHNADELRIKMEHLQ

SEQ ID NO: 95025 - DNA, 975 bp, Bacteroides fragilis YCH46
  CDS (1)..(975): transl_table=11
atgaaaataggccacatagacctgggcgaacgccctgtatttctggctccgatggaggatgtcactgaccccgcttttcgcctgatgtgcaaaaagtttggagccgatatggtatacaccgagttcgtctcgagtgatgctttgatacgttccgtcaataaaaccactcaaaaactgaccatctgcgatgaagaacgccccgtcgccattcaaatatacggtaaagacacggaggccatggtgggtgccgcccggattgtagaagaagcacaaccggatatattggatatcaacttcggttgcccggtaaagaaagtagcagggaaaggggccggagccggcatgttgcagaatatccccaagatgctggaaataacccgtgccgtggtagatgcagtcaaaatacctgtcaccgtgaaaacccgactgggatgggatgccgatcataaaataatagtggacctggcagagcaactgcaggattgcggcattgcggcactggccattcacggacgtacccgtgcgcagatgtatacaggcgaggcagactggaccctgataggagaagtcaagaataacccacgtatgcacatacctattataggaaacggtgatgtgaccacggccgctggtgccaaagagtgctttgagcgatatggtgtagatgcgattatgataggacgcggcagtatcggccgtccctggatattccgcgaagtgaagcattatctggaaaccggagaagaacttccgcgggaatcattcgagtggtatctcgatgtgttgcgcgaagaggtgctgaacagtgtagcccgactggacgaacgcagggggatcatccatatccgccgtcatctggcagcaactcccctatttaaaggaatccccaatttccgtgagacacgcattgccatgctacgcaccgaatcggtagaagaactcttccggatattcgacggactcaccacagagtaa

SEQ ID NO: 95026 - protein, 324 aa, Bacteroides fragilis YCH46
MKIGHIDLGERPVFLAPMEDVTDPAFRLMCKKFGADMVYTEFVSSDALIRSVNKTTQKLTICDEERPVAIQIYGKDTEAMVGAARIVEEAQPDILDINFGCPVKKVAGKGAGAGMLQNIPKMLEITRAVVDAVKIPVTVKTRLGWDADHKIIVDLAEQLQDCGIAALAIHGRTRAQMYTGEADWTLIGEVKNNPRMHIPIIGNGDVTTAAGAKECFERYGVDAIMIGRGSIGRPWIFREVKHYLETGEELPRESFEWYLDVLREEVLNSVARLDERRGIIHIRRHLAATPLFKGIPNFRETRIAMLRTESVEELFRIFDGLTTE

SEQ ID NO: 95027 - DNA, 984 bp, Methylococcus capsulatus str. Bath
  CDS (1)..(984): transl_table=11
atgcaaatcggaccctaccgcctcagtagcccggtcatcctcgcacccatggcgggcgtcaccgatctcccttttcgcaggctctgccggcaattcggcgcggggctcgcggtctcggagatgatatccgccagcccggcgttgcaggccacacgcaagtccaggctgcggcaagatcaccgcggtgagcctggcccgatcagcgtccagatcgtcggcgccgatccgagggagatggccgaggcggcgcgccgcactgtcgatctcggcgccgacatcatcgacatcaacatgggctgccccgcgaaaaaagtctgcaacgtcgccgccggttcggccctgctgcgcgacgagaagctggtggcgaacatcctcgaagcggtggtccaggccgtaccggttccggtcaccctgaagatcaggaccggctgggattcggcgtcccgcaatgcggtcagcatcggaaaaatcgccgaaagcgccggaatccgggcgctcacggttcatggccgcacccgcgcctgcgggtttgcgggggcagccgaatactctacaattaccgaagttaagaaagccatcggcattccggtcatcgccaacggcgacatcgactctcccggaaaagccgaggccgtgctccgatcgaccggcgcggatgccgtgatgatcggccgtggcgcctggggacggccctggctgctgcgggaaatcgacgcgcggctcaaggacggtcgccagcccttgccccctacgctcgatgagatccgccgcaccgtgctcggccacctcgaagcgctgtattccttctatggggagaagcagggggtgcggatcgcacgcaaacatatcggctggtacgccgcccggatcccgggtctggacgaccggctggtaccggggattttttccctcgccaacgccccccagcagctctccgctgtggaagccctgttgaaatttcagttcgagaagaccgctgcatga

SEQ ID NO: 95028 - protein, 327 aa, Methylococcus capsulatus str. Bath
MQIGPYRLSSPVILAPMAGVTDLPFRRLCRQFGAGLAVSEMISASPALQATRKSRLRQDHRGEPGPISVQIVGADPREMAEAARRTVDLGADIIDINMGCPAKKVCNVAAGSALLRDEKLVANILEAVVQAVPVPVTLKIRTGWDSASRNAVSIGKIAESAGIRALTVHGRTRACGFAGAAEYSTITEVKKAIGIPVIANGDIDSPGKAEAVLRSTGADAVMIGRGAWGRPWLLREIDARLKDGRQPLPPTLDEIRRTVLGHLEALYSFYGEKQGVRIARKHIGWYAARIPGLDDRLVPGIFSLANAPQQLSAVEALLKFQFEKTAA

SEQ ID NO: 95029 - DNA, 1149 bp, Nocardia farcinica IFM 10152
  CDS (1)..(1149): transl_table=11
gtgacgatgactaccgaggcgacctcgacgctgcggatcggcccgtatccggtcgatccgccggtcgtgctcgcgccgatggcgggcatcaccaatctcgcgttccgcaagctgtgccgggagttcggcagcgccacctcgatctacgtgtgcgagatgatcaccgcccgcgcggtcgtggagcgcaacgagaagaccctgcacatgatgtccttcgacgccgacgagcatccgcggtcgatgcagctctacggcgtggacccgcagaccctcggcgaggccgtgcgcatcatcgtcggcgagggctgggccgaccacatcgacatgaacctcggctgcccggtgcccaaggtcacccggctcggcggcggtgccgcgctgccctacaagcgcgcgctgttcgcgcggatcgtgcgcgcgatggtcgccgccgcggaaccggcgggcgtgccggtgacggtgaagttccgtatcggcatcgacgacgatcatcacacctacctcgacaccggccgcatcgccgaggccgagggcgcccgcgcggtgtcgctgcatgcccgcacggccgcgcagcgctactccggccaggccgactggtcggcgatcgcccggctcaaggaggccgtcaccaccatcccggtgctcggcaacggtgacatcttcgccgccgaggacgcggtgcggatgatggccgagaccggctgcgacggcgtggtggtcggccgcggctgcctggggcggccctggctgttcgccgagttgcaggcggcgttgcgcggtcagccgctgccggagccgcccaacctgggccgggtgggcgaagtgctgtaccggcacggtgcgctgctgtccgaacacctcggcgaggacaaggccatgcgcgatctgcgcaagcacatggcctggtacctgatgggcttcccggtcggcgcggacctgcgccggtccttcgcgacggtgtcgagcctggcccagttgcgtgacctgatcggccggctcgatccgaccgcgccgttccccaaggacgccgagggcccgcgcgggcgccagggctccccgggcaaggtggcgctgccgcacggctggctcgacgacccggacgatcccgccgtgcccaccgcggccgacgtcatgcacagcgggggctga

SEQ ID NO: 95030 - protein, 382 aa, Nocardia farcinica IFM 10152
MTMTTEATSTLRIGPYPVDPPVVLAPMAGITNLAFRKLCREFGSATSIYVCEMITARAVVERNEKTLHMMSFDADEHPRSMQLYGVDPQTLGEAVRIIVGEGWADHIDMNLGCPVPKVTRLGGGAALPYKRALFARIVRAMVAAAEPAGVPVTVKFRIGIDDDHHTYLDTGRIAEAEGARAVSLHARTAAQRYSGQADWSAIARLKEAVTTIPVLGNGDIFAAEDAVRMMAETGCDGVVVGRGCLGRPWLFAELQAALRGQPLPEPPNLGRVGEVLYRHGALLSEHLGEDKAMRDLRKHMAWYLMGFPVGADLRRSFATVSSLAQLRDLIGRLDPTAPFPKDAEGPRGRQGSPGKVALPHGWLDDPDDPAVPTAADVMHSGG

SEQ ID NO: 95031 - DNA, 987 bp, Legionella pneumophila str. Paris
  CDS (1)..(987): transl_table=11
atgcacacttttattaacagtcctctgcaaatcggctctttaaaactccctcatcgactgattcaaggacctttggcaggatacagttgcgcccctttcagagatctattcaatatttatacaccgcctgcttattgcgtttctgaaatgtgttctgccatcgacattcttcataaacactcctctcaatcccggtatatttacagagctcccacagaaaaactcctggcttaccaaatctccggaaatgagccacatgtccttgcagaagcagcagctaaactgcaatcactgggtgcggatctaattgatattaattgcggctgccctaaaagcaaaattcgtaaaaaaggggctggtagcgctttattggaagatccacaaaaattgattgccattatctctagggtacgcgcagcaattagcattccgctgactattaaaatacgcattcaaaataatgaaaaggatttaaccttagccaaacaaatagaggacgccggagctcatgccctgatagtacatggcaggcgatggacagaagattatgatatcccatgcaattggcagcaaattgcaaatatcaagaatgctgtcaatataccagttattgtaaatggtgatattagcaatatatccagtttaagaaaggccctggaaatcagcatgtgcgatggttttatgatttctcgagcaggtacaggcaaaccctggctatatcgagatttattgaatctggaaacaaatgatgtcgcttttgacgagaaattaaaactgtttatgctccacctcgaaggattatcataccttgaaaacgagcataaagcggtactgcaaagcaagtctctagtccgctattatttcaaaaagcaactgaacgaacaacaactgcaactgttctatcaattaggtacattaatggaaatcaaggattttttagctgaggcaactcaccgagtttccaacatattagttgccacctcatga

SEQ ID NO: 95032 - protein, 328 aa, Legionella pneumophila str. Paris
MHTFINSPLQIGSLKLPHRLIQGPLAGYSCAPFRDLFNIYTPPAYCVSEMCSAIDILHKHSSQSRYIYRAPTEKLLAYQISGNEPHVLAEAAAKLQSLGADLIDINCGCPKSKIRKKGAGSALLEDPQKLIAIISRVRAAISIPLTIKIRIQNNEKDLTLAKQIEDAGAHALIVHGRRWTEDYDIPCNWQQIANIKNAVNIPVIVNGDISNISSLRKALEISMCDGFMISRAGTGKPWLYRDLLNLETNDVAFDEKLKLFMLHLEGLSYLENEHKAVLQSKSLVRYYFKKQLNEQQLQLFYQLGTLMEIKDFLAEATHRVSNILVATS

SEQ ID NO: 95033 - DNA, 966 bp, Photobacterium profundum SS9
  CDS (1)..(966): transl_table=11
ttgcaaatcggtccatatcaactaaacaaccagctgatagtcgcgccaatggcgggtgtgaccgatcggccatttcgtgaactatgccttcgctacggcgcgggaatggctgttagcgagatgatgtcgtcgaatccagatttatggaaaacggctaaatcgcagaaccgaatggttcatgaaggtgaatcggggattcgctcggttcaaattgcaggagcagatccaaaactgatggctgaagctgcacaatttagtgttgaaaacggtgcgcaaatcatcgatatcaacatgggttgtccagcgaaaaaagttaacaaacgcttggcaggttctgcattactgcaacaccctgcgttaatcgaagagattcttcgtagcgttgtgggtgcagtcgatgttcccgttacgctaaaaacgcgtacgggttgggatttagacaaccgtaactgtgtcgacattgcaaaaatcgcggaacaatgtggcattcaagctttggcgcttcatgggcgaacgaagtcttgcatgtacaaaggtgaagcggaatatgactacatcagagcagctaaacaagcggtatccattccggtaattgctaacggtgatatcgattcaccggaaaaggctcgctttgtactcgattatacgggtgcagatgctttgatgattggccgtcctgcacaaggacgaccgtggatttttagagaaatccagcattacttaacaactggcgaatacctgcctgccccatctatggatgaggtaagtggaattatgttgggacatgttcaagaacttcatcgtttctacggtgaatatttagggttgcgcattgcacgtaaacacgtgtcttggtacttaaaagaacatgcaccagctggtgatttccgtcggtccttcaacgcactcgaggatgctcaagagcaaatcgatgcgctgcaaggctacttcgaaaacgttgcataa

SEQ ID NO: 95034 - protein, 321 aa, Photobacterium profundum SS9
MQIGPYQLNNQLIVAPMAGVTDRPFRELCLRYGAGMAVSEMMSSNPDLWKTAKSQNRMVHEGESGIRSVQIAGADPKLMAEAAQFSVENGAQIIDINMGCPAKKVNKRLAGSALLQHPALIEEILRSVVGAVDVPVTLKTRTGWDLDNRNCVDIAKIAEQCGIQALALHGRTKSCMYKGEAEYDYIRAAKQAVSIPVIANGDIDSPEKARFVLDYTGADALMIGRPAQGRPWIFREIQHYLTTGEYLPAPSMDEVSGIMLGHVQELHRFYGEYLGLRIARKHVSWYLKEHAPAGDFRRSFNALEDAQEQIDALQGYFENVA

SEQ ID NO: 95035 - DNA, 1053 bp, Streptococcus thermophilus CNRZ1066
  CDS (1)..(1053): transl_table=11
atggggctgaaatcgtctgtcaattctgccaaactaagtatgaattttcagaagctgacttggaggaactcatcaatgactaaacttaattcatcctttatgattggaaatgtagagatccctcaccgaacagtcctagctcctatggcaggcgtgaccaactctgccttccgtactattgcaaaagagtttggtgctggtcttgtggtgatggagatgatttctgaaaaaggtctcctctacaataatgagaaaaccctccacatgcttcatattgatgagaatgaacatccaatgtctatccagcttttcggtggtgatgctgagggcttgaagcgtgcagctgattttattcagaccaataccaaggctgatatcgttgatatcaatatgggttgtccggtcaataaggtagtcaaaaatgaagcgggtgccaagtggctcaaggatccagacaagatttaccacattgtcaaggaagtaacgtcagtgcttgatattcccttgaccgttaagatgcgtacgggatggtcagacagtgatttggctgtggaaaacgctcttgcagctgagtctgcaggtgtttctgctcttgccatgcacggtcgtacccgtgaacaaatgtatactggtcactgtgaccacgagacgctggctcgtgttgctaaagctattactaagattccatttatcggaaatggagatgttcgtaacgttcaagacgctaaactcatgattgaagaacttggcgtagatgccgttatggtgggtcgtgcagccatgaataatccatacatcttcacgcaaatcaatcacttcttcgaaacgggagaggagttgccagatcttccgtttgataagaagctggacattgctgaagaccacctcaaacgtttggtagaccttaaaggtgagatgattgctgtccgtgaattccgtggtcttgctccacactatcttcgtggaacagcaggagcagctaaggttcgtggcgaagtctcgcgtgccgagtctgttgctcaggtcaaagaaatctttgcgactttacgatga

SEQ ID NO: 95036 - protein, 350 aa, Streptococcus thermophilus CNRZ1066
MGLKSSVNSAKLSMNFQKLTWRNSSMTKLNSSFMIGNVEIPHRTVLAPMAGVTNSAFRTIAKEFGAGLVVMEMISEKGLLYNNEKTLHMLHIDENEHPMSIQLFGGDAEGLKRAADFIQTNTKADIVDINMGCPVNKVVKNEAGAKWLKDPDKIYHIVKEVTSVLDIPLTVKMRTGWSDSDLAVENALAAESAGVSALAMHGRTREQMYTGHCDHETLARVAKAITKIPFIGNGDVRNVQDAKLMIEELGVDAVMVGRAAMNNPYIFTQINHFFETGEELPDLPFDKKLDIAEDHLKRLVDLKGEMIAVREFRGLAPHYLRGTAGAAKVRGEVSRAESVAQVKEIFATLR

SEQ ID NO: 95037 - DNA, 1002 bp, Geobacillus kaustophilus HTA426
  CDS (1)..(1002): transl_table=11
atgtttcgcattggcgatgtcgaaattaaaaaccgcgtcgtgctcgctccgatggcaggcgtatgcaactccgcgttccgcctgaccgtcaaagaattcggcgccgggcttgtatgcgccgagatggtaagcgacaaaggaatcgtatacaacaacgaaaagacgttaaacatgttatatattgatgaacgggaaaagccgatcagcttgcaaattttcggcggcgagaaagaaacgctcgtcaaagcggcgaaatttgtcgataaaaatacgaatgcagatatcatcgacatcaacatgggttgcccagtgccgaaaattacgaattgcgacgctggagcgaaatggctgcttgacccgaataaaatttatgatgtcgttgccgcgatcgtcgatgccgttgaaaaaccggtcacggtgaaaatgcggatcggttgggatgaaaagcacatttacgccgtcgaaaacgctcaagccgttgagcgcgccggcgggaaggccgtcgccgtccacggacggacaagggtgcaaatgtatgaaggaaaagcggactggaacatcatcaagcaagtgaaagaagccgtcaacatcccggttatcggcaacggagatgtcaaaacgcctcaagatgcaaagcggatgcttgaagaaacaggggtcgacggcgtcatgatcggacgggcggcgcttggaaacccttggatgatctatcgcactgtccgttatttagaaactggagagctcatcccggaaccgacgccgagggaaaaaatcgatgtctgcctgctgcatttagaccgattaattgccttaaaaggcgaatatatcgccgtcaaagaaatgcgtaaacacgctgcttggtatttaaaaggcattcgcggcgcagcgaaaatccgcaacgccatcaatgaatgtgaaacgcgggacgaactggccgcactgttgcttcgcgtggcggaggaagcggaagtccaagcagcggcgaacgccgaagccgtttaa

SEQ ID NO: 95038 - protein, 333 aa, Geobacillus kaustophilus HTA426
MFRIGDVEIKNRVVLAPMAGVCNSAFRLTVKEFGAGLVCAEMVSDKGIVYNNEKTLNMLYIDEREKPISLQIFGGEKETLVKAAKFVDKNTNADIIDINMGCPVPKITNCDAGAKWLLDPNKIYDVVAAIVDAVEKPVTVKMRIGWDEKHIYAVENAQAVERAGGKAVAVHGRTRVQMYEGKADWNIIKQVKEAVNIPVIGNGDVKTPQDAKRMLEETGVDGVMIGRAALGNPWMIYRTVRYLETGELIPEPTPREKIDVCLLHLDRLIALKGEYIAVKEMRKHAAWYLKGIRGAAKIRNAINECETRDELAALLLRVAEEAEVQAAANAEAV

SEQ ID NO: 95039 - DNA, 939 bp, Salmonella enterica subsp. enterica serovar Paratypi A str. ATCC
  CDS (1)..(939): transl_table=11
atgcgtgttttactggcgccgatggaaggcgtgctcgacgcgttagtgcgcgagctgctgaccgaagtgaatgattacgatctctgcatcaccgaatttgtgcgcgtggtggatcagctgctgccggtaaaagtgtttcatcgcatctgcccggagttgcatcacgccagccgcacgccgtccggcacgccggtgcgtattcagcttctgggccagcatccgcagtggctggcggaaaacgccgcgcgggcgacggcgttgggatcgtatggcgtggacctgaactgcggctgtccgtcaaaagtggtgaacggcagcggcggcggtgcgacattgctcaaagatcccgaactcatctatcagggcgcgaaagcgatgcgggccgcggtaccgtcgcatctgccggtgacggtaaaagtgcgtctcggctgggatagcggcgatagaaaatttgaaatcgccgatgcggtgcagcaggccggcgccagtgaactggtggtgcatggccgtaccaaagcgcagggctaccgcgccgagcatatcgactggcaggcgatcggcgaaatacgccagcgtctgactattccggttatcgctaatggcgaaatctgggactggcagagcgcgcaggcatgtatggcgatcagcggctgcgatgcggtgatgattggccgtggggcgttaaatattcctaacctgagtcgggtggtgaagtataacgagccgcgtatgtcgtggccggaagtagtgacgttattacaaaaatatacccggctggaaaagcagggcgataccggtttataccatgtcgcgcgtattaaacagtggttgggatatttacgtaaggaatatattgaggcgacggaactctttcagtcgattcgggcgttaaaccgttcgtccgagattgcgcgggcgattcaggctattaaaatctaa

SEQ ID NO: 95040 - protein, 312 aa, Salmonella enterica subsp. enterica serovar Paratypi A str. ATCC
MRVLLAPMEGVLDALVRELLTEVNDYDLCITEFVRVVDQLLPVKVFHRICPELHHASRTPSGTPVRIQLLGQHPQWLAENAARATALGSYGVDLNCGCPSKVVNGSGGGATLLKDPELIYQGAKAMRAAVPSHLPVTVKVRLGWDSGDRKFEIADAVQQAGASELVVHGRTKAQGYRAEHIDWQAIGEIRQRLTIPVIANGEIWDWQSAQACMAISGCDAVMIGRGALNIPNLSRVVKYNEPRMSWPEVVTLLQKYTRLEKQGDTGLYHVARIKQWLGYLRKEYIEATELFQSIRALNRSSEIARAIQAIKI

SEQ ID NO: 95041 - DNA, 963 bp, Anaplasma marginale str. St. Maries
  CDS (1)..(963): transl_table=11
ttgccaatgagacagcttatatctgaatgcccagtaattttggcgccaatgtcaggcgttactgacatgccctttcggtctatcgtcggggaattcggtgcagggcttttagtttctgaaatgatcgccagtcgggctatgataataaaaacgcggcaaagtctgcaaaaatcagacgttggggcaaacactgccgtacagttggctggatgcgtgcctgagattatggcggaagcagcaaaaattaaccaagatatgggcgcaaggtcgatagatatcaattttggttgcccggtgaaaaagatagtagacggccatgccggctccgcgcttatgaaagacgaggagaaagctacaaaaataatggagagcgtggtaaaggcggtgaccattcccgtgaccgtcaagatgcgtatgggctggagtgcaacagatttgaacgcacccaggttggcaaaaatagctgaagacgttggtatacagatggttacagtacacgggagaaccaggacccagatgttcagcgggactgcagattggaagtttatcaagtgcgtgaaagattgtgttaagataccagtgatagcaaatggagatatccgcactcttcaagacataaccagtgcgttaagtctttccggtgcagacggggttatgattggcagaggggcgtacggcaagccttggctcataaaacaggcactgcactttatgaaaacaggggaggcattgcctgagccttcggcggacgaaaaacttagaatagtgctaaagcattacgatagtgcagtagattactacgggaaggacataggcgtgaagattcttaggaagcatcttggatggtatagcgtctccaatgctggtgccacatatttcagggcgcagattaatacgatgagtgacccggtagcgataagggaaaagttgttagagttctttggaaccagcggaaatgcgtga

SEQ ID NO: 95042 - protein, 320 aa, Anaplasma marginale str. St. Maries
MPMRQLISECPVILAPMSGVTDMPFRSIVGEFGAGLLVSEMIASRAMIIKTRQSLQKSDVGANTAVQLAGCVPEIMAEAAKINQDMGARSIDINFGCPVKKIVDGHAGSALMKDEEKATKIMESVVKAVTIPVTVKMRMGWSATDLNAPRLAKIAEDVGIQMVTVHGRTRTQMFSGTADWKFIKCVKDCVKIPVIANGDIRTLQDITSALSLSGADGVMIGRGAYGKPWLIKQALHFMKTGEALPEPSADEKLRIVLKHYDSAVDYYGKDIGVKILRKHLGWYSVSNAGATYFRAQINTMSDPVAIREKLLEFFGTSGNA

SEQ ID NO: 95043 - DNA, 972 bp, Idiomarina loihiensis L2TR
  CDS (1)..(972): transl_table=11
atgcggattggtccatatcaactcgacaatcaggtcatattagctcccatggctggagttactgatcagccgttccgtcagctgtgttacagcacgggggccgggcttacagtatcagagatgctgtccagtaaccctaaggtatggcagaccgataaatccaggcaacgcatggatcattcgggagagctgggcattcgtgctgtgcagatagcgggctcggaaccggcattaatggccgaagcagcgcgcgtgaatgtgagtatgggtgcgcagattattgacataaatatgggctgcccggcgaaaaaggtaaataagaagatggctggctcggcgctcatgcagcatcccgggttagtagaagagatattaacagctgtggttgcagctgttgaggttccggtaacactgaaaaccagaaccggttgggatcctgaacacagaaacggtattgatatagcgcagctggcagaacgttgcggtattcagtctcttgccattcatggtcgtactcgtgcctgcatgtacaaaggcattgccgaatacgacaccattaaggcaattaagaaggctgtttctatcccagtagtggctaacggcgatatccgtacaccactgcaggctcaacaggttttagagtacaccggagccgacgccattatgattggtcgcggcgcgcagggtaacccctggctgtttagagaaattgctcattttcttgaaacaggacaggagctaagcccgccgtccttaaccgaagtggctgagaccgttattcatcacgttggcaaactgcacgaattttacggcagttaccagggtgtcagaatcgcccgaaaacacgttggttggtatttaaaagaacaagccagcaatgatgaattcaggcaaacatttaatcgtcttgaggatgccagcgagcaacttaaggcacttgaagattattttgtcactgtagagaagagataa

SEQ ID NO: 95044 - protein, 323 aa, Idiomarina loihiensis L2TR
MRIGPYQLDNQVILAPMAGVTDQPFRQLCYSTGAGLTVSEMLSSNPKVWQTDKSRQRMDHSGELGIRAVQIAGSEPALMAEAARVNVSMGAQIIDINMGCPAKKVNKKMAGSALMQHPGLVEEILTAVVAAVEVPVTLKTRTGWDPEHRNGIDIAQLAERCGIQSLAIHGRTRACMYKGIAEYDTIKAIKKAVSIPVVANGDIRTPLQAQQVLEYTGADAIMIGRGAQGNPWLFREIAHFLETGQELSPPSLTEVAETVIHHVGKLHEFYGSYQGVRIARKHVGWYLKEQASNDEFRQTFNRLEDASEQLKALEDYFVTVEKR

SEQ ID NO: 95045 - DNA, 1053 bp, Azoarcus sp. EbN1
  CDS (1)..(1053): transl_table=11
atgcgccctcttccccgaacaccctctccatccatgcagtacgccggttttaccctgcgcaacaatcttttcgtcgccccgatggcgggcgtgaccgatcggccgttccgccaactgtgcaagaagctcggcgcaggcgtcgcggtcagcgaaatggtcacgtcgaactcgctgctctatggcagcgcgaaaacccgtcgccgcgccgagcacgccggcgaggccgatccgatctcggtgcagatcgccggcgccgatccggcgatgatggccgacgccgcgcgctacaacgccgacaacggcgcacagatcatcgacatcaacatgggctgcccggcgaagaaagtctgcaacgtcatggcaggctccgcgctgatgcaggatgagccgctcgtcgcccgcatcctcgaagcggtcgtcgccgcggtgcccggcaccccggtgacactgaagttccgcaccggctggaaccgcgacaatcgcaacgcgccgacgatcgcccgcattgccgaagcatcgggcatccgcgcggtcgcgatccatggccgcacgcgcgccgaccaatacaccggcaacgccgagtacgacacgatcgccgaagtgaaatccctcgtgaagatcccggtgatcgccaacggcgacatcacgacgcccgagaaagcccgctacgtgctcgactacaccggtgccgacggcgtgatgatcggccgcgccgcgcagggccgaccgtggattttccgcgaaatcgagcattacctcgcgaccggcacgctgctgccgccgccgctcgtcgccgagatcctccaggtatgccgcgagcacctgggcgacctgtacgcgttctatggagaggaaaccggagtcaggatcgcgcgcaagcacatctcctggtacacgaagggcctcgtcggctcggcggctttccgccgcacgatgaaccagctgtcggatgtacgcgaacaactcgaggcggttgacgacttcttcggccgcctcgccgagcaggacgcccgcctgcgctacgaagaacttccgcaggaactcgcagcatga

SEQ ID NO: 95046 - protein, 350 aa, Azoarcus sp. EbN1
MRPLPRTPSPSMQYAGFTLRNNLFVAPMAGVTDRPFRQLCKKLGAGVAVSEMVTSNSLLYGSAKTRRRAEHAGEADPISVQIAGADPAMMADAARYNADNGAQIIDINMGCPAKKVCNVMAGSALMQDEPLVARILEAVVAAVPGTPVTLKFRTGWNRDNRNAPTIARIAEASGIRAVAIHGRTRADQYTGNAEYDTIAEVKSLVKIPVIANGDITTPEKARYVLDYTGADGVMIGRAAQGRPWIFREIEHYLATGTLLPPPLVAEILQVCREHLGDLYAFYGEETGVRIARKHISWYTKGLVGSAAFRRTMNQLSDVREQLEAVDDFFGRLAEQDARLRYEELPQELAA

SEQ ID NO: 95047 - DNA, 1026 bp, Zymomonas mobilis subsp. mobilis ZM4
  CDS (1)..(1026): transl_table=11
atgaacagccctgaacataatcctacccataatctgatttcgcctattcagataggctctgtccgaattgataatccggttattctagctccgatgacaggcgttacggatttgccttttcgtcggattgtccgccgttatggttcgggattgaatgtgacggaaatgattgccagtcaggcgatgattcgggaaacgcgccaatcgttacaaaaatcgacatgggatccctatgaagagcccatttcggttcagttggttggctgcacgccggatgatatggccgaatcagccaaactgaatcaggatcgtggtgccgctattattgacatcaatatgggctgtcctgtcagaaaagttgtcagtggtgatgctggctcggctttgatgcgtgatttgaaactggcggcctcgattatcgaagcaaccgtcaaagcggtttctcttcctgtcaccttaaaaatgcggatgggctgggacctaaacagtctgaatgcaccagaacttgcgcgtattgcccaagatatcggggttcagatggtaacggtgcatggccgtactcgtaaccagctttataaaggtcatgcggattgggcttttgttcgccaagtcaaagacgccgtgtcgatacctgttattgtgaatggcgatatcaatagccttgatgatgctaaaacagccctgcaacaatccggtgctgatggcattatggttggacgaggcagctatggtaaaccgtggcttttatcccagttgatgcagggattgactgatggtgaaatggaaaaagcaccgtcgatagatgaacaatatcgcaccattaccgaacattatgaccatatgttaagctattacggtacgatcacgggcgtcaatatcgctcgcaaacatatcggatggtataccaaaggcctgcctgcttcggcagaatttcggaataaaatcaaccgtgaagaagaccccgacagggtaaaagaaatgctggccgaattttaccgaccttggctcagccaaatagccgcctga

SEQ ID NO: 95048 - protein, 341 aa, Zymomonas mobilis subsp. mobilis ZM4
MNSPEHNPTHNLISPIQIGSVRIDNPVILAPMTGVTDLPFRRIVRRYGSGLNVTEMIASQAMIRETRQSLQKSTWDPYEEPISVQLVGCTPDDMAESAKLNQDRGAAIIDINMGCPVRKVVSGDAGSALMRDLKLAASIIEATVKAVSLPVTLKMRMGWDLNSLNAPELARIAQDIGVQMVTVHGRTRNQLYKGHADWAFVRQVKDAVSIPVIVNGDINSLDDAKTALQQSGADGIMVGRGSYGKPWLLSQLMQGLTDGEMEKAPSIDEQYRTITEHYDHMLSYYGTITGVNIARKHIGWYTKGLPASAEFRNKINREEDPDRVKEMLAEFYRPWLSQIAA

SEQ ID NO: 95049 - DNA, 984 bp, Silicibacter pomeroyi DSS-3
  CDS (1)..(984): transl_table=11
gtgaccctgcatcttggagacaaaaccctggccccgccggtgatcctggcgccgatggccggaatcaccgaccgcccctttcgcgatctggtgatggagttcggcgccggcatggtggtgagcgagatggtcgccagccaggagatggtgcaggccaaaccgggtgtgcgcgagcgggcggaactgtcagcggatgttgaaaataccgccgtgcagctggccgggcgcgatacccactggatcgccgaggccgcccgtcaggtcgccgaccggggcgcgcgcgtgatcgacatcaacatgggttgcccggccaagaaggtgaccaacggctattccggctcggcgctgctcaagacccccgatcacgcgctgcgcctgatcgaggcggtggttgcggcggttgatgtgccggtgacgctcaagacccggttgggttgggacgatacgctgatgaacgcgcccgatgtggcgcggcgcgcagccgaggccggcgtgcggatggtgacaatccatggccgcacccgctgtcagttctacaagggccgtgccgattgggcggcgattgcggcggtgcgagaagcggtcgatgtgccgctgattgccaatggcgacatcacctgcgcccacaccgcccggcaggcgctggaccggtccggcgccgatggggtgatggtggggcgcggcgcgcaggggcggccctggctgctggcgcagattgcccatgcgctttatggcacgcccgcgcccgaggtgccgcaaggcgccgagctggccgacatggtggcgcgccactatcaggccatgcttgatttctacgggcgcgaactgggcctgcgcgtcgcgcgcaagcatctgggctggtacatggacgaggccgccaccccagcaccgctgcgcaagctggtgctgaccgcgcgcgacccggaaacggtgctgcacctgctgcctgaggcgctgtgcggcaacgcggaggaggccgcatga

SEQ ID NO: 95050 - protein, 327 aa, Silicibacter pomeroyi DSS-3
MTLHLGDKTLAPPVILAPMAGITDRPFRDLVMEFGAGMVVSEMVASQEMVQAKPGVRERAELSADVENTAVQLAGRDTHWIAEAARQVADRGARVIDINMGCPAKKVTNGYSGSALLKTPDHALRLIEAVVAAVDVPVTLKTRLGWDDTLMNAPDVARRAAEAGVRMVTIHGRTRCQFYKGRADWAAIAAVREAVDVPLIANGDITCAHTARQALDRSGADGVMVGRGAQGRPWLLAQIAHALYGTPAPEVPQGAELADMVARHYQAMLDFYGRELGLRVARKHLGWYMDEAATPAPLRKLVLTARDPETVLHLLPEALCGNAEEAA

SEQ ID NO: 95051 - DNA, 1035 bp, Silicibacter pomeroyi DSS-3
  CDS (1)..(1035): transl_table=11
atggaaagaaaatcgcagaatatcgtaccttggcgtatgtcttgcgcgccaatgatggactggacggaccggcattgccggtatctgcatcggctgctcagccggcagaccctgctttacaccgagatggtgaccgcgccggctttggtgcgggggggggccttgcatctgttggagtacagcgttgaagagcatccggtggccctgcaactgggcggttcggaccccgaagagctggcgcaggcggcgcggttgggggccgaggcggggtatgacgagatcaatctcaattgcggctgcccctcggatcgggtgcaatcggggacattcggcgcggtgctgatgaaacatcccgggttggtggccgattgtgtcaccgccatgcgtgaggccgtcgatgtcgaggtgacggtgaaatgccggatcggggtagacgatcaggaccccgagaccgtgctgccggagttcctggaacagatcgccggggcagggtgccagcgggtgatcatccatgcgcgcaaggcctggctgcaggggttgagcccgaaggagaaccgggacatcccgccgcttgactacgatctggtgcaccggatgaaggcgcgctttcccgggatgcatatctcgatcaatggcggcatcgacacgctcgcggcggcgcgggcgcatctggatgcggggctggatggggtgatgatcgggcgggccgcctatcaccagcccgccgatatcctgtgcaaggccgatccgctgatctatggcaccggcacggccagcgatccggtcacggcggtgcgcgccatgctgccctatatcgaggcgcatttggccacgggcgggcggctgcaccagatcacccggcacatgctggggctgtttgccgggcgcccgggtgcgcgcggctggcggcggatgctgtccgaaggcgcggtgcgccccggtgcgggtcccgagctggtcgaggcagcgctggaccaggtggccgggctttggcacacctctgaaacgccgttggaccccgcgccgaggctttga

SEQ ID NO: 95052 - protein, 344 aa, Silicibacter pomeroyi DSS-3
MERKSQNIVPWRMSCAPMMDWTDRHCRYLHRLLSRQTLLYTEMVTAPALVRGGALHLLEYSVEEHPVALQLGGSDPEELAQAARLGAEAGYDEINLNCGCPSDRVQSGTFGAVLMKHPGLVADCVTAMREAVDVEVTVKCRIGVDDQDPETVLPEFLEQIAGAGCQRVIIHARKAWLQGLSPKENRDIPPLDYDLVHRMKARFPGMHISINGGIDTLAAARAHLDAGLDGVMIGRAAYHQPADILCKADPLIYGTGTASDPVTAVRAMLPYIEAHLATGGRLHQITRHMLGLFAGRPGARGWRRMLSEGAVRPGAGPELVEAALDQVAGLWHTSETPLDPAPRL

SEQ ID NO: 95053 - DNA, 984 bp, Francisella tularensis subsp. tularensis Schu 4
  CDS (1)..(984): transl_table=11
atggactttaaaattgcagatatagaaatcgaaaataatgttgtacttgcaccaatggcgggtttctgtgatagtgcatttcgtactatatgcaaagagcatggggctggtctgatatatacggagatggttagtaacaaagccgtagtagagcataattgggaaaccatggaaatgctctatatggaaaatagtgaaaagccacttggtatacagatatttggtacagatattaatagttttgttggtgcgacaaaatatatcgcagagaatacagagtgtgattttttagatataaatatgggttgtcctatgccaaaagttgctaagaagttacaagctggagcggcacttctaaaagatgttaatagaatccatgagatactaacagctgtagtaaaagcagtacataaaccagtaaccgtaaagatgcgtattggttgggatgaacaaaatatcaatgctatagaggttgctaaagcatgtcaagatgcaggtgtaagtgctattgcgatacatgggcgcacgagagagcaaatgtatactggtaaggcaaattgggatattatccgcgatgtcagaaaagcagtagacacagtagtaattggtaatggtgatgtgttttgtccacatagtgctaaggctatgatggagcatactggtgtagacgctgtgatggttgggcgagcttctcgtggtaacccttggatatttagacaaattgcagaatatctaaatacaggtgagctaataccgccaccaaccccagttgagcgtgttgatgtactagaagagcatctaagaagacttattaaactaaaaactgccaaagtagcagttaaagaaatccgtactcatgcaagcttttaccttcaagatttacctaattcaaaagagtttcgtatgaagttaaatcagttggagcatgaacaagagatttttaaagttctggaagagtataaaaaatcattatataaattttaa

SEQ ID NO: 95054 - protein, 327 aa, Francisella tularensis subsp. tularensis Schu 4
MDFKIADIEIENNVVLAPMAGFCDSAFRTICKEHGAGLIYTEMVSNKAVVEHNWETMEMLYMENSEKPLGIQIFGTDINSFVGATKYIAENTECDFLDINMGCPMPKVAKKLQAGAALLKDVNRIHEILTAVVKAVHKPVTVKMRIGWDEQNINAIEVAKACQDAGVSAIAIHGRTREQMYTGKANWDIIRDVRKAVDTVVIGNGDVFCPHSAKAMMEHTGVDAVMVGRASRGNPWIFRQIAEYLNTGELIPPPTPVERVDVLEEHLRRLIKLKTAKVAVKEIRTHASFYLQDLPNSKEFRMKLNQLEHEQEIFKVLEEYKKSLYKF

SEQ ID NO: 95055 - DNA, 1005 bp, Synechococcus elongatus PCC 6301
  CDS (1)..(1005): transl_table=11
gtggctgaatttgccgtcgttgaccgagcgattcctgctcatttacaaacgccactgcaggtaggttctctgattctgcacagtcgtgtcttgcaatcaccgctggcgggcgtcagcgatcgcagctttcgacagctcgtccggcgatcggctccgcagtcgctgatttttgccgaaatggcgcatgcaggcttgcaattagcagggcgcgatcgttgggaatttttgccccatgagcaaccgattggcgcgcagttatttggtgatcagccagcgactttagcagcagcagcgcaacaagccgaagcagctggagcggtttgtatcgacctgaacatgggttgtcccgtcagtaaagtgacgcgcaaacgcggtggatccgcgctcctccgcgagccagaactggcgatcgcgatcgtccaagcggtggcagcagcggtcagcattcccgtcaccgtcaaaacccgcttgggctgggagcaggtgaccattctcgacttcgcccaacagcttgaagcagcaggggcacaactgctgacacttcatggccgcagtcgcagtcagggctatagcggtcaggcagattggaactggattacacgggtcaaatcacggctgtcgattcccgtaatcgccaatggtgatatcaactcgccagcagatgcgatcgcctgtctccagcaaacgggtgcggatggtgtgatgtgtgggcgcggtagcctcggtaatcctggcttagtgggcgcgatcgatcgctctctcaaaactggagagcaaacaccggaattagagctgcgcgatcgcctgcaactggcgcgggaacatctgctgctgctctgggaggacaaaggagcagcgggactcttgcaagctcgcaagcatttgggctggtatctcgcggatcaacctgactatcaagacctgcgtcagcacctcctccgcagtgaggatctcagccaaagtctggatttattggatgcagcaatcgcctctgtagtctgctga

SEQ ID NO: 95056 - protein, 334 aa, Synechococcus elongatus PCC 6301
MAEFAVVDRAIPAHLQTPLQVGSLILHSRVLQSPLAGVSDRSFRQLVRRSAPQSLIFAEMAHAGLQLAGRDRWEFLPHEQPIGAQLFGDQPATLAAAAQQAEAAGAVCIDLNMGCPVSKVTRKRGGSALLREPELAIAIVQAVAAAVSIPVTVKTRLGWEQVTILDFAQQLEAAGAQLLTLHGRSRSQGYSGQADWNWITRVKSRLSIPVIANGDINSPADAIACLQQTGADGVMCGRGSLGNPGLVGAIDRSLKTGEQTPELELRDRLQLAREHLLLLWEDKGAAGLLQARKHLGWYLADQPDYQDLRQHLLRSEDLSQSLDLLDAAIASVVC

SEQ ID NO: 95057 - DNA, 1002 bp, Bacillus clausii KSM-K16
  CDS (1)..(1002): transl_table=11
atgctgaaaataggcgatatagaaatgaaaaaccaagtcgtactcgcgcctatggcaggagtatgcaacccggcgtttcgcttaattgcgaaagaatttggcgccggcctagtttgcgcggaaatggttagtgacaaagccatcttgcataaaaacgaaaaatcgttacaaatgctttacgtagatgagcgggaaaagccgcttagtttgcaaatttttggtggagaaaaagatacactagtagaagcagcgcgattcgtagaccaaaacaccaatgccgatatcatcgacattaacatgggttgtccagtgccgaaaattacaaaatgtgatgcaggagcccgttggcttcttgaccctaaaaaaatttacgaaatggtcgctgccgttgtcgatgcagtcaaaaagccggtaactgtcaaaatgcggattggctgggatgaagaccatatttatgccatcgagaatgctcgtgcagttgaacgagcgggcggaagtgcagtagccgtacatggtcgcacgcgcgttcagatgtacgagggtgtggctgattggaatattattggcgatgtgaaaaaggcagtgaacattccggttataggcaacggtgatgtggctacaccgcaagacgccaagcggatgctcgacgaatatggcgttgatggtgtgatgattggccgtgcagctctcggaaacccgtggatgttgtaccgtacaatccaatatcttgagaatggtactcttcctccagaaccgactccacgcgagaaaattgaagtttgtttaattcatttggatcgtttggttgctttaaaaggcgagcgtgtggcagtgcgcgagatgcgtaaacatacagcttggtatattaaaggattgcgcggcaaagcgaaaatccgcgacaaagtcaaccaatttgaaacaagggatgatgtagtaaaagccctttatgaatacgttgatttcttagaggggcgcgaactggcggagagttctgcgatatag

SEQ ID NO: 95058 - protein, 333 aa, Bacillus clausii KSM-K16
MLKIGDIEMKNQVVLAPMAGVCNPAFRLIAKEFGAGLVCAEMVSDKAILHKNEKSLQMLYVDEREKPLSLQIFGGEKDTLVEAARFVDQNTNADIIDINMGCPVPKITKCDAGARWLLDPKKIYEMVAAVVDAVKKPVTVKMRIGWDEDHIYAIENARAVERAGGSAVAVHGRTRVQMYEGVADWNIIGDVKKAVNIPVIGNGDVATPQDAKRMLDEYGVDGVMIGRAALGNPWMLYRTIQYLENGTLPPEPTPREKIEVCLIHLDRLVALKGERVAVREMRKHTAWYIKGLRGKAKIRDKVNQFETRDDVVKALYEYVDFLEGRELAESSAI

SEQ ID NO: 95059 - DNA, 954 bp, Ehrlichia ruminantium str. Welgevonden
  CDS (1)..(954): transl_table=11
atgaatttgtctcaatttatttctgactatcctgtaatattagcacctatgtctggtataactgattttccatttcgttctcttgtcaaaaaccttggagcaggattattagtgtcagaaatgatagcaagccgtggaatgatcaaacaaactaaagatagtttacagaagtcacatatacaatctaatactgctgtacaattagctggatgcgatccactaataatggcagaagcagcaaaacttaatgaagacatgggtgcacaaattattgacataaattttggatgtcctgtaaaaaaagtagttaatagctatgctggatcagcactaatgaaagatgaaataacagctgcaaagattttagaagctgtagtaaaagcagtaaaagtaccagtaacattaaaaatgcgtattggatgggacagtcagaacctaaattctcctagattagcaaaaattgctgaaaacactggtattaaaatgatcaccatacatggtagaaccagagcacaaatgtttaccggaaaagcagactggaagttcatcagtaacataaaaaaatgtgttagaattccgattatagtcaatggcgatataaaaactctagatgatataaaaatagcattagaagagtcacaagctgatggaataatgataggaagaggtgcatatggtaaaccatggattataaataaagcactacaatttataaaatcaggtattattttaccagatccaacagtatctgaaaaattacaaattattataaatcactacgacaacatcatagaacattatggaaaggacattggagttaagatatcaaaaaaacatataggctggtacagcgcttgcctagaaaactctacagaatttagaagtaaagtcaactgttcaaacaatcatcaatttattagagatcaaatattaaactttttctcaccaaagtaa

SEQ ID NO: 95060 - protein, 317 aa, Ehrlichia ruminantium str. Welgevonden
MNLSQFISDYPVILAPMSGITDFPFRSLVKNLGAGLLVSEMIASRGMIKQTKDSLQKSHIQSNTAVQLAGCDPLIMAEAAKLNEDMGAQIIDINFGCPVKKVVNSYAGSALMKDEITAAKILEAVVKAVKVPVTLKMRIGWDSQNLNSPRLAKIAENTGIKMITIHGRTRAQMFTGKADWKFISNIKKCVRIPIIVNGDIKTLDDIKIALEESQADGIMIGRGAYGKPWIINKALQFIKSGIILPDPTVSEKLQIIINHYDNIIEHYGKDIGVKISKKHIGWYSACLENSTEFRSKVNCSNNHQFIRDQILNFFSPK

SEQ ID NO: 95061 - DNA, 1116 bp, Gluconobacter oxydans 621H
  CDS (1)..(1116): transl_table=11
atgactgcttccgctccttccgccgtccctgatgcgcctgccgcagcacccccgaaccgtgtcctgaaacccatcgacctggggcagggcgtggtgatcgaggatccggtgatccttgctccgctttcgggtgtcacggatctgccgttccgtcagcttgcccgtgatctgggggcagggctcgtcgtgtcggaaatgatcgcctcctgggcgatgatccgcgagaatgaaaacaccatgcgcatggcgcggatggccgagcgcgggccgaatgcggtccaactggccggatgtgatcccaaggccatggcgcaggctgcgaaaatttcggtggatgggggcgcgaacctcatcgacatcaattttggctgcccggtgaagaaggttgcgatcgggcagatggctggttctgcattgatgcgggacgaggttctggccggaaagttgctcgaagcgaccgcacgtgccgtgaatgtaccggtgacgctcaagatgcgcatgggctgggaccacaattcgctcaatgcgccgcgactggcgaaaatcgcggaagagagcggaatccggcttgtaacggttcacggccgtacccggcagatgttttataacggcacggcggactggcgtttcgtcaaaacggtgaaggacgcggtgtcacttccggtcatcgtcaatggtgatatcaacaccatccgcgatgcgcgtgaggcgctgcatcagtctcaggccgatggcgtcatgatcgggcgtggctgttacggaaggccctggtttacggcacaggtggcacagtccctgcgcaccggcgaggatgtgccggacccggatctggcgaccgaaaaggaaatcgccctgcggcattaccggatgatgctcgaccatttcggtgagcggccgggcctacgtctcgcccgcaagcatgtctcctggtattccgccgggctgccgggctctgcgacgttccgctccaccatcaatggcgtcgagagcgccgccgaggcgattgcgctgctcacggcattctatgaccgtcatatcgacgctggtgtcgttcgcaaccgtgaggccggcccgacgggcagtctgagccgcgacggcacgcgtgaagcggcgtga

SEQ ID NO: 95062 - protein, 371 aa, Gluconobacter oxydans 621H
MTASAPSAVPDAPAAAPPNRVLKPIDLGQGVVIEDPVILAPLSGVTDLPFRQLARDLGAGLVVSEMIASWAMIRENENTMRMARMAERGPNAVQLAGCDPKAMAQAAKISVDGGANLIDINFGCPVKKVAIGQMAGSALMRDEVLAGKLLEATARAVNVPVTLKMRMGWDHNSLNAPRLAKIAEESGIRLVTVHGRTRQMFYNGTADWRFVKTVKDAVSLPVIVNGDINTIRDAREALHQSQADGVMIGRGCYGRPWFTAQVAQSLRTGEDVPDPDLATEKEIALRHYRMMLDHFGERPGLRLARKHVSWYSAGLPGSATFRSTINGVESAAEAIALLTAFYDRHIDAGVVRNREAGPTGSLSRDGTREAA

SEQ ID NO: 95063 - DNA, 999 bp, Xanthomonas oryzae pv. oryzae KACC10331
  CDS (1)..(999): transl_table=11
atgcagatcggcccctactccatcgcccccaaggtgatcctcgcgcccatggcgggcgtcaccgacaagccgttccggctgctgtgcaagcggctgggcgctgggctggcagtgtcggagatgaccatctccgacccgcgcttctggggcacgcgcaagtcgctgcaccgcatggaccatgccggcgaaccggacccgatcagcgtgcagatcgccggcaccgagccgcagcaactggccgaggcggcgcgctataacgtcgaccacggcgcgcaattgatcgatatcaacatgggctgcccggccaagaaagtgtgcaatgcctgggctggctcggcgctgatgcgcgatgaagagctggtggcacgcatcctcaccgcggtggtgcaggcggtggacgtgccggtgacgttgaagatccgcaccgggtgggattgcgaccaccgcaacggcccgaccatcgcgcgtctcgcacaggactgcggcatcgccgcgctcgccgtgcacgggcgcacccgcgaccagcattacaccggcagcgccgaatacgcgacgattgcgcagatcaaggcagcactgcggattccagtggttgccaatggcgatatcgactcgccgcaaaaggccgcgcaggtgctgcgcgagaccggcgccgacgcggtgatgatcggccgcgccgcacaagggcgcccgtggatctttggcgaagtggcgcattttctggccaccggcgaagtgttgccgccgccgtcgctggcattcgtgcgcgacaccctgctcagccacctggaagcactgcacgcgttctacggccaaccccagggcgtgcgcatcgcacgcaagcacctgggttggtatgccaaggatcacccccagagcgcggacttccgtgcggtggtcaatcgcgccgaaacgccggaagcccagttggccctgacgcgcgattacttcgatgccttgatcgccggcgtgccgcccgcattgccggacgctgcctga

SEQ ID NO: 95064 - protein, 332 aa, Xanthomonas oryzae pv. oryzae KACC10331
MQIGPYSIAPKVILAPMAGVTDKPFRLLCKRLGAGLAVSEMTISDPRFWGTRKSLHRMDHAGEPDPISVQIAGTEPQQLAEAARYNVDHGAQLIDINMGCPAKKVCNAWAGSALMRDEELVARILTAVVQAVDVPVTLKIRTGWDCDHRNGPTIARLAQDCGIAALAVHGRTRDQHYTGSAEYATIAQIKAALRIPVVANGDIDSPQKAAQVLRETGADAVMIGRAAQGRPWIFGEVAHFLATGEVLPPPSLAFVRDTLLSHLEALHAFYGQPQGVRIARKHLGWYAKDHPQSADFRAVVNRAETPEAQLALTRDYFDALIAGVPPALPDAA

SEQ ID NO: 95065 - DNA, 1002 bp, Neisseria gonorrhoeae FA 1090
  CDS (1)..(1002): transl_table=11
atgattgacggacaaacaaccgaacccaaacaaaaaaccagaatcataccagcccccatgcgggggctggtagacgatgtgatgcgcgacctgctgacacgtatcggcggctacgacgaatgcgtcagcgaatttgtacgcattacccataccgtgcattcacgatccatatggttaaaatatgtccccgaaatcgccaacggaaacaaaacgttttccggcacgccctgcaccgtccaacttctgggcagcgatgcggacaatatggcggcaaacgcattggaagccgtccgattcggcgcggacaaaatcgatttgaacttcggctgccccgcgcccaccgtcaacaaacacaaaggcggcgcaattcttctgaaagagccggaactgatattccacatcgtcaaaacgctgcgcggacgtttgcctgcacatattccgctgacggggaaaatgcggctaggctatgaagacaaaagccctgctttggaatgcgcctgtgcgattgccgaagggggcgcgtgcggactgaccgtgcacgcgcgcaccaaagccgagggctacgaacccccggcgcattgggaatggataaggaaaatccacgataccgtcaatattcccgttaccgccaacggcgacgttttcagcctgcaggactatatcggcatcaaaacaatcagcggctgcaacagcgtgatgctcggtcgcggtgcggtcatccgccccgatttggcgcgccaaatcaagcaatacgagaacggcggaccggtcaaagacacggattttgccgaagtttccacatggatagggcagtttttcgagctgtgcctgacaaaagaggcaaacaacaaatacccgatcgcccgtcttaagcaatggctgggcatgatgaaaaaaacgttcgacccggcgcaaacgctgttcgaccgcgtccgaacggttaaagatgcggatgaagtgcgccgaatcctgaacgcatttgagcatgagatggatgtttga

SEQ ID NO: 95066 - protein, 333 aa, Neisseria gonorrhoeae FA 1090
MIDGQTTEPKQKTRIIPAPMRGLVDDVMRDLLTRIGGYDECVSEFVRITHTVHSRSIWLKYVPEIANGNKTFSGTPCTVQLLGSDADNMAANALEAVRFGADKIDLNFGCPAPTVNKHKGGAILLKEPELIFHIVKTLRGRLPAHIPLTGKMRLGYEDKSPALECACAIAEGGACGLTVHARTKAEGYEPPAHWEWIRKIHDTVNIPVTANGDVFSLQDYIGIKTISGCNSVMLGRGAVIRPDLARQIKQYENGGPVKDTDFAEVSTWIGQFFELCLTKEANNKYPIARLKQWLGMMKKTFDPAQTLFDRVRTVKDADEVRRILNAFEHEMDV

SEQ ID NO: 95067 - DNA, 975 bp, Magnetospirillum magnetotacticum MS-1
  CDS (1)..(975)
atgcatccgcccgtccttctggctccgctctcgggcgtcaccgacctgcatatgcgccgtctcgcgcaggggctcggcgccagcgccgtcgtctccgaaatggtggcggcggccgaactggcgaagggtgacgccgaatcgcgcgtccgggccgagggcgccggggtgagtccgcacatcgtccagctcgccggctgcgcaccggagccgatggccgaggccgcccgcatcgccgtcgccaacggggcggatgccatcgatatcaacatgggctgcccggccaagaccgtgaccggcggcgaatccggctccgccttgatgcgcgatctcgatcatgccgcccggctgctcgccgcggtgcgcgaggcggtcgaggtcccggtgacggtgaagatgcgcctcggctgggaccatgccagcctcaatgcgccggacctcgcccggcgcgccgaatcgctcggtctcgacggcgtcaccgtccacggccgcacccggcagcaattctacaagggccgggccgattggtcggcgatccgatccgtggtggaggcggtgagtctccccgtcatcgccaacggcgacatcgcgagcctggaggaggcgcgcgcctgcctcgccgcctcgggcgcgaccggcgtgatgatcgggcgcgcggcggtcggccggccctggctcgtcggcgcaatcgccgccgggctggccggcagaaccgtcatgccactctcgcccgaacggcaagcggaggtcgcgaccgcgcattacgaggggctgatcgcgctctacggggcgtcgatgggcgtgcgccacgcccgcaagcacctcgccgcctatgccgatgcggccggcggcctcggtgccgacgaccggcgccgcctcgtcaccaccaccgatccggcggaggcgctgcgtctcctgcgccgcgcttttctcgaaccggccggagggacggatgcgcccttcggcgaggcggcctga

SEQ ID NO: 95068 - protein, 324 aa, Magnetospirillum magnetotacticum MS-1
MHPPVLLAPLSGVTDLHMRRLAQGLGASAVVSEMVAAAELAKGDAESRVRAEGAGVSPHIVQLAGCAPEPMAEAARIAVANGADAIDINMGCPAKTVTGGESGSALMRDLDHAARLLAAVREAVEVPVTVKMRLGWDHASLNAPDLARRAESLGLDGVTVHGRTRQQFYKGRADWSAIRSVVEAVSLPVIANGDIASLEEARACLAASGATGVMIGRAAVGRPWLVGAIAAGLAGRTVMPLSPERQAEVATAHYEGLIALYGASMGVRHARKHLAAYADAAGGLGADDRRRLVTTTDPAEALRLLRRAFLEPAGGTDAPFGEAA

SEQ ID NO: 95069 - DNA, 1008 bp, Magnetospirillum magnetotacticum MS-1
  CDS (1)..(1008)
atggctcagtatacacgcaagaccatctccatcggatcggtgaccctggataatccggttatcctggcccccatggcgggtgttaccgacatgcccaatcgcaggctggtcaagcggctcggcgcgggtctggtcgtgtcggaaatgatcgccagccaggccatgatccgccagaaccgccagaccatgcagatggcccaacacaccgccgaggaattccccatgtcggtgcaactggccggttgcgaacccaaggtcatggccgaggccgccaagctgaaccaggatctgggcgtggccatcatcgacatcaatatgggctgtccggtcaagaaggtcgccttgaagggcgaggccggatcggccctgatgcgcaacgagaacctggcggcccgcatcatgagcgccgtggtcaaggcggtggatattcccgtcaccttgaaaatgcgcaccggctgggacatgaacagccgcaacgcccccagtctagcccgtgtcgccgaggaatgcggcatccgcatggtcaccgtgcatggccgcacccgaaaccagatgtatacaggccaggccgactgggccttcatcggcgaggtcaagcgggcggtgtccattccggtgatcggcaatggcgatgtggaaagcatcgatgatgccgtccgtatgctggaactgtccgacgccgatggcgttatgatcggccgcggcacctatgggcgtccgtggctgccggggcaggtggctcatttcctggccacgggcgagcggctccccgatccttcgcgggcggagcaattggagatcatgctggggcatctggacgccatgctatcccattacggatccgaaccgggggtgcgcatcgcccgtaagcacgtggcctggtattccaagggattgccaggttcggccgagttccgggccgaaatcaaccgcacaaacgacccggcgatcatgcgtcagtccatcatcgacttctacgcccccatcttggaaaaggccgccgcctga

SEQ ID NO: 95070 - protein, 335 aa, Magnetospirillum magnetotacticum MS-1
MAQYTRKTISIGSVTLDNPVILAPMAGVTDMPNRRLVKRLGAGLVVSEMIASQAMIRQNRQTMQMAQHTAEEFPMSVQLAGCEPKVMAEAAKLNQDLGVAIIDINMGCPVKKVALKGEAGSALMRNENLAARIMSAVVKAVDIPVTLKMRTGWDMNSRNAPSLARVAEECGIRMVTVHGRTRNQMYTGQADWAFIGEVKRAVSIPVIGNGDVESIDDAVRMLELSDADGVMIGRGTYGRPWLPGQVAHFLATGERLPDPSRAEQLEIMLGHLDAMLSHYGSEPGVRIARKHVAWYSKGLPGSAEFRAEINRTNDPAIMRQSIIDFYAPILEKAAA

SEQ ID NO: 95071 - DNA, 981 bp, Azotobacter vinelandii
  CDS (1)..(981)
atgcgaatcgccctggcccccatggagggattggtcgacgaactgcttcgtgacttgctgacccgcgtcggcggtatcgactggtgcgtgaccgaattcgtccgggtctgcgaccgtctgctgccggtcgcccagttcgagaaactggctccggagctgcggcatggctggcggacccgggccggcacgccgatgcatctgcaactgctcggttccgatccggcatgcctggccgagaacgcggcgctggcggccgaattgggcgcgccggcgatcgatctcaacttcggttgcccggcgaagacggtcaaccgctcgcggggcggagcggtgctgctcgacgagccggaactgctgcatgccatcgtccgcgaggtgcgccgggccgtgccggcgcatgtgccggtgaccgccaagatgcgcctggggtacgcccggcccgagggcgccctggagtgcgcccgcgcgctggtcgagggcggcgtcgcacatctggtggtgcacgcacggaccaaggtcgagggctaccggccgccggcccattgggaatggctggcgcgggtgcgggaggcggttgccgtgccggtctatgccaacggcgaaatctggacgccggcggattggctgcgctgccgggaaatcagcggggtggaggatgtcatgctcggccgcggcctggtttcgcgccccgatctggcccggcagatcgccatggcgtgcgccggacgcacgctcgagccgcagggctggggtgaggtacagccgctggtgcgcgagttctggcggcgcgcccggcagcggatcgcgccgcgctacgcgcctggccggctcaagcagtggctgggcatgctggcgcgcagttatccggaggcggccgcgctgttcgccgaactgcgccgggagaacgactgcgggcggctggatgccctgctgggcgtagagttgcgcggtattttcccggatctgtgtccggcgctctga

SEQ ID NO: 95072 - protein, 326 aa, Azotobacter vinelandii
MRIALAPMEGLVDELLRDLLTRVGGIDWCVTEFVRVCDRLLPVAQFEKLAPELRHGWRTRAGTPMHLQLLGSDPACLAENAALAAELGAPAIDLNFGCPAKTVNRSRGGAVLLDEPELLHAIVREVRRAVPAHVPVTAKMRLGYARPEGALECARALVEGGVAHLVVHARTKVEGYRPPAHWEWLARVREAVAVPVYANGEIWTPADWLRCREISGVEDVMLGRGLVSRPDLARQIAMACAGRTLEPQGWGEVQPLVREFWRRARQRIAPRYAPGRLKQWLGMLARSYPEAAALFAELRRENDCGRLDALLGVELRGIFPDLCPAL

SEQ ID NO: 95073 - DNA, 927 bp, Desulfitobacterium hafniense DCB-2
  CDS (1)..(927)
atgcgtttaggaaaatttgagctgggcatccctgcttttctcgcccctatggccggtgttacggacaaggcctttcgggagacggtccgttccgtaggggggctccatgtctggaccgagatgatcagcgataaggcattgacctatatgaactcaagaactttggagatgttggatctttccggggaagcttccccgcgcattgttcagctctttggctcagagcctgaagtcatggccaaggcagcagctttggctgtggagcgggatgccgagatcattgatatcaatatggggtgtccaacacctaaaattgtcaaaaacggggaaggttcggcattgctgcaggaccttcccttagcgcagcgcattgctgaagctgttgtgaaggcagtggaggttccggtgacggtcaaaatgcgccttggctggactgcagaaaggatcgttgctcctgagctggccaagcgggtggaagctgtaggcgtccagatggtcagtgtccatgggcggacccgggagcaattttacgcaggtactgccaatcgggatgggataaaaaaggttaaagggggggtaagcatcccggtaatagccaatggggatattttttcccctcaagaagccaagacagttctcgaagcaacaggctgcgatggagttatggtaggccggggaagccttggcaacccctggctgattccacaaattaatgtttttttgaataagggcgtgctgcttgaggaaccctctttagagcagaagctcaaagtggccacagaacattttgagcgagtgctgaattataaaggagaacgcatcggccttaacgaaatgcgtaagcatgccgtctggtatattaaagggattcgcaatgctgcgcagatgcgggattatattatgcagacaaaacccccctggaaatga

SEQ ID NO: 95074 - protein, 308 aa, Desulfitobacterium hafniense DCB-2
MRLGKFELGIPAFLAPMAGVTDKAFRETVRSVGGLHVWTEMISDKALTYMNSRTLEMLDLSGEASPRIVQLFGSEPEVMAKAAALAVERDAEIIDINMGCPTPKIVKNGEGSALLQDLPLAQRIAEAVVKAVEVPVTVKMRLGWTAERIVAPELAKRVEAVGVQMVSVHGRTREQFYAGTANRDGIKKVKGGVSIPVIANGDIFSPQEAKTVLEATGCDGVMVGRGSLGNPWLIPQINVFLNKGVLLEEPSLEQKLKVATEHFERVLNYKGERIGLNEMRKHAVWYIKGIRNAAQMRDYIMQTKPPWK

SEQ ID NO: 95075 - DNA, 1056 bp, Nostoc punctiforme PCC 73102
  CDS (1)..(1056)
atgatttcgctttcccctattctccaagctagactttcccaaccccttaaaattggatcgtttgaggtgaaaagtcgggttctccagtcgcctctatctggagtgacggatatggtgtttcgccgtctcgtgcgtcgctatgcaccagattcgatgatgtataccgaaatggtgaatgctacgggattgcattatgttaagcagttacccaaaatcatggaggtagatcccaacgaacgcccaattagcgttcaactatttgattgtcgtcccgattttttggcagaagcagcagtaaaggcagttgcagaaggtgctgatactgttgatattaatatgggttgtccggtaaataaaatcactaaaaatggtggtggttcttcgttattgcggcaaccagaagtagcagaagcaattgtgcgggaagtggtaaaagctgttgatgtacctgtgacagtcaaaacccgtattggctggaatgacaacgaaattactattctcgactttgccaagcggatggaagatgcaggggcacaaatgattacagtccacggacgcacccgcgcccaaggatacaatggcaatgcccgttgggaatggattactcgtgtaaaagaagtgctttctatcccagtgattggaaatggagatattttttccgttgaagcggcggtgaaatgtttagaacaaactggtgctgatggtgtgatgtgttcccgtggcactttgggttatccgtttttggtgggagaaatcgatcacttcctaaaaactggggaaatattaccgacacctactccgattcagcgtttggaatgtgcgagagatcatttacaagccttgtgggaatataaaggcgatcgcggtgtacgtcaagcccgtaagcacatgacttggtatgctaagggtttcgttggtgctgccgaacttcgaggacagctaagtttggttgaaaaagtagatcagggtttggcaatgattgaccaagcaattgaaaaactgactaatggttacgaattagaagaagaagcagaagatagtttggtgatactttaa

SEQ ID NO: 95076 - protein, 351 aa, Nostoc punctiforme PCC 73102
MISLSPILQARLSQPLKIGSFEVKSRVLQSPLSGVTDMVFRRLVRRYAPDSMMYTEMVNATGLHYVKQLPKIMEVDPNERPISVQLFDCRPDFLAEAAVKAVAEGADTVDINMGCPVNKITKNGGGSSLLRQPEVAEAIVREVVKAVDVPVTVKTRIGWNDNEITILDFAKRMEDAGAQMITVHGRTRAQGYNGNARWEWITRVKEVLSIPVIGNGDIFSVEAAVKCLEQTGADGVMCSRGTLGYPFLVGEIDHFLKTGEILPTPTPIQRLECARDHLQALWEYKGDRGVRQARKHMTWYAKGFVGAAELRGQLSLVEKVDQGLAMIDQAIEKLTNGYELEEEAEDSLVIL

SEQ ID NO: 95077 - DNA, 966 bp, Pseudomonas syringae pv. syringae B728a
  CDS (1)..(966)
atgcaaattgctctggcgcccatggaggggttggtcgacgacatcctgcgtaatgtgctgacgaaagtcggcggcatcgactggtgcgtgaccgaattcatccgggtgtccgagcgtttgatgccggcgcactacttctacaagtacgcttcggagtttcataacggcgcgaagactgacgccggtacgcctttacggctccagctgttgggctccgatccggtgtgtctggccgagaatgccgcgttcgcctgcgagctgggcgcgccggtgctggacctgaacttcggttgcccggccaagaccgtcaaccgttcccgtggtggcgcagttctgctcaaggagccggaactgctgcacaccattgtcagccaggtgcgccgtgctgtgcccaaagacataccggtcaccgccaagatgcgtttgggctacgaaaacaccgacctggcgctggattgcgccagagcgttggctgacggcggggccgagcaaatcgtcgtgcatgcgcgcaccaaggtcgacggctacaagccgccggcgcactgggagtggatcgcgcgcatccaggaagtggtcaaggtcccggtagttgccaacggggaaatctggaccgttgaggattggcggcgatgccgcgaaatctgcggcgcgcgggacatcatgatcggtcgcgggctggtggcgcgccctgatctcgcccggcagattgctgcggcgcagaagggcgaagaggtggtgccgatgacttgggacgcgttgcagccgatgctgcgggtcttctggcaggactgtctggtgaagatgacgctgattcaggcaccgggtcggctcaagcagtggctggtgctgctgaccaaaagctaccccgaggcgaccctgatgttcaatacgttgcgccgcgagaccgactgcgatcgcatcagcgtattgctgggctgcgcgcccggttgcttacccaaaagctga

SEQ ID NO: 95078 - protein, 321 aa, Pseudomonas syringae pv. syringae B728a
MQIALAPMEGLVDDILRNVLTKVGGIDWCVTEFIRVSERLMPAHYFYKYASEFHNGAKTDAGTPLRLQLLGSDPVCLAENAAFACELGAPVLDLNFGCPAKTVNRSRGGAVLLKEPELLHTIVSQVRRAVPKDIPVTAKMRLGYENTDLALDCARALADGGAEQIVVHARTKVDGYKPPAHWEWIARIQEVVKVPVVANGEIWTVEDWRRCREICGARDIMIGRGLVARPDLARQIAAAQKGEEVVPMTWDALQPMLRVFWQDCLVKMTLIQAPGRLKQWLVLLTKSYPEATLMFNTLRRETDCDRISVLLGCAPGCLPKS

SEQ ID NO: 95079 - DNA, 1131 bp, Desulfovibrio desulfuricans G20
  CDS (1)..(1131)
atgatgcagccggaagaatatacagcagccgatgccgttgaatcctgtccgcagcagagtctttccggacacgggccggatctggccgtggccgctgacggggtttttgacgccgcccttgccgcccgtctgactgaaccgctgcagataggcggcagaacggtgaacggccgtctgtttctggctcccatggccggtctcgggcatattgcctaccggcaggtgctcgaaagcttcgggggatgcgggctggtgtttacgggcatgtgcagcgcacgcgcggtgcctacggaaaatccggcgcggtctccggtgttcagctggcgtccggaagaactgcccgcgctggtctgccagcttttcggtgccgatccgcaggatatggctgcggctgcccgcagggttgagtccgaaggctttttcggggtggacatcaacatgggctgttctgtggcgcctattgtgaaaaaaggctgcggagcggatctgctgcgtgatccggagcgcgctgtgcgcatggtggatgccgtgcgccgcgctgtgtctgtgcctgtctttgtcaaaatgcgcacagggtggagccctgatccggaaccggcggtgaatctggcccgcaggcttcaggacgccggtgccgatgcgctggtctttcacccccgtgtggcgcccgacaggcgcacccatcgccccagaacggcgcatatcggtctggtgaaagacgcggtggatattcctgttatcggcaacggtgatgtttttgatgcagcggattgcgccgccatgctggaacgcacaggctgcgacggtgtttcgctgggcagactggccatagcccgcccgtggatttttgcacagtggacgcgcggttttgttccggaaaagcagacataccgcgacacgctttttgcgctgatggatgcgctggaagcgcattatgatcctgcccgcgccatcaaactgtataaaaagctcatcatgtactacgcggccaatttcacgttcggaaacaggctgttcggcaggcttatccgcggtgacgacatgcaggccatgcggcgcaatgcacaggcggagttctgccgggtgccgcaggtcggtgcacgtcccaacctgctgatgttctgcatgtga

SEQ ID NO: 95080 - protein, 376 aa, Desulfovibrio desulfuricans G20
MMQPEEYTAADAVESCPQQSLSGHGPDLAVAADGVFDAALAARLTEPLQIGGRTVNGRLFLAPMAGLGHIAYRQVLESFGGCGLVFTGMCSARAVPTENPARSPVFSWRPEELPALVCQLFGADPQDMAAAARRVESEGFFGVDINMGCSVAPIVKKGCGADLLRDPERAVRMVDAVRRAVSVPVFVKMRTGWSPDPEPAVNLARRLQDAGADALVFHPRVAPDRRTHRPRTAHIGLVKDAVDIPVIGNGDVFDAADCAAMLERTGCDGVSLGRLAIARPWIFAQWTRGFVPEKQTYRDTLFALMDALEAHYDPARAIKLYKKLIMYYAANFTFGNRLFGRLIRGDDMQAMRRNAQAEFCRVPQVGARPNLLMFCM

SEQ ID NO: 95081 - DNA, 942 bp, Actinobacillus pleuropneumoniae serovar 1 str. 4074
  CDS (1)..(942)
atgattttagcaccgatgcaaggtgtgcttgatccttttgtccgtaaattactcactgccgtaaatgattacgatctctgtatttccgaatttgtacgagtggtggatcaaaaattgccgaagaaagcgttttatcgccgtgcccctgaattgttgcaaggcggtttaaccgattcaggaacgcctgtgagagtgcagctattggggcaacatccgcaatggctggcggagaatgcccgcttggcgatagagttgggatcgcagggagtggatttgaattgcggttgtccgtctaaaacggtaaacggtagtaatggcggcgcatcattgttaaaagatccggatttaatttatcgtgcaaccaaagcaatgcgagaagcggttccacaggatcagatcgtttcggtgaaagtacgtttgggctgggattctgcggatcaaagttttgaaattgccgatgcggtggcacaaggcggtgcaaatgaaattaccgtacacggtcgcactaaacaagacggctatcgagcggaacgaattaattggcaggcaatcggcgaaattcaaaaacgcctttcgattcctgtgatcgccaatggtgaaatttgggattttgaatcggcaaaaaactgtcaaaatacgaccgcttgttcgagccttatgattggacgaggcgcattaaacacaccgaacctcagccgagtggtgaaatttaatcagccaaaaatggcgtggaatgaagtgctgcaattactgtttcaatatgtgaatatggaaaatgagcatgactcgggcttttatcatgtggcgagaattaagcaatggctacattatttggataaagaatatccgcaagcgaaagatttgttccagatactgaaaacggaacacggctatgacggtctaaaaacgcatattgaacgagcggtaaatcaagagttttaa

SEQ ID NO: 95082 - protein, 313 aa, Actinobacillus pleuropneumoniae serovar 1 str. 4074
MILAPMQGVLDPFVRKLLTAVNDYDLCISEFVRVVDQKLPKKAFYRRAPELLQGGLTDSGTPVRVQLLGQHPQWLAENARLAIELGSQGVDLNCGCPSKTVNGSNGGASLLKDPDLIYRATKAMREAVPQDQIVSVKVRLGWDSADQSFEIADAVAQGGANEITVHGRTKQDGYRAERINWQAIGEIQKRLSIPVIANGEIWDFESAKNCQNTTACSSLMIGRGALNTPNLSRVVKFNQPKMAWNEVLQLLFQYVNMENEHDSGFYHVARIKQWLHYLDKEYPQAKDLFQILKTEHGYDGLKTHIERAVNQEF

SEQ ID NO: 95083 - DNA, 963 bp, Actinobacillus pleuropneumoniae serovar 1 str. 4074
  CDS (1)..(963)
atgcgtataggacaatatgaattaaaaaaccgtattttcctcgcgccgatggcaggtattaccgaccaacctttccgccgtttgtgtactaaacttggagcaagtttgactttttcggagatgatgtccacaaaccctgaggtatggcatacggaaaaatctcgtttgaggcttgcgcatcatgaggagattggcatcaatgccgtacaaattgcagggtcggatccagcggaaatggcaatggcggctaaagtcaatgttgagtacggagcgcaaattattgatattaatatgggctgtccggctaaaaaggtaaacaagaaaatggcgggatccgcacttttacgcgaacccgaattagtcgctcaaattttagatgcggtagtcaatgctgtggatgtgcctgtaacattaaaaattagaacaggttgggatcaggaaaatagaaactgtttggagattgcaaaaattgccgaaaaggcaggtatctccgctttaacgattcacggtcgtacgcgtcattgcctttttgaaggtaatgccgaatacgacagtattaaagccgttaaacaagcggtttctattccgattattgctaacggcgatataacctccgcagagaaagcgaagtatgtgttagattatacgcaagcggatgcggttatgatcggtagaggcagtttcggtcgcccttggttgtttaaggaagttgaacaatttttagagaacggtcgccttttggatttgcctttggatgaaaaatgccggctcatgtttaagcatatcgaagaccttcatcggttttacggtgaacaaaaaggttatcgtatcgcacgtaaacatgtcggttggtatgcggatcaattgtcgccagacttaacttttaaacgtactttcaatgcgttggattcgacaaaagaacaattactcgcattggaagattttatgaaatcgattcggtag

SEQ ID NO: 95084 - protein, 320 aa, Actinobacillus pleuropneumoniae serovar 1 str. 4074
MRIGQYELKNRIFLAPMAGITDQPFRRLCTKLGASLTFSEMMSTNPEVWHTEKSRLRLAHHEEIGINAVQIAGSDPAEMAMAAKVNVEYGAQIIDINMGCPAKKVNKKMAGSALLREPELVAQILDAVVNAVDVPVTLKIRTGWDQENRNCLEIAKIAEKAGISALTIHGRTRHCLFEGNAEYDSIKAVKQAVSIPIIANGDITSAEKAKYVLDYTQADAVMIGRGSFGRPWLFKEVEQFLENGRLLDLPLDEKCRLMFKHIEDLHRFYGEQKGYRIARKHVGWYADQLSPDLTFKRTFNALDSTKEQLLALEDFMKSIR

SEQ ID NO: 95085 - DNA, 999 bp, Pseudomonas aeruginosa UCBPP-PA14
  CDS (1)..(999)
atgtcggtggtacgcatcggcccatatacactgcccaacagactgatcctcgcgccgatggccggggtgaccgatcgtccgttccgtcagctttgccgtcgccttggcgccgggatggtggtatcggagatggtgaccagcgacgtccgcctgtggaacagccgcaagtcgcgcctgcgcctgatccacgatggcgaggacgagccgcgctcggtgcagatcgccggcggcgatccggccatgctggccgaggccgctcagcgcaatgtggaactcggtgcgcagatcatcgacatcaacatgggctgcccggcgaagaaggtatgcaacaaggcagcggggtccgccctgctgcgggacgaggcgctggtcgccgagatcctcgatgccgtggtcagggcggtcgacgtaccggtcaccctgaagatccggaccggctgggaccgggacaaccgtaacggcgtcagcgtcgcgaggctcgccgaacaggcggggatccaggctcttgcggtacatggccggacccgcgccgacctgtacaccggggaggcggagtacgagaccatcgcggcgatcaagcaggccgtgtcgataccggtgttcgccaatggcgacatcgattcgccggagaaggccaggaaagtcatcgagcagaccggggtggatgccctgctgatcggtcgggccgcccagggaagaccgtggattttccgcgagatcgaccattacctgcggaccggcgagcacctgccggcggcgccgcttcccgaagtgcagagcatcctgctcgaacacctcgcggagctgcaccttttttatggggaagaaatgggtgtgcggatcgcccgcaagcatgtggggtggtatctcgcgactctgccgggcgcaagggaattccgcgcccagttcaatcgtttgcaggacacggatgcgcagtgcgccagcgtcaggcagttcttcgccgagcgccagaacaacggaacaggggtggccgcatga

SEQ ID NO: 95086 - protein, 332 aa, Pseudomonas aeruginosa UCBPP-PA14
MSVVRIGPYTLPNRLILAPMAGVTDRPFRQLCRRLGAGMVVSEMVTSDVRLWNSRKSRLRLIHDGEDEPRSVQIAGGDPAMLAEAAQRNVELGAQIIDINMGCPAKKVCNKAAGSALLRDEALVAEILDAVVRAVDVPVTLKIRTGWDRDNRNGVSVARLAEQAGIQALAVHGRTRADLYTGEAEYETIAAIKQAVSIPVFANGDIDSPEKARKVIEQTGVDALLIGRAAQGRPWIFREIDHYLRTGEHLPAAPLPEVQSILLEHLAELHLFYGEEMGVRIARKHVGWYLATLPGAREFRAQFNRLQDTDAQCASVRQFFAERQNNGTGVAA

SEQ ID NO: 95087 - DNA, 993 bp, Psychrobacter sp. 273-4
  CDS (1)..(993)
atgtctcagcatcctttattgcaaccattagtgattggcggcttaacgattgaaaaccgtctgatagtcgcaccgatggctggtgtgacagacaatccttttcgcaggttgtgcaagtcctttggtgcgggtcatgcagtcagtgagatgattatcgctgatacggcattgtatgcgcgcaaaaaatcgctgtaccgtgccaattttgataatgagattgcgcctatttctgcccagatagcgggcgcagagcctgataaattggcagaagcggcacgttatcagattgataatggcgcgcagattattgatatcaacatgggatgtcctgccaaaaaagtctgccgtaaattggcaggctctgcattgctacaagatgaggatttagtagcacgtctattagatgccgccgtgaatgccgtcgatgctcccgtcactttaaaaacgcgattaggctatgagaatggacgtgagaacattttgcgcgttgcaaagcgagcagaacaagcaggcattgctgctattgctatccatggacgtacgcgcgaagatatgtataccggagaggcacgttacgatctaatacgtgaggtgaaagaaagtattagtattccagtcatcgcaaatggtgacattgatagtgcgcaaaaagcgcagcgcgtctatgagttgaccggttgtgatgcagtaatgattgggcgagccgctcaaggacaaccatggatatttcgtgatattgagcattttttgcggtcaggggagacgctggcgccgcccagtgttagcgaaataaaaaaaattgtactgacgcatttagaagagctgtacggtttttatggtgaatattcaggctgtcgtattgctcgcaagcatatcgcttggtataccactggtattccgaactctaacgcctttagacaagcgatgtatggtgaggaaagtactgctggtcagtttcgtgtggtggaagattttttgcacgcccatgaataa

SEQ ID NO: 95088 - protein, 330 aa, Psychrobacter sp. 273-4
MSQHPLLQPLVIGGLTIENRLIVAPMAGVTDNPFRRLCKSFGAGHAVSEMIIADTALYARKKSLYRANFDNEIAPISAQIAGAEPDKLAEAARYQIDNGAQIIDINMGCPAKKVCRKLAGSALLQDEDLVARLLDAAVNAVDAPVTLKTRLGYENGRENILRVAKRAEQAGIAAIAIHGRTREDMYTGEARYDLIREVKESISIPVIANGDIDSAQKAQRVYELTGCDAVMIGRAAQGQPWIFRDIEHFLRSGETLAPPSVSEIKKIVLTHLEELYGFYGEYSGCRIARKHIAWYTTGIPNSNAFRQAMYGEESTAGQFRVVEDFLHAHE

SEQ ID NO: 95089 - DNA, 957 bp, Methanococcoides burtonii DSM 6242
  CDS (1)..(957)
atgagacttggcagagttgatcttcccggaaatcttttgcttgcaccattggctgaggtgactaatcttgcattccgtctcatgtgtaagaaatatggtgcatccctttgttttaccgaaatgataagttcggacgctgttgtttatggaaatgccagttccgctatgcgtgggatcacctgtgatgaagagcgtcctttcggtttgcagttgttcggcaattctccggaagtgatcacagaagctgcacttgttctcgaagacatgttctatccagatatgatcgatattaatcttggatgcccggctccggtgatcactaatgcaggatgtggttctgcactgcttgaatctcctgagcttgttagtgatatattctcaactctttgtgagggggtggatactcctgtaactgcaaagatacgtgtgctggagagtcgtgcagctactcttgatatggcacataggctcgaggatgcgggggtttgtgctataaccgttcacggaaggacctgcgaacagggttatagtgggactgctgaccatagttatgcaaaactgatcaaagaagaactttccattccagtgatcgtcaatggcgatatcagggatggtgtgtctgctgaaaaggttctggaatatactgggtgtgatggattgatgataggcagggctgcaatgggtgaccctcacgtgttccatcgtatatccagatatttggatgatggtgaggtaattgggtgtggatgtgagcagaaaagggatgaccttctggaatatcttgatcttctggagaaattcgatctatcctcacatattaatttgaaagcacatgtacagtggttcacgagagggttgaagggcagtcgaaggatgcgttccgatattggatatgcggattcacgagactctattgtagagtttgttaagaatatgtgtgaaaaagaattggtgtga

SEQ ID NO: 95090 - protein, 318 aa, Methanococcoides burtonii DSM 6242
MRLGRVDLPGNLLLAPLAEVTNLAFRLMCKKYGASLCFTEMISSDAVVYGNASSAMRGITCDEERPFGLQLFGNSPEVITEAALVLEDMFYPDMIDINLGCPAPVITNAGCGSALLESPELVSDIFSTLCEGVDTPVTAKIRVLESRAATLDMAHRLEDAGVCAITVHGRTCEQGYSGTADHSYAKLIKEELSIPVIVNGDIRDGVSAEKVLEYTGCDGLMIGRAAMGDPHVFHRISRYLDDGEVIGCGCEQKRDDLLEYLDLLEKFDLSSHINLKAHVQWFTRGLKGSRRMRSDIGYADSRDSIVEFVKNMCEKELV

SEQ ID NO: 95091 - DNA, 1062 bp, Haemophilus influenzae R2866
  CDS (1)..(1062)
atgcgtattatagccagccttgtcggttgtcgagcagttcgatataaattagatttaggcttgctaggaaaggaacgtaaaatgcgaatcggttcataccaattaagaaatcgtgttttacttgcaccaatggcaggtattaccgaccagcctttccgccgtctttgtgcatattatggtgcggggcttacattttcagaaatgatgtccacaaatccgcaagtttggcataccgaaaaatccaaattgcgtttggcacatagcgaagatttaggtctcaatgcggtgcaaattgcaggtagtgatccactcgagatggcgcaagccgctgctattaacgtggaatatggcgctcaaatcattgacattaatatgggatgccctgccaaaaaagtaaatcgcaaactcgcaggctctgcgttgttgcaatttccagatttggtggaaaaaatcttgcgagaagtcgtgtccgccgtcaatgtgccagtgaccttaaaaattcgtacaggctgggataaatctaatcgaaactgcgttcaaatcggcaaaattgcagaacaatgtggcatacaagcattaacggtgcatggtcgtacacgcgcttgtctttttgaaggggaagcggagtacgataacattaaagccgttaaacaagcgattgctataccagttatagctaatggcgatattgattctgctcggaaagcaaaactcgttcttgattatactggagcggatgccattatgattggtcgtgctgcgttaggtaacccttggttatttcaagcggtagaaaacctaattgagcataactcaataagccaaatgccaagtttaaaggaaaagtgcggtcaaattttgcgtcatattcaagaattacatcaattctatggcgaacaaaaaggctatcgcattgcgcgtaaacacgtggcttggtatttacagggaattcaacctgattccgtttttaaacagacttttaatgcaattagtgatcctaaagagcagctgattgtgttggaagattttttcaatttaattttggataaagaaaaatgttag

SEQ ID NO: 95092 - protein, 353 aa, Haemophilus influenzae R2866
MRIIASLVGCRAVRYKLDLGLLGKERKMRIGSYQLRNRVLLAPMAGITDQPFRRLCAYYGAGLTFSEMMSTNPQVWHTEKSKLRLAHSEDLGLNAVQIAGSDPLEMAQAAAINVEYGAQIIDINMGCPAKKVNRKLAGSALLQFPDLVEKILREVVSAVNVPVTLKIRTGWDKSNRNCVQIGKIAEQCGIQALTVHGRTRACLFEGEAEYDNIKAVKQAIAIPVIANGDIDSARKAKLVLDYTGADAIMIGRAALGNPWLFQAVENLIEHNSISQMPSLKEKCGQILRHIQELHQFYGEQKGYRIARKHVAWYLQGIQPDSVFKQTFNAISDPKEQLIVLEDFFNLILDKEKC

SEQ ID NO: 95093 - DNA, 1053 bp, Anabaena variabilis ATCC 29413
  CDS (1)..(1053)
atggttactctgtcccccaacctcaaagctagactttcccaacccctaaacatcggctcgtttgtagttaaaagccgtgttcttcagtcgcctttgtcgggggtgacagatatggtgtttcgccgtctagtacgtcgctatgcacccgattcgatgatgtatacagaaatggtgaatgctacgggtttacactacgtccagcagttaccaaaaattatggaagtagaccccaacgagcgaccaatcagtattcagttgtttgactgtcgtcccgattttttggcagaagcagcaatcaaagccgttgcggaaggcgctgatacgattgatatcaatatggggtgtccggtaaataaaattaccaaaaacggcggaggttcttctttactacgacagccggaagttgcagaagccattgtacgggaagtagtaaaagctgttaatgtgccggtcactgtcaaaacccggattggctggaatgacagagaaattaccattctcgattttgccaagcgcatggaagacgctggagcgcaaatgattacggtgcatggacgtacccgcgctcaaggttacaatggcaatgcccgttgggaatggatagcccgtgtcaaagaaatactttccatccccgtgattggtaatggcgatatattttccgtagaatcggcggtgaaatgtttagaagaaacgggtgctgatggtgtgatgtgttcccgtgggactttaggttatccgtttttggtgggggaaattgaccatttcttaaagactggtgaactcctgacagcaccaaccccaattcaacgtttggaatgtgctagagatcacttacaagccttatgggaatataaaggcgatcgcggtgtccgtcaagcccgcaagcacatgacttggtatgctaaaggttttgtcggtgcggctgagttgcgtggacaattaagcgtaattgaaacagtccaacaaggtttagatttgattgacaaagccactgaaaagctaactcatggttatgagctagtggaggaagctgataattttcaggtagcttaa

SEQ ID NO: 95094 - protein, 350 aa, Anabaena variabilis ATCC 29413
MVTLSPNLKARLSQPLNIGSFVVKSRVLQSPLSGVTDMVFRRLVRRYAPDSMMYTEMVNATGLHYVQQLPKIMEVDPNERPISIQLFDCRPDFLAEAAIKAVAEGADTIDINMGCPVNKITKNGGGSSLLRQPEVAEAIVREVVKAVNVPVTVKTRIGWNDREITILDFAKRMEDAGAQMITVHGRTRAQGYNGNARWEWIARVKEILSIPVIGNGDIFSVESAVKCLEETGADGVMCSRGTLGYPFLVGEIDHFLKTGELLTAPTPIQRLECARDHLQALWEYKGDRGVRQARKHMTWYAKGFVGAAELRGQLSVIETVQQGLDLIDKATEKLTHGYELVEEADNFQVA

SEQ ID NO: 95095 - DNA, 1026 bp, Crocosphaera watsonii WH 8501
  CDS (1)..(1026)
atgttatctatttcatcccatctacaagaaaaactatctcaacccttaaaaattggctcagtagaagttaaaagtagggttttacagtctcccttatctggtgttactgacttagtttttcgtcgtttagtgaggcgttattcacccaattctatgatgtacactgagatggtgagtgccacagaaattcatcatttaaaacaacttcctagactgatggaaattgatgaaaatgaacaacctattagtattcaattatttgattgtcgtcctgattttatggcagaagcggcacaaaaagccgtagcagaaggagcaaaaactattgatattaatatgggttgtcccgttaataaaataacgaaaaaaggtgggggttcttctttattaagacagccacatctagcccaaacactcgtggcagaagtagttaaatctgtggaggttcctgttactgtaaaaacgagaatagggtgggatgataaagaaattaacatcttagaatttgctcaaaaaatggaagatgcaggggcagctatgttaacccttcatgggagaactcgcgcacaaggatataagggaaatgctaggtgggaatggattaaaaaagttaaagaaatcttgactattcctgttattgctaatggtgatatcttttctgtagaagctgctattaactgtttggaaataacaggggcagatggggttatgtgttcccgtggaaccctggggtatccttttttagtaggagaaattgatcactttttttgcacaggaattaagcagaataaacccactcctagagaaaaattagaatgtgctaaagaacatttacaagggttatgggaatataaaggtaaacgaggtatttatcaagctagaaaacatttgagttggtattgtaaagagtttcctggagcatcagaattaagggataaagtctctcgtatcgaaacagtagaagaaggctataaattattaaatgaggcaaaagagtcgctctcactgattaacccttgctcataa

SEQ ID NO: 95096 - protein, 341 aa, Crocosphaera watsonii WH 8501
MLSISSHLQEKLSQPLKIGSVEVKSRVLQSPLSGVTDLVFRRLVRRYSPNSMMYTEMVSATEIHHLKQLPRLMEIDENEQPISIQLFDCRPDFMAEAAQKAVAEGAKTIDINMGCPVNKITKKGGGSSLLRQPHLAQTLVAEVVKSVEVPVTVKTRIGWDDKEINILEFAQKMEDAGAAMLTLHGRTRAQGYKGNARWEWIKKVKEILTIPVIANGDIFSVEAAINCLEITGADGVMCSRGTLGYPFLVGEIDHFFCTGIKQNKPTPREKLECAKEHLQGLWEYKGKRGIYQARKHLSWYCKEFPGASELRDKVSRIETVEEGYKLLNEAKESLSLINPCS

SEQ ID NO: 95097 - DNA, 999 bp, Exiguobacterium sp. 255-15
  CDS (1)..(999)
atgatgacaggttttaaaataggtgacgtcgaactgaataaccgtgtcattttagcaccgatggcgggtgtctgtaatcctgcgtttcgtttgatcgcaaaagaattcggggcaggtctcgtctgtgcagaaatggtcagtgataagggaatcctctacgaaaacgaacggacaatgcaaatgctgtatgtggacgatcgggaaaaaccgctcagtttgcagatttacggcggatcaaaagaaacgttggttcaagcggctcaatatgtcgatgcgaatacgaatgcagacatcatcgacatcaatatggggtgtcctgttccaaaagtgacgaagtgtgacgcgggtgccaagtggttgcttgatccggataaagtctatgagatggttcatgccgtatcacaagcggtggataaacccgttacggtgaagatgcgaaccggctgggacagccaccatatttattgtgttgataatgtccgcgctgcggaagcgggaggggcgaaggcggtcgctattcacggccggacccggtcgcagaagtatgaaggcgtcgccgattggaatatcatcggtgaagcaaaacgggccgtgactattccgatcatcggaaacggtgatgttcaaaccccgcaagacgcgaaacggatgattgatgaaatcggggtggacggtgtcatgatcgggcgagcggcactcggaaatccgtggatgttgtatcagacgattcaatatttggaatcgggtaccctgtcggtcgagccgacgccacgtgagaaaattgatatttgcctgttacatgccgaacgtcttgtcgcacttaaaggagaagacctcgcggtacgggaaatgcggactcatgtcgcctggtatttaaaaggattaagcggcaacgggcatgtgcgcaaagccttattcgatacgaatacccacacaggactgcaaaagttgctgcatgagtatgttgaaacattggaaatgaatgccgtacatgcgtga

SEQ ID NO: 95098 - protein, 332 aa, Exiguobacterium sp. 255-15
MMTGFKIGDVELNNRVILAPMAGVCNPAFRLIAKEFGAGLVCAEMVSDKGILYENERTMQMLYVDDREKPLSLQIYGGSKETLVQAAQYVDANTNADIIDINMGCPVPKVTKCDAGAKWLLDPDKVYEMVHAVSQAVDKPVTVKMRTGWDSHHIYCVDNVRAAEAGGAKAVAIHGRTRSQKYEGVADWNIIGEAKRAVTIPIIGNGDVQTPQDAKRMIDEIGVDGVMIGRAALGNPWMLYQTIQYLESGTLSVEPTPREKIDICLLHAERLVALKGEDLAVREMRTHVAWYLKGLSGNGHVRKALFDTNTHTGLQKLLHEYVETLEMNAVHA

SEQ ID NO: 95099 - DNA, 1065 bp, Mesorhizobium sp. BNC1
  CDS (1)..(1065)
atgtctaacaaatgggcattcagcaaggatgccttattcttgagcaacagtgcgctgcaaatcctttcccaaccgcttcaggtcggcgcggtccggctgcggaaccgcgtgttcctggcgcctatgtccggtgtgacggatctgccgtttcgcatgcgcgcttatgcgcatggcgccgggttggtcgtatccgagatggtggccagcggtgagctggcgaagggcagggcggagagtgcaaggcgcatccgccggcccgatatcgacgtccacatggttcagatcgccggtcgcgaagcgcgctggatggccgaggcggcgcgcatcgccgtggacgagggtgcggacatcgtcgacatcaatatgggctgtccggccaagaaagtgacgggcggctattccggctccgctctcatgcgcgagcccgatcacgcactgtcgctgatcgaggcggtggtaaaagccgtggatgtgccggtgacagtcaagatgcggcttggctgggatgatgcgtgcctcaacgcgcccgagcttgctcgccgggctgaagccgccggcgtggcgatggtgacggttcatgggcgcacgcgctgccagttctataccggtcaggcaaattggaaagcgatagcggaggtcaagcaggcggtctccatcccggtcgtcgccaatggggatggcgaaggaccgttggaggctgcgactatgctcacccaatcaggcgctgacgccgtgatgatcggccgggcgcattacggcgcgccgtggaaggccggcgcgctggcgcatgccgcagacggcagtgcggcgcctggcgtaccggccggtacggccgagatggcagattatgttgcggcgcattacgtggatatgctttcgcattacggcacggggcagggaacgcgccacgcaagaaagcatatcggatggtatctggaccgtcattcagcccctgatcccgctttgcggcgctcgattatgacggaaacggacccttctaaggtgctccaccttattggcgggatattttctcaaccgggtctcgtgcaagggctagccgcatga

SEQ ID NO: 95100 - protein, 354 aa, Mesorhizobium sp. BNC1
MSNKWAFSKDALFLSNSALQILSQPLQVGAVRLRNRVFLAPMSGVTDLPFRMRAYAHGAGLVVSEMVASGELAKGRAESARRIRRPDIDVHMVQIAGREARWMAEAARIAVDEGADIVDINMGCPAKKVTGGYSGSALMREPDHALSLIEAVVKAVDVPVTVKMRLGWDDACLNAPELARRAEAAGVAMVTVHGRTRCQFYTGQANWKAIAEVKQAVSIPVVANGDGEGPLEAATMLTQSGADAVMIGRAHYGAPWKAGALAHAADGSAAPGVPAGTAEMADYVAAHYVDMLSHYGTGQGTRHARKHIGWYLDRHSAPDPALRRSIMTETDPSKVLHLIGGIFSQPGLVQGLAA

SEQ ID NO: 95101 - DNA, 954 bp, Ehrlichia canis str. Jake
  CDS (1)..(954)
atggatatcagacaattcatatcagaacatccagtaatattagcaccaatgtctggtgtaactgattttccatttcgctgccttgtaaaaaacattggagctggattattagtatcagaaatgatagcaagtcgtgcaatgatcatacaaacaaaacaaagtctacaaaaatcacaaattcaagctaataccgctgtacaattagctgggtgtgatccagcaataatggcagaagctgcaaaactcaatgaagacatgggtgcaaaaattatagatataaactttggctgtcccgttaagaaagtagttaatagctatgctggctcagcactaatgaaagatgaaattacagctgcaaaaatcctagaatctgtagtaaaagcagtaaaaattccagtaacattgaaaatgcgtactggatgggacaataacaatctaaattcaccaaaattagctaaaattgctgaagaaagtggaataaaaatgataacaatacatggtagaacaagaacacaaatgtttaatggaaaagcagactggaaattcatcagcaatatcaagaaatgcgtaaaaatccctgtcatagctaatggagatataaaaaacctagatgatataaaaacatcattagaagaatcacaagcagatggagtcatgataggaagaggagcatacggtaaaccatggtttattaatcaagctttgcattttataaaatcaggcataattttacctgaaccatcaccatcagaaaaactacaaattataacaaaccattatgaccacatgatagaatattacggaaaagatataggagttaaaatatcaaaaaaacacataagttggtatagtgcttctctagataattcagcagaatttagatctcaagtaaatcgatcaaatgataacagctttatcagagataaaattatagattttttttcacaaaactga

SEQ ID NO: 95102 - protein, 317 aa, Ehrlichia canis str. Jake
MDIRQFISEHPVILAPMSGVTDFPFRCLVKNIGAGLLVSEMIASRAMIIQTKQSLQKSQIQANTAVQLAGCDPAIMAEAAKLNEDMGAKIIDINFGCPVKKVVNSYAGSALMKDEITAAKILESVVKAVKIPVTLKMRTGWDNNNLNSPKLAKIAEESGIKMITIHGRTRTQMFNGKADWKFISNIKKCVKIPVIANGDIKNLDDIKTSLEESQADGVMIGRGAYGKPWFINQALHFIKSGIILPEPSPSEKLQIITNHYDHMIEYYGKDIGVKISKKHISWYSASLDNSAEFRSQVNRSNDNSFIRDKIIDFFSQN

SEQ ID NO: 95103 - DNA, 1110 bp, Burkholderia cepacia R1808
  CDS (1)..(1110)
ttggcccgcgacgtcccggcgctcgcgggcggtgccattgcgatgcccgttatcggctctcacgttctgcgcaacaacctgttcgtcgccccgatggccggcgtcaccgatcgtccgttccgccagctgtgcaagcggctcggcgccggctacgcggtgtccgaaatggtcgcgtcgaatgcgcagctgtggaagagcgcgaagacgatgcggcgcgccaaccacgagggcgaagtcgagccgatcgcagtgcagatcgccggcgccgatccggcgatgatggccgaagcggcccgctacaacgtcgacaacggcgcgcagatcatcgacatcaacatgggctgcccggcgaagaaggtctgcaacgtcgcggccggctcggcgctgctgcagaacgagccgctcgtgcagcgcatcgtcgaggccgtcgtcgcggcggtcggcacggggccggatgcggtgcccgtcacgctgaagatccgcaccggctgggatcgcgaacacaagaacgcggtcaccgtcgcccgcctcgccgaagccgcgggcatctcgatgctgaccgtgcacggccgcacgcgcgccgacctgtaccacggcgacgccgagtatgaaaccatcgcggccgtgaaggcggccgtcggcattccggtcgtcgcgaacggcgacatcgcgtcgccggcgaaagcgaaggccgtgctcgacgccaccggcgccgatgcactgatgatcggtcgcgccgcgcaaggccgtccgtggttgttccgcgaaatcgatcatttcctgcaaaccggcgagctgctgccgccgccgcgcatcgacgagatccggcaggtgatgaacgagcacctggaagatcactacgcgttctatggcgaattcaccggagtccgtactgcgcgcaagcacatcggctggtacactcgcggcctttccggtgccaacgggttccggcacaggatgaacacgctcgattccacccgcgagcagctcgccgccgtcaacgcattcttcgacgcgcaagaggcgctgtcggaccgcctcgtgtacgtcgacgacgaacccgaaaacggccagcgcgagtcggacgaccataaccagttagcagcatga

SEQ ID NO: 95104 - protein, 369 aa, Burkholderia cepacia R1808
MARDVPALAGGAIAMPVIGSHVLRNNLFVAPMAGVTDRPFRQLCKRLGAGYAVSEMVASNAQLWKSAKTMRRANHEGEVEPIAVQIAGADPAMMAEAARYNVDNGAQIIDINMGCPAKKVCNVAAGSALLQNEPLVQRIVEAVVAAVGTGPDAVPVTLKIRTGWDREHKNAVTVARLAEAAGISMLTVHGRTRADLYHGDAEYETIAAVKAAVGIPVVANGDIASPAKAKAVLDATGADALMIGRAAQGRPWLFREIDHFLQTGELLPPPRIDEIRQVMNEHLEDHYAFYGEFTGVRTARKHIGWYTRGLSGANGFRHRMNTLDSTREQLAAVNAFFDAQEALSDRLVYVDDEPENGQRESDDHNQLAA

SEQ ID NO: 95105 - DNA, 975 bp, Bacillus cereus G9241
  CDS (1)..(975): transl_table=11
atgaaaaatccggttgtattagcaccgatggcgggagtgtgtaactctgcattccgtttgacagtaaaagaattcggtgcgggcttagtttgtgccgaaatggtaagtgataaggcaatactactgaacaataaaagaacattagatatgttatatatcgatgagagagaaaagccattaagtttacaaatttttggtggcgagaaagaaactcttgtagatgctgcgaaatacgtagatcaatatacgacggcagacatcattgatattaatatggggtgcccagtaccgaaaatcgttaagtgtgatgcaggagcaaagtggcttttagacccaaataaaatatatgaaatggtagcggcagttgtagatgctgtagaaaaaccggttacagttaaaatgcgtattggttgggatgaggatcatattttcgcaatcgagaatgcgaaagctgttgagcgtgctggtggacaagcggtagcagttcatgggcgcacacgagtacaaatgtatgaaggaaaagcggattgggatattattaaacaagtaaagcaagctgtaaatatcccggttattggaaatggtgatgtcgcaacgccacaagacgcaaagcgtatgcttgatgaaataggtgtagatggtgttatgattggtcgcgctgcccttggagatccatggatgatttatcgtacggtaaagtatttagagacaggtgaattaatgccagaaccgacagtacgtgagaaaattgacgtatgtatgttgcatctagatcgtctgatcgatttaaagaatgaaaatgtcgctgtaagagagatgagaaagcacgcagcttggtatttaaagggcattcgtggtaatgcaactgtacgtaatggtatcaatgcttgtaatacgcgtgaagaccttgcgaatgtattaggtgcatttgtagaagaagtagaagcgaaacaacaaacaattcacgttggttaa

SEQ ID NO: 95106 - protein, 324 aa, Bacillus cereus G9241
MKNPVVLAPMAGVCNSAFRLTVKEFGAGLVCAEMVSDKAILLNNKRTLDMLYIDEREKPLSLQIFGGEKETLVDAAKYVDQYTTADIIDINMGCPVPKIVKCDAGAKWLLDPNKIYEMVAAVVDAVEKPVTVKMRIGWDEDHIFAIENAKAVERAGGQAVAVHGRTRVQMYEGKADWDIIKQVKQAVNIPVIGNGDVATPQDAKRMLDEIGVDGVMIGRAALGDPWMIYRTVKYLETGELMPEPTVREKIDVCMLHLDRLIDLKNENVAVREMRKHAAWYLKGIRGNATVRNGINACNTREDLANVLGAFVEEVEAKQQTIHVG

SEQ ID NO: 95107 - DNA, 1050 bp, Rubrivivax gelatinosus PM1
  CDS (1)..(1050)
atgtctcccctgcgcatcggctcgatcgagctcccgaaccggctgttcgtggcaccgatggcgggcgtcaccgaccgaccgttccgccagctgtgcaagcggctcggcgccggctatgcggtgagcgagatggtcacctcgcgcaaggaactctggcacagcctgaagacctcgcggcgtgccaaccacgacggtgaggtcgcgccgatcgcggtgcagatcgccggcaccgagccgctgatgatggccgaggccgccgcctacaacatcgaccgcggcgcgcaggtcatcgacatcaacatgggctgcccggccaagaaggtctgcaacgtgtgggccggctcggcgctgatgcgcgacgagtcgctcgcgctgcgcatcgtcgaggcggtggtcaccgcctgcgcgccgcacggcgtgccggtgacgctgaagatgcgcaccggctggaacatgcagaaccgcaatgcggtggcgctggcgcgcggcgccgagtcgctcggcatcgcgatgctgacggtgcacggccgcacgcgcgagcagggctacgccggctcggccgaacacgacaccgtgcgcgcggtgaagaccgcggtgcaggtgccggtggtcgccaacggcgacatcgactcgcccgagaaggcgcgcgacgtgctcgccgcaaccggcgccgacgcggtgatggtcggccgcgctgcgcaggggcggccgtggatcttccgcgagatcgcgcacttcctcgccaccggcgagcgcctgccgccgccgcgtaccgcgcaggccaaggcctggttgatcgaacacctgcacgaccactacggcctgtacggcgaatacgccggcgtgcgcaccgcgcgcaagcacatcggctgggcagtgcacgcgttgccgggcggtgccctgttccgcgcccgaatgaacacactggagcgctgcgaggcgcaagtcgccgctgtcggcgatttcttcgatgccctcggggtcgagcatgagctgctgccgcaagcagcagcggcgctcgaaccgtccttcgaacaagaggctgcatga

SEQ ID NO: 95108 - protein, 349 aa, Rubrivivax gelatinosus PM1
MSPLRIGSIELPNRLFVAPMAGVTDRPFRQLCKRLGAGYAVSEMVTSRKELWHSLKTSRRANHDGEVAPIAVQIAGTEPLMMAEAAAYNIDRGAQVIDINMGCPAKKVCNVWAGSALMRDESLALRIVEAVVTACAPHGVPVTLKMRTGWNMQNRNAVALARGAESLGIAMLTVHGRTREQGYAGSAEHDTVRAVKTAVQVPVVANGDIDSPEKARDVLAATGADAVMVGRAAQGRPWIFREIAHFLATGERLPPPRTAQAKAWLIEHLHDHYGLYGEYAGVRTARKHIGWAVHALPGGALFRARMNTLERCEAQVAAVGDFFDALGVEHELLPQAAAALEPSFEQEAA

SEQ ID NO: 95109 - DNA, 1089 bp, Rhodospirillum rubrum
  CDS (1)..(1089)
atgacgccgtcccccgcgttccccgtttccgatccgctgatcatgctggcgccgatggctggggtaaccgattcccccttccggcgactggcccacgactatgggtgtccgctatcgtggaccgagatggtcgccagccgcgagctgctgcgcgagcgggcgcggggcgtcgatccccggctgggcggcggagcggaggccgggcgggcgggccccttcgccgtgcaactggccggctgcgatccgctgatcatggccgaggcggcgcggcgggttgaaggcgccggagccgagctgatcgatatcaacatgggctgcccggtgcgcaaggtggtgggcggcttgggcgggtcggcgctgatgcgcgatctgcctttggccgcgcgtattctcgaagccgtggtcggtgccgtgaccctgcccgtgagcctgaagatgcgcctgggctgggatgacgccagccgcaacgcggtcgagctggcccggctggccgaaagcgcggggatcagccggctgaccgtccatggccgcacccgggcccagatgtatgacggtcgcgccgactggccggccatcggtctggtcaaacgggccgtctcgctgccggtcatcgccaatggcgatgtgacgaacctgtccgaggcccgcgagatcctggccgttaccggcgccgatggcgtgatgatcggccgggcggccctcggcgcgccctggttgcccggcgccatcgcccgggccatcgccgccgggacgcgggaaacgccgccgccggctttggccgagagggcggcggtgatggccgcccacctcgaaggcctgttggcctgccatggtctggagcgtggccttaagacctcgcgcaagcatatgggctggtatgcgcggacgatgccgcaaggcgccgacttccgcgccgcctatatggccgccgccgatgccggggcggcgcgccgagttctcaaccatttcacggcgctgtggcagtcggccccgccgtccgcatcccaagaaagccgccaaagagcggtcttgaaaaaccccaccccggaggacacgtcacccgaccgcccgcgagaagaggccgcttga

SEQ ID NO: 95110 - protein, 362 aa, Rhodospirillum rubrum
MTPSPAFPVSDPLIMLAPMAGVTDSPFRRLAHDYGCPLSWTEMVASRELLRERARGVDPRLGGGAEAGRAGPFAVQLAGCDPLIMAEAARRVEGAGAELIDINMGCPVRKVVGGLGGSALMRDLPLAARILEAVVGAVTLPVSLKMRLGWDDASRNAVELARLAESAGISRLTVHGRTRAQMYDGRADWPAIGLVKRAVSLPVIANGDVTNLSEAREILAVTGADGVMIGRAALGAPWLPGAIARAIAAGTRETPPPALAERAAVMAAHLEGLLACHGLERGLKTSRKHMGWYARTMPQGADFRAAYMAAADAGAARRVLNHFTALWQSAPPSASQESRQRAVLKNPTPEDTSPDRPREEAA

SEQ ID NO: 95111 - DNA, 1065 bp, Ralstonia metallidurans CH34
  CDS (1)..(1065)
atgcagatcggtccgcaccaacttcgcaacaacctgttcgtcgcccccatggccggggtgaccgaccggcccttccgccagctctgcaagcagcttggcgcgggctacgcggtgtccgagatggttgcgtcgaacgcccagctctggaaaagcgaaaagaccatgcgccgcgccaaccacgccggcgaggtggaaccgatctcggtgcagatcgcaggcgcggagccgtcgatgatggccgaggcggcccgctacaacgtggaccgcggcgcccagatcatcgacatcaacatgggctgcccggccaagaaggtctgcaacgtggccgccggttcggcgctgctgcagaacgagccgctggtcgtgcgcatcgtcgaagccgtggtggccgccgtgggcgaccgcgtgcccgtcacgctgaagatccgcaccggctgggaccgcgagcacaagaatgcgctgcgcgtggcgcgcatggtggaagacgccggcatcagcatgctgacgatccacggccgcacgcgcgccgatctctatcatggcgaagccgagtacgagacgattgccgccgtcaagtcgtcgatccgcatccccgtggtagccaacggcgacatcaccacgccgcagaaggcccgacatgtgctggccgtgaccggcgccgacgcgatcatgatcggccgggccgcgcagggccgcccctggctgttccgcgagatcgagcactacctgaagacgggcgagctgctgccctcgccagaagtggccgagatccgcgcgatcatgaaccatcacctggcggaccactacgcgttctacggcgagttcaccggagtgcgcaccgcccgcaagcatattgcctggtacacgcgcggcctcaagggcgcgaacctgttccggcatcgcatgaacacactggaatccaccgacgcgcaactcgcggccgtcaacgcattcttcgacgaacaggctgcaatttccgaccgcctggtctatgtcgacgagaatgccgcgccggacgacgacgcgctcgacaacaacaagaaacgggaattgcttgccgcatga

SEQ ID NO: 95112 - protein, 354 aa, Ralstonia metallidurans CH34
MQIGPHQLRNNLFVAPMAGVTDRPFRQLCKQLGAGYAVSEMVASNAQLWKSEKTMRRANHAGEVEPISVQIAGAEPSMMAEAARYNVDRGAQIIDINMGCPAKKVCNVAAGSALLQNEPLVVRIVEAVVAAVGDRVPVTLKIRTGWDREHKNALRVARMVEDAGISMLTIHGRTRADLYHGEAEYETIAAVKSSIRIPVVANGDITTPQKARHVLAVTGADAIMIGRAAQGRPWLFREIEHYLKTGELLPSPEVAEIRAIMNHHLADHYAFYGEFTGVRTARKHIAWYTRGLKGANLFRHRMNTLESTDAQLAAVNAFFDEQAAISDRLVYVDENAAPDDDALDNNKKRELLAA

SEQ ID NO: 95113 - DNA, 933 bp, Magnetococcus sp. MC-1
  CDS (1)..(933)
atggctggggtaaccgatgccccttttcgacttatcgctcggcgctacggtgctgaccttacggtttcggagatgatcgcctcccaagccatgatacgtaacaccagcaaaagtctactcattggtaccgcccatgaggaagaacatcccctctcggtacagattgccggcagcgatccccaagtgatggccgaagcagcccgcatgaatgtagaccggggggctgaaataatcgacatcaatatgggctgccccgttaaaaaagtggttaaagggcaggcgggtgccgctttaatgcgcgatgaggctctggtcgcacgaattttagccgctgtggtggccgccgttccggtgccggtcactcttaaaatccgcctggggtgggataaaagcaacctaaatggtgcccgcatcggccaaattgccgaacaacagggggttcgcatgctcaccgtgcatggccgcacccgcatgcagatgtatcgcggccatgcggattggcaatgcatcgccagcattaaacaggccgtcaccataccggtggtgggcaatggggatcttcacaccccccaagaggctaaggagaagtggctgctctctggcgttgatgggttgatgattggacgggccgccatgggctgcccttggttgtttggacagattgcccactatctgcgcagtggtcaggaaaaaccacctcccgatctggccgaacaacacgccttggttttggaacattttgatcgactcattgatttttatgggccgcatatcggtaatcgcatggcgcgcaagcatctggcttggtacgccaaaggactacccaacagcgcccactatcgcagtgcgatcaaccattgccctacgcctgaagagacccgccatctggtggacgacttctaccgtggtgtgcataacacccaagctgcgtaa

SEQ ID NO: 95114 - protein, 310 aa, Magnetococcus sp. MC-1
MAGVTDAPFRLIARRYGADLTVSEMIASQAMIRNTSKSLLIGTAHEEEHPLSVQIAGSDPQVMAEAARMNVDRGAEIIDINMGCPVKKVVKGQAGAALMRDEALVARILAAVVAAVPVPVTLKIRLGWDKSNLNGARIGQIAEQQGVRMLTVHGRTRMQMYRGHADWQCIASIKQAVTIPVVGNGDLHTPQEAKEKWLLSGVDGLMIGRAAMGCPWLFGQIAHYLRSGQEKPPPDLAEQHALVLEHFDRLIDFYGPHIGNRMARKHLAWYAKGLPNSAHYRSAINHCPTPEETRHLVDDFYRGVHNTQAA

SEQ ID NO: 95115 - DNA, 972 bp, Methanosarcina barkeri str. fusaro
  CDS (1)..(972)
atgaaacttaataaattaaaaatcggcaaaacagaaacacctgggaaccttcttcttgcgcctatggcagacgtgacaaatctggctttcaggctgctctgcaggcagaatggagctgaccttacatatactgagatgatcagcgcagatgccttgctcaacgaaaaccgaaaatcgcttctcaaaggactgtcttcccctgaagaccgaccttttggagttcagcttgtaggaagttctcctgagaaactgagggaagctgcgctctttattgaagatgagtacagacctgaactcatcgatgtaaatatgggctgccctgcaaagcgtattactggaacagggtgcggctcggctcttctcaactccaagaaactcatatatgaaattatctccgatctgaccgatgttctgaagactcctgtaactgcaaagatccgcattctgaagagggatgagaaaacccttgagattgcacgcctgatcgaagaggctggagcttctgccctgaccatacatggcaggagggcagagcaaatgtactccggaagttcagaccttacagtgataagagccgttaaacaggaactttccattccagtaattgcaaacggggatataaggaacgaagagtctgctgaagctgcccttgattttaccgaatgtgacgggcttatgatcggacgcgcagcaatgggaaatccctttatcttcaaaaggataaggcattacctagaaaccggggaaaggctggaatttgacaggcaagttcgtcaattagaggactttgagaattatatcgctttacttgaagaatatgatctccacgcgtctacaaatataagaatgcatgctcactggtttacaaaagggttgcgcggctcgcggcagattagggaaaagattaataatctgaaagatggaaaggcgattgttgagttaataaaagatttccatacggagaattattaa

SEQ ID NO: 95116 - protein, 323 aa, Methanosarcina barkeri str. fusaro
MKLNKLKIGKTETPGNLLLAPMADVTNLAFRLLCRQNGADLTYTEMISADALLNENRKSLLKGLSSPEDRPFGVQLVGSSPEKLREAALFIEDEYRPELIDVNMGCPAKRITGTGCGSALLNSKKLIYEIISDLTDVLKTPVTAKIRILKRDEKTLEIARLIEEAGASALTIHGRRAEQMYSGSSDLTVIRAVKQELSIPVIANGDIRNEESAEAALDFTECDGLMIGRAAMGNPFIFKRIRHYLETGERLEFDRQVRQLEDFENYIALLEEYDLHASTNIRMHAHWFTKGLRGSRQIREKINNLKDGKAIVELIKDFHTENY

SEQ ID NO: 95117 - DNA, 975 bp, Geobacter metallireducens GS-15
  CDS (1)..(975)
atgctcaaccccctggccatcggccccctgaccctggcaaacaatctgatcctcgcccccatggcgggaattacgaacctccccttccggcttctggcccgggaggagggggcgagcctctgctttaccgagatggtgagcgtgaacggcctcgtgcgggaggggcgcaagaccttcgagcttctgcgaagcgtgccggaggaccgtcccctggggatccagctcttcggcgacgacccgcagcttctggccgaaggggcacggatggtggaggggcacggcgacctcatcgacatcaacatgggatgcccggtcaagaaggtggtcggcaccggggccggcagcgccctgttgcgggagccggcaaaggtccgggccatcatccgtgagacccgccgcgccacacgccttcccctgaccgtcaagatccgcagcggctgggcctgcggcgaggccaacttccttgatatcgcccagattgccgaggaggaggggtgcgacgccatcaccctccacccccggagccggtcccagatgttcgaggggcacgccgactggcagcagatcgccgagatgaagcagagcgtgaaaatccccgtcatcggcagcggcgatctcttcaccgccgccgacgtcaccgccatgctggccgaaaccggctgcgacggagtcatggtggcccggggcgccctgggtaacccgtggatcttccgccaggccctggccctcctggacggcagggaaccggacgcaccctccaccggggagcggctccgcgccgcgctccgacacctggagctcttcacggagctcgccggcgagcgggtggccctgcgggagatgcgcaagcacttcagctggtattcccacggtctctccggcgcggcccagttccgcaaggccgtcaacatcatcgagggaaaggaagcccttctcgaagcgctgcaccgcttcttcgcgccggaggcgccatga

SEQ ID NO: 95118 - protein, 324 aa, Geobacter metallireducens GS-15
MLNPLAIGPLTLANNLILAPMAGITNLPFRLLAREEGASLCFTEMVSVNGLVREGRKTFELLRSVPEDRPLGIQLFGDDPQLLAEGARMVEGHGDLIDINMGCPVKKVVGTGAGSALLREPAKVRAIIRETRRATRLPLTVKIRSGWACGEANFLDIAQIAEEEGCDAITLHPRSRSQMFEGHADWQQIAEMKQSVKIPVIGSGDLFTAADVTAMLAETGCDGVMVARGALGNPWIFRQALALLDGREPDAPSTGERLRAALRHLELFTELAGERVALREMRKHFSWYSHGLSGAAQFRKAVNIIEGKEALLEALHRFFAPEAP

SEQ ID NO: 95119 - DNA, 921 bp, Geobacter metallireducens GS-15
  CDS (1)..(921)
atgctggcccccatgcaggggctgacgaaccgcgccctgcgtgccctgttcatcaactgggtacggcccgatgtggtctttaccgagttcatgcgggtcaatcccggcggagcgcggcagccgatcagggcgggggatctgcgggaggtggccgccgtggaggggggcgtccccctggtggtacagctcatcggtcacgaccataaagccctggtggccgctgcccggacggctcaggaggccggggcagtccacatcaaccttaatctcggctgtccctacggacggatgacttccggcctcaccggcggagggatgctgcaccgccccgaggccctggaagagctcatcccagccctgcggagggccattgcggggacattttccgtcaaggtcagggcaggctacgacgactccgggcagataatgaccctcctccccctgttcgaggaggcgggggtcgacttcctggtgctccatccccggacggttgtgcaggaatacaccggccacgccgaccatgccgttaccgccgaggtggtgcggcagacccggctcccggtcatcgccaacggcgacgtccggagcgccgccgacggtctgcgggtcctgcggaaaacgggggcgacgggactcatgctggggaggggagccatcgccgaccccctgctgttccagcggctcaggggcaaggcgccggccgaaccgaccggtgaggaacgggtggcaatgctcaagcgttatctgggggagttgctggagggatacggcgaaatcttctgcggcgacacgcagattctggggaagatcaagggagtcatggccaccatggacgatcccttcctggcaaaggggctcaaacagctcaagaaagcgcggactgtcgcggccttcgcctccaccctgagagacatccaatga

SEQ ID NO: 95120 - protein, 306 aa, Geobacter metallireducens GS-15
MLAPMQGLTNRALRALFINWVRPDVVFTEFMRVNPGGARQPIRAGDLREVAAVEGGVPLVVQLIGHDHKALVAAARTAQEAGAVHINLNLGCPYGRMTSGLTGGGMLHRPEALEELIPALRRAIAGTFSVKVRAGYDDSGQIMTLLPLFEEAGVDFLVLHPRTVVQEYTGHADHAVTAEVVRQTRLPVIANGDVRSAADGLRVLRKTGATGLMLGRGAIADPLLFQRLRGKAPAEPTGEERVAMLKRYLGELLEGYGEIFCGDTQILGKIKGVMATMDDPFLAKGLKQLKKARTVAAFASTLRDIQ

SEQ ID NO: 95121 - DNA, 1056 bp, Novosphingobium aromaticivorans DSM 12444
  CDS (1)..(1056)
atgtcccaggttcccgttccgccccgcctcaagcccatccaggttggccccgtcaccgtgagctgcccggtcgtgctcgcgccaatgacgggcgtttcggacctgccattccgcacgatcgtgcgccgcttcggctcggggctcaacgtgaccgagatgattgcgagccctgcggccatccgtgagacgcggcaatccatccagaaggccgcatggcacccgacggaagaaccggtctccatgcaactcgttggctgcgagcccgagcagatggccgaagctgccaagctttcggaagacaaaggcgcggcaattatcgacatcaacatgggctgccccgtgcgcaaggtcgttaacggggatgccggctcggccttgatgcgcgacattccgttagctacccgcctgatcgaggccacggtgaaggcggtgaaggtgcccgtcaccgtaaagatgcgcatgggctggtgccacgacagcctgaatgctcccgaactcgcgcgcattgccgaggatctcggcgcgaagatgattaccgtgcacggacgcacccgcaaccagatgtacaagggcagtgccgactgggccttcgtccgcagcgtcaaggaggcggtgtcaattccagtgatcgtcaacggcgacatctgcgggatcgaggatgtcgctaccgccatagagcagagcggcgcggacggcgtgatgatcgggcgggggtcctatggtcgtccgtggcttctcggccagatcatgcattggctcgacaccggcgagcgtctggcggaccccccccttgccgaacagtacgccctcattgtcgagcactaccacgcgatgcaggagcattacggcgagatgaccggcgtcaacatggcgcgcaagcatctcggctggtataccaaggggctgcacggctcagccgatttccgcaacaaggtcaacttcatcgacgacccaaaggccgtcctggcaagtctggcggatttctacggacgagcgatcgaacaccagcactccgccgccgaggcttccgctgcggagcggcgcgcagccgcatga

SEQ ID NO: 95122 - protein, 351 aa, Novosphingobium aromaticivorans DSM 12444
MSQVPVPPRLKPIQVGPVTVSCPVVLAPMTGVSDLPFRTIVRRFGSGLNVTEMIASPAAIRETRQSIQKAAWHPTEEPVSMQLVGCEPEQMAEAAKLSEDKGAAIIDINMGCPVRKVVNGDAGSALMRDIPLATRLIEATVKAVKVPVTVKMRMGWCHDSLNAPELARIAEDLGAKMITVHGRTRNQMYKGSADWAFVRSVKEAVSIPVIVNGDICGIEDVATAIEQSGADGVMIGRGSYGRPWLLGQIMHWLDTGERLADPPLAEQYALIVEHYHAMQEHYGEMTGVNMARKHLGWYTKGLHGSADFRNKVNFIDDPKAVLASLADFYGRAIEHQHSAAEASAAERRAAA

SEQ ID NO: 95123 - DNA, 990 bp, Cytophaga hutchinsonii
  CDS (1)..(990)
atggtaaaaataggtgatattgaattaggtgcgtttccgttgcttttagctccgatggaggatgttagtgatccgccgttccgggcgctttgcaagcagcagggggccgatatgatgtacaccgaatttatcgcagcagaaggtttgatccgtgatgccgcaaaaagtgttcacaagcttgatatatttgattatgagcgccctatgggtattcagatttttggcgataaaatagatgtcatgtgtgacgccgctgcaatcgctgaagaagccgggccggaattggtggatattaactttggctgcccggttaaaaaggttgcctgcaaaggtgccggctcaggcgcattgctggacattccgaaaatggtaaaaatgacggaagagattgtaaagcgctgtacattacctgtaacggttaaaacccgtttaggctgggatcatgattccatacatattgttgatattgccaggcgcttgcaggatgtgggtattaaggcattaaccattcatgggcgtacacgtcagcaaatgtataaaggcgaagccgactggtcctggattgccaaagtaaaggaacagcaggatattcatataccgatttttggtaatggagacattgactctcctgaaaaagcattggaatataaaaacagatacggtgttgatggtatcatgattggccgtgcagctatcgggtatccatggatattcaaagaagtaaaacatttttttgcaacaggtgaaaaacttggtccgccaacgattcgtgaacgtgtagaagtatgtaaaaaacatttggccttttcagttgaatggaaggggcccaaggaagggatttttgaaatgcgtatgcattacacaaattatttcagaggcatacagaattttaagccttaccgccagcgtcttgttgaagcgggctcatacgaggacacatttgctattttagatgaagtagcagagcagctgtctgaatatgtattttaa

SEQ ID NO: 95124 - protein, 329 aa, Cytophaga hutchinsonii
MVKIGDIELGAFPLLLAPMEDVSDPPFRALCKQQGADMMYTEFIAAEGLIRDAAKSVHKLDIFDYERPMGIQIFGDKIDVMCDAAAIAEEAGPELVDINFGCPVKKVACKGAGSGALLDIPKMVKMTEEIVKRCTLPVTVKTRLGWDHDSIHIVDIARRLQDVGIKALTIHGRTRQQMYKGEADWSWIAKVKEQQDIHIPIFGNGDIDSPEKALEYKNRYGVDGIMIGRAAIGYPWIFKEVKHFFATGEKLGPPTIRERVEVCKKHLAFSVEWKGPKEGIFEMRMHYTNYFRGIQNFKPYRQRLVEAGSYEDTFAILDEVAEQLSEYVF

SEQ ID NO: 95125 - DNA, 969 bp, Clostridium thermocellum ATCC 27405
  CDS (1)..(969)
atgaaaatagggaatgtcacccttgataataatatttttcttgctcccatggcgggcattaccgatattcccttcaggcttttatgtaaagaacagggatgcggattgacatatacggaaatggtaagcgcaaaaggaatttactataatgacgagaagaccaaaaagcttaccgcggtagatgccgccgagggaaaagttgcgctgcagatttttggttcagatccggtgattatggcaaaagtgacggaacaacttaatgattctgacgcatgcattatcgacataaacatgggctgcccgacaccgaaaataacaaaaaacggtgacggctgtgcgttaatgcgccagccggagctggtagggaaaatagttcgggaggtttcaaaggcttcagtcaagcctgtcacggtgaaaatccgcaagggatgggatgaaaacaggatcaatgcggtggaaatagccaggatagccgaggagaacggcgcagcggcaattacggttcacggaaggacaagggaacagttttacagtggcaaggcggattggagcatcataagagaggttaagcaatctgtcagcatacctgtaataggaaacggggatgtttttacgccggaagatgccaggagaatgtttgaagagacaaattgcgatgcaataatgattggcagaggtgctcagggaaatccgtggattttccgaaaaataataaagtatcttgaaggctccgaggattttgacctggatatatcccttgaaactaagataaacataatcaagagacatatgcaaatgcttgttgaacttaaaggtgagcaatgcggagtacgggaaatgagaaaacacatagcatggtatataaaaggtatgcgcaacgcttcacgtatcaaggaaaaagtatttaaagcgacaactcagcaagaagttttcagcctgcttgatgagcttttggaattcaacatgtaa

SEQ ID NO: 95126 - protein, 322 aa, Clostridium thermocellum ATCC 27405
MKIGNVTLDNNIFLAPMAGITDIPFRLLCKEQGCGLTYTEMVSAKGIYYNDEKTKKLTAVDAAEGKVALQIFGSDPVIMAKVTEQLNDSDACIIDINMGCPTPKITKNGDGCALMRQPELVGKIVREVSKASVKPVTVKIRKGWDENRINAVEIARIAEENGAAAITVHGRTREQFYSGKADWSIIREVKQSVSIPVIGNGDVFTPEDARRMFEETNCDAIMIGRGAQGNPWIFRKIIKYLEGSEDFDLDISLETKINIIKRHMQMLVELKGEQCGVREMRKHIAWYIKGMRNASRIKEKVFKATTQQEVFSLLDELLEFNM
